United States Patent 9,771,598 (ISOLATED POLYNUCLEOTIDES AND POLYPEPTIDES, CONSTRUCT AND PLANTS COMPRISING SAME AND METHODS OF USING SAME FOR INCREASING NITROGEN USE EFFICIENCY OF PLANTS) - sequence listing, part 2

SEQ ID NO: 1417 - DNA, 2424 bp, Triticum aestivum
ccttgaggtgtgaagaaggaagggtggagcgtgtgcgtgtgctttactttgcgttcaccactgacttcgcttggctggggtgctttcttccgcgtcactcccgtccgtcccgaccgactgacggactgctcctctctctctctcacctcgcctcgccagtccactaccaaccacgctgacaactccccttctcctgccgccaccaccttccaattccatctccaaatccccttccttccttccccatacattccctccccacaccgcaattgctgccatccttcgtcctcttcctcctcccgctgctgcgctggatcccaggtgcttgatgatcacaacatgtcatcaaactccacgctcacagaatcacttcatgagaaaacaatcgtctttgggcttaaactttgggttgtgattgggatcgctgttggagcatccctcctgggtattcttcttatccttgtgatatgccttaccatccaaacctggatcagacggtcacgaagggcattcaaggagcttcctatgacccagataccttctgcattcaaagacatcacagaagtcagggtggctgaccaattttcaccaaatgattatgttgtacatgatgggcttctactcgccattgagaatgggcctgttgaatcaacggataaagatgccgttcaatcggcgcaggaggacaattcgaggcatagagaagagaacaatctttcaggttccttagttcacactgatggctgtgatggaattcaatctgtttctgtctgtgaacagccttctgtacatgctactgccgattctgcgccgttggacggcctacctgagttttcttaccttggatggggccattggttcactctcagagatctagatgttgcaaccgaccattttgcaaaggacaatgtaattggtgagggcggatatggtgttgtgtatcgtggcagattatcaaatggcaccccagtcgctgtcaagaaaatccttaacaatttagggcaggctgagcgggaattcagagtggaagttgaggcaattggtaatgttcgccacaagaatttggtccggcttttgggatattgtgttgagggtacccagaggatgcttgtatacgagtttgttaacaacgggaatcttgaaagctggctccacggagaattgtcccagtacagctctctcacttggttagctcgcatgaaagttcttctggggactgcaaaggcccttgcatacttacatgaggcacttgaaccaaaggttgtgcatcgtgacatcaaggccagcaatatcttgatcgacgatgagtttaatgccaaaatatctgactttggtttggccaagatgcttggtgctggtaaaagtcatattgctactcgagttatgggtacctttggctatgttgcgcctgagtatgctaacagtgggcttttgaatgagaagagtgatgtctacagctttggggttcttttattggaagttattacaggtagagatccaattgactatgatcgccccccaagtgaggtaaacctagtcgattggcttaaattgatggtcgccaacagacggtctgacgaagtggtggatccacaccttgagagaagaccatcgacaaaggaactcaaacgtgcccttttgacagctctgcggtgtatcgatctgaatgctgagaagagaccaaggatggatcaggtcgtccggatgttggattctagcgaaaccatacctcaagaggaacgaagaccacggcagaaccggatctctgagaatactgaaaccgtgccattgaggggcaagaacagcatcgagaagagtgatgcccctgagcatgaggagaggccccctcggccaaagagtcgtccattttcgtccaaatgaggtaaagaatgaaggaaagcctaaacattttctggagatataaagatagagagagataccagcgcgcggaagaacatggtggagaattcttctgaatacgtaacagattgatcgatttttatttttcacccctcggagcggggatttttgcatttgttgatacatggaatggaatgtacagtggtgtgtatgacggctcaaggatgtacagaactagcttgtaaaacggtctgaaaggctctcagctggtgtggttgctggtatgagctacagacttctcttatctctactatcgtattgtacacaccaagagtataaatcaaagaaaagaaaaaatgtttcgtgggtggttgtcacctgtcagtgtgtgtttctggcgtctgaatctgaaattttcagcctagaatagagtgatgtatcaggtaaaggaagaattcttgaaaggtgtgactttgatcatttgtttgtgaccaataaggatagctatccttctggagttaaaatgattctgtgattgtttcagagataaaatgattactacct

SEQ ID NO: 1418 - DNA, 2131 bp, Triticum aestivum
ggggtgctttcttccgcgtcactcccgtccgccccgaccgactgacggactgctcctctctctctctcacctcgcctcgccagtccactaccaaccacgctgacaactccccttctcctgccgccaccaccttccaattccatctccaaatcccctcccttccttccccatacattccctccccacactgcaattgcttcgtcctcttcctcctcccgctgctgcgctggatcccaggtgcttgatgatcacaacatgtcatcaaactccacgctcacggaatcacttcatgagaaaacaatcgtctttgggcttaaactttgggttgtgattgggatcgctgttggagcatccctcctgggtattcttcttatccttgtgatatgccttaccatccagacctggatcagacggtcacgaagggcattcaaggagcttcccatgacccagataccttctgcattcaaagacatcacagaagtcagggtggctgaccaattttcacccaatgattatgttgtacatgatgggcttctactcgccattgagaatgggcctgttgaatcaacggataaagatgctgttcaatcggcgcaggaggacaattcgaggcatagagaagagaacaatctttcaggttctttagttcacactgatggctgtgatggaattcaatctgtttctgtctgtgaacagccttctgtacatgctactgccgattctgcgccgttggacggcctacctgagttttcttaccttggatggggccattggttcactctcagagatctagatgttgcaaccgaccattttgcaaaggacaatgtaattggtgagggcggatatggtgttgtgtatcgtggcagattatcaaatggcaccccagtcgctgtcaagaaaatccttaacaatttagggcaggctgagcgggaattcagagtggaagttgaggcaattggtaatgttcgccacaagaatttggtccggcttttgggatattgtgttgagggtacccagaggatgcttgtatacgagtttgttaacaacgggaatcttgaaagctggctccacggagaattgtcccagtacagctctctcacttggttagctcgcatgaaagttcttctggggactgcaaaggcccttgcatacttacatgaggcacttgaaccaaaggttgtgcatcgtgacatcaaggccagcaatatcttgatcgacgatgagtttaatgccaaaatatctgactttggtttggccaagatgcttggtgctggtaaaagtcatattgctactcgagttatgggtacctttggctatgttgcgcctgagtatgctaacagtgggcttttgaatgagaagagtgatgtctacagctttggggttcttttattggaagttattacaggtagagatccaattgactatgatcgccccccaagtgaggtaaacctagtcgattggcttaaattgatggtcgccaacagacggtctgacgaagtggtggatccacaccttgagagaagaccatcgacaaaggaactcaaacgtgcccttttgacagctctgcggtgtatcgatctgaatgctgagaagagaccaaggatggatcaggtcgtccggatgttggattctagcgaaaccatacctcaagaggaaagaagaccacgacagaaccggatctctgagaatactgaaaccgtgccattgaggggcaagaacagcatcgagaagagtgatgcccctgagcatgaggagaggccccctcggccaaagagtcgtccattttcgtccaaatgaggtaaagaagagaagtaaagccatcttctggagatgtaaagatagagagatacctgcgtgcggaacaacatggtggagaattcttctgaatacgtaacagattgatcgatttttatttttcacccctcggagcggggatttttgcatttgttgatacatggaatggaatgtacagtggtgtgtatgacggctcaaggatgtacagaactagcttgtaaaacggtctgaaaggctctcagctggtgtggttgctggtatgagctacagacttctcttatctctactatcgtattgtacacaccaagagtataaatcaaaaaaaaaaaaaaaaaaa

SEQ ID NO: 1419 - DNA, 2211 bp, Secale cereale
ccccttctcctgccgccaccaccttccaattccatctccaaatcccctcccttctttccttccttccccatacattccctccccacactgcaattgcttcgtcctcttcctcctcccgctgctgcgctggatcccaggtgcttgatgatcacaacatgtcatcaaactccacgctcacagaatcacttcatgagaaaacaatcgtctttgggcttaaactttgggttgtgattgggatagctgttggagcatccctcctgggtattcttcttatccttgttatatgccttaccatccaaagctgggtcagacgctcacggagggcattcaaggagcttcccatgacccagataccttctgcattcaaagacatcaccgaagtcagggtggctgaccaattttcacccaatgattatgttgtacatgacgggcttcttcttgccattgagaatgggcctgttgaatcaacggataaagatgcagttcaatcggcgcaggaggacaattcgaggcatagagaagagaacaatctttcaggttctttagttcacactgatgactgtgatggaattcaatctgtttctgtctgtgaacagccttctgtacatgctactgccgattctgcgcccttggacggcctacctgagttttcttaccttggttggggccattggttcactctcagagatctagatgttgcaaccgaccattttgcaaaggacaatgtaattggggagggtggatatggtgttgtgtaccgtggcagattatcaaatggcaccccagtcgctgtcaagaaaatccttaacaatttagggcaggcggagcgggaattcagagtggaagttgaggcaattggtaatgttcgccataagaatttggtccggcttttggggtattgtgttgagggtacccagaggatgcttgtatacgagtttgttaacaacgggaatcttgaaagttggctccacggagaattgtcccagtacagctctctcacttggttagctcgcatgaaagttcttctggggactgcaaaggcccttgcatacttacatgaggcgcttgaaccaaaggttgtgcatcgtgacatcaaggccagcaatatcttgatcgatgatgagtttaatgccaagatatctgactttggtttggccaagatgcttggtgctggtaaaagccatattgctactcgagttatgggtacctttggctatgttgcgcctgagtatgctaacagtgggcttttgaatgagaagagtgatgtctacagctttggggttcttttattggaagttattacaggtagagatccaattgactatgatcgccccccaagtgaggtaaacctagtcgattggcttaaattgatggtcgccaacagacggtctgaggaagtggtggatccacaccttgagagaagaccatcgacaaaggaactcaaacgtgcccttttgacagctctgaggtgtatcgatctgaatgctgagaagagaccaaggatggatcaggtcgtccggatgttggattccagcgaaaccatacctcaagaggaacgaagaccacgacagaaccggatctctgagaatactgaaaccgtgccattgaggggcaagaacagcatcgagaagagtgatgcccctgagcatgaggagaggccccctcggtcaaagagtcgcccattttcgtccaaatgagataaagaagagaaggaaagcctaaacatcttctggagatataaagatagagagagataccagcgcgcggaagaacatggtggagaattcttctgaatacgtaacagattgatcgatttttatttttcacccctaggagcggggatttttgcatttgttgatacatggaatggaatgtacagtggtgtgtatgacggctcaaggattgaaggatgtacagtactagcttgtaaaacggtctgaaaagctctcagctggtgtggttgctggtatgagctacagacttctcttatctccactaccatattgtacacaccaagagtataaagcaaagaaagagaaaaaaaaagtgtctcgtgggtggttgtcagtgtgtttctgctgtctgaatctgattttttaaatcctagaatagagagtgatgtatcaagtaaaggaagaattcttgtcatgtgtgactttgatcattgtttgtgaccagtaaggatggctatccttctgaagttaaaaaaaa

SEQ ID NO: 1420 - DNA, 1845 bp, Triticum aestivum
cacaacatgtcatcaaactccacgctcacagaatcacttcatgagaaaacaatcgtctttgggcttaaactttgggttgtgattgggatcgctgttggagcatccctcctgggtattcttcttatccttgtgatatgccttaccatccaaacctggatcagacggtcacgaagggcattcaaggagcttcccatgacccagataccttctgcattcaaagacatcacagaagtcagggtggctgaccaattttcacccaatgattatgttgtacatgatgggcttctactcgccattgagaatgggcctgttgaatcaacggataaagatgctgttcaatcggcgcaggaggacaattcgaggcatagagaagagaacaatctttcaggttctttagttcacactgatggctgtgatggaattcaatctgtttctgtctgtgaacagccttctgtacatgctactgccgattctgcgccgttggacggactacctgagttttcttaccttggatggggccattggttcactctcagagatctagatgttgcaaccgaccattttgcaaaggacaacgtaattggtgagggcggatatggtgttgtgtatcgtggcagattatcaaatggcaccccagtcgctgtcaagaaaatccttaacaatttagggcaggctgagcgggaattcagagtggaagttgaggcaattggtaatgttcgccacaagaatttggtccggcttttgggatattgtgttgagggtacccagaggatgcttgtatacgagtttgttaacaacgggaatcttgaaagctggctccacggagaattgtcccagtacagctctctcacttggttagctcgcatgaaagttcttctggggactgcaaaggcccttgcatatttacatgaggcacttgaaccaaaggttgtgcatcgtgacatcaaggccagcaatatcttgatcgacgatgagtttaatgccaaaatatctgactttggtttggccaagatgcttggtgctggtaaaagtcatattgctactcgagttatgggtacctttggctatgttgcgcccgagtatgctaacagtgggcttttgaatgagaagagtgatgtctacagctttggggttcttttattggaagttattacaggtagagatccaattgactatgatcgccccccaagtgaggtaaacctagtcgattggcttaaattgatggtcgccaacagacgttctgacgaagtggtggatccacaccttgagagaagaccgtcgacaaaggagctcaaacgtgcccttttgacagctctgcggtgtatcgacctgaatgcggagaagagaccaaggatggatcaggtcgtccggatgttggattccagcgaaaccatacctcaagaggaaagaagaccacgacagaaccggatatctgagaatactgaaaccgtgccattgaggggcaagaacagcatcgagaagagtgatgcccctgagcatgaggagaggccccctcggtcaaagactcgtccattttcgtccaaatgaggtaaagaagagaagtaaagccatcttctggagatgtaaagatagagagatacctgcgtgcggaacaacatggtggagaattcttctgaatacgtaacagattgatcgatttttatttttcacccctcggagcggggatttttgcatttgttgatacatggaatggaatgtacagtggtgtgtatgacggctcaaggatgtacagtactagtagcttgtaaaacggtctggaaggctctcagctggtgtggttgctggtatgagctacagacttctcttatctctactatcatattg

SEQ ID NO: 1421 - DNA, 2318 bp, Brachypodium distachyon
ggagaaggagcgtgcgctttactttgctttactctgcgtttaccactcacttcacttggcctttgctgctttgctttgcttgcttcctgagtcctgaccgactcgatcgccattcgccagtcgccactaccaaccacgctgacaactccccttctcctgccgccaccaccttccaattccatctccaaatccccttctcccccctccccatttcgattgctctcctgcttgcttcttcttcctctgctgctggatcccaggtacttgatgatcacaagatgtcatcaaactccacgctaactgaatcgcttcatgagaaaacaatcgtctttggccttaaactttgggttgtgattgggatagctgttggagcatccctcctgggtattcttcttattcttgttatatgccttactatccaaagctgggttaagcggtcacgtagggcattcaaggagcttccgatgacccagataccttctgcttgcaaagatatcacggaagttagggtggctgatcaattttcacccaatgactttgttgtacatgatgggcttctacttgccattgagaatgggcctgttgaatccgctgacaaagatgcagttcagttgtctgaggaggacaatttgagacatagagaagataacaacaatcttttgggtggtactttctgtcatgcagatggttgtgatggaattcaatctgtctctgtctgtgaacagccttcagcacatgctgctgctgattctgcgccattggcgggcttacctgagttttcttaccttggttggggccattggtttactctcagagatctagatgttgcaaccaaccatttttcgaaggataacgtaattggcgagggtggatatggcgttgtgtaccgtggcagattatccaatggcaccccggttgctgtcaagaagatccttaacaacttagggcaggccgagagggaattcagagtggaagtcgaggcgataggtaatgtgcgccacaagaatctggtacggcttttggggtattgtgttgagggtacccagaggatgcttgtgtacgagtttgttaacaatggtaatcttgaaagttggcttcatggagaattgtcccagtacagctctctaacttggttagcgcgcatgaaagttcttctggggactgcaaaggcccttgcctacttacatgaggcacttgagccaaaggttgtgcatcgtgacattaaggccagtaatattttgattgatgatgagtttaatgccaaaatatcagactttggtttggctaagatgctcggtgctggtaaaagtcatattgctactcgagttatgggtacctttggctatgtcgcacctgagtatgctaacagtgggcttttgaatgaaaagagtgatgtctacagctttggagttcttttactggaggttattactggtagggatccaattgactatgatcgccccccgagtgaggtaaacctagtagattggcttaaagtgatggttgccaacagacggtccgaagaagttgttgatccacaccttgagagaagaccgtcgacaaaggagctcaaacgtgcccttttgacagctctgcggtgtatcgatctgaatgctgagaagagaccaaggatggatcaggtggtccggatgttggattctagcgaaaccatacctcaagaggaacgaagacagcgacctaaccggatgcctgacaacacagaaaccatgccattgaggggcaagaacagcaccgacaatagcgatgcccctgagcgtgaggagaggccccctcggccaaagagtcgtacgttttcgaccaagtgaggtaaacaagagaaggaaagctcaaacatctggagataaaagatagagagatacatacctttgcgagaaaggaaaaacacactgtggagaaaattcgtctgaatacgtaacggattgattgctttcttcttcttctttacatcccttagagcagggatttttcttgcatttgttggtacatggaaattgaatggaatggaatggaatgtacagcggtgtggtatgaaggatgtacagtactgctagcttgtaaaaaaaaggtctggaaagctctcagctggtataagctacagaccttttcccttgttatctctgctatattcagttgtacacacacccaaagagtattaaagtcttgcaaaaaaaagagagtattaaagtaaagagaaaatttgtcttgtgggtggttgccagtcagttggtgttctgaactctcaattgtcctgtcttgagaagcttcatcaatagtgtgctagctgtttcaagaaaagg

SEQ ID NO: 1422 - DNA, 2894 bp, Oryza sativa
agacataaatacaaggcatatatgtaaagccacatattttttattgggctctaatgcaaactagaaagaaaaaattaatactattgtccttataaattaggaatatagtattaagttttcctttattagtttgcattagagcccaataaaaacaaagtggcggagttcttggtcagatcaagcggtcacctttgctccgccgctatcattttactatcggtagttgttaataaattagtcgatcactcgaaaacacgttattaatccgtttgggctcgctccttataaatctcacagcgcgagtacgtcatctcaaaataataaaaagaaaaaaaagaaaaagaaagaaaacacacacagcgcgactgcgcgaggtccagcagggaagccggccgcgtcggcagagactccagccaacgggcgccgccgcagcctccgccagtcggcagtgggagcaggcagaagctgcagcggggggcctcgagcaggtggcggcctcaagcggaggcgagcaatctcagggaaaccaagctcgccgccgtcgtacccattcttccgtcgcagatttcgctgtgactggttccttgtgattgaatccataggaacggaacccaaatcttggaattgtttttgcagtgcaagtctaatccttgggaggaaaaaaaaaagaaagcgtaataagtcctgcaccaagcaagcaatctccaaagtgcaagctttctcttcttcctgcgtctggatctcgctcaggtttctcctctgcctgccactccccatggctctggattcaggtcgctcttcagcattcactaccgtattcacttcttgaaggccaatttctggttcctcaccaaaggtacttgatgatccgaagatgtcatcaaactccactctgacagattctcttcatgagagaacaattgtttttggcctgaaactttgggttgtaattgggatatctgttggagcatccctacttggtgttcttctcatacttattgtatgcctcaccttacaaacttggatcaaacggtcacgtaggacattcaaggaaattccaattacccaaataccttctgcatccaaagatatcaaggaagtgagggcagtggacgaatttttgcccaatgatttcgttgtacatgatgggcttctactcgccattcagaatgaacctgttgaaccagtggataaagatgtgaatcagtttgctcaagaggacaagacgatacaaggagaagaaaacagtcctgttcctcttcattacgtggacaactatgatgtaattcaatctgtttccacatgtgaacagtcttcctcgcatgctcccgtcgactctgttctgttgccaggcttacctgagttctcttaccttggctggggtcattggttcactctcagggatctggaacttgcaaccaactgtttttcaaaggataatgtaattggtgagggtggatatggtgttgtctaccgtggcagattatcaaatggcaccccagtggctgtcaaaaaaatccttaacaatctaggacaagctgagagagaattcagagtggaagttgaagcaattggtcatgtccgacacaagaatttggttcgccttttggggtactgtgttgaaggcactcaaaggatgcttgtgtatgagtatgtcaacaatgggaatctcgaaagttggttacatggagagttatcccaatatagttctctcacttggctagcgcgcatgaaaattcttttgggtactgcaaaggcccttgcttacttacatgaggcaattgaaccaaaagttgtgcatcgtgatatcaaggccagtaatatattgattgatgatgagtttaacgccaaaatatctgactttggtttggccaagatgctaggtgctggtaaaagtcatattgctactcgagttatgggtacttttggctatgtcgcgcctgagtatgctaacagtggacttttgaatgaaaagagtgatgtctacagttttggggtggttctgctggaagctattacaggtagagatcccattgactatgatcgccctacagatgaggtaaacctagttgactggcttaaaatgatggttgcccacagacgatctgaagaagttgttgatccaaacctggagagaagaccatcgacaaaggagctcaaacgtgcccttttgacagctctgaggtgcatcgatttgaatgctgagaagagaccaaggatggaccaggtggtccggatgttggactctaatgaacccattcctcaagaggaaagaagacaacgacagaaccacatctctaataattcagagaccgagccattaagaggcaagagcagcagcggcaagagtgatgcccctgaaaatgagatgaggccacctcggtataagaatcgatcatttccccccaagtgaaaagtgaaaagcatactagagtggaagttatggagttacctgcgatgctctcaatacataatgaattggtcaattgttttgtttctcttttattatttctcttgacttgatcaatttttttgttccctgggaggctgggggagcggccattgcagttacacatatttgtatttcttgaaacatgtacagtgctggtgtgtgatacatgtacagtagtttgtgtgtgatagatagttgaaggatgcacatgagagcataaaagctattatttagaagctagtggctggtatggttgctggtgtgagaaagtgcatgaagaaaccaatgaaataactttttcatattttctgtatactctaagagtataaagaggcaaatgaaagaaaaattgactttcagtttgtgttgtgtgcgacaaatgaacgaactgaatctctcagtggtcgagttcagtgctgtatttatcagctcttcaggcagg

SEQ ID NO: 1423 - DNA, 2708 bp, Oryza sativa
taattgttgatatctataaaattagttgatcacggaaaacattattaatcgtctaggcttgatagggccgctcgctccttataaatcaagcgaaactaatctcacagcgcgagtatgtcatctcaaaataataaaaaagaaaaaaaaagaggaaacacagacacagacagagcgactgcgcgagctccagcagggaagccgtcggcagagactccagcaaacggacggcgccgcagcctccgccaggcggcagtgggagcaggcagcagctgcaaggtggcggcctcaagcggaggcgagcagtctcagggaaaccaagctcgccgccgtcgtccccattcttccgtcgcagatttcgctgtgactggttccttgtgattgaatccataggaaccgaacccaaatcttggaattgtttttgcagtgcaagtctaatcctcgggaggaaaaaaaaagaaagcgtaataagtcctgcaccaagcaagcaatctccaaagtgcaagctttctcttcttcctgcgtctggatctcgctcaggtttcccctctgcctgccactccccatggctctggattcaggtcgctcttcagcattcactaccgtattcacttcttgaaggccaatttctggttcctcaccattgtatccaataaaggtacttgatgatccgaagatgtcgtcaaactccactctaacagactctcttcatgagagaacaattgtttttggcctgaaactttgggttgtaattgggatatctgttggagcatccctacttggtgttcttctcatccttattgtatgcctcaccatacaaacttggatcaaacggtcacgtaggacattcaaggaaattccaattacccaaataccttctgcatccaaagatatcaaggaagtgagggcagtggaggaatttttgcccaatgatttcgttgtacatgatggacttctactcgccattcagaatgaacctgttgaaccagtggataaagatgtgaatcagtttgctcaagaggacaagacgatacaaggagaagataacagttcttctgttcctcttcattatgtggacaactatgatggaattcaatctgtttccacatgtgaacagtcttcctcgcatgctcccgccgactctgttcccttgccaggcttacctgagttctcttaccttggctggggtcattggttcactctcagggatctggaacttgcaaccaactgtttttcaaaggataatgtaattggtgagggtgggtatggtgttgtctaccgtggcagattatcaaatggcaccccagtggctgtcaaaaaaatccttaacaatctaggacaagctgagagagaattcagagtggaagttgaagcaattggtcatgtccgacacaagaatttggttcgccttttggggtactgtgttgaaggcactcaaaggatgcttgtgtatgagtatgtcaacaatgggaatcttgaaagttggttacatggagagttatcccaatatagttctctcacttggctagcgcgcatgaaaattcttttgggtactgcaaaggcccttgcttacttacatgaggcaattgaaccaaaagttgtgcatcgtgatatcaaggccagtaatatattgattgatgatgagtttaacgccaaaatatctgactttggtttggccaagatgctaggtgctggtaaaagtcatattgctactcgagttatgggtacttttggctatgttgcgcccgagtatgctaacagtggacttttgaatgaaaagagtgatgtctacagttttggggtggttctgctggaagctattacaggtagagatcccattgactatgatcgccctccagatgaggtaaacctagttgactggcttaaaatgatggttgccaacagacgatcagaagaagttgttgatccaaacctggagagaagaccatcgacaaaggagctcaaacgtgcccttttgacagctctgaggtgcatcgatttgaattctgagaagagaccaaggatggaccaggtggtccggatgttggactctaatgaacccattcctcaagaggaaagaagacaacgacagaaccacatctctaataattcagaaaccgagccattaagaggcaagagcagcagcggcaagagtgatgcccctgaaaatgagatgaggccacctcggtataagaatcgatcatttccccccaagtgaaaagtgaaaagcatactagagtggaagttatggagttacctgcgatgctctcaatacataatgaattggtcaattgttttgtttctcttttattatttctcttcacctgatcaatttttttgttccctgggaggctgggggagcggccattgctgttacacatatttgtatatttcttgaaacatgtacagtgctggtgtgtgatacatgtacagtagtttgtgtgtgatagatagttgaaggatgcacatgagagcataaaagctattatttagaagctagtggctggtatggttgctggtgtgaggaagtgcatgaagaaaccaatgaaataactttttcatattttctgtatactctaagagtataaagaggcaaatgaaagaaaaattgactttcagtttgtgttgtgtgcgacaaatgaatgaactgaatctctcagtggtcgagttcagtgctgtatttatcagctcttcagacaggagatgatcca

SEQ ID NO: 1424 - DNA, 1031 bp, Pennisetum glaucum
ggaggaagaggaagaggaagaggaagaggaagaggaagaggaaggaggagctgccggagctggtcttcgctcgggtcggccacggccacggcggcggcggcggcggcatatggcggggcggatggtgcggagctgcgtgcagacggcgctcaaggcggcgaactccgtcgtggggctcgccggcatggccgtcatcctctacgcgctctggatgctccgcgcgtggtacagggaggtcgcccaactccaccaacgcctccccgtcccctggttcatctacacatttcttggcatggggatctttctgtgccttctgacttgctctgggcatattgctgcagaaactgcaaatggccactgcctctcttgttacatgatcatcgtatttgtgcttattatactggaaggtgcgatcactgtggatgtatttttgaataacaactgggaagaggatttcccccctgatccatcaggcaagtttgatgaattcaaggtatttgtgatatcaaattctgagatatgtgaatgggtaggcctctcagtggtggctgctcaggtgttatcaatcattcttgggatggtactcaggacacttgggcccgaccgagagactgactatgacagtgatgatgacattactgtgcctgcaaggctgcctctcctaagaaaccagtcccagcatggtccaacagactatgccgaacctaacacatctcgtgggagtgattcatggaaactgcggattttagacaaggtcaacaactaagattttatcggtgtcacatgaggaacccttccggaaagttttgctccagagggtttgggaaggatgataagagtataccttttttcttcttatggagagatgagtctcatggtggggtagaagcagcggtagaatagttaggaatggctacttttgaatgcctttcaacatgcacagatatttgagtagcatgtgactgaccagcaatgttggagaagaatgccgtattgaaatgtttcggaaaaagttgaaggcatgactggtg

SEQ ID NO: 1425 - DNA, 1399 bp, Panicum virgatum
tgtgcaagcatttacacccgtacccgtcgccgtccggagcgatcgcggccgcgttttcttttcctcccccgcgcccgcggcgccgctcgtcccccgctctccgtttcgtttccccagaaccagaaccccacgccacgtcaaaccccacggccgctgaagaagctcgacccgcacacacggtctccgcattctcccacacgacacgagttgctgcctgcctgcgaccaccgcttgcttcggcgctcgacaaaaagtaaaaccataccgagccgccgacctcgccgaggccccagggagcgaagggctaggaggaagaagggcggccggagctggtcttggctcttcttgctcgggtttgtcacggcggcggcatggcggggcggatagtgcggagctgcgtgcagacggcgctcaaggcggtgaactccgtcgtggggctcgccggcatggccgtcatcctctacgcgctctggatgctccgcgcctggtacagggaggtcgctgacctcgaccaacgcttccccgtcccctggttcatctacacatttcttggccttgggatctttctgtgcctgctgacttgctctgggcatattgctgcggaaactgcaaatggtcactgcctctcttgttacatgatcattgtatttgtgcttattatactggaaggtgcaattactgtggatgtatttctgaataccaactgggaagaggatttcccccctgacccatcaggcaagtttgatgaattcaaggacttcgtgaggtcaaattttgagatatgcgaatgggtaggcctctcagtggtagctgctcaggtgttatcaatcattcttgggatggtacttaggacccttgggcctgaccgagaggctgactatgacagtgatgatgacaccaccgtgcctgcaaggctgcctctactaagaaaccagtcccaacatggtccagactatgctgaacctaacacatctcgtaggagtgattcatggaaactgcggattttagacaaggtcaacaactaagattttactgatctcatatgacgaacccttaggacagaattttgatccaagggtattggaaggatgataagattataccttttttcttctggagagatgatccttatgatggagtagcagcagcagtggtagaatagttttgaatggctacttttaaatgcctttcaacttgcacagatatttgaggagcatgtgactgatccatataaacccggggaagaatgttgcactgaaatatttcagaaagagatgagggcatgactggtgccttcactgaccaaacacagaaatatttgatttgtttttcattttccatcagctggttcatccacttatttctatctgattgtctgttcttggtatactagtttgca

SEQ ID NO: 1426 - DNA, 1250 bp, Panicum virgatum
gggtcgacccacgcgtccgcggacgcgtgggcgtttccccagaaccagaaccccacggccgctgaagaagctcgacccgcacacacggtctccgcattctcccacacgacacgagttgctgcctgcctgcgaccaccgcttgcttcggcgctcgacaaaaagtaaaaccataccgagccgccgacctcgccgaggccccagggagcgaagggctaggaggaagaagggcggccggagctggtcttggctcttcttgctcgggtttgtcacggcggcggcatggcggggcggatagtgcggagctgcgtgcagacggcgctcaaggcggtgaactccgtcgtggggctcgccggcatggccgtcatcctctacgcgctctggatgctccgcgcctggtacagggaggtcgctgacctcgaccaacgcttccccgtcccctggttcatctacacatttcttggccttgggatctttctgtgcctgctgacttgctctgggcatattgctgcggaaactgcaaatggtcactgcctctcttgttacatgatcattgtatttgtgcttattatactggaaggtgcaattactgtggatgtatttctgaataccaactgggaagaggatttcccccctgacccatcaggcaagtttgatgaattcaaggacttcgtgaggtcaaattttgagatatgcgaatgggtaggcctctcagtggtagctgctcaggtgttatcaatcattcttgggatggtactcaggacccttgggcctgaccgagaggctgactatgacagcgatgatgacaccaccgtgcctgcaaggctgcctctactaagaaaccagtcccagcatggtccagactatgctgaacctaacacatctcgtaggagtgattcatggaaactgcggattttagacaaggtcaacaactaagattttactgatctcatatgacgaacccttaggacagaattttgatccaagggtttggaaggatgataagattatacctttttttcttctggagagatgatcctcatgatggagtagcagcagcagcagtggtagcatagttttgaatggctgcttttgaatgcctttcaacatgcgcagatatttgagtagcatgtgactgacccatataaacccggggaagactgttgcactgaaatgtttcagaaagagatgagggcatgactggtgccttcactgaccgaacacagaaatatttgatttgtttttcatttttc

SEQ ID NO: 1427 - DNA, 1990 bp, Panicum virgatum
ccgggcaggcacaccactcttcccccgcgatcgcggccgctttccttttcctcccccgcggcgccgcccgtccaccgctctccgtttcgtttccccaggaccccacgccacgccaccacgtcaaacccccggccgctgaagaagcacgacccacacacccgcggtctccgctttcgcccgcacgagttgctgctgcctgcgaccaccgcttgcttcgtcgctcgacagaaagtaaaaccataccccagggagggaaggactaggaggaagaagagcggccggagctggtcttggctcttgcccgggtttgtcacggcggcggcggcggcggcggcggcatggcggggcggatggtgcggagctgcgtgcagacggcgctcaaggcggcgaactccgtcgtggggctcgccggcatggccgtcatcctctacgcgctctggatgctccgcgcgtggtacagggaggtcgccgacctcgaccaacgcttccccgtcccctggttcatctacacatttcttggcctggggatctttatgtgcctgctgacttgctctgggcatattgctgctgaaactgcaaatggtcactgcctctcttgttacatgatcattgtatttgtgcttattatactggaaggtgcaattaccatggatgtatttctgaataccaactgggaagaggatttcccccctgacccatcaggcaagtttgatgaattcaaggactttgtgagatcaaattttgagatatgcgaatgtgtaggcctctcagtggtggctgctcaggtgttatcaatcattcttgggatggtgctcaggacccttgggcctgaccgagaggctgactatgacagcgatgatgacaccaccgtgcctgcaaggctgcctctactaagaaaccagtcccagcatggtccagactatgctgaacctaacacatctcgtaggagtgattcatggaaactgcggattttagataaggtcaacaactaagattttactgatctcatatgacgaacccttaggacagaattttgatccaagggtttggaaggatgataagattatacctttttttttcttctggagagatgatcctcatgatggagtagcagcagcagcagtggtagcatagttttgaatggctgcttttgaatgcctttcaacatgcgcagatatttgagtagcatgtgactgacccatataaacccggggaagactgttgcactgaaatgtttcagaaagagatgagggcatgactggtgccttcactgaccgaacacagaaatatttgatttgtttttcattttccatcagctggttcatccacttatgtctatctgattgtctgttgttggtattccagtttgcacctgtcgatgccaaaagatgaaatacaaggtctacctattttgcacataatacaggctgcatataccaacatttcttaggggaaaaatgaaagagttttttcccttgaaaaatcaaaatgcaagagaaccagcatccagttgtttggttatgattactggcatgtacggtgcgcctaatttatagccaccggttgctatcgcctgccgcgatgcttggtccataaatattccgggagctccacacggtagagtgtgttggcctccatgctatttattgacctgttctctagtgtcgtgtacggagtattccttcgtggagacgctccatgtagccagcctcgctacgctacatgatgtctcaaccgacaccgttgagtccttgctacagcctttgctgtgaatttatttcaggatcattccaagcaaaagggttaaaacacaaatatatccagttgaaactacagagcatttcaagcttaaaatcgaacccaatacatgcaccaaatgtatatcatctggagcttccatactttggaacacaacgctttttccctaaagatttttcattgaccataaatatgtacaacacattatatttacaagaacctgaacagactc

SEQ ID NO: 1428 - DNA, 1704 bp, Sorghum bicolor
gtcgactacaccagaccaagcgtagcaacgtcgtttattacacccgtccccgtcggccgtcggaaactccccacccccgcattttccccgcgttttgtcaaggtcaacgtcacgcctcgcccgccatcccttcccacccccactctctctccccctcctctgcagtctgccgccgcggggctccactcatccaccgcttctacaagatcccaccaccccacgtcaaaccaaacccggccgcggagaaagcagcttctagctacccgcccggtctccgcttctcccgcacgcgcaggctgctgctgagtgctgcctccatcctgccaccgccgcttgcctgcttcgttcgcggaacaaaaaaaaaagtgagccggaccgaccgacgacccagccgagcccacgagagggaggcgctgcttgggctgtcggagccgcagcaggtcttgctccggccagccacggcggcatcggcatcggcatggcggggcggatggtgcggagctgcgtgcagacggcgctcaaggcggccaactccgtcgtggggcttgccggcatggccgtcatcctctacgcgctctggatgctccgcgcctggtacagggaggtcgccgaccaccacctccaccaacgcctcccggtcccctggttcatctacgcttttcttggcctggggatctttttgtgcctgttgacttgctctgggcatattgccgctgaaactgcaaatggtcactgcctctcttgttacatgatcatcgtatttgtgcttattatactggaaggcacaatcactatggatgtatgtctgaatagcaactgggaagaggatttcccccctgatccatcaggcaagtttgaggatttcaaggactttgtgaaatcaaattttgagatatgtgaatgggtaggcctctcagtggtggctgctcaggtgttatcaattattctggggatggtactcaggacccttgggcctgaacgtgagactgactatgacagtgatgatgacacaattgtgcctgcaaggctgcctctcctgagaaatcaggcccaacatggtttagactatgctgaacctaatacatctcgtaggagtgattcatggaaattgcggattttagacaaggtcaacaactaagatcttataatgatctcatacaacagaccatttgggaaagactttcgctcctagggtttcagaaggatgataagattataccctttttttcttcttgtggagagatgattagcagaagcgatagagtagttcttagttctgtctacttttgaatgccattcaacatgcacagatatttgagtagcatgtgactgacccttataaacccacaatgtatgggaaggatgttgtaccataatgtttcataaagagatgagggcattattggtgccttccctgaccaaagtcagaaatgtttaatctttcccacttgtccatcagctgcatcatccatgtatttttatggggcccctatttttatctgcttgtctgctgtcagatttcctacttgcatcacctgtcaatgccgaaggatgaaaactgaaataggagtatttgaaatatgacctgtgaccgtgtgagtacccttgttgagttaaaaaaaaatgcaaaatggacaccgtaccatttttatttgtatttgacaaatattgtccaatcgtggactaactaggcttaaaaaattt

SEQ ID NO: 1429 - DNA, 1370 bp, Zea mays
cacgatcagcgcaaacgaaacacgacaacccatgattgaggcgtgcgcgggacgtgacggcgaggcggcgactagtattaacctaccacaacaccaagtccccccccacctccgcattgtctccgccgcgatttgtcaacgtgacgtcacgccgcgcctccgagagggagccagtgtggtggaggacacgaggctgccggagccgcaggtgttgctccggtcagcatcggcatggcggggcggatggtgcggagctgcgtgcagacggcgctcaaggcggccaactccgtcgtggggctcgccggcatggccgtcatcctctacgcgctctggatgctccgcgcttggtacagggaggtcgccgacctccaacaacacctcccggtcccctggtgcatctacacatttcttggactggggatctttctgtgcctactgacttgctctgggcatattgctgccgaaactgcaaacggtcactgcctctcttgttacatgaccatcgtatttgtgcttattatgctggaaggcgcaatcactatggatgtatttttgaatagcaactgggaagaggatttccccgctgacccatcaggcaagtttgaggatttcaagcacttcgtgagatcaaatttcgagatatgtgaatgggtaggcctctcagtggtggctgctcaggtgttatcgatcattcttgggatggtactcaggacccttgggcctgaccgtgagaccgactatgacagtgatgatgacgtgaccgtgcctgcaaggctgcctcttttgataaatcagtcccagcatggttcatactatgctgaacctaacacgtctggaaggagtgattcatggaaactgcggattttagacaaggtcaacaactaagatcttaaggatctcatacaacagaccctccagtaaagactctctctccaaggggttcgggagaatgataagagtatacctttttcttcatctcatggagagatgattagcagcagcagtagaatagtttacacacatttgaatgcaatccaacatgcacaagtatttgagtagcatgtgacttgacccccccccccccctcctacaaaacctacacaatgtaggggaaggatgtttattgtaccaaaatgtttcagaaaagagataaagggcatgaacggtggtggtgccttcactgaccaaagacagaaatatttgttctcccccccccccctgcctatcagctcagctgcatcatgcatgtgtttttgatctgcttgtcgggccggcaggtttcctatttgcaccaactgtcaatgccaaagggtgaaaaaaaatgaaatgaaaatgtcttgaaatctgacgtgactgtgtgagtacctatt

SEQ ID NO: 1430 - DNA, 1644 bp, Panicum virgatum
gcttggccctcctccttccgccctcccatcacaaccgcctccacaacaacaagggatcggacagcaaggggtggatcgatcgatcgaccgagccccgcgccaccaggccaccaccaacataaccggctgctggtactggtagagaccagtaggaagggcggccaggccagcatgaagggcggcgacgtgagcagcattagcccgctggtctccttcgtcctcggcgccgccatggccaccgtctgcgtcctcttcttcatgtccgccagccccacacgccgcctcgccgacatctccgccttctcctccggaaacgccaccagcagcgacctccgcctcgcctcctccgactccgacaacggggtggtcgccgacggcgacgccgaggtcaccgccacccccgcgccggcgccggcgccggtccaggcggagtcgccgtggggcgaccttgaggaggtgctccggcgcgcggcgaccaaggaccggacggtgatcatgacgcagatcaacgcggcgtggacgcgcccgggctccctgctggacctcttcttcgagagcttccgcagcggggagggcggcgtggcgcggctgctggagcacctggtgatcgtgaccatggacccggccgcgtaccagggctgccaggccgtgcaccgccactgctacttcctccgcacctccaacggcgtcgactaccgctccgagaagatgttcatgagcaaggactacctcgagatgatgtggggccgcaaccgcttccagcagaccgtcctcgagctaggatacaacttcctattcacggacgttgacgtgatgtggttccgtgaccctttccgccacatctccatggcggcggacatcgccatttccagcgacgtgtacatgggcgacccctacagcctgcgcaacttccccaacggcggcttcctcttcgtgcggtcgtcggccaagaccatcgacttctaccgcgcgtggcagcaggggcggtggcgcttcttcgggaagcacgagcaggacgtgttcaacctcatcaagcacgacatggccgccaagctcgacctcgccatccagttcctcgacaccacctacatcagcggcttctgccagctcagcaaggacctcaacaagatctgcacgctccacgccaactgctgcgtcggcctcggcgccaagctccacgacctccggggggtcctcgacgtctggaggaactacaccgccggcacgccccaggaccgacgcgccggaaagttccagtggaagctcccgggaatctgcatccactgatcgatcgtcctttgctagctagcagagctatactatatagctaggtccgatggtgatccatcgtattcgttttcgatggtcgagatcggccgcgccggctgcctgccaggctgcttgttgcattattgtccattctttctctgctgcttctttcttcaagtttgaggagattattcaagggagctgggtaggtttcattcttttgatttctgatgaaagcctagaggtagaaccgggagacgtacggttaagttatactggtgcaccctccaccttaattattatgtatgtatgtatgtacacagcacaggctaattaattatatacaaatattaattattatgtacagtagatttc

SEQ ID NO: 1431 - DNA, 2338 bp, Zea mays
ctgttgactgcctaccagctcctgctctcgatcgagaagagcaagtagattgtttggctgacgcctgcttgcctaacaacaaggttggccataaccatcatcactatgagccaagccaaccccccgccggccgcgcggaaacccctcgcatctcgccgccgctacctaacctaccccgccggcaccgggttccgtttcgtttgactaccacttggcctggccccccccgatccctcgcgtgttaaaagggaactcggattgcctcgttcctccgcatgccccccgtaccttgcggattgttgcgcccttccgttcggttccttcctccgcgcccgccccacgcctcgcggttcgccacgcccgccccacgcctccaagttgtagccgatgaagggcggcgacatgagcagcgtcagcccgctggtgtccttcgtgctgggcgccgccatggccaccgtctgcgtcctcttcttcatgtccgccgcgcccgcgcgccgcctcgtcgacatctctgccttcacctccaactccaactccaccgccgacctcctcctcgactcctccgactcgccggcagcggcggaccttgccgaggcagcgccgccggctcccgcgcccgtccaggccccgccgtctccgtggggcgacctggaggaggtgctggcgcgcgcggcgaccaaggaccgcacggtgatcatgacgcagatcaacgcggcgtggacgcgcccgggctcgctgctggacctcttcttcgagagcttccgcacgggggaaggcggcgtggcgcgcctcctggaccacctggtcatcgtcaccatggacccggccgcctacgagggctgcagggccgtgcacagccactgctacttcctccgcacgggcaacggcgtcgactaccgatcagagaaggtgttcatgagcaaggactacctggagatgatgtggggacgcaaccgcttccagcagacggtgctggagctgggatacaacttcctattcacggacgttgacgtgatgtggttccgcgacccgttccgccacatctccatggcggccgacatcgccatctccagcgacgtgtacatgggcgacccctacagcctgcgcaacttccccaacggcggcttcctcttcgtgcgggcgtcggacaagaccgtcgccttctaccgggcgtggcagcaggggcggtggcgcttcctggggaagcacgagcaggacgtgttcaacctcatcaagcacgaggaggcgcccaggctggacctcgccatccagttcctcgacacagcctacatcagcggcttctgccagctcagcaaggacctcaacaggatctgcacgctccacgccaactgctgcgtcggcctcggcgccaagctccacgacctccgcggggtcctcgacgtctggaggaactacaccgccggcacacccgaggagcgacgcgcgggaaagttccagtggaagctaccgggcatctgcatccactgatatccattctttctcagccggcctctcgcctccttggtagtaaaagatccattcttttgattccatcatcaacaaattaaaggttatatatatactagtaacagatagttagaatttcatagctataagtacgggcagggcttcttccacgtgagaacagtgatcgatatggtccagaaatagacctaccatacactattttttatatataaatatcaatttaaggactagaaacacatttttgaagttcagggacagccgatgcatttaaccctaggctaggctacatgaaggatcgcaagcgcggccgcacgatggactgagcaccgtccacgaatattgttgtgcccgtcatgtaccgggactcgtcgccgacaaggtacagcaccgtcgacgccaggtccttctccggatccagccatctccgcaggggcatcacctccgccgttgccttctccgccttctccttgcccacggacacggggaacttgtcttgcagatgcaggccgcggcaggcggcgttaacccttatctttagacaagggtgggtacttacacggaccaactggtggatggctcccaagcttgtgccatatgctgcagcgcctggatacaatcctctctcagcaccaataatctgagtcaagaacacaatagatccaccagattttgtatcctggaaccgctttgcgatcgccttcattagaaaccaaggtgttatcacatttactttgatggtcttcatgtactcgtcttcacttatactgaggcaatcttgcacctcccctggccacacagtaaaggaacatttatttatttgatacaaggtgcaaattcagttcatccaacg

SEQ ID NO: 1432 - DNA, 2288 bp, Sorghum bicolor
cggcaccgggacgcgacatttctttccgttccgtttttttcgtttgactacccgttctccacttggcttggggccaccttccagtccaagtcccttgcgtgttaaaaagagcctcggcatcccatcccatcccatcccgtccgtcccgtcccttgcgcgttccgttccttgttcctccgcgccccgccccacggcgacaacgggcagcagcaacaaacccagaagaacctgaactcaaaccaccaagtacatacagtagtaggcaaagggatcggcatcccgccgtcaactcgacgagcgaggatatgaagggcggcgacatgagcagcgtcagcccgctggtgtccttcgtgctgggcgccgccatggccaccgtctgcgtcctcttcttcatgtccgccacgcccgcgcgccgcctcgtcgacatctccgccttcacctccgccgcccccgacaacctgacggggatcgcctcctccgtctccgactccgactccgacgccgcggtcgccgactcggccgccgcccttgcctccaccgccaccctggcgccggctcccgccccgtcgccgtggggcgacctggaggaggtgctggcgcgcgcggcgaccaaggaccggacggtgatcatgacgcagatcaacgcggcgtggacgcgcccgggctccctgctcgacctcttcttcgagagcttccgcaccggggagggcggcgtggcgcgcctcctggaccacctcgtcatcgtcaccatggaccccgccgcctacgagggctgcaaggccgtccaccgccactgctacttcctccgcacctccaatggcgtcgactaccgatccgagaagatgttcatgagcaaggactacctcgagatgatgtggggacgcaaccgcttccagcagacggtgctcgagctcggctacaacttcctcttcacggacgtggacgtgatgtggttccgtgacccgttccgtcacatctcgatggcggcggacatcgccatctccagcgacgtgtacatcggcgacccctacagcctgcgcaacttccccaacggcggcttcctcttcgtgcggtcgtcggccaagaccatcgacttctaccgggcgtggcagcaggggcggtggcgcttcttggggaagcacgagcaggacgtgttcaacctcatcaagcacgagatggcgcccaagctggacctcgccatccagttcctcgacaccgcctacatcagcggcttctgccagctcagcaaggacctcaacaagatctgcaccctccacgccaactgctgcgtcggactcggcgccaagctccacgacctccgcggggtgctcgacgtctggaggaactacaccgccggcacacccgacgagcgccgcgcaggcaagttccagtggaagctcccgggcatctgcatccactgatcgatcgatcaatcgaggtccaagtccaacgacggccggcgacggcgagtccggcagcgcgcgcgcggcatcatatcaatcacctgcgatgctgcacggtggcggtggctgcctccccgtgccccgtgcccgcccggtttcattgctctccaccttgtccattctttctctgcctcttgttcttggcgtgaaatttcaggagattgcgcgcattgagcgagggtgtaggttccattcttttgattcgtcatcatcaaaggttatactccactagtaggtagctagaattcaggaaaaaaaatcgttaagttatactgctccgtatgtatgtatgtacgcacacagcacagcttatactatgtatctaatatcgttgatctgctcctgcataccaagatgaatgaatgaatgaatgaatgcaacaggcagcgcccatttatcggcaacagactcattcctcacgcgttggcgttgcctcttcgactcatcagtcagagcaaattttcagatgctgaactagacctgctgctactgcgtgatcaggatgcagtccattttcagagcaaaaatgtttagattggtctgggtctgggctgagcaacatgagatccggaaggatgcagccaggtcccaggagcttcgctttgttaacagcagcagagctcgagagccgttgcgagttcgcatgggccacaactgcacctgatgtgtaaagtctcaggtttttggtgctgggctaaaacttatataggccctttagaaagtggtcctgcaaggaatgtggccgaaccatactcgcatcgcatctcatacgtgggctgggtttgtaacgtttggagtttttctttttccccagataaagattag

SEQ ID NO: 1433 - DNA, 1142 bp, Saccharum officinarum
gttcctccccacgtcacggcaacaacgggcagcggcaacaaacccagaagaacctgaaccgaaccccgtccgccgtcggacctcgtgagcgaggatgaagggcggcgacatgagcagcgtcagcccgctggtgtccttcgtgctgggcgccgccatggccaccgtctgcgtcctcttcttcatgtccgccacgcccgcgcgccgcctcgtcgacatctccgccttcacctccgccgccgcccccgaggacctgcagcgcctcgcctccgacgactcggcggccaccgccaccccggcgccggctcccgcgcccgtccagcccccgtcgccgtggggcgacctggaggaggtgctggcgcgcgcggcgaccaaggaccggacggtgatcatgacgcagatcaacgcggcgtggacgcgcccgggctccctgctcgacctcttcttcgagagcttccgcaccggggaggacggcgtggcgcgcctcctggaccacctcgtcatcgtcaccatggaccccgccgcctacgagggctgcaaggccgtccaccgccactgctacttcctccgcacctccaacggcgtcgactaccgctccgagaagatgttcatgagcaaggactacctcgagatgatgtggggccgcaaccgcttccagcagacggtgctccagctcggctacaacttcctcttcacggacgtggacgtgatgtggttccgtgacccgttccgtcacatctcaatggcggcggacatcgccatctccagcgacgtgttcatcggcgacccctacagcctgcgcaacttccccaacgggggcttcctcttcgtgcggtcgtcggccaagaccatcgacttctaccgggcgtggcagcaggggcggtggcgcttcttggggaagcacgagcaggacgtgttcaacctcatcaagcacgagatggcgcccaagctggacctcgccatccagttcctcgacaccgcctacatcagcggcttctgccagctcagcaaggacctcaacaagatctgcaccctccacgccaactgctgcgtcggcctcggcgccaagctccacgacctgcgcggggtgctcgacgtctggaggaactacaccgccggcacacccgacgagcgccgcgcaggca

SEQ ID NO: 1434 - DNA, 2150 bp, Oryza sativa
gtccatctcaacagttcaacgcatcaggtccagtctacgcctaaacaaacgcgaacctacaggcagacagggtcggcaccaacaacccaacccatcctgagttcctgacagccaaacctcgacctccagctccagcagctagcaaatcaaagcaaagcaaccgtgtgttgcgactttgaaacctgtcacgctgaagcaagaggcacgcatcacactacaagttgtcatcacaccagcaaagccaaaactacgagtaaatcaatcagtgggagaggattaagatgatgatgatctgtctcttaggcctccatcacgcccgttaattccctttcaggctggtcttcgcctacctgttgctgctgctcctccatcaaatacccccattccctctcctctctgctactactatacctccttcttgttcctttcttcagacaaaggctttgcctttccttcctcttccaccatcctgccacaagaagcaagaacctctcttaatttgagcaagaaaccattcgtcacatcaacggaggaagcagctatagtttgattgattggttgatcgatcgatgctgggcggcggcaagatgaagggtggggagacgatgggcggcggcggcggcagcggcagcagcagcattagcccgctggtgtcgttcgtgctgggcgccgccatggccaccgtctgcatcctcttcgtcatgtccgccagcccgggacgccgcctcgctgacatctccgcctggagcaacgccgacgacgcgccgccgctgccgctcccgttgcaggacgccgccgtcgactccaacgactcgctggccgccgccgccgccgccaacgtcaccgtcgttgctgctccggctcccgcccccgtccaggctccggcgccggcgtccccttacggcgacctggaggaggtgctccggcgagcggcgaccaaggacaggacggtgatcatgacgcagatcaacctggcgtggacgaagccggggtcgctgctggacctcttcttcgagagcttcaggctcggggagggcggcgtgtcgcggctgctggaccacctggtgatcgtcaccatggaccccgcggcgtacgaggggtgccaggcggtgcaccgccattgctacttcctccgcaccaccggcgtcgactaccgctccgagaagatgttcatgagcaaggactacctcgagatgatgtggggtcgcaacaagtttcagcagaccatccttgagctcggctacaacttcctcttcacggatgtggacgtgatgtggttcagggacccgttcaggcacatatcaatgggagcagacatcgccatctccagcgacgtgttcatcggcgacccctacagcctcggcaacttccccaatggcggcttcctgttcgtgcgatccaacgacaagaccctcgatttctaccggagttggcagcaagggaggtggcgattcttcgggaagcacgagcaggacgtgttcaacctgatcaagcacgagcagcaggcgaagctgggcatcgccatccagttcctcgacaccacctacatcagtggcttctgtcagctcagcaaggatctgaacaagatctgcacgctccatgccaactgctgtgttggcctcggcgccaagatgcacgacctccgaggcgtcctcgacgtctggaggaactacacggcggcgccgcccgacgagcggcgctcgggcaagttccagtggaagctccccggcatctgcatccactgatcgatcgatcgatcatatgttcatatgcatatacacgcagcgttcagcattgctggattgccttggctgcttggttaatttagctaggcgatcgctcgactgcaggccggttaatttctcgagctgccaaattctttctcctcaattattagttgcgccgattctttttgtcaagttaggaaaatctatatattaagttattacatcatatatttatacgtacgtacgtacgtacgtatgtatacagattaattctagcatgcttgtatcccggagctcctctgtaaagataaaagaatgcatcagctttgcatcaatcatcaagcatgtgtccaggctattatctacctatctattatatctattatattatattatataaagacagctttgaaaggaggcacc

SEQ ID NO: 1435 - DNA, 362 bp, Setaria italica
gggtctccctcatcctgagcatttccccttctgcgaccaggaggacgaaaccattcagcacctcctctgttcttgtgtcttctctaggcaattctggcttcaactacttcgcagttttggactcctggatattgcacctcaaccatcttccactgggttctttgactggtggcaacaagctggtagcacacttgacaaaggaaccaagagaggattcaattcaccggtcatgctaggagcttggattctatggaaggaaaggaatgatattgtgtttaatggtgcctcacccaggatggagcgggtgcttctccttgcacaggaagaagctgttctctggaggctggtaggcgccaaaggca

SEQ ID NO: 1436 - DNA, 1346 bp, Setaria italica
ctggtcgtgctacatatgtgcaattggttctcacctcagttctgatctatttcgccactgccttggagcttcctccatggtgcctaaaggcggtggataagattcgtcgtaatttcttgtggagaggccagaaggaggcgaaggaaggtcactgtttaatagcatggcccaaggtgagccgtccaaaggagctaggtggtttgggcattttagacctacagagatttggctgggcgctcagagtccgttggttgtggttgagtaaaactgaacccgataagccatgggcagccttcccggtcacagttcatgggaatgcacagtccctatttgctgctgctataactacggaagtcggcaatggggcgaacaccaagttctggactgatcggtggttgcaagggtcctctattcagctattggctcccaatttgtttgcaactgtacccaagaggcgggttaagaagcgtactgttcaggaagcattgctggacaatcagtggatacaggatatccaggggcactactcggtagcggtcctgtcagaatttctggatatttgggacatggttcaggaaacattgcgtctaccagaggctgaggatgttcataaatggaaatttgagaattcaggatagttctctactacgtcagcatacgaggcttttttccttggagaagtccagtttgagccgagcacactaatttggaggaattggggtcccaggaagtgcaaattcttcctttggttagtggcacataatcggtgttggacagctgatagactcgctagaaggggtctccctcatcctgagcattgccccttttgcgaccacgaggatgaaaccattcagcacctcctccattcttgtgtcttctctcggcaattctggcttcaactacttcgcagttttggactcccagatattgcacctcaaccatcttccactgggctggtggcaacaagctggtagcacacttgacaaaggaaccaagagaggattcaattcactggtcatgctaggagcttggattctatggaaggaaaggaatgatattgtgtttaatggtgcctcgcccaggatggagcgggtgcttctccttgcacaggaagaagctgttctctggaggctggcagccgccaaaggcattagtgatctggtcactgctcaacctgggggttagcagagtccgttggtgaggggtggtcgacctttaaattttaacgggcgtgtatgtaacctagaacctgtgaggtgtgtgtagtgttggtgtgtgtggtgttgtatggctatatgagccttttatctcctttcttaatgcaatgatacgcagctctcttgcgt

SEQ ID NO: 1437 - DNA, 362 bp, Setaria italica
gggtctacctcatcctgagcactgccccctcaaggaccaggaggatgaaaccattcagcacctcctgtgttcctgtgtcttctctcggcaattctggtttcagcttcttcgcatttttggactcccggatattgcacctcaaccatcttctactgggttctttgactggtggcaacaagctggtagcactcttgacaaaagaacaaagagaggattcaattcactggtcatactaggtgcctggctgtcatggaaggagaggaatgatattgtgttcaatggtgcctcgcctacgatagagcgggtgcttctccttgcacaggaagaagccgctctctggaggctggcaagcgctaaaggca

SEQ ID NO: 1438 - DNA, 1178 bp, Pennisetum glaucum
agctcgagtcggccttgaacatccagtcaggcggtttgggcatttgcagagattcagatgggcgctcagagtccgttggttgtggctgggtaaaactgaacccaacaagccatgggctgccttcccggttatagttcatgggaacgctcaggccctttttgccgctgctgtaaccacggcagtcggcaatggagcaaacaccaagttttggactgatcggtggcttcatgggtcctccatccagactttggcccccaatctgtttgcaactgttcccaagaggtgggttaagcggcgtactgtacaagaggcacttttggataacaaatgggtacaggatattcagggacatcatactgttgcggtcttggcggagttcctagaggtttgggacttggttcaagaggtgatactgctgccagaagtggaggatgttcataaatggaaattcgaaagttctggacagttctcttctaagtcagcttatgaggccttattccagggagcagttcagcttgagccaagcgcgttaatctggaagaattggggacctaggaaatgcaaatttttcctttggttagtggcccataactggtgttgggcagccgatagactcgccggaaggggtctccctcatcctgagcactgccccttctgtgaccaagaagatgaaaccatccagcacattctttgttcctgcgtcttctcttggcaattctggccgcaactcctacaccgctttggcctcccggacattgctcctcaaccatcggccgttggcttctttgattggtggcagcaagccggcagcacgcttgacaaaggagcaaagaaggggtttgattcactggtcatgttaggagcttggattctatggaaggaaaggaatgatattgtgtttaatggtgcctcgcccaagttagagcgggcgcttcttcttgcacaggaggaagctaccctctggatgcttgcaggtgccaagggcattagtggtttggtcgctgctcgacctgcgggttagcagcgtgcataggaggggggtggttgtcttttattttgtagcgggcgcgtagtttttcttggtccagaggagagggtgcgtagtgttggtgttcttgtgttgtatggctataaccttatcttctttcttaatgcaatgatgcgcagttctcctgtgt

SEQ ID NO: 1439 - DNA, 1933 bp, Saccharum officinarum
aaaggcgtaaagccgtcgccactcttcccccattccacgctgctgcctcggccctcggcgctgcgcccggccccggcaccttcctccccacttcgccgccggcgggtggagtcgggccggagcagccgctctcctctgttaccccccaaaaagaaaaaagaaaaaaagagtaccaatcaagcgagccgccggcagctcgggcagcagccatggggcacggcgtgagctgcgcccgcaccggcgacgagcacgactacttccgcgcggcgcaggtcggggacatcgacgccctggacgcgctcctcgccgccgacccctccctcgcccaccgggccacgctctacgaccgcctctccgcgctccacatagccgccgcgaatggccgcctcgaggtgctgtccatgatcttggatcacggggtgccgccggacgcggtgaatcggcacaagcagactccgctgatgctcgcggcgatgcacggcaagatcgactgcgtgctcaagctcctgcaggccggcgccaatatcctgatgttcgactccctgcacgggcggagctgcctacaccacgcgtcctacttcggccacgtcgactgcctgcaggccatcctcacggcggcgcggaccacgccggtggccgactcatggggtttcgcccggttcgtcaacgtcagggacgaccacggcgccacgccgctgcacctcgccgccaggcagggccgccccggctgcgtgcaggtgctgctggagaacggcgccattgtctccgccctcaccggctcctacgggttccccggcagcacgtcgctgcatctggccgctcgcagcgggaacctggactgcatccggaagctgctcgcctggggtgcagatcgtctccagagggactcagcagggaggattccttatgccgttgcgctgaagcgcagccacgaggcgtgtgcggcgctgctgaacccttcgtcagctgagcccatggtgtggccttccccactgaagttcatcagcgagctggacccggaggcgaaggcgctcctggaagcggccctgatggaagccaacagggagagggagaagaagattctgaagggcacaaagtactctccaccatcgccttccccttgcgagcatgagaatgatgccgatgccatcgacgatgcgtcctcggaggcgagtgacacggagctatgctgcatctgcttcgaccaggcgtgcacgatcgaggtgcaagactgcgggcaccagatgtgcgcgccatgcacgctggcgctgtgctgccacagcaagcccaacccgacgacgcttacactaccgtcgccggcgtgcccgttctgccgcggcagcatctcgcggttgctggtggcccgagcaagcaccgcgtccagcgacgacgccgacaaggctgcttctgcggcggcctcctcaccgcagctcgtccggcggcggtcccggcggtctcacaacctcagtgacggcgggagcagcagcttcaaggggctgtcgtccgccgtggcagggtccttctccaagatcgggcgcgggtcgagccggatggccgatagcgacggcatggacaagcccgagcacgacctgtgatcagcattggatcctgtgcaagtggagcagagtgccggctgatcggccggcccggacggctggcttgtggtactgaagctgaagcagccattgccactggctttccaagatgaggacatccaaggctccaagcaagcgtgatcgtgggttttatatagatatatactaggagctactagtactactactaaaataagtactagtgtaatgcattctcttcttctccctatgtccctgcctgtctgtcttgtcctatttttgggcatgccattgcaaggattcacctggcccatggcgtattccgtggtcaccgggctataattcgattccttcctggt

SEQ ID NO: 1440 - DNA, 2850 bp, Sorghum bicolor
gacaagagagcgacagatagagagaggggcgttgataaaaaggcgtaaagccgtcgccactctttccccattccacgctgcctgctgcctcggcgtaaagccctcggcgctgcgggagcccggccccggcacctacctcccccaccacttcgccgccggcgggtggagtcgggccggagcagccgctcgctctcctctgttaccttaccccacccaaacagaaaaagaaaaaaaaaggagagtaccaagcaagcgagccgaccggcggcagctcgggcagcagccatggggcacggcgtcagctgcgcccgcaccggcgacgagcacgactacttccgcgcggcgcaggtcggggacctcgacgccctgggcgcgctcctcgccgctgacccctccctcgcccgccgcgccaccctctacgaccgcctctccgcgctccacatcgccgccgcgaatggccgcctcgaggtgctgtccatggtcctggatcacggggtgccgccggacgcggtgaatcggcacaagcagactccgctgatgcttgcggcgatgcacggcaagatcgactgcgtgctcaagctcctgcaggccggcgccaatatcctgatgttcgactccctgcacgggcggtcctgcctgcaccacgcgtcctacttcggcaacgtcgactgcctgcaggccatcctcacggcggcgcggaccacgccggtggccgactcatggggtttcgcccggttcgtcaacgtcagggacgaccacggcgccacgccgctgcacctcgccgccaggcagggccgacccggctgcgtgcaggtgctgctggagaacggcgccattgtctccgccctcaccggctcctacgggttccccggcagcacgtcgctgcatctggccgctcgcagcgggaacctggattgcatccggaagctgctcgcctggggcgcagatcgtctccagagggactcagcagggaggattccatatgccgttgcgctgaagcgcaatcacgaggcgtgtgcggcgctgctgaacccttcgtcggcagagcccatggtgtggccttccccgctcaagttcatcagcgagctagacccggaggcgaaggctctcctggaagcggcactgatggaagccaacagggagagggagaagaagatcctgaagggcacaaagtattctccgccatcatcgccaccttccacttgcgagcatgagattgatgccgatgccattgatgatgtgtcgtcagagacgagcgacacggagctgtgctgcatctgcttcgaccaggcgtgcacgatcgaggtgcaagactgcggtcaccagatgtgcgcgccatgcacactagccctgtgctgccacagcaagcccaacccgacgacgctgacactgccgtcgccggcctgcccattctgccgcggcaacatctcacggctactggtggcccgagcaagcaccgcgtcgttggacgccgacaccgacaaggctgctgcggcggcggcctcctcacctcagctggtccggcggcggtcccggcggtctcacaacctcagtgacggcgggagcagcagcttcaaggggctgtcgtccgccgtggccgggtccttctccaagatcgggcgcgggtcgagccggatggccgacagcgacaatggcatggacaagcccgagcacgacctgtgatcggcattggatggatcctgtgcaagtggagcagagctctggctgatcggccggctggcttggcttgtggtggtgaagctgaagcagccattgccactggctttccaagatgaggacatccaagcaagcgtgatcgtggtgggtttatatagatatatactactagtaaaataagtagtgtaatgcattctcatcttcctcccccatgtccatgtctgtctgtcctatttttgggcgtgccaggattcacctgggccattgccgtattccattgtcaccggctataagattccattccttcctgttcaatgtccatgcagctgtgcttgtgctatggttgagagttgagccacagacatgtagtagcaccatcggtgatcggtgtactgtatgtaacagtcgcaggcacagcacagtcgggaactgtggccggccggcgaggtcgactggactggtgatctctcaattcctgaattccggcattgcatgttgtagcacagcagcagcagcagcggtgacggcgatgtgagctctaaagatggcctgccatggcatgtgagctctgtcggtctgtctccgatcccatgcccttgtgtaatggacggatcaggctctcgcccggttttggccttggccgtcttgttgcctgccactgtcatggtgttaatggctgttcctgagtcctgtgccctttgctccatgagcaagcacgagcacggtggtcctctccgtcgccgtcgccgtcgccgtcctgggtggtgaatctgccagggatacgcctgctctgctctggggctctgcgccgctgccgggaggaagggacggcaatgagtaccggcgcagcgctctagctgcggctgcgggctcaccgtcaccgatccacaggcaggctccgtgaccggccggccggggccatggtcgtccggcggatgcagctgccaatggtccgtgatcgctgatgcacgcaggaggagtggtgggcgtcactctgtcagacagagggagcagccgcagttattattatacgccgtatatacgctgtacggtagatggatgccgacgcgttgcaggcttgcagcacaccagtcaaacaattggatttggggtggggacagtcggttttttctttttacttttttcttcttccagggttatctagataggaat

SEQ ID NO: 1441 - DNA, 1548 bp, Sorghum bicolor
gaaaaagaaaaaaaattgtagtcgcaagtttttctagtgacgacggccggagaatttcgctagcaatcggtggcccagaaagaatttgctaaaaatgattcaccgccagatatcgtcgatgcctcgttcgtcgttccccatcatcaccgccatggatttctcctaggctcccccatccgctcggctcgcttccctcctccccactctctctgatcccgtcgcacttccctcctcctcctcgccgccggcccccctctactcgtccgactaccgtttcctcgttccccctctcccttttcggtcggcaacgatcatcgtcggcagcaatcatcagggcaagcaattcctcgatttccgccccccgctctcagctagcgcaagaggagcgacgcgatgtctatgccggaggcggggcaggccgcggagagggatgagcagcagcaggcccaggtgatcaaggcgctgatgcagggcatctgcgccgtgcggtaccgcaaggccgataacacgccctgccccatcgcgcagggtctctacttgggatctgttggagcagcattcaataaggaggctctcaagagcttgaacatcacccatatcttgattgttgcaaggtcgctggacccagtatttccagctgaattcaattacaagaagatcgaggtacttgacagcccagacactgatctgttaaagcattctgatgaatgctttagtttcatagatgaagctataagctctggaggcaattgtttagtccattgctttgctgggcggtcaaggagtgtgacaatcgttgttgcatatctcatgaagaagtatcaaatgagcctcgaaagtgccttgtcgctagttagaagtaaacgacctcaagtggctcctaatgaggggtttatttcccagctggagaagtttcagaaatcctttcaagtggagcaggaacggagaatgcaatctgtgcagaattaactcattatattataataggtgtagaggccttatatgttgtgaatgcatatgcgttgtcaagagcgtcctgactgcgtattatgtcatctggataacaagcaaggccttggcaaactggtggtggtgggactccactgctttatgttgtaaacagcaagtgacgttgttcctccattgggatgcagtttctcttctaatgggtagtatcatatatagagctgcaattagcacttcatgaactacaacatcaagacactcaaagaaaaagcctgctcatgtcaccaagctaaacagacactaggatgatggtgcttgatccggtgtctcgtagatttgtgctatgtaatcatgcttgatttttcatgtcacttgtttttgtaaacctgggttccaaatattgtgaaacatcctacaatctcaaagtcttcttttttacaatgatgtcacctatcatgatcataaacacatgcgtgccacatatgcacgtccattagtagatacatatgaaagcgaactgatcatagatccatgcggtggaatctatccacttaagttcaagttcccgacttgacatgggtg

SEQ ID NO: 1442 - DNA, 1402 bp, Sorghum bicolor
aaaacacaaaaggccttgagccctccgttgtgctccgcgaggaaaacgaggtgctgaccaacggaaagtccagtgcccaaccggagccaaagggaaggaggaatggaagccgccggcgcagcctcgccgcccacggagccgccgccgactcacccggcggtggcgccgctggccttcctgctggggaagtggcgcggggaaggcgagggcagcttccccaccatctcctccttccggtacggcgaggagctcctcttctcgcatcatccctccaagccggtgatctcgtacacgcagaagacgtggaaggcggcgtctggcgagccgatgcacgccgagagcgggtactggcggccccgccctgatggctccgtcgacgtggtcatcgcgcagagcactggcctcgccgaggtccagaagggttcatatgacgctgaaaagaaaacagtgacactccaaagtgaactagttggaaatgcatcaaaggtgaagcagatcacgagaacttttcaagtggcagatggggagctctcgtacgtcgttcagatggcaacaatcacaactagcctacagccacatctcagggcccttcttaagaggatttgaagacgatcgacaatctcttatagcgccgtcgctgcggctaaccaactgagggacacctgtactacacagcataagcttctggtcattactagttagtgaatgaacttacaagttcaaagctcattttcaaaaataaaagttctgttggagatttgccattataattttgcaaagttgtagatttgccattggtatctcactgacatatgggacgcacatgagtcaatgacatgtgggacaggatggcaaatctccaatttagtaaaattataatggcaatctatgagatttttcagggtttttgacgtatttattcctccttaacatgcacagtgagaagtgagaacacatcgctacatttctcaacaacgtcaatatgagctcgtgtttgtttttcgcagcatcacaggacgttcaggatgtccgataaatcgaattaatgagcatttccacaatttcaaagcagagggtagaggagttgaagcgggtcatgtttcagagtcctgaggttaaaagttcaaacagacactgcattctgaagctgcctcttacaaagaggatcagccctaaagccaggaaccaattcctcaaaaaaaaaagccaggaaccaaaaaacagaaccaccacaccgagaacttgggtactgtcgattttgtggatatgctgcacaagaaatgaagcaagtagaacgacaaacaagagtccagtataaaaaccagatatttgatgttatgaagtaaggactatggtcaagcaggtcaaatttgcaacgagagccaaggtttttagcatcaat

SEQ ID NO: 1443 - DNA, 663 bp, Saccharum officinarum
actcctcgagccctccgttgtgctccgcgaggaaagcgaggagccgatgaggcgaccggctcggcgctgaatgctgctgaccaacggaaagtccagtacccaaccggagtcaccaaggaaaggaggaggaatggaagccgccggcgcagcctcgccgcccacggagccgccgatgactcacccggcggtggcgcctctggccttcctgctggggaagtggcgcggggaaggcgagggcagcttccccaccatctcctccttccggtacggcgaggagctcctcttctcgcatcatccctccaagccggtgatctcgtacacgcagaagacgtggaagccggcgtctggcgagccgatgcacgccgagagcgggtactggcggccccgccctgacggctccgtcgacgtggtcatcgcgcagagcactggcctcgccgaggtccagaagggttcatatgacgctgaaaagaaaacagtgacactccaaagtgaactagtaggaaatgcatcaaaggtgaagcagatcacgagaacctttcatgtggcagaaggggagctctcgtacgtcgttcagatggcaacaatcacaactagtctacagccacatctcaaggcccttcttaagaggatttgaagatgaccgaaaatctcctatagcgacgt

SEQ ID NO: 1444 - DNA, 1470 bp, Panicum virgatum
caacgagtcaaaacacaaggccttcgcagccccgcgaagaaagcgaaggagccgaccggctaaccagcggagagtccacggcccaaccggagccaccgaggagggaggaatggaagccgccggcgcaggctcgccgccctcgcagccgccggcgccgcacccggcggtggctccgctggcgttccttctgggcaagtggcgcggggaaggagagggcagcttcccgacaatctcctccttccgctacggcgaggagctcctgttctcgcaccacccctccaagccggtgatctcgtacacgcagaagacatggaaggcggcgtccggcgagccgatgcacgccgagagcgggtactggcggctccgccccgacggttccgtcgaggtggtcatcgcgcagagcacgggcctcgccgaggtccagaagggttcatatgatgctgaaaagaaaacggtgacactccaaagcgaacttgtaggcaatgcgtcaaaggtgaagcagatcacaagagcttttcaagtatcagatggggagctctcctatgtcgttcagatggcaacaatcacaactagtctacagccacatctcaaggcccttctcaaaaagatttgaagatggctgccatgccaatctgctatatagcgaggcctctgctctaccaagagggtggttgtcccattctccccattctgatgtttgattcaaagtggaatgagttgattcaaagttcaataagctcttagaagttagaaacctaacatcaacagtcatatcaccccattctgatgtttcattcaagggttaattggatctgtgacccttgattgattgaaagtggaatgagatgatccatcattccgttaacaagcttgagccccagcgattcattttgataagtaaacatttcaaagtgtttcagcgaatgttttgagttcaataaaccgcttaacaatgagggggagcagatgaattgaagtggcccatgtttcactgaaccgaggcaaaagttcaaacgtgctgtgcattcccacgccgcctctttcaacgcgtggcaatcaagtagggcgtgcttcagccaagatctacagaacagaaccaccacacaactaagagcttgggctctcgtcaatttcggaaacatgcagcaaaagaaagttggccaaagagtagcaaactggagataagaaccatgaggaaattctacatcatgaatggatcaagacaggtcaactttgcaacagcaacgaagtacaaattttagcaccataatttttgatatccttaagcataaccagaatattcatgaatgttcttaggccaaacagccatatgtcttagacggtacaaaaagcacaggactactgcagagaagagctccgattatgcttcagtctgctccctcaagcgacggattgtgctcctgacggtgactgcactagcagtgctgcaaacacaaacagaagaattat

SEQ ID NO: 1445 - DNA, 940 bp, Panicum virgatum
aaccgctgaccacttaaccagggcggaaagtcccacgacccaaccggaggcaccgagggggatggaatccgccggagcaggcacgccggcgcccacgcagccgccggtgccgcacccggcggtcgctccgctagccttccttctgggcaagtggcgcggggaaggcgagggcagcttccccaccatctcctccttccgctacggcgaggagctcctcttctcgcaccacccctccaagccggtgatctcgtacacgcagaagacgtggaaggcggcgtccggcgagccgatgcacgccgagagcgggtactggcggccccgccccgacggctccatcgaggtggtcatcgtgcagagcacgggcctcgccgaggttcagaagggttcgtatgatgctgaaaagaaaactgtgacactccaaagcgaacttgtaggcaatgcgtcaaaggtgaagcagataacgagagcttttcaagtggcagatggggagctctcgtacgtcgttcagatggcaacaatcacaactagcctacagccacatctcaaggcccttctcaaaaggatttgaagatggctgccaatctggtatagtcaggccttctcgctaacatagtggggggttgtactgagcttgtgctgttccgttcattactatcgggaaagttaaaagttcaataagctcttagaaacctcacattcaacagtcaacatagatttcttttttgagtgtttggttcagtgggacctccattctgctgtttcattcaagaagtggaatgagttgatccattcattaataagcgttctgataagtaaaggttaccagtgtttcagcgaatgttaaggtctcgtttgattttttttaagttgtcgtatatcgaatgtttcggatgtaaattcgaatgttcagatgtcaacttaatataaaaataattgtata

SEQ ID NO: 1446 - DNA, 783 bp, Setaria italica
aagaaagcgaggagctgagcggaaagtccaggacccaaccggagccaccaaggaagaatggaaaccgccggagcagccacgccgcccacgcagccgccggcgacgcacccggcggtggctccgctagcgttcctgctgggcaagtggcgcggggaaggcgagggcagcttccccgccatctcctccttccgctacggcgaggagctcctcttttcgcaccacccctccaagccggtgatctcgtacacgcagaagacgtggaaggcggcgtcaggcgagccgatgcacgccgagagcgggtactggcggccccgccccgacggctccgtcgaggtggtcatcgcgcagagcacaggcctcgccgaggttcagaagggttcatatgatgctgaaacgaaaacagtgacactccaaagcgaacttgtaggcaacgcgtcaaaggtgaagcagatcacaagagcgtttcaagtgacagatggggagctctcgtacgtcgttcagatggcaacaatcacagctagcctacagccacatctcaaggcccttctcaaaaagatttgaagatggctgccaatctcctataacgaggcctcttcgctaacctgagagttgtgttgagcatgcgctgctccgttattaccagtgggaaacttcaataagctcttagaaaccatcacacatgtaaactgctttgcttgacacctcataatcaacggtctctattttgatgtttggttcaagaaatggaatgagttgatccaatgatccattatcaagcatgag

SEQ ID NO: 1447 - DNA, 801 bp, Panicum virgatum
  misc_feature (283)..(283): n is a, c, g, or t
  misc_feature (542)..(542): n is a, c, g, or t
  misc_feature (698)..(698): n is a, c, g, or t
  misc_feature (700)..(700): n is a, c, g, or t
acgacccaaccggaggcaccgagggggatggaatccgccggagcaggcacgccggcgcccacgcagccgccggtgccgcacccggcggtcgctccgctagccttctttctgggcaagtggcgcggggaaggcgagggcagcttccccaccatctcctccttccgctacggcgaggagctcctcttctcgcaccacccctccaagccggtgatctcgtacacgcagaagacgtggaaggcagcgtccggcgagccgatgcacgccgagagcgggtactggcggncccgccccgacggctccgtcgaggtggtcatcgtgcagagcacgggcctcgccgaggttcagaagggttcgtatgatgctgaaaagaaaactgtgacactccaaagcgaacttgtaggcaatgcgtcaaaggtgaagcagataacgagagcttttcaagtggcagatggggagctctcgtacgtcgttcagatggcaacaatcacaactagcctacagccacatctcaaggcccttctcaaaaggatttgaagatggcngccaatctggtatagtcaggccttctcgctaacatagtggggggttgtactgagcttgtgctgttccgttcattactatcgggaaagttaaaagttcaataagctcttagaaacctcacattcaacagtcaacatagatttcttttttgagtgttngnttcagtgggacctccattctgatgttcattcaagaagtggaatgagttgatccattcattaataagcgttctgataagtaaaggttaccagtgtttcagcg

SEQ ID NO: 1448 - DNA, 984 bp, Oryza sativa
cccaaaaataaaaaataaagataaaatgttgcccctgaggccagttagaacttagaacgcttcccttcaacgtccgaactgcaaagcccaataggcccaataggaaggaggaaagagtcaaactgacgaaatgacgagcagaaataagtccaggaatcgaaacggagaccccgaggaaatggaaggcggcggagcaaccgcacccgccgcgccgcacccggcggtggcgccgctggcgttcctgctggggaagtggcgcggggaaggcgaggggagcttccccaccatctcccccttccgctacggcgaggagctcctcttctcccaccacccctccaagccggtgatctcgtacacgcagaggacgtggaaggcggcgtcaggcgagccgatgcacgccgagagtgggtactggcggccccgccccgacggctccgtcgaggttgtcatctcgcagagcactggtctggccgaggttcagaagggttcgtttgatgctgaaaagaaaacagtgacgctccaaagcgaacttgtggggaacgcatccaaggtgaaacagatcacaagagcttttcaattggtagatggggagctctcatatgttgttcagatggcaacaatcacaaccagtctacagccacatctcaaagcccttctgaagaagatttgaacgatactgcgcccctctaggggcgcagtgcggcggcgtctgtggcacttctggatttttatgttaaaataataatggtatttttgcctattatatctgggaattggggcaacctgcccctactagtttgacataatagacgctgaaaatacgcccttcagagttcagataatgtccatgcgagttcgggcttgttcatgcgcatgagagttcaaactttgttgcgttaaacttaatttaatttaccatcagtattttcacaaatataacgcattcttttcattcgttggcgtgtgacggatcgacaaaacaac

SEQ ID NO: 1449 - DNA, 588 bp, Pennisetum glaucum
gaaagcaaggagcgtcccaccacccaccggccggctagtgctgaactgctgaccagcggaaagtccaggacccaaccggagccaccaaggaggaatggaaaccgccggagcaggcacgccggcgacgcacccggcggtggctccgctagcgttcctgctgggcaagtggcgcggggaaggcgagggcagcttccccaccatctcctccttccgctacggcgaggagctcctcttctcgcaccacccctccaagccggtgatctcatacacgcagaagacgtggaaggcggcgtccggcgatccgatgcacgccgagagcgggtactggcgaccccgccccgacggctccgtcgaggtggtcatcgcgcagagcacaggcctcgccgaggtccagaagggttcgtatgatgctgaaaataatactgtgacactccagagcgaacatgtaggcaacgcgtcaaaggtgaaacagatcacaagagcttttcaagtggtggatggggagctttcatacgtcgttcagatggcaaccatcacaactagcctacagccacatctcaagggccatcccaaaaagatttgaagatg

SEQ ID NO: 1450 - DNA, 789 bp, Secale cereale
gttcagctcaccaaaggaggagagtcgtgagaccagtccgaaaatccaaccggagacttcaagaaatggaagccaccggcgcaccaacgcagccgccggcgccgcacccgttggtggctccgctgtcgtttctgctgggcaagtggcgcggggagggcgaggggacattccccaccatcgccccgttccgctacggcgaggagatcctcttctcccaccacccttccaagccggtgatctcgtacacgcagaggacgtggaaggcggcgtccggcgacccgatgcacgccgagagtgggtactggcggccccgccccgacggctccgtcgaggtggtcatcgcccagagcacaggcctcaccgaggtccagacgggttcatatgacagtgaaaagaaaacagtgacactccaaagcgaacttattggcaatgcatcaaaggtgaagcagatcacgagggcttttcaggtggtggatggggagctctcatacgtcgtccagatggcaacaatcacaaacagtctacagccgcatctgaaagcgcttctcaagaggatctgagcaatctccttgggtgggattgcggtaacataccgtatctgaagctctagattctttgggaaacttaaagttcggctaataaggagcttctatttattatttgcgagaacatgaaaacctatcatttgctggaatctgaagattattcagggcttacaacattccgtataaccttttatgagcatcagctgtgtaacgcacagcaaactcaagagaaagaaactacaaa

SEQ ID NO: 1451 - DNA, 819 bp, Secale cereale
gttcagctcaccaaaggaggagagtcgtgagaccagtccgaaaatccaaccggagacttcaagaaatggaagccaccggcgcaccaacgcagccgccggcgccgcacccgttggtggctccgctgtcgtttctgctgggcaagtggcgcggggagggcgaggggacattccccaccatcgccccgttccgctacggcgaggagatcctcttctcccaccacccttccaagccggtgatctcgtacacgcagaggacgtggaaggcggcgtccggcgacccgatgcacgccgagagtgggtactggcggccccgcccggacggctccgtcgaggtggtcatcgcccagagcacaggcctcactgaggttcagacgggttcatatgacagtgaaaagaaaacagtgacactccaaagcgaacttattggcaatgcatcaaaggtgaagcagatcacgagggcttttcaggtggtggatggggagctctcatacgtcgtccagatggcaacaatcacaaacagtctacagccgcatctgaaagcgcttctcaagaggatctgagcaatctccttgggtgggattgcggtacaatctccttgggtgggattgcggtaacataccgtatctgaagctctagattctttgggaaacttaaagttcagctaataaggagcttctatttattatttgcgagaacatgaaaacctatcatttgctggaatctgaagattattcggggcttacaacattccgtataagcttttatgagcatcagctgtgtaacgcacagcaaactcaagagaaagaaactacaaagtca

SEQ ID NO: 1452 - DNA, 2758 bp, Brachypodium distachyon
acggcgccaccctaaacttaaaaactctaaagctgcgtccccccacgcaagagcgcaagataaatacgcactccaaagcggcacacacacgcacgaggcccgaaacgcgagcgcaaacaaacgcaccaccgccgcggcgcttgcaagttgcagcggcagcagcagctcgacttgtctaggctgcctggagccaagagacatcagacgcgcgcattattacattggcgcgtaccgtcgccggccgctgcggtggcgtgacaagctaagaaggggatcaagattcaagaagcgagcgcgcggcgggcgccggccgtcgtcaatggcgggtcgccgcctgacgctgctgctgctgatggcggtggccgcgctctcggcgggcgcgagcggcaagtcggcgcggttcgagctgatccgcagcgggccggcgtccttccaggagatggcgctccacgaccgcgaccgggtggcgtccttcgccgccgcgcgcgggcggcggcacgggcgtcgcggcgcccgggagaccgcggccggatcggcgtcgtcgtcggagtctgccttcgcgatgccgctcacgtccgccgcgtacacgggcatcgggcagtacttcgtgcggttccgcgtgggcaccccggcgcagccgttcctgctcgttgccgacaccggcagcgacctcacctgggtcaagtgccgccccgccaaggccgcggccgcctccacgaactcgtcatcgtcggcatcggcttcgtccccgcggcgcgcgttccggccggagaaatccaagacgtgggcgcccatcccgtgcgcgtccgacacctgcagcaagtccctccccttctccctctccacctgccccacgcccggcagcccctgcgcctacgactaccggtacaaggatgggtcggcggcgcgcggcacggtgggcacggagtcggcgaccatcgcgctgtcgtcgtcgtcgtcgtcgtccaagaacaaggtgaagaaggccaagctccagggcctggtcctgggctgcacgggctcctacaccggcccaagcttcgaggcctcggacggcgtcctgagcctgggctacagcaacgtctccttcgcgtcccacgccgcctcgcgcttcggcggccgcttctcctactgcctcgtcgaccatctctccccccgcaacgccaccagctacctcaccttcggcccaaactccgccctctccggcccgtgccccgccgccgccgggcccggggcgcgtcagacgccgttggtgctcgacagccggatgcgccccttctacgacgtcagcatcaaggccatctccgtggacggggagttgctcaagatcccgcgcgacgtctgggaggtcgacggcggcggcggcgtcatcgtcgactccggcaccagcctcacggtgctggccaagccggcctaccgcgccgtcgtggccgcgctcggcaagaagctcgcccgcttcccgcgcgtcgccatggaccccttcgagtactgctacaactggacctcgccgtcgcgcaaggacgaaggcgacgacctgccaaagctggccgtgcacttcgccgggtcggcgcggctggagccgccgtccaagagctacgtgatcgacgcggcgcccggcgtcaagtgcatcggcgtgcaggaggggccatggcccgggatctccgtcatcggcaacatcttgcagcaggagcacctctgggagttcgacctcaagaaccgacggctcagattcaagaggtcgcggtgcacgcactcgtgattatgggcgtgcagcgcggatcgctccaaccactagttctgtttttttttttctccttgtggtggtggtggtctgctctcgctgattaattatatttttttgtcccgtgttcaggtgctactgctaatgcgatgagaaatgtgcttcgcagaaatgatagtagtagtaagctcaatccagcaccaaagtgccccgagaacagagagtcccaaagtcccgagttcctgaccaagagaaaaacagaaaatccggccggagaccccgagaaatggcagccgccggcccacccacgcagccgccggcaccgcacccgtcggtggcgccgctgctgttcctgctgggcaagtggcgcggggaaggcgagggaacctttcccaccatcaaccccttccgctacggcgaggagatcctcttctcccacaacccctccaagccggtgatctcgtacacgcagaagacgtggaaggcggcgtccggcgagccgatgcacgccgagagtgggtactggcggcccacacccgacggctccgtcgaggtggtcatcgcccagagcacgggcctcgtcgaggtccagaagggttcatatgatgctgaaaacaaaacggtgacgctccaaagcgaacttgttggcaatgcatcaaaggtaaagcagatcaccagggcctttaagatggtggatggggagctctcgtacgttgttcagatggcaacaatcacaaacagtctacagccacatctgaaagcccttctcaagaggatttgagatatctcctcgagtccagtggaatctatgttttgaagaatgatatttgagtatttcttagtaagtttggtacttaaaagtcaaatttgacttaactagaaatacccttcttccaaacttacattacgggaacctgctcgtaggagcatgatatgtacgaaaacaaatgacattcatttctgacctgtagtaagagatattacagggctcttaacttgtatacattttcttggaga

SEQ ID NO: 1453 - DNA, 1113 bp, Triticum aestivum
tgaaaattgtgcaacccacagttacggttaaaaaataattagattgtgcaacccaagccactccccatcgtcccgttcagctcacgaaacaagagagcagagaggtgagaccagtccgaaaatccaaccggagacttcaagaaatggaagccgccggccctccaacgcagccgccggcgccgcacccattggtggctccgctgtcgtttctgctgggcaagtggcgcggcgagggcgaggggaccttcccctccatcgccccgttccgctacggcgaggagatcctcttctcccaccacccttccaagccggtgatctcgtacacgcagaggacgtggaaggcggcgtccggcgacccgatgcacgccgagagtgggtactggcggccccgccccgacggctccgtcgaggtggtcatcgcccagagcacaggcctcaccgaggtccagacaggttcatatgatagtgaaaagaaaacggtgacactccaaagcgaacttattggcaatgcagcaaaggtgaagcagatcacgagggcttttcaggtggtggatggggagctctcgtacgtcgttcagatggcaacaatcacaaacagtctacagccgcatctgaaagcgcttctcaagaggatctgagcaatctccttgggtgggattgcggtaacataccgtatctgaagctttagattctttgggaaacttaaagctcaactaataaggagcttctatttattatttgcgaggacatgaaaacctatcatttgctggaatctgaagattattcagggcttacaacattctgtataagctttatgagcgtcagctgtgtaacgcacagcaaactcacgggaaagaactacaaaatcataacatctgcaaaaatagcattaatggaatggaacatgaagtctctgcatgcacccacggaaatttcagaaactgtttttgggataaacgaaaaacaacaacaatgtttcaaaaggtctgaaaagatataccacctcccggctgttggatgaaagctagaacgaccattgtatctccccatgtgaacccgttgaaaccagtgattccaacactcagtctctgcaacatgggacttattgcaaac

SEQ ID NO: 1454 - DNA, 2869 bp, Brachypodium distachyon
aagaaacagaccccacctttgcctcttctcctcgccttcgccacttcccctttgccctccgtcccgcccccacggaatctggaaaatcccggacgccattgccaaccttttccctcgagcacaaggaaagcacgccacagggaggaggggtggtggaattaccgtgatcaaattcggaagctgctccggaggtgggtagaatctggccgtggtgagaggaaatgtctggtttcgtgggggtcgtcgtctccgacccctcgttgcagggacagttcacgcaggtcgagctccgatcgctcaaggccaagtttgtatctctaaagagagaatccggccatgtcaccaccaaaaacctcccgggactgatgaaaaagttgaggggactcaatgaagtggtctcggaggaggagatcgctgctttcttgtcggagtcatacccagacagcgaccaggagattgagttcgagtcgttcctccggacgtacctgaatcttcaagcaaaggtgaccacgaaggaagaaaacggcggcagcgggactggcgctcgcaagaactcgtcgtcgttcctgaaatccaccatcactactctgctgcacaatctcaaccaggcagagaagtcttcttatgtggcccatattaacacttatctaggtgaagaccaattcttgaagaagtacttaccagtcgacccatccggcaaccaactgtttgatcttattagggacggtgttctgctctgtaaattgatcaatgtagctgtacctgggaccattgatgagagagcaataaataagaaaagagttcttaacccatgggagaggaatgaaaaccacacgctctgcctcaactccgcgaaagccattgggtgcactgttgtaaacattggtacccaggatttggtggaaggaaggcctcacttagttcttggattgatatcccaaatcataaagattcaacttttggctgatctcaatctaaagaagacaccccagctcgtggaattgtttgatgacagcaaagatatagatgaagtattgagcttgtcaccagaaaagatgttacttcgatggatgaaccatcatctgaaaaaagctggctacaagaaaactgttaacaatttttcttcggatgtgaaggatggtgaagcctatgcttatcttctaaaagcccttgctccagagacttcacctgaaaccacattggaaaccaaggatcctgatcagagggcaaaattggtacttgaacaagcagagaagttggactgcaaaagataccttacaccgaaggatatcaccgagggttctgccaacttgaatcttgcttttgttgcacaaatattccagcatcggaatggtttcactagtgacgctaaacaagttacactcacgcagacagcatcacgtgatgatgttctagtatccagagaagaaagggccttccggatgtggatcaacagccttggggttgaaacatacgtgaacaatgttttcgaagatgttcgcaatggatgggtacttctcgaagtacttgacaaagtttctccaggatctgtcagttggaagttggcatcaaaacctccgattaaaatgccatttaggaaactggaaaattgcaaccaagttgtaaaaattgggaaggagttgaagttttcattagtaaatttagctgggaatgatattgttcagggaaataagaaattgatagttgcacttctgtggcaattgatgagatttaatatccttcaattgttaaacaaactgaggtttcattcccaaggatcccaaggaaaagaaattactgatgcagatatactaaactgggctaacagcaaagtgaaagcatcaggaagaacatctcgaattgaaagcttcaaggacaagagcttatcaaatggagtgttcttcctcgaacttcttggtgcagtacaaccaagggttgtaaactggaaagtagttacaaagggggaaaatgatgacgaaaagaagctaaatgctacctacatcattagtgttgcgagaaagctcggatgttctgtgtttcttctaccagaggacattatagaggtgaatcagaagatgatcctaacacttactgctagcattatgtattggagcctacagagacagccacaacctcaatctgaaacacctgaaccatcggagccatctagtatggcttcagatgcaacttccgatgttggttcggaggatggtgcctcaactgtagcaccatctgaaggggaagaagtgaattcattgtctgaaagtatatccaatctgaccacagatgatgctacttcaaatgctccacctgcagaaaatggaaatgatgcagcaggatcctgatgattatatgttcttcatagccctgtccgttagttttatacaggaattggtacatccctgatgcccaaagttgctgctaccagaagtgaatttttaccctacttctgcctacttttcaggtagcataatagatacatatacagatagatgtagctgccgtttgttcattaaattttgctcaatactatatgggaaaaagagagaaatacacacacataggcaaacgttggccatttcctgtaccctctttggtatgctttatggcctccttacgcaacttgtaccttgtcggtcaatgtttccacctttttttttcaatttgtactgcttggccattatcgtttgtactactgctcaggatcattcatgagctgtacataacatattgaaggaatttatgccgtgtccaggaattattgtagacaccacattgtagcaatttttttgttcctttgcatgcagtgtgacatgtcggatgttgactggactatctgcagttctggcacggatagcgatttataatg

SEQ ID NO: 1455 - DNA, 2782 bp, Oryza sativa
ctgacctcctgtcctcgtctccaccacttcccctcccctctcccgcccccacgaaatctgggaggagccacgacgccattgccaacccttcttctcttttccccccaccgcaaggaaagcacttccggcgagcgtcgacgacgacgaatcgtcgcgagaaattcggaagtcgataggggaggtcggggaggaggggggagatgtcggggttcgtcggcgtcgtggtctccgacccgtcgctgcagggccagttcacgcaggtggagctccgatcgctcaaggccaagtttctatctctgaagagagactccggaggacatgccacgacgaagaacctcccgggactgatgaagaagctgagggggctcaatgaggtgatctccgaggaggagatcgccgcccacttgtcccagtcttaccctgacgccgaccaggagattgagttcgagtcattcctacgggaatacctgaatctgcagtcaagggtgagcgccaaagaaggcggaggtggtggtggcggcggtggcaagaccgcgtcatctttcctcaagtccagtaccactacattgctgcacaatctcaaccaggcggagaagtcgtcttatgtggcgcacatcaacacctaccttcgtgaagacccgtttctgaagaagtatttaccaatcgagcctaccgacaaccagctgttcgatcttgtcagggacggtgttctgctatgtaaattgatcaatttagctgtacctgggaccattgatgagagagcaataaataagaaaagagttcttaacccatgggagaggaatgaaaatcacaccctgtgcctcaactctgccaaggccattggatgtacagttgtaaacattggtacacaagatttggtggagggaaggcctcatttaattcttggattgatatctcaaatcataaagattcaacttttggctgatctgaatctcaagaagacaccccagctggtggaattgtttgatgacagcaaggatatagatgaagtgttgagcttgtcaccagaaaagatgctacttcggtggatgaaccatcatctgaaaaaagctggctacaagaaaaccgtcagcaatttctctacagatgtgaaggatggtgaagcatatgcttaccttctaaaagctcttgctccagagcattcccctgaaaccacattagagacaaaggatcctagtgagagggctaaattggtacttgaacaagcagagaagttggattgcaaaagatacttgactcctaaggatatcactgagggttctgccaatttgaatcttgcatttgtggcacaaatattccagcatcggaatggtctaactagtgacaccagacaagttactctcaatcagactgcatcacgtgatgatgttctattatcgagagaagaaaggtcctttcggatgtggatcaacagtcttggggttgactcttacgtgaacaatgtttttgaagatgttcgccatggatgggtacttcttgaagtactggacaaagtttctccaggatctgtcaattggaagctggcctcgaaacctccaattaaactaccattcaggaaattggagaattgcaatcaagtggtaaaaatcggaaaggagttaaagttttccttagtaaatttagctgggaatgatattgttcagggtaacaagaaattgattgttgcacttctgtggcaattgatgagatttaatatgcttcaattgttgaatagactgagatcccactcccaaggatcccaaggaaaagaaattactgatgctgatatactaaaatgggcaaacagcaaagtgaaagcatcaggaagaacatctcaaatggaaagcttcaaggacaagagcttatcaaatggacggtttttccttgaacttcttagtgcagtacaaccgagggttgtcaactggaaagttgttacaaagggggaagatgatgaggaaaagaagctaaatgctacatataccattagtgttgcaaggaaaatcggatgttccgtgtttctgctgccagaggacatcattgaggtaaatcagaagatgatcctaacgcttacggctagcatcatgtattggagtctacagaagcaaccacagtcacaatctgaaacgtcagaacaatcagagccatctagtatggcttcggatgcagcttctgatattgcttcggaggacgctgcttcaataacagctgcatctgagggagaagaggtgaattcgctatctgatagtatgtccaatttgaccacatatgatgctatttcaaatgccccgccagcagaaaatggaaatggtgtggcaggatgatgatgattacacgggctgttcttctgtcctgatagcggttttattatggtggaactagtaccgtcatggtgtccaacgtttgctgccagaagtgatttttttcctgcttctgttccaagcctacttttgaggtagcatgatagatacagatacagatagatagagttgccgtttgttcatttaattttgctctatacatacgacagggaaaaaactatacataggtcactagttgggcatttcttgtactcttagtatactttgatttcaatgtcttcactttgtttcccggacctgtcaaaatgtactggcatcgtttgtaatctgctgctgctctggaccattcatgagctgtatataacataatattgtggagagatctggtttcccaagaatccctgttcattgtttacagtactcttttcaccaatctatctctatgctctactagcagatttggg

SEQ ID NO: 1456 - DNA, 2661 bp, Secale cereale
ccccaccgtgtcccgtccccggcccccacaaaatccggaacgcaacaaaatccactcctccccaatgtcgtaagctaaacagaaaaagatttggcgcaaagcaaacagaacatctcccaccaattcgaccgccgccgcctcgcatccctccagtcgatcgattacgtgctcgtccggcgatccctcctccctcgtcaattcgatcccccaatgcgcgcgcgaacgagacgatcgatcgccgcatttcctcttttgatctgaggcgttcgctagggcgctccgagaattgggcacctcgccggagatagatagatgtccgggttcgtgggggtcgtcgtctccgacccctccttgcagggccacttcacgcaggttgagctccgatcgctcaaggccaagtttgtgtctctgaagagggattctggccatgtcaccgccaagaacctgccgggcttgatgaagaagctgagggggctcaacgaggttgtctccgaggaggagattgctgcgttgttgtcggaggtttaccccgacagcgaccaggagattgagttcgagcaattccttcaggagtacctgaacctgcaggagaaggtgagctccaaggcgggtgcgagcgggagcaagaactcgtcgtcgttcctcaagtcgagcaccaccacgctaatccacaaccccaaccaagcagagaagtcgtcctatgtcgcgcacatcaacgcgtacctcggcaacgatccttttctcaagaagtatttgccgatcgaccccatgggcaatgatttgttcgacctcgtcagagacggagtcgtgctctgtaaattgatcaacgtagcggtacccgggactatcgatgagagagccatcaacaagaagaggatccttaacccatgggagagaaatgagaaccatacgctttgcctcaactctgcaaaggctattggatgtactgtcgtgaatcttggagctcaagacttggtggaaggaaggactcatctagttctcgggttgatatctcaaattataaagatacaacttttggctgatctaaatcttaagaggacgccacagctggtggaaatttttgatgacagcaaggatatagatgaagtgctgagcttatcacctgaaaagttactacttcagtggatgaattatcatctcaagaaagctggctacaagaaaactgttaacaatttctcttcagatatcaaggatgctgaagcctacgcgtatcttatcaaatctcttgctccagagcattcctctatacttgcatttgacaccaaggatcctgcggtaagagcgaaagtggtacttgaccaagcagagaagttgggctgcaaaagatacttgagcccaaaggatattactgagggctccccaaatctcaaccttgcatttgttgcacaaatattccaacatagaaacggtttgagtgacaccagacaggttacactcacacaaacatcatcgcgagatgaggttgtattgtcccgagaagagagagccttccgtatgtggatcaacagccttggaattgcaacatacgtgaacaatgtgtttgaagatgttcgaactgggtgggttatactagaagtgctcgacaaagtctctccgggctctgtcaactggaagctagcgacaaaacctccaataaaaatgccatttcgaaaactggagaactgtaatcaagttataaaaattgggaaggagctgaagttttctttggtgaatttagctggaaatgatattgttcagggaaacaagaagttgatcgtcgcacttctatggcaattgatgagattcaatatcctccagctgttaaacaaactgagattccactctcaagggtctcaagggaaagaaataactgatgctgatatcttgagttgggcgaataacaaagtgaaggtttccggaagaaactctcgaattgaaagttttaaggacaagaacctatcgagtggaatttttttccttgagcttctcagtgctgtagagccaagggttgtgaactggaaggttgtatcgaagggtgtagatgatgacgagaagaagttaaatgcaacctacatcatcagtgtcgcacggaagctcgggtgctctgtttttctgttaccagaagacatcattgaggttaatcagaaaatgatccttacattgactgctagcatcatgtactggagtctgcagaaaccacagcagcctgaaacatctgaacagtcagaatcatcttgtacggcttcagatgctgcttctgatatcgcctcagaggatgccgcttcgataatggcaccatcagaaggagaagaggtgaattggctgcctgatagagcgtccagcatgccaactgatgatactagtacttcacaggctcctgcctgagtctttttgcctgatagaccaactcaagcttaattaaccacaattgacaatatttcagacaccggagcgatgtgagatcgtgactacaaaatgatgatttaggatagtactttccctcccatcattttttgttttcctgtctcgtgcacagaatagatctgagcaaatttgttatttttatttgtatagtcttcttactaagtgcacataaaacaatccagtgtataggattatgctgaatataggttatatttgctcactgaattttgctcttac

SEQ ID NO: 1457 - DNA, 1029 bp, Sorghum bicolor
ggagggatgtaaggtaacagcaattttgttagtggcccgtgcgccgtaccctacatccagcggactgccttttgttctccagttccccggcgtgcggcggcgggctctcgctcccggcatacggtactattctcccgtgcccgtcgcctgcgctgtctgtctttgtgggggccggcgacgtttggcgaccgccctacgccaggtgcccagatctccatcctcggcaccctcgccggcgacgagcatcaccaggttcccattgaccatggcgcagcgcgcgatgtgcctgcttcggcgctccatggggtttatggcgcccccggcacaaagagccctgagtaccactgccacaccggcggcggagggtgcggcggtggccgaggccacggcgaaggaggtgaagaggaggaagaagaagaatctgtttgacgtggtgcagttcctgccagagtggggcatcggatacaaggtcgctaagaccacctggcgcgatgtctcttaccagatcaccaagatcaacctgtacaaggatggtcggcatggaaaggcgtggggggttcggtacaaggcaggtgtgcaagctgcagacgccccaactaggatcagcggggttaacaagcgtgggtggaagtacataaaagaatcacagaagaaactacaagatgcccccaaagtagacgtagctgttgctgcctagttgcatgttgtaagatgattcttggttccttcatgccatagatgttttgatggctgttgccaatgaacagatatccactttcggatcgactcaatggttccatcctttttgtcgatgatgatgactgaacctccctgcaatatgtccattttcttttctttatggaacctttcaccataatgtactaatacagaagaactgtgttgatggtgggaatctagttttcattctaatgcaagctttgtttgattctgagtctataggtaataatgccccttcatccaccaagatgaaatcttttatgtgaaattaccgagggttattgatatact

SEQ ID NO: 1458 - DNA, 2193 bp, Zea mays
aaaagctatcgcttatcatgctaggctaggcagctttgttgagaaggagcacgggggaagcccggcaagatcactacacgtggcatgtatgtccaaaactccaaatgccgagtagacagtggcggcggtagagagcgctgttaccttgcggggtgacgggggcaccttcttcggcgcggctgcagctgcagcatcggcggccgcgccggacgcggaggccgtgctggcgtaccgctcgggcgccgcgccgcgccgcgggaagccgcgaagtagggcgttgcggagggtgcgtcgccacgcgagtgcggtggaagatgacatcgggaacgcgaggggagaccaggcgcgggaagggcgggaggactgtgaagagcgcgaggagggcggcggcggcggcggcgctgatgctgatgctggtgcaggggctgatgagccggattcccgttcggcgtggccgcgtggggagcaagcagaagtgcagaactgcacaaggagagggcccacataaccatttctatgatattgcgcgtgtctcagtgtatcggcccagtttttcatgggctgacccggttatgtggccttgttagttttcgcctaatttcaaataacagcaatttcttagtggcccgtacactctgcagcagtgcggtgcgggcgtgcggcctccctttttttctccagttcctccggcggcggcgtgcttggcggtgcgccaggtgcccagatctccaccatcttagtcgccggcgacgagcatcaccaggttcccgatgaccatggcgcagcgcacgatgtgcctgcttcggcggtccattgggtttacagcgccgcaggcacagagagccctgagtaccactgccgcgccggcggcggagggtgcggccgtggctgaagctacggcgaaggaggcgaagaggaggaggaagaatctgtttgacgtagtgcagttcctgccagagtggggcattggatacaaggttgccaagaccacctggcgtgacgtctcctatcagatcaccaagatcaacctgtacaaggatggtcggcatggaaaggcgtgggggcttcggtacaaggcaggtgtgcaagctgcagacaccccaactaggatcagcggtgttaacaaacgtgggtggaagtacataaaagaatcacagaagaaactacaagaagcccccaaagtagacgtagctgttgctgctgcctagtttgtagttacatgcatgtttgttgtaagatgattcggtaaatctttagatggctgttgccagggtgagaacagggaaccactttttttttggatcgactctatacttttttgtcgatgacgactgaacctctctgcaacatgtccagtttctcttcttttcttttccttatggaacgaacctttaccgtaatgtactgatgcagaagaactgtgttgattgtggcaatctagtttccattcaaatgcaatccttgtttcattctgagccaatgttcctaggtttcagccgttcgttttccaagttgaactattttgttcctcaccatgttcctaggttttcattctacactgcggaggcgattgactggtattctcagtcagatgatgctggacggagtcatgcctacacgttcgcaacgcaggacaagtttggtgttcagccccgcgaggaccactacatggtcgatctgggactggtgttctggtatggcaggcggtgctggttgcctgccatctttcacggcagcgaggctgtaggcactcatctaattttggaagcagcaagcgagcgaacaaacaaacataccattgtgtgtcacaaagatgtcgaaaaacaaacttgcttgtatcaaaattagctcttcatgtatactgtaccaaatatacgcaaatgaccccgcagcatagttaattacaagctaaactcataaaaggaaattccttcaacattcccattggcatcctcggtggtcggtgctgaagccgcaggcaatggtcttaagtgactgtcgtagtcaagagaggttccaggtattgcttgaacttatcttttgtcattgccccttctcgccggctatctgctacctctcggccattcttgaagaaaatcaaagtcgggagaccatagaccttgtactcttcaatcagctgcggattggcgtcgtgatcgatcttgacgatttttactcgcccgtcatattcct

SEQ ID NO: 1459 - DNA, 839 bp, Setaria italica
ctccgcaaaatccacgcaaaaccctagccccggccgccgcctcgccccctcacacctcctcgccggagctccgcatcctcctctttcggctgccacctgccctgatcgcgccgagacccacctccggctcccgatggccatggcgcagcgggcgatgggcctgctccggcggtccctcgggttcgcgccgccgacggcacagagagccctgagtaccagcgccgcgccggcggcggagggtgcggccgcggcggcggccgaggcggtggcgaaggaggcgaagaagaggaagaagaagaacctgttcgacgtggtgcagttcctgccggggtggggcgtcgggtacaaggtcgccaagaccacctggcgcgacgtctcctaccagatcaccaagatcaacctctacaaggacggtcggcatgggaaggcgtgggggattcggtacaaggcaggtgttcaagctgcagacgctccaattaggatcagtggggttaacaaacgtgggtggaagtacataaaggaatcacagaagaaactacaagatgcccccaaagtagaagcccctgtcagtgcctagttgcagcctgtaagatgcttcttgtgtttcttcccttatagcaaaactttagatggttgttgccggatgaacacaggtccacttttggtatacacaagggttccctgtttgtcaatgatgacttaactctctgcagacttgcagtggttgatgtctattttttttccttggaacttttcccataatgtactgatacagaagaactgtgttgatcgtagcatctagtttgtattctaatgcaaagctttgtttcattcaagtc

SEQ ID NO: 1460 - DNA, 1056 bp, Panicum virgatum
caaatattttgaaatttcatcgctggatttggccattgcccaatgtggacttttaaatttcacaaatctcttgtttcacagtttgcgactttgcgtgaactcaagtagtcaatcgaacgatttttgcccgagtgaacgacgttgctgtcgtccgtccaaacatcgactgtgaacggcccggatctatccaaacccactccgccaaatccacgcaaaaccctagccccggccgccgcctcgccccctcacaccgactcgccggagctcgcatcctcctccttcggctgccacctgccctgatcacgtcgagacccacctccggctcccggtggccatggcccagcgggcgatgggcctgctccggcggtccctcggggtcgcgccgccgacggcgcagagagccctgagtaccagcactgcgccgccggcggagggggcggcggcggcagccgaggcgacggcgaaggaggcgaagaagaggaagaagaacctgttcgacgtggtccagttcctgccggggtggggcgtcgggtacaaggttgccaagaccacttggcgcgacgtctcctaccagatcaccaagatcaacctctacaaggacggtcggcatgggaaggcgtgggggattcggtacaaagcaggtgttcaagccgcagatgctccaactaggatcagtggggttaacaaacgtgggtggaagtacataaaggaatcacagaagaaactacaagatgcccccaaagttgaagccccggtcactgcctagttgcagcctgtaaggtgcttattgtatttcttcccttgtagcaaaattttagatggttattgccagatgaacagagatccacttttggatagacacaagggttcccagtttgtcgatgaagactgaactctctggagagtggagactgcagtggttgatgtctcttttttttaccctggaacttaaccataatgtactgatgcggtgtttatgatggcatctagtttgtattctactacgaagctttaattcattgaagtgaaggatctccggtaatgcctgttcaccaa

SEQ ID NO: 1461 - DNA, 820 bp, Cenchrus ciliaris
  misc_feature (104)..(104): n is a, c, g, or t
  misc_feature (242)..(242): n is a, c, g, or t
  misc_feature (801)..(801): n is a, c, g, or t
gtgagcggtggccgcctccgcaaaatccacgcaaaaccctagccccggccgccgcctcgccccctcacaacctcctcgccggagctccgcgtcctcctctttcngctgccacctgccctgatcacgccgggacccacctccggctcccgatggccatggcgcagcgggcgatgggcctgctccggcggtccctcgggttcacgccgccgacggcacagagagccctgagtaccagcgccgcnccggcggcgaacggtgcggcggcggccgaggaggtggcgaaggaggcgaagaagaggaagaagaagaacctgttcgatgtggtgcagttcctgcccgggtggggcgtcgggtacaaggtcgccaagaccacctggcgcgacgtctcctaccagatcaccaagatcaacctctacaaggacggtcggcatgggaaggcgtgggggattcggtacaaggcaggtgttcaagctgcagacaccccaattaggatcagtggggttaacaaacgtggatggaagtacataaaggaatcacagaagaaactacaagatgcccccaaagtagaagcccctgtcagtgcctagttgcagcctgtaagcttcttgtgtttcttcccctgtagcaaactttagatggttgttactggatgaacacaggtccactttggatagatacaagggttccccgattgccaatgatgacttaactctctgcagtcttgcagtagttaatgtctacttttttccctggaacttttcccataatgtgctgatacagaactgtgtttatgagagcatntagtttgtattctaatgca

SEQ ID NO: 1462 - DNA, 876 bp, Panicum virgatum
tctgcaaaatccccgcaaaaccctagccccggccgccgcctcgcccggtcgccccctcacaccgactcgccggagctcgcatcctcctccttcggctgtcacctgtcctgatcgcgtcgagaaccacctccgccttccgatggccatggcccagcgggcgatgggcctgctccggcggtccctcgggctcgcgtcgccgacgtcgcagagagccctgagtaccagcaccgcgccgccggcggagggggcggcggcggcggccgaggcgacggcgaaggaggcgaagaagaggaagaagaagaacctgctcgacgtggtccagttcctgccggggtggggcgtcgggtacaaggttgccaagaccacttggcgcgacgtctcctaccagatcaccaagatcaacctctacaaggacggtcggcatgggaaggcgtgggggattcggtacaaagcaggtgttcaagcagcagatgctccaactaggatcagtggggttaacaaacgtgggtggaagtacataaaggaatcacagaagaaactacaagatgcccccaaagtggaagccccggtcactgcctagttgcagcctgtaaggtgcttattgtatttcttcccttgtagcaaaattttagatggttattgccagatgaacagagatccacttttggatagacacaagggttcccagtttgtcgatgaagactgaactctctggagagtggagactgcagtggttgatgtctttttttttttaccctggaacttaaccataatgtactgatgcagaataactgtgtttatgatggcatctagtttgtattctactacgaagctttaattcattgaagtgaaggatctccggtaatgcctgttcgc

SEQ ID NO: 1463 - DNA, 537 bp, Pennisetum glaucum
gtgagcgcaaaaccctagccccggccgccgcctcgccccctcacaacctcctcgccggagctccgtccgcgtcctcctctttcggctaccaccttccctgatcgcgccgggacccacctccggctcccgatggccacagtgcagcgggcgatgggcctgctccggcggtccctcgggttcacgccgccgacggcacagagagccctgagtagcagcgccgcgccggcggcagacggtgcggcggaggcggcggcgaaggaggcgaagaagaggaggaagaagaagaacctgttcgacgtggtgcagttcctgcccgggtggggcgtcgggtacaaggtcgccaagaccacctggcgcgacgtctcctaccagatcaccaagatcaacctctacaaggacggtcgccatgggaaggcgtgggggattcggtacaaggcgggtgttcaagctgcagacgccccaattaagatcagcggggttaacaaacgtgggtggaagtacataaaggaatcacagaagaaactacaagatgccccc

SEQ ID NO: 1464 - DNA, 1048 bp, Panicum virgatum
cggaacaaaagctgtgtggaagcgaaaaggacacagcatggaagccagcctgcgctgccccagaatctgattcccagaacgctcaccggtcgagcccacatgggattggaatgaaccgagcgagtgacttgaccataaagaggctcaacccacaagttttaagcaaaacaaagcacaaaagaagcaagaatcaggccacgcctctcacgctaatcccctgcttttaactgcccttgacacaccacacacagccctcgctctcactggagcctctcacactctgcacctctctccagtctgagaagagctgctgctcctcctgccccatggactacaggtactactgcatgaccctgaggatgaacatcgactgcaacgggtgctaccagaggatccgaagggcgctcctccagatccgagagctggagagccacctgatcgacaagaagcacggccgggtgatggtgtgcggcgccttcagcccgcaggacgtggccatcaagatcaggaagcggaccaaccgccgcgtcgagatcctcgacgtcagcgaggccgcgccggccgcccaggacggcggccccggccacatgccctgaaagaaacagggtgccgtctcctacccccgccagcgccaccattgataagtgctcatcatacgactcgtaccttctcagttccggtagagtggcagttcagctgagctgaaacctttggcgcgagtccttctcgcagcaccagaagatgtgtgtgtacctggtcgaacgtgtgcggctcactggctgccataatttaccttcttgtaagttgtaacttaggaaccctgcatcattttgttctgtaaggcttgatgacgtagccagaaaatttcagtttagtcacaacttaaggtggccatcaccagcactactttcagaatggttgtcgatggccattctaaaattccacgataaatcaggagtttacaggactcgaccagagaggttatgctcttccccgtcaacatttgctttaacctttgctcgaaacaataaagattttctttatccaa

SEQ ID NO: 1465 - DNA, 593 bp, Zea mays
cttttcacactctgccgcccatttcacactctgcacctcgcttgcctgcctcagaccagtggataccgctttcgtcgtcgtcatctcgacgcacgacgctcctcgaccagtctccatggactactacaggcagccctactgcatcatgaccctgaggatgagcatcgactgcaacgggtgctaccagcggatcaggagggcgctcctccagatggaagggctggagagccacctgatcgacaagaagcacggccgggtcgtcgtgtgcggcgccgccttcagcccgcaggacgtggccatcaagatcaggaagcggaccaaccgccgcgtcgagatcctcgacgtcagcgaggcctcgccggcagcaccagaaggcggccccggccacatgccctcctgaaggagtcacgccgccgacacgtgctctgtagcggcggaagaagcctgcttgctattcccctaaacgaaacgaaagcatgtgcctggcatgttttgcctgcttgtaacttttggaatccttgcaccattttgttctgtaactgtaaaggattgttgaagtagccagaaaattccaagaccgtgttctaaaagac

SEQ ID NO: 1466 - DNA, 1133 bp, Panicum virgatum
ttcaaagcaaaacaaagcacaagaagcaagaatcaagccacgcctctcacgctaatcccctgcttttaactgccattgacacacagccctcgctctcactggagcctctcacactctgcatctctcctgtcaggtcgaacccgctgtgcgccgggctaagaagagctcctcctcctgctccatggactacaggtactactgcatgaccctgaggatgagcatcgactgcaacgggtgctaccagaggatccgaagggcgctcctccagatccgagagctggagagccacctgatcgacaagaagcacggccgggtgatggtgtgcggcgccttcagcccgcaggacgtggccatcaagatcaggaagcggaccaaccgccgcgtcgagatcctcgacgtcagcgaggccgcgccggccgcccaggacggcggccccggccacatgccctgaaagaaacagggcgccgtctcttacccgcaccagcgccaccattgattggtgctcatcatactactcgtgacttcagttccggtagagtgcagctgagcttgaaacctttggagcgagaccttctcgcagcaccagaagatgtgtgtactatgcatcattttgttctgtaaggcttgatgacgtagccagaaaatttcagtatttcatttcagtcacaacttaaagttgccataccagcactatttccagaatggttgtcgatgaccacactaaaactccaccataaatcaggagtttacagaccatatgtaagactcttaccagagaggctatgctcttccccgtcagcattttctttaacctttgctggaaacaataaagatatgctttatccaatttcttgccaatcagtatggtccaagccaggatagtgtgacaacagaagccgtcttgcacttcatttagagattttttttagcgctctgtagtatgcatactattcattatttcttgaatcgggatccgcatccaagaaaaaagtagacccaaactgaaaacaggcaggtccatgatttggaagtgtatagtttataaagttctctgtgggagcaaaattaagaagtggctcattattcttctgttaatccctttacaaactctatatagcattattatttattgg

SEQ ID NO: 1467 - DNA, 627 bp, Panicum virgatum
  misc_feature (626)..(626): n is a, c, g, or t
gaagcaagaatcaagccacgcctctcacgctaatcccctgcttttaactgccattgacacacagccctcgctctcactggagcctctcacactctgcacctctccagtcaggtcgaacccgctgtgcgccgggctaagaagagctcctcctcctcctgctccatggactacaggtactactgcatgaccctgaggatgagcatcgactgcaacgggtgctaccagaggatccgaagggcgctcctccagatccgagagctggagagccacctgatcgacaagaagcacggcctggtgatggtgtgcggcgccttcagcccgcaggacgtggccatcaagatcaggaagcggaccaaccgccgcgtcgagatcctcgacgtcagcgaggccgcgccggccgcccaggacggcggccccggccacatgctctgaaagaaacagggcgccgtctcttacccgcaccagcgccaccattgattggtgctcatcatactactcgtaacttcagttccggtagagtggtagctcagctgagcttgaaacctttggagcgagaccttctcgcagcaccagaagatgtgtgtaccctgcatcattttgttctgtaaggcttgatgacgtagccng

SEQ ID NO: 1468 - DNA, 1430 bp, Sorghum bicolor
aatggttttcgagagctgaaactttgagaggcagttagtgactgacgtgtgccctgtactctgcagcagccctactgcatgaccctgaggatgaacatcgactgcaacgggtgctaccagaggatcaggagggcgctcctccagatgcaagagctggagagccacctgatcgacaagaagcacggccgggtcatagtgtgcggcgtcttcagcccgcaggacgtggccatcaagatcaggaagcggaccaaccgccgcgtcgagatcctcgacgtcagcgaggtctcaccgcccgccccagagggcgcccccggccacatgccctgaaggagccacgccaccactgcgtgctctggagctctaggcctgcttgtcattctcttcagcaacggcaaggcaggcccgcctcagaggatgaatgctgccaaatcagcaccatagataatcctgtgatcagcagtaacattcacctgaaaaataaatgataggatcaacttacttagattctgaacaccatctctgcagggaaaattggttgctattatgtaccaagattgtgctgtattttttttcttgtccctgtactgtgaatatgatgcctacccaagcttgctcagcacaaaagggtttgttgttgttttgaggataggatggtgtggtgttgtacacatattcttatatagatctagaatagtagttcttatttacaaacaaaatttgtaacacatcattggagatcagcatgtccaattctaattttaggagtcagtagtatatgtacttatgacagaaaataatcagttaaccactagtaaataaggatgccaagcattctaattcttgatttatcgtgaatgatatcaccaaacaaaacttgaccacaacacacaattctgaatttaatataaaaaccaacttagataccaaaaaaaaaaatcagaagcatgctaacatagaagcatgaatctgaaactgcagcaagtctacaccctatgcctcttaaatttaggcacagtcaccagatccttgtctctcatacatttgatatgtgaaatgacgttatgtaatagatttcacttacatgttctagggaataagcagactgatcacagactttttggtatgggactgtagttaaatgctttaaggtttagctattgtattcacaaataaatttcataacatgctactgtgctttagcatttccaatgaaatgtgctaaggcacatacaccaactcatcttcacaattacataaaacgctagaaatactaaacaacagtcactaaccagagctttggtatactcaaattatagatatagatctgagaacaaactaaccagcatttcactcttgatactaaagaaaccatccttgtcagccactacagttggtcttgatgctccaacagccatgatagccccctgcat

SEQ ID NO: 1469 - DNA, 1121 bp, Setaria italica
acctggatatacagaaatcttgcaaaaggaaatgccaggaaaagtactaaaccggagatcaaactgccaaggacatctattagactaggtgaatcaaagtacaataaaaatctgaaggcatataactatataagtatccatccatgccttaccggtcctgggtccaaatcaaagtgccaaaggggcaagcagccggaacaaaagctgtgtggaagcgaaaaggacactgcatggaagccagcctgcattaccccagaatccgattcccagaacacaaatcgatcgagcccacacgggattggaatgaaccaagtgagaaatgactcgaccataaagaggctcaactcacaagttctaagtaaagcaagaatcaagccacgcttcgcacgctaatcccctgcttttaactgcccttaagaccttgacgcccgcacacatcccttgctctcactggggcctcacacactctgaacctctctccggtcaggtcgaacccgccgtgccgccgtcgccgctgggctgagaagcgctcctcctcctccatggactacaggtactgcatgaccctcaggatgaacatcgactgcaacgggtgctaccagaggatccggagggcgctcctccagatcagagagctggacagccacctgatcgacaagaggctcggccgggtgatggtgtgcggcgccttcagcccgcaggacgtggccatcaagatcaggaagcggaccaaccgccgcgtcgagatcctcgacgtcagggaggccgcgccggcgtcccaagacggcggcccaggccccatgccctgacagagcgccagctgaagcctgtggagcgagacctgctgttcttctcgcagcaccagaagatgtttgtggctgtcatattttaccttcgtgtaacttaggaaccctgcaccattttgttctgtaaggcttgttggcatagccagaaaagattcagcatttcatttcagtcacaacttaaggtagccataccagtactatttccataacggttggtgatgaccattctacaattccaccgtagagcaggagttcagagaccatatgaccgaacagataggctacatgatcttccctttcaacctttgctttaac

SEQ ID NO: 1470 - DNA, 2029 bp, Sorghum bicolor
gtaattgggtgtcattttctgctcctgttccaagagcatgcgtatgcacgaaatcaatagatagatccatgaatgaagaaacgatcattacaccgaggacaaaaatctttgaaaaaagaagcagggagagtggtgcctgaagtagagtggaagggacacccagttatctatctttatagatcaaatttatgtagttgaatgattcaccatccatccatccgcgcttccactcgcgtagaagtaacagggctcggagctcggtcgcgtacgtcgcccatgccgttgcgtggcgaattcactctctccccctccgcccattcgcccaccatatagcctagccgccaccgccacaccatcaccctcccactccgtggcgcccgcctgccaagaaccagtagtctctcttggtcagtcctactggtccttgacgttcgtggccagtcaggttatgttcttgccccggcgccgggtgtggtggtgaggccgagtgagtggtcggcggcgtgctcgtgctcgtgcttgactgcttgtacatgaggagcggctgcggcaggggagggaggcaacctggggaaggaggcgggggaggcgctggggctgctgggctgcgtcaatgaggtcgtggcggcggtggcggcgacgtgggggcccatgaccgacggcgcgcgcgtcgaggcggcgcccaggctcgcgcaatggcgcgtcgaggcgctcccctgctacacctatcgcaagtcactccccttccgcatcggcctctggaactggtacctgtctgtggagagaaataacaagcaaacttgtgttaagctctttgcagagaatccaaattctcccaagaacggcccctcagccccaatagcttcctttatcaccaaacttctcatatctcttccacctaatcaacagaccatagtccacccagggattttcgacaaacagctgaaacacgacggttttgtgtgggcaatcgatagcactgtgacagggagatttgtgattgagatagagtttcttgacctgaaggtcgctgatccatctggtggcgaaccagcctcaatctgggcctcccgccagatcaagcagtgttcagacagcaccgctctgtcctccctggctcggatgctgcacgaggacatcctcaccgacatcaccatcaacgcggcggacggcagcgtgcgtgcgcaccgcgccatcctggcgacgcggtcgccggtgttccggagcatgttctcgcacgacctcagggagaaggagctctccaccgtggacatctccgacatgtccctggacgcgtgccgcgccttcctcagctacatctacggcgacgtgagcggcgaggagttcctggcgaaccggctggcgctgctccgtgccgccgacaagtacgacatcgacgacctcagggaggcctgccacgagagcctgctggaggacatcaacatgggcaacgtgctggagcggctgcagacggcgcacctgtaccagctgcccaggctcaagggcggctgccttaggttcctggtggacttcaggaaggtgtacgagatgcacgacgacctcaacgcgttcctgcagacggccgacagggacctcgtggccgaggtgttccatggcgtccttgctgcgtggagcggccggtgatccatgggtgcatccgtgcatggcattgcagtctgcaggtgtgtacatctggttggtttagttcatacagattgtttggaggattcttgctggaaaagcgtgtaaatatatttgcaaacagtacatgcgtgccagtagttggcctaaaacatactgtgcacgccttgattggattttgttcttatcatgtggaaatctaattcttgtaacctattgctggacttgtaatacatcagctgatatgctgcttattgcaaaagttacttgagacttcactgataattactattgcattagtttctttttggtttttttttgtggtagatggtaaactctgtcgcattctgcctgactgaatatttgcaaaactgcacatgcgtgccag

SEQ ID NO: 1471 - DNA, 1554 bp, Pennisetum glaucum
cacccgcccgccaagaaccgggacaagcaaccagtcatcgcgcccagtccctctggttcctggcgcacgcatccgtcgtgcccaatcaggtgccttgccttgaattcttggagttcttgagcttgagccgggactgggtggtggtgcggcggtgaggtccgagttggtcgagttcttggcgattggcggctgtacatgaggaggggctgcggcggtggagggaggcaacctggggaaggaggcgggggaggcgctggggctgctgagctgcgtcaatgaggtggtggcggcggtggcggcgacgtgggggcccatgaccgacggcgcgcgcgtcgaggcggcgcccaggctcgcgcaatggcgcgtcgacgcgctcccatgctacacctaccgcaagtccctccccttccgcatcggcctctggaactggtacctatctgtggagagaaacaacaagcaaacttgtgttaagctctttgcagagaactcaaattctgccaagaacggcccctcagccccaatagcttcctttgtcaccaaactactcatatctcttccacctaatcaacagactatagtccacccaggaatttttgacaagcagctgaaacacgaaggttttgtgtgggcaattgatagtagcgttacagggagatttgtcattgagatagagtttcttgacctgaagatcgctgatccatctggtggtgaaccggcctcaatctgggcctcccagcagatcaagcagacttcagacaacacctctctgtccgcccttgcccggatgctgcacgaagacatcctcaccgacatcacgatcaacgccgcggacggcagcgtgcgcgcccaccgcgccatgctggcggcgcgctcccctgtcttccggagcatgttctcgcacgacctcagggagaaggagctctccgccgtggacatccccgacatgtccctggacgcctgccacgccttcctcaactacatctacggcgacctgcgcggcgaggagttcctggcgaaccggctggcgctgctccgggccgccgacaagtacgacatggccgacctcaaggaggcctgccacgagagcctgctggaggacatcgacacgggcaacgtgctggagcggctgcagacggcgcacctgtaccggctgccgaggctcaagggcgggtgcctgaggttcctggtggacttcaggaaggtgtacgagatgcacgacgatctcggtgcgttcctgcagacggcggagcgggacctcgtcgccgaggtgttccatggcgtccttgctgcgtggagcgggcggtgaagcgtgccatggcggcatggcctttgcaggattggttgattggttggttcagaatcagaagcattgttttggactatggataattcttgctggaaaaagcatgtacatataatttgcaaacagtacataatatgtgctggtggttatttggcctgtgtaaattcttgattggattctgttcttatcatgtggaaatctgattcgtgtatgtaacctctgctcgatttgtaatgcatcgtcattagctg

SEQ ID NO: 1472 - DNA, 1419 bp, Panicum virgatum
tgctcgtacatgaggggctgcgccgggggagggaggcaacctggggaagggggcgggggaggcgctggggctgctgggctgcgtcaatgaggtggtggcggcggtggcggcgacgtggggggccatgaccgacggcgcgcgcgtggaggcggcgcccaggctcgcgcaatggcgcgtcgacgcgctcccctgctacacctaccgcaagtcgctccccttccgcatcggtctctggaactggtacctatctgtggagagaaacaacaagcaaacttgtgttaagctctttgcagagaattcaaattctacaaagaacggcccctcagccccaatagcttcctttgtcaccaaacttctcatatctcttccacctaatcagcaaaccatagttcacccaggaattttcgacaagcagctgaaacacgacggttttgtgtgggcgattgatagtagtgttacagggagatttgtgattgagatagagtttcttgacctgaaggttgctgatccatctggcggtgaaccggcctcaatctgggcctcccaccagatcaagcagtcttcagacaacatcgctctgtctgccctgtctcggatgctgcacgaggacatcctcaccgacatcacgatcaacgccgcagtcggcagcgtgcgtgcccaccgcgccatcctggcctcgcgttcccctgtcttccggagcatgttctcgcacgacctcagggagaaggagctctccactgtggacatctccgacatgtccctggaggcgtgccacgccttcctccactacatctacggcgacctgcgcagcgaggagttcctcgcgaaccggctggcgctcctccgggcggctgacaagtacgacatggccgacctgaaggaggcctgccacgagagcctgctggaggacattgacacgggcaatgtgctggagcggctccagaccgcgcacctgtaccggctgccgaggctcaagggcggctgcctgaggttcctggtggacttcaggaaggtgtacgagatgcacgatgacttcaacgtgttcctgcagacggcggagcgggacctcgtggccgaggtgttccatggcgtccttgcagcgtggagcgggcggtaagcatggcatggcatggcagccttgcaggtgttcatctgggttggttggttcagaatcagcagcattgtttggatgattcttgctggaaaagcatgtaaatatttgcatacagtacacacgtgccagtagttggctggccttgaattcactttctatgccttgattggattttgttcttatcatgtggaaatctaattcatgtaattatacaaactattgctcaatttgtaatacacatcagctgattggtgctcatggcaaaagtccttgaggcttcacttctacatatcgccattccatta

SEQ ID NO: 1473 - DNA, 1520 bp, Panicum virgatum
tggttctcggagttcttgagcgcgggggacggcctggtggcgactggtgaggtcgagtggccgagttcttggcgattggcgggtgtgccagtgctcgtacatgaggaggggctgcgccgggggagggaggcaacctggggaaggaggcgggggaggcgctggggctgctgggctgcgtcaatgaggtggtggcggcggtggcggcgacgtgggggcccatgaccgacggcgcgcgcgtggaggcggcgcccaggctcgcgcaatggcgcgtcgacgcgctcccctgctacacctaccgcaagtcgctccccttccgcatcggcctctggaactggtatctatctgtggagagaaacaacaagcaaacttgtgttaagctctttgcagagaattcaaattctacaaagaacggcccctcagccccaatagcttcctttgtcaccaaacttctcatatctcttccacctaatcaacaaaccatagttcacccaggaattttcgacaagcagctgaaacacgacggttttgtgtgggcgattgatagtaccgttacagggagatttgtgattgagatagagtttcttgacctgaaggttactgatccatctggaggtgaaccggcctcaatctgggcctcccaccagatcaagcactcttcagacaacatcgcactgtctgccctgtctcggatgctgcacgaggacatcctcaccgacatcacaatcaacgccgcagacggcagcgtgcgtgcccaccgcgccatcctggcgtcgcgttcccccgtcttccggagcatgttctcgcacgacctcagggagaaggagctctccactgtggacatctccgacatgtccctggaggcatgccatgccttcctccattacatctacggcgacctgcgcagcgaggagttcctcgcgaaccggctggcgctcctccgggcggccgacaagtacgacatggctgacctgaaggaggcctgccacgagagcctgctggaggacatcgacacgggcaacgtgctggagcggctccagaccgcgcacctgtaccggctgccgaggctcaagggtggctgcctgaggttcctggtggacttcaggaaggtgtacgagatgcacgacgacatcaacgtgttcctgcagacggcggagcgggacctcgtggccgaggtgttccatggcgtccttgcagcgtggaacgggcggtaagcatgccatggcattgcagccttgcaggtgttcatctgggttggttggttggttgtttcagaatcagaagcattgtttggaggattcttgctggaaaagcatgtaaatattgcatacagtgggcacgttccagtggttggctggcctgggatttttactgtgtatgccttgattggattttgttcttatcatgtggaaatctaattcatgtaagtatacaatttattgctcaatttgtaatacacatctctgattggtgctcatggcaaaagtccttgaggcttcactaggtgatacctgttgccattc

SEQ ID NO: 1474 - DNA, 1769 bp, Setaria italica
ctcgcgtagaagtaacgagcctcgagctcggtcgcgtgcgtcgccgcagccgttgcgtggcgaattaattctctcccccctcctccgcccattcagagttcagacaccatatagcctagccgccaccgccacaccaccctcccactccgtgtggcacccgcccgccaagaaccggggacaagcaaccagtcatctcgtccagtcccactggttcctggcgcacgcatccgtcgtgtccaagtccaatcaggtgccttgatttctcggagttcttgagcttgagccgggactgggtggtgcggcggtgagggccgagcggtcgagttcttggcgattggcggctgtacatgaggggctgtgccgggggagggaggcaacctggggaaggaggcgggggaggcgctggggctgctgggctgcgtcaatgaggtggtggcggcggtggcggcgacgtgggggcccatgaccgacggcgcgcgcgtggaggcggcgcccaggctcgcgcaatggcgcgtcgacgcgctcccctgctacacctaccgcaagtccctccccttccgcatcggcctctggaactggtacctatctgtggagagaaacaacaagcaaacttgtgttaagctctttgcagagaattcaaattctgccaagaacggccactcagccccaatagcttcctttgtcaccaaacttctcatatctcttccacctaatcaacagactataatccacccaggaatttttgacaagcagctgaaacacgaaggttttgtgtgggcgattgatagtagcgttacgggcagatttgtcattgagatagagtttcttgacctgaagatcgctgatccatctggtggtgaaccggcctcaatctgggcctcccagcagattaagcagtcttcagacaacaccgctctgtccgcccttgcccggatgctgcacgacgacatcctcaccgacatcacgatcaacgcggcggacggcagcgtccgcgcccaccgcgccatcctggcggcgcgctccccggtgttccggagcatgttctcgcacgacctcagggagaaggagctctccgccgtggacatccccgacatgtccctggacgcctgccacgccttcctcaactacatctacggcgacctgcgcagcgaggagttcctggcgaaccggctcgcgctcctccgcgccgccgacaagtacgacatggccgacctgaaggagacctgccacgagagcctgctggaggacatcgacacgggcaacgtgctggagcggctgcagacggcgcacctgtaccggctgccgaggctcaagggcgggtgcctgaggttcctggtggacttcaggaaggtgtacgagatgcacgacgacctcagcgcgttcctgcagacggcggagcgggacctcgtggccgaggtgttccatggcgtcctggcagcgtggagcgggcggtgaagcgtgcccatgccatttgcagggttgcaggtgtattttctggattggttggttcagaatcaggaggacagaagcattattgtttggaggattcttgctggaaaaagcatgtacatatttgcaaacagtacataatacgtgccggtggttggctggcctggaatttaccgtgtatgccttgattggattttgctcttatcatgtggaaatctaattcatgtatgtaacatattgctcgatttgtaatacatcagtcattagctgatatggtgctcaactgatcatggcaaaaaggtcacttgagaggcttcact

SEQ ID NO: 1475 - DNA, 1676 bp, Panicum virgatum
aattctctccgcccattcagccaccatatagcctagccgccaccgccacaccaccctcccactctgtggcacccgcccgccaagaaccggggcgagcaaccagcagggtcgtctccgcccagtccgactggttcctggcgcacgcatccgccgcgcccaatcaggtggtgccttgatttctcggagttcttgagcgcgtgggactgcctggtggtgactggtgaggtcgagtggccgagttcttggcgattggcgggtgtgccagctgtgctcgtacatgaggaggggctgcgccgggggagggaggcaacctggggaaggaggcgggggaggcgctgggactgctgggctgcgtcaatgaggtggtggcggcggtggcggcgacgtgggggcccatgaccgacggcgcgcgcgtggaggcggcgcccaggctcgcgcaatggcgcgtcgacgcgctcccctgctacacctaccgcaagtcgctccccttccgcatcggcctctggaactggtatctatctgtggagagaaacaacaagcaaacttgtgttaagctctttgcagagaattcaaattctacaaagaacggcccctcagccccaatagcttcctttgtcaccaaacttctcatatctcttccacctaatcaacaaaccatagttcacccaggaattttcgacaagcagctgaaacacgacggttttgtgtgggcgattgatagtaccgttacagggagatttgtgattgagatagagtttcttgacctgaaggttactgatccatctggaggtgaaccggcctcaatctgggcctcccaccagatcaagcactcttcagacaacatcgcactgtctgccctgtctcggatgctgcacgaggacatcctcaccgacatcacaatcaacgccgcagacggcagcgtgcgtgcccaccgcgccatcctggcgtggcgttcccccgtcttccggagcatgttctcgcacgacctcagggagaaggagctctccactgtggacatctccgacatgtccctggaggcatgccatgccttcctccattacatctacggcgacctgcgcagcgaggagttcctcgcgaaccggctggcgctcctccgggcggccgacaagtacgacatggctgacctgaaggaggcctgccacgagagcctgctggaggacatcgacacgggcaacgtgctggagcggctccagaccgcgcacctgtaccggctgccgaggctcaagggtggctgcctgaggttcctggtggacttcaggaaggtgtacgagatgcacgacgacatcaacgtgttcctgcagacggcggagcgggacctcgtggccgaggtgttccatggcgtccttgcagcgtggaacgggcggtaagcatgccatggcattgcagccttgcaggtgttcatctgggttggttggttggttgtttcagaatcagaagcattgtttggaggattcttgctggaaaagcatgtaaatattgcatacagtgggcacgttccagtggttggctggcctgggatttttactgtgtatgccttgattggattttgttcttatcatgtggaaatctaattcatgtaagtatacaatttattgctcaatttgtaatacacatctctgattggtgctcatggcaaaagtccttgaggcttcact

SEQ ID NO: 1476 - DNA, 1230 bp, Panicum virgatum
cgcgtcgacgcgctcccctgctacacctaccgcaagtcgctccccttccgcatcggtctctggaactggtacctatctgtggagagaaacaacaagcaaacttgtgttaagctctttgcagagaattcaaattctacaaagaacggcccctcagccccaatagcttcctttgtcaccaaacttctcatatctcttccacctaatcagcaaaccatagttcacccaggaattttcgacaagcagctgaaacacgacggttttgtgtgggcgattgatagtagcgttgcagggagatttgtgattgagatagagtttcttgacctgaaggttgctgatccatctggcggtgaaccggcctcaatctgggcctcccaccagatcaagcagtcttcagacaacatcgctctgtctgccctgtctcggatgctgcacgaggacatcctcaccgacatcacgatcaacgccgcagtcggcagcgtgcgtgcccaccgcgccatcctggcctcgcgttcccctgtcttccggagcatgttctcgcacgacctcagggagaaggagctctccactgtggacatctccgacatgtccctggaggcgtgccacgccttcctccactacatctacggcgacctgcgcagcgaggagttcctcgcgaaccggctggcgctcctccgggcggctgacaagtacgacatggccgacctgaaggaggcctgccacgagagcctgctggaggacatcgacacgggcaatgtgctggagcggctccagaccgcgcacctgtaccggctgccgaggctcaagggcggctgcctgaggttcctggtggacttcaggaaggtgtacgagatgcacgatgacttcaacgtgttcctgcagacggcggagcgggacctcgtggccgaggtgttccatggcgtccttgcagcgtggagcgggcggtaagcatggcatggcatggcagccttgcaggtgttcatctgggttggttggttcagaatcagcagcattgtttggatgattcttgctggaaaagcatgtaaatatttgcatacagtacacacgtgccagtagttggctggccttgaattcactttctatgccttgattggattttgttcttatcatgtggaaatctaattcatgtaattatacaaactattgctcaatttgtaatacacatcagctgattggtgctcatggcaaaagtccttgaggcttcacttctac

SEQ ID NO: 1477 - DNA, 1928 bp, Brachypodium distachyon
gattggtttaactaacaaccgagcgattaaccggccagtaaattgaagctcctcgaaggacaaattcattcacgacgatgaattcctcgccgggatttttgaggagggagggaaaatggggaggagcggtggttgaagtggagtggaagcgagagagtaattaatcatggagggatttcattcattcaccgtcaggtcgcgtggaagaaagtctccattttgcgtaccggattaatcttcttcctctccctccccggcccgcaacagcaacgccaccccatctcccactcccatatagccgccatccctctccaccctcccagcccacttctctcggcgtgcgcgcgcgctcccttcgtgtcgctgtggcctgccagtgtaagttacagtttacagcagctgctgcctgctttgctagtgccgtggatcctggcttgtctcctttgtggatagccgtgtttgattgggggcgtgcgtgtcgtgcgcttgggggttggcgcggcagtacatgaggaggaggaggagcggagggaggaggaaggctggggaaggaggcgctggggctgctgggctgcgtcgatgaggtggtggcggcggtggcgtcgacgtgggggcccatgaccggtggccgcgtggaggcggcgccgaggctcgcgcaatggcgcgtcgacgcgctcccgtgctacacctaccgcaagtccgaccccttccgcgtcggcctctggaactggtacctatctgtggagagaaacaacaagcaaacttgcgttaagctctttgcagagttgtcaaattctgccaagaacacggtcccagctcctatagcttcctttgtcacgaaacttttgatatcctttcctcctaatgaaaagatcatagtgcatccaggaatctttgacaagcatctgaaacatgacggttttgtgtgggcgattgatagtactgttacaggaaggtttgtgatcgagattgagtttctcgacctgaaagttccagatccatctggtggtgaacctgcctcagtttgggcgtcacaccagatcaagcagtcttcagataataccgccctgtcttctctcactcggatgctgcaagaatgcatcctcactgacatcacaatcaacgccactgacggcagcattcgcgcccaccgtgcaatcctggccgcccgttcacccgtcttcaggagcatgttctcgcacgacctcaaggagaaagggctctccacggtcgacatctccgacatgtccctggacgcatgcaggggcttcctcaactacgtctatggtgacctgcgcaatgaggagtttctcacccacaggctggccctcctcggggctgccgacaagtacgacatcgctgatctcagggaggcgtgccacgagagcctgctggaagacatcgacacgggcaacgtgatcgagaggctccaggtggcgcacctgtaccggctgccaaggctcaaggagggctgcttgaggttcctggtcgacttcaggaaggtgtacgagatgcacgacgacttcaacgccttcctccagacggcggacagggacctggtggccgaagtgtttcaaggtgtccttgcggcatggagtggccggtgatgggttcatttgggagggtggtgggaggattggcaggcaattgttcccaggattcttgctgataccagcatgtaaatagcaagtgcaagccatcttttggctgtaaaaatgtaatgcctttaccacgattggattttgttcaagtcatatggtaattatctgattcatgtatatatattgtactactctacattttgtaacacatctgatgttcttggcaatcaagtcatgtcatgatcaaagttctctgtttgtgttatgttgggaacttcatttttaactgcctctgtgtggattagtaatggtaaactgaaagtatgc

SEQ ID NO: 1478 - DNA, 793 bp, Setaria italica
ccagcccatttgcataagcaacaacttcacaagcccacgacgccaacgccacaacccttgcgccgccgcctcgccgcccgtcgcgctgccgcctcgccgcccgtcgcgctgccgcctgcggtcgtgcccgtcgatctccccgcctacagccagtcctgttcctgcggcgctgctgttctcccggcaacctctcgtcgctccccctgcgctgaggagcgccggtccccggctcctcctcgccagcgtcgccgcccatcgcgacatcgtcgacaccgttataaggagaactcatgtccagggcacgtaatgctttagttgccactggcttgctgatctttgctggtgctggcttatcatttccattccttttcgtgaaatcaaagaacaggcctatcattgattcaacaaaacccctgccaccacaggctacattccgagggccatatgtgaatactggatcacgcgatatcggacctgatcccaccaactatccaaagaagtgatgtattctttcctgataattgagacaccattcctcctctctttgggcagaccacaaaagtgtacaactctgaaatagtgccgcataaagaattacctggtattctgtgcgtctttatcatggttgggcctttggacatctaattttgcatttaccttgacaatgaatttttttcagtatctcctatataaagaaggatggatattgaatactttttatagtgtattcagataataaaaagtaaacaacttagtgaaagcagaactctgtaaataatataaataaaaaaaa

SEQ ID NO: 1479 - DNA, 916 bp, Sorghum bicolor
gggctcaatgcaaaactaaacatgggctttgaaggagaagagaagcccatctaactattccggaccttccccgacccaccaccatcaccactgcggcggcggcggcggcagtgcgtgggggcgtgacgccgaccaaatccgcaaccctagcatcgcggtgggcggcggggacgggcggtcgacggctcgacgcgacgccgacaggtgtggccgtgtggtgcgcgagcacttgcgggggttcgcggcgccaggctgccagcgtgtggcctcccggctttccgccactgtcagttatatggtgagctgatgtcaaaggcacgtaatgctttagttgccactggattactggtcttcgctggtgctggtttatcatttccgttccttttcgtgaaatcaaagaacaggcctatcattgattcgtcaaaacctctgccaccacaggctacattccgaggaccatatgtgaatacgggatcacgtgatattggacctgatcctaccaactatcccaagaagtgatttaatcttccatgatgtttcgaggtcctgtgtgagctatgtggaaaagttttgagtctatgtaatttgcctcactcatatttggtccctgtatgagtgaggatcatgttttggaccaccctttttctctttaatacaatgaaacactgcgttttcaaaaaaaaaagtgatgtttcgaggtcccatttccctcgactccactgctgtgaaatggtgttctgtcaccttgtatttagtgcgttctgatcatggtttgttttggggacatcagattgtgcatgtgccttgacgttacattttttttagcaatacctaagggaatgacggttattgaagcccttttagaggtgtaaagtttgcccaatactttacgacgatatctattttaacaggtccg

SEQ ID NO: 1480 - DNA, 639 bp, Saccharum officinarum
catagagcattcagatagcaggttgtgcagacttttttaaagccaagcgatctgctgcttgcaagccatatgaaaaagcgccgtgccccaaatagccaggattccagaatatgtgatgatgaactacgttccttttaaagcacaccttgtccaatgagattcagttatatggtgagctcatgtcgaaggcacgtaatgctttagttgccactggattactggtcttcgctggtgctggcttatcatttccgttcctttttgtgaaatcaaagaacaggcctatcattgattcctcaaaacctctgccaccacaggctactttccgagggccatatgtgaatacgggatcacgtgatattggacctgatcctaccaactatcccaagaagtgatttaatcttccatgatgtttctaggtcccatttcactcaactcctctgctgtgaaatggtgttgtgtcaccttgtattttgtgcgttctgatcatggttcagtttggggacatcagattatgcatgtgtctggacattgcaatttttttagcaatacctaaaggaaggatgtttattgaagaccttgtataggggtaaagtttgcccaatattttatgagatatctattatctattcacagatccat

SEQ ID NO: 1481 - DNA, 474 bp, Triticum aestivum
gacgccgacaggtgtggccgtgtggtgcgcgagcacttgcgggggttcgcggcgccaggctgccagcgtgtggcctcccggctttccgccactgtcagttatatggtgagctgatgtcaaaggcacgtaatgctttagttgccactggattactggtcttcgctggtgctggtttatcatttccgttccttttcgtgaaatcaaagaacaggcctatcattgattcgtcaaaacctctgccaccacaggctacattccgaggaccatatgtgaatacgggatcacgtgatattggacctgatcctaccaactatcccaagaagtgatttaatcttccatgatgtttcgaggtcctgtgtgagctatgtggaaaagttttgagtctatgtaatttgcctcactcatatttggtccctgtatgagtgaggatcatgttttggaccaccctttttctctttaatacaatgaaacact

SEQ ID NO: 1482 - DNA, 1064 bp, Panicum virgatum
gcccatttacagcctaaacagcaactccacaagcctgcacgacgccaacgccacatgcccacacatcccttgcgccgccgccgcctcgccgcccgtctccctgccgccggctgtcgtgctcgtcgatctccccggccgacagccggtcccctttgtgtggcttccagtctctcgctgctctccctgcgctgagtagcgcgacccccggctcctcccgtcgcgacatcgtcgactccgttataaggagaactcatgtcgagggctcgcaatgctttagttgccactggcctgctgatctttgctggtgctggtttatcatttccattccttttcgtgaaatcaaagaacaggcctatcattgattcatcaaaacctctgccaccacaagccacattccgaggaccatatgtgaatactggatcacgcgatattggacctgatcctaccaactatcccaagaagtgatgtattctttcctgacatttgaggcctgttccctttcatctctttgggcagatcactaggcacaactctgaaatagtgtcatgttaagaataccttgtattatgtgtgtccttatcattcttgggtcttgcgacatctgtttgtgcatgtgccttgacaattaatttttttcagtatctcctatataaagaagggtggatattgaagaccttttggaagtgcaaagtttgctcaataggaaaatagtatatataagaagggtggatattgaagaccttttagaagtgcaaagtttgctcaatatgaaaatagtatatatacttttgtggatgcatatgattacttgtagatttaggagctccatctcatatatatactatgcagaaccagaatagccatgtgaattggctgtctagcacaatctgccgccctttatggtgtacagaccttattctgccaggtagctactgcccattagtatttttcaataacaatcatttcaggggctaaaagcagtagtcagagaatcatcttctgctgggcatattcatcctttatccaagcctactgtgctatatactatttgttaaattgctttt

SEQ ID NO: 1483 - DNA, 613 bp, Panicum virgatum
gacacatcccttgcgccgccgcctcgccgcccgtctccctgccgccggctgtcgtgctcgtcgatctccccggccgacagccggtcccctttgtgtggcttccagtctctcgctgctctccctgcgctgagtagcgcgacccccggctcctcccgtcgcgacatcgtcgactccgttataaggagaactcatgtcgagggctcgcaatgctttagttgccactggcctgctgatctttgctggtgctggtttatcatttccattccttttcgtgaaatcaaagaacaggcctatcattgattcatcaaaacctctgccaccacaggccacattccgaggaccatatgtgaatactggatcacgcgatattggacctgatcctaccaactatcccaagaagtgatgtattctttcctgacatttgaggcctgttccctttcatctctttgggcagatcactaggcacaactctgaaatagtgtcatgttaagaataccttgtattatgtgtgtccttatcattcttgggtcttgcgacatctgtttgtgcatgtgccttgacaattaatttttttcagtatctcctatataaagaagggtggatattgaagacc

SEQ ID NO: 1484 - DNA, 766 bp, Cynodon dactylon
cattagtattttgttatcatgaatccaagtgcattggccatctcttccttgaaaagaaatgataaggagacctcacctagtctccaggtactagtggttctaaattattctgctttatcaatcaaataggcacaatctcgtgccgatttgttccaaaaaaatgaaatggtaaggaactttgtgcctttctttttgtcaattttcctagatactatttccatagacaaataagtgacttcatggtcatacaatacgtattatagcttccactgtcctttgtattatgtgttacagcatttttgtaagtcttgatagcatatggtgcttttgtggtactttctatagttgacatatttttctgttctttcaaacagttataagtcgagcacatgtccaaggcacgcaatgctttagtagccactggcttattggcgtttgctggtgctggcttaacatttccattcttctttgtgaaatcaaagaacaagcccatcatcgattcttcaaaacctcttccaccacaagctacattccgaggaccttatgtgaatactggatcacgtgatattggacctgatcctactgactatcccaagaagtgatctgttgctaacatttgaggtggcattcgtcttttctgtatggatcttcgcatctaacagtccgaaactgtgctgatatcctttccttacatattgtagtgtttttgtgaatctgtgaatcctttccatggttggctttgaggacatgaatgtacatcctatca

SEQ ID NO: 1485 - DNA, 767 bp, Pennisetum glaucum
ctcgcccagcccatttacagcataagcaaaaactccataggcctgcacggacgacgccaacgccacaacccttgcgccgccgcctcgccgctcgtcgcgctgccgccggtggtcgtgcccgtcgatctccccttctacagcccagtcctgatcctacggctctgctgttctcctgacaatctctcgccgttcgacctgctctgaggagcgccgccacccggctcctcctcgccggcgttgccgcccatcgcgacatcgtcgacaccgtcacaaggagaactcatgtccaaggtgcggaatgctttagttgccactgggttgctgatctttgctggtgctggcttatcatttccattccttttcgtgaaatcaaagaacaggcctatcattgattcatcaaaacctttgcccccacaggctactttccgaggaccatatgtgaatactggatcacgcgatattggacctgatcccaccgattatcccaagaagtgatgtatgggacaccattactcctctctttggacacattaaaaaactgcacaacttcgaaataggaccgcttaagaatgtccttgtatcctgtgtgggccttgggatatctaatttggcatttgccttgacaatgaaatttcttcagtatctcctatatagagaaagggtgtatgttgattaccttttacaatgtattccaataaaagacaaacaacttattgaaagcagaattctgttaataatatgaataatttataaaaaaaagtactact

SEQ ID NO: 1486 - DNA, 1197 bp, Panicum virgatum
aaccagcacgtccagcgcgcgtaaaaagaccagagtactctgagccatccttcgcaggccactctagaattgcacgtagcgatttaaaaaaaaaaatagaattgcacgtagcccattccacaatttcatttggctggcccagcccatttacagcctaaacaaggcaactccgcaagcctgcacgacgccaacgccccatgcccacacatcccttgcgccgccgccacctcgccgcccgtctctctgccgccggctgtcgtgctcgtcgatctccccgccgacggccggtcccctttgtgtggcttccagtctctcgctgctctccctgcgctgaggagcgtcgatcccgggctcctcctcgccggcgtcgccgcccgtcgcggcatcgtcgactccgttataaggagaactcatgtccagggcacacaatgctttagttgccactggcttgctgatcttcgctggtgctggtttatcatttccattcctttttgtgaaatcaaagaacagggctatcattgattcatcaaaacctctgccaccacaggctacattccgaggaccatatgtgaatactggatcacgcgatattggacctgatcctaccaactatcccaagaagtgatgtattctttcctgacatttgaggcctgttccctttcatctctttgggcagatcacaaaagtgcacaactctgaaatagtgccatgttaagaataccttgtattatgtgcgtccttatcattgttgggtcttgcgacatctgtttgtgcatgtgccttgacaatgaattttttttcagtatctcctatataaagaagggtggacattgaagaccttttagaagtgcatagtttgctcaatatgaaaatagtatatatacttttgtggatgcatatatgactacttgtagttttaggagctccattgaaatgaaatatggatattgtagacctcatagaagtgtaaactttgctaattattttataggtatactattttttatggatgtttataggattagttgcatctcgtatgtattattaagcagaatctgaatagccatgtgaattggctgtctagaacaatctgccgccctttatggtgtacggaccttgttctgtcaggcagctactgccctttagtatttttcaatagtaatcatttcaggggctaaaagcaatacagactgagaa

SEQ ID NO: 1487 - DNA, 744 bp, Brachypodium distachyon
ccctcttcgccaattcattccccacgcaaagcaaagccctaacccgccggagcagcagcagcagcgaccgaccggcgaggcgcgggaccgacggcggccggcggtaagagcagttttgagccaagcacatgtccaaggcacgcaatgctttagttgccactggcttgttgatctttgctggttcaggcctggcgtttcccttctttttcgtcaaatcgaagaacaaacctattattgattcgtcgaagcctctgccaccgcaggctactttccgaggaccgtatgtgaacaccggatcacgcgacatagggcctgatcctaccgagtaccccaagaagtgatgttccctcgtgttatctcttatgggcagaaaaccattgtaacctgtaatgctgatttattattagcgagataatcatcttgtgatgttgggcaacgcattgcagtggtagattagttcctggtattctgtgcagaatgcttctatatatagtccttcatgattcctcccagcatcagtatttacgatctaaagatctcagctaatctctagcggctctaaagtgttctttgcttggagaatccacatggaattgaggtggaagatgcatgagcgtcgaccgtaccaccgctgtaaagactatattagctttgaataatgttggggcacatgctgacgttgttctgattggcttaactttgagcaactgatgaacttaattggagacctgtttcattgcaact

SEQ ID NO: 1488 - DNA, 688 bp, Hordeum vulgare
gtttttttttcttctttctctataatcaaatcggccattcaacgacgccccgctcgctccctcttccgtctctgcgccgtcgcggccatcgatcgacttcgaaggaggcgcggcctgcatcccccaccttccctcaaccaagtttttaactcaaccacatgtccaaggcacgcaacgccgtagttgtcactggcttggtgatctttgctggttctggcctagcatttcccttctactttgtgaaatcaaagaacaggcctattatcgattcgacgaagcctctgccaccgcaggctactttccgagggccgtatgtgaacaccggatcacgtgacatagggcccgatcccaccgagtaccccaagaagtgatatgtatttcgccatcttgttttctctttgttttcaatgggcatgcagaaaaccagtgaggcagtgagtggaaccctatgatgctggtttaccagtgggatgatgataatcggctcagtatgcgacctcgtagtggcagattagcttcggtttcaggtgttgtgtgcagagcgcatgtatttgtacctagttcttcatgaatcgtaggcgcttttgatcgtttcttgtgctccagtgactattccttccaaagcgctgtgccgctttatctcttttcggcaataaataaataaaatgtcaaagctactcaccctcgg

SEQ ID NO: 1489 - DNA, 1002 bp, Oryza sativa
aaaaaaggagatggagttctaaaatcattgtgcatcttcattctcccccgtcccctgcgtcaggggaaaaagagaacaaaaaaaaaaacaacacaaaacaaaaactcccgtctcgtctccgctccttgcgcctgcgccgatctccgtctcgcgagcagaatccagagcaaggggaagccgccgtcgtccgtcctgctgcatcctggtttttgagtcaagcacatgtccaaggcacggaacgttttagttgccactggtttgttggcctttgctggtgctggcttagcatttccattctattttgtgaaatcaaagaacaaacccatcattgattcatcaaagcctctacctccacaggctacatttcgaggaccatatgtgaatactggatcgcgggacattggacctgattataccgactaccccaagaagtgatctatctatccaaaaatcagagggactcttcttggacagatgatattgttagattattgggacctataactttgaagttgtactgacattgttatgtgtactgtagtcaaggattgggcttccagacttttgaatgttcatgcacccacccaagcagcgcaaaaccagcagtgaataattatttccagttgggactgtcttgtcctgtgcaagtgctcttatggagtttcaagaataattttagcacataggtttactatatattatcttttgttagttcatggaatttattttagggatgtctagtgtaggtgatgctacgtttgcgacaccattacagtttcaaacaaagtgctggttttcattttcttttatactgtgctagtattgatgctaacattagtgagcccagtgatacaaagatgagttgggaatttcaagaagcaaagttcacagttgaaagaatgcatgtaatctctctctctctctctctctctctctctctctctctcttttttccttttttttttttttttttttttttttttttttttttgcaaagagcat

SEQ ID NO: 1490 - DNA, 646 bp, Cynodon dactylon
aggttgagcacatgtccaaggcacgcaatgctttagtagccactggcttattagcatttgctggttctggcttagcctttccattcttctttgtaaaatcaaagaagaagcctatcatcgattcttcgaaacctcttccaccacaagccacattccgaggaccatatgtgaatactggatcacgttattggacctgatcctactgactatcccaagaagtgatctgttgctaacatttgagtgtttttgtgaatcggtgaatcctttccatggttggctttgagggcacatgaatgtacatccgatcacgttgcaaattaagtattgcgtacaataaaatgaagagtgtatactctagacctttgtttttgcgaattgggccttccattcatttaatcaacatccggattacaatctttagccagcaggatactaatgcaagaagggggttcatgccacatcctcgatctgacatctcctgagacttgtttagctaaattatgtgctactgcattacagactctactagcaaatttcatcacaaccttggaaaacagagctaatttctctaatctcctggagaattggctacacgctagaccgctgctccaatcctgcttcccaaagtttgatcagttcttggaat

SEQ ID NO: 1491 - DNA, 547 bp, Avena sativa
ggggtcctccaccggatcgaccaacgctccctctctgtgtcttcccccgcgacggcgacggagacggaggcggcgaccaggctccagcttctgtcaagttttaaggcaatcacatgtccagggcacgcaatgctgtagttgtcactggcttggtgatctttgctggttccggcctagcatttcccttctactttgtgaaatcaaagaacaaacctatcatcgattcttcgaagcctctgccaccgcaggctactttccgaggaccctatgtgaatactggttcgcgcgacatagggcctgatcataccgagtaccccaagaagtgatatctcctcttgttttttttttctggttttttaaatggtaggaaacaactggaacttgtaatgctggtttattaggccttgtaatcggcttgtgatgttggggcggatgggcaatgcaattgcagtagcagattggtttcagtttcagttgttacatgcagaatgcatctatatgtagtccctcatggattataagcgttttgatcgtttcttgtgctccg

SEQ ID NO: 1492 - DNA, 654 bp, Triticum aestivum
ctcgctgctctctctccctctctgtctcggcgccgccgcggccatcgatcgacctcgaaggaggcgcggcctgcagcctccaccttcgcccagtcaagtttctaaaacaatcacatgtccaaggcacgcaacgccttagttgtcactgggttggtgatctttgctggtactggcctagcatttcccttctactttgtgaaatcaaagaacaggcctattattgattcaacgaagcctctgccaccgcaggctactttccgaggaccgtatgtgaacactggatcgcgcgacatagggcctgatcacaccgagtaccccaagaagtgatatgtatttccatcttgttttctctttgttttcagtgggcatgcagaaaaccagtgagtggaaccctgtaatgctgatttaatagcgaggtggtgataatcggctcgtgatgctgggcaacgcgattgcagtgcattagcttcggtttcaggtgttatgtgcagagcacatgcatatgtacgcagttcttcatgaattgtaggctcttttgatcgtttcctgtgctccagtgactattccttccaaagcgttgtgccgctataggctatacctatgttaggcaataaaaaaaatgttgggtttgcgttgctgaaaaaaaaaaaaaaa

SEQ ID NO: 1493 - DNA, 632 bp, Triticum aestivum
tcggggggagggtctctaccccccaaaaaagaactctctctaatcgaatcggtgactccacgacgccccccgctcggcgctcgctgctctctccccctttccctctgtctcggcgccgtcgcggccatcgatcgacctcgaaggaggcgcggcctgcagcctccaccttcgctcagtcaagtttctaaaacaatcacatgtccaaggcacgcaacgccttagttgtcactggcttggtgatctttgctggtactggcctagcatttcccttctactttgtgaaatcaaagaacaggcctattatcgactcaacgaagcctctgccaccgcaggctactttccgaggaccatatgtgaacactggatcgcgcgacatagggcctgatcacaccgagtaccccaagaagtgatatgtattttcatcttgttttctctttgtttttcaacgggcatgcagaaagccagtgagtggaaacctgtaatgttgataaccggctcgtgatgtgctgaacacatgcatctgtgcgtagttcttcatcaactgtaagcgcttttgatcatttcttgtgctccactgactactccttgcaaagcgctatgccgctgtaccttttttaggcaataataaggaa

SEQ ID NO: 1494 - DNA, 543 bp, Elaeis guineensis
cgcgccctttctcgggtttcgcttctcacttcacccgttttcacattagcgtttctccccccgccccaggatcctcaggtaccaattcgaggtttctccccccaccccgggatcctcagtttggatgtcccggttacgtaatgtagtgatggcaacaggcttattagcctttgcaggtgctggcttgtcatttcccttcttcttcgtgaaatcaaaaaataaacctgtaaccgattcatcaaagcctctgccaccacaggctacttttcgagggccatatgtgaacactggatctcgtgatattgggccagactcttccacctatccaaaaacataaattgcttgtctgatcacagtctcttttcacttatagagaaaccatcttctgggaaaaatatcttgtgcttttctgtattaataatttgagaaaatatattcttgttattgtagtgtcatcaatagctttcttcttgttctctatttgatttctttttatgcattaatgtgagaatggacaagttaactaattatggattcagggaa

SEQ ID NO: 1495 - DNA, 459 bp, Zostera marina
cggcgcatgtggttttcgattctgctttcatcggcgtcagtttcttcttcaaagaacaaacatttgtaaaaatttcaaatgtcgcgactacgaaatgtattagtagccactggattgctggtatttgcaggaggtggtttagcttttcctttcttctttgtgaaatcgaagaacaaaccgataattgataacacaaaaccgctgccacctcaggctacttttcggggtccttatgttaatactggatcacgcgatgttggtccagacagctcgacttactcaaaaaaatgaggtaaactcaatggaatggtattgtttttattctgggttttaggtttaattgtattcattgtacatcacattttaatttactacaataattaattccaacacaagtagaataaaatactcttggaccttggctttttttgttaaaatattcataataatctatctgta

SEQ ID NO: 1496 - DNA, 1518 bp, Sorghum bicolor
gaatctgaaaaattttgtaaaatttttgaggaactaaacaaggcctctctcagagagagagagagagagagagagcagcaggcagccccccccaacggctggctcgcgagaatcgagtcggtctctgcacgcgcttccaaggtattagctgctccatcagggcagcgatagtcaagttctgttctactggaggaagaagagcagggaagggagcaagatggggtccggatctttcctcaaggtgctggctaacaacttcgatgtcctagcagggccactcatatcacttgcatatcctctatatgcttctgttagagcaatagagaccaaaaatcctgtagatgaccagcagtggctcacttactgggtgttgtactcatttatcactttgtttgagctaacttttgctccaattatcgagtggcttccattttggtcatatgcaaagttgttctttaactgctggttggtcttaccttggttcaatggtgctgcttatgtttacgaccattttgtgcggccaacgtttgtgaaccgccaaatagtgaacatatggtatgttccaaggaatgagaagctaggtaaatctgatgatgttctgtcagctgcagagagatatattgagcaaaatggaccggaagcatttgagaagctcatcagcaagtctacaaagtcttcaaaatcaaggaacacaaagcggtcgatcttggaggaggcagaggctgaaaacagagctaaggctgaaagagaatcgtgggatgaaaatcccttctacgacaaaaattacagatactaaaccacgtccactcggcagcttgaagacggaccttgcttatgagccccatgcgagctttagccgcgtcacagactgaagacgactttcccatatttctgactcagtactgtaccttgttacatccactgctactaaacaatgagttatagagcaattgtggactgtaaatggaggtagttgctagcgatgattatttatgtgagcttttgtatattatatacagtggagtagtggactgcgttcatcttctgcgtttctcccttctggccgtctgctcttttggaatttcgagcgaacagatttcagcacctcgtgatttttttttaagaaatttgctatttcagtcaccagatttcttccaagaaatatgtcgagtttcttgcctcacgattcagcaaagagattcgtgctcacttctttgtcttccatctccgatgatcttcatcaactaaggtggagttgaaggtttattatgggtttagggttgtggagattttgtacggtttctcagttgtaagggatgccccgggaggccgtctgtccagcgggtgtggtgggtcagtggctggcgtgcgagatatcttcctaagcaaattagctgatatccattactcatatccaaggccttgtttagttccaaaatttttggcaaaatgtgaatagtaccaattttatttgtatttaacaaatattgtccaatcatggactaactaagctcaaaa

SEQ ID NO: 1497 - DNA, 1169 bp, Zea mays
gcatatttcttccgcattgacggtggggcccgacgccggccacaccgccacagagagaaacgttaggacagactgactggttgagaattgagaaccaaaagaagagagaggaagacaggaagagagagagagagcgcgcgcttccaggtttttagctgcaggggaggccgatagttctgttctactggaggaggagcagagagcaagatggggtccggatctttcctcaaggtgctggccaagaacttcgatgtccttgccgggccactcatatcacttgcttatcctctatatgcttctgttagagcaatagagacaaaaaatcctgtagatgatcagcagtggctcacttactgggtgttgtactcatttgtcactttgtttgagctaacttttgctccaattatcgagtggcttccattttggtcatatgcaaaactgttctttaactgctggttggtcttaccttggttcaatggtgctgcttatgtttacgaccattttgtgcggccaatgtttgtgaaccgccgaatagtgaacatatggtatgttccaagaaatgagaagctaggtaaatctgatgatgtgctgtcagctgcagagagatatattgaacaaaatggacctgaagcatttgagaagctcatcagcaagtctaccaagtcttcaaaatcaagaagcacaaagcggtcgatcttggaggaggcagaggctgaaagagaatcatggggtgaaaatcccttctacgacaaaaattacagacactaaacctcttcaaaatccacctagcagcttgaagacaacctttgcccacgagcctcatgcaagctttttagttgcatcagactgaagacgaccttcccaaatttctgactctcagtatactataccttgttacattcactgccagtctgtcgctggacaatgatgagttctagagcaattgtggactgtgtttgtaaatggaggcagatgctagcgttgatcatttttcactgtacgtttcttccttctggttggtggtacgtgctctgctgcaatttcaagcgaacagatttcagcacctcgtgtcattttttttagaaatttgttatttctgtcaacggatttcttccaaggtgtatgtcaagtttcttacctcacgattcaggatattagattcacgctga

SEQ ID NO: 1498 - DNA, 1190 bp, Panicum virgatum
cggtgaccgcttatttcttccgcattgacggcggggcccgccgccggccacagagagaaacgttaggagtggaggacagccacaaggagaaaaagaagagaaagcagggcagagaaaagagagcctgcctgccagccttctcgaaacagcacggcagctccctgcctccccaacggctggctcgcgagaatccaagccattttctgcacgcgctcccgggtttcagctccggcgccatcagggcaggggggagcgatagttctgtgctattgggagaggagggtgaggaggaggaggttgcgagatggggtccggatctttcctcaaggtgctggccaagaacttcgacgtgctcgccgggccaataatatcacttgcttatcctctgtatgcttctgttagagcaatagagacaaaaaatcctgtagatgatcagcaatggctcacttattgggtgctgtactcctttatcactttgtttgagctaacttttgctccaattattgagtggcttcccttttggtcatatgcaaagctgttcttcaactgctggttggtcttaccttggttcaacggtgctgcttatgtttacgaccattttgtgcggccaatgtttgtgaaccgccaaatagtaaacatatggtatgtcccaagaaatgagaagtcaagtaaacctgatgatgtactgtcagctgcagagagatatattgaacaaaatggaccagaagcatttgagaagctcatcagcaagtctacaaagtcttcaaaatcaaggaccacaaggcgttcgatcttggaggaggctgaggctgaaagagaatcctggggtgaaaatcctttctacgacaaaaacttccgacactaaactacttgaaggcgaattccccagttttctgttagtgttatggattttcaattgcgagatttccttgacaacatgcgcttcatgcagccttgctgggccacacggcctcgagacgaccttcatgtattcctgacttgaggactgtaccttgttgcatccactgctagcaattgtggactctactgtaaatggaggtagatgctagcgttgctgatttatgtgagcttttggctggtgtaatatcaacaacatcgcctgtgttactaaaccttcaggaggatacaagcctagatttttcagtttccatttcgttctgagcattttt

SEQ ID NO: 1499 - DNA, 1217 bp, Panicum virgatum
cggtgacagcatatttcttccgcattgacggcgcggggcccgccgccggccacagagagaaacgttgggagtggaggacagccacagggagggagagaaaaagaagagaaaggagggggagagaaagggagcctgctgccctgcctgccttctcgaaacagcacggcagctgcgggctgcggcagcttgacagctgcctgcctctccaacggctggctcgcgagaatccaagccattttctgcacgcgctcccaggttctagctccggcgccatcagggcaggggggagagcgatagttctgtgctattggaaggggagggggaggaggaggttgcgagatggggtccggatctttcctcaaggtgctggccaagaacttcgacgtgctcgccgggccaataatatcacttgcttatcctctgtatgcttctgttagagcaatagagacgaaaaatcctgtagatgatcagcaatggctcacttactgggtgctgtactcgtttatcactttgtttgagctaacttttgctccaattattgagtggcttcccttttggtcatatgcaaagctgttcttcaactgctggttggtcttaccttggtttaacggtgctgcttatgtttacgaccattttgtgcggccaatgtttgtgaaccgccaaatagtaaacatatggtatgtcccaagaaatgagaagtcaagtaaacctgatgatgtactgtcagctgcagagagatatattgaacaaaatggacctgaagcatttgagaagctcatcagcaagtctacaaagtcttcaaaatcaaggaccacaaggcgttcgatcttggaggaggctgaggctgaaagagaatcctggggtgaaaatcctttctacgacaaaaatttccgacactgaactacttcaagtccactcagcagccttgctgcgccacacagcctggagacgaccttcatgtattcctgacttgaggactgtaccttgttgcatccactgctaaactacgatcagttctagagcaattgtggactactgtaaatggaggtagatgctagcgttgctcgtttatgtgagctgttggccggtgtaatatcaacaacaacgcctgtgttactaaacctttaggaggatacaagcctagattttcagtttccatttcgttctgagcatatatatagtcggcttgttgcatttcttgcgcttctccgttctac

SEQ ID NO: 1500 - DNA, 1060 bp, Panicum virgatum
ggaaacagcacggcagctgcggcagcttgatagctgcctgcctctccaacggctggctcgcgagaatccaagccattttctgcacgcgctcccaggttttagctccggcgccatcagggcagggggagagcgatagttctgtgctattggaagaggagggggaggaggaggttgcgagatggggtccggatctttcctcaaggtgctggccaagaacttcgacgtgctcgccgggccaataatatcacttgcttatcctctgtatgcttctgttagagcaatagagacgaaaaatcctgtagatgatcagcaatggctcacttactgggtgctgtactcgtttatcactttgtttgagctaacttttgctccaattattgagtggcttcccttttggtcatatgcaaagctgttcttcaactgctggttggtcttaccttggtttaacggtgctgcttatgtttacgaccattttgtgcggccaatgtttgtgaaccgccaaatagtaaacatatggtatgtcccaagaaatgagaagtcaagtaaacctgatgatgtactgtcagctgcagagagatatattgaacaaaatggacctgaagcatttgagaagctcatcagcaagtctacaaagtcttcaaaatcaaggaccacaaggcgttcgatcttggaggaggctgaggctgaaagagaatcctggggtgaaaatcctttctacgacaaaaacttccgacactaaactacttgaaggcgaattccccagttttctgttagtgttatggattttcaattgcgagatttccttgacaacatgcgcctcatgcagccttgctgggccacacggcctcgagacgaccttcatgtattcctgacttgaggactgtaccttgttgcatccactgctagcaattgtggactctactgtaaatggaggtagatgctagcgttgctgatttatgtgagcttttggctggtgtaatatcaacaacatcgcctgtgttactaaaccttcaggaggatacaagcctagatttttcagtttccgtttcgttctgagcat

SEQ ID NO: 1501 - DNA, 780 bp, Cynodon dactylon
aatctctgccactttccgcacgcgcttccagggtttcggctgcggcgggcggaaccactccacggggagggagacggggacggagtgagcggaggaggaggacgagggtgctgcgagatggggtccggatctttcctcaaggtgctggtcagcaacatcgacgtgctcgccgggccattaatttcacttgcttatccactatatgcttctgttagagcaatcgagacgaaaaatcctatagatgatcagcaatggctcacgtactgggtgttgtactcctttatcactttgtttgagctaacctttgctccaatcattgagtggcttcccttttggtcatatgcaaagctgttcttcaactgctggctggtcttaccttggtttaatggtgctgcttatgtttatgaccattttgtgcgaccaatgtttgtcaatcgtcaaatagtaaacatctggtatgtgccaaggaaggagaagttcagcaaacctgatgatgtactctcagctgcagagagatatattgaacaaaatgggacagaagcatttgagaagctcatcagcaagtctacaaagacttcaaaatcgaggggcacaaggcgatcaatcttggaggaggcagaggctgaaaacatagccaaggctgaacgagaatcatggggtgaaaatccattctacgacaaaaattattgacactaaacaactcgacatccacccagcagccttattgtatcagcctgaagatgacctttccccgtgtctgacttgagcattttaccttta

SEQ ID NO: 1502 - DNA, 1248 bp, Setaria italica
gtcggtggccgcacattcttccgcattgacggtagggcccgccgccggccacagagagtaacgttaggaggagtggagggcagggagggaggaaaagaagagaaaggaggagagagaaagcgagcctgcctctgcctgcctgccttctcgaaccaggcggccgcccccaacggccggctcgcgagaatccgagccattttgtgcacgcgcttccaggttttagctgcggcggcaccagggcagggggagagagagagttcgtgctattggaagaggaggaggcggcgagatggggtctggatctttcctcaaggtgctggccaagaatttcgacgtgctcgccggaccaataatatcacttgcttatcctctatatgcttctgttagagcaatagagacgaaaaatcctatagatgatcagcaatggctcacttactgggtgctgtactcatttatcactttgtttgagctaacctttgcaccaattattgagtggcttcccttttggtcatatgcaaagctgttcttcaactgctggttggtcttaccttggttcagcggtgctgcttatgtttacgaccattttgttcggccaatgtttgtgaaccgccaaatagtaaacatatggtatgtcccaagaaatgataagccaagtaaacctgatgatgtactgtcagctgcagagagatatattgaacaaaatggaccagaagcatttgagaagctcatcagcaagtctacaaagtcttctaaatcaaggaccacaaggcggtcgatcttggaggatgctgaggctgaaagagaatcctggggtgaaaatcctttctacgacaaaaactaccggcactaaactacttcgagtttaatcagcagtcttgttgggtcacagcctggagacgaccttcccatgttcctgactcgaggactgtaccttgttgcatccactgctactaaactacgatgagttgtagagcaattgtggactactgtaaatggaagtagatgctagtgttgctcgtttatgtggggttttcgatggtgtaatatcgttattactcgttactagatctttagcaggatacaagcctagattctcagtccgcctccgccgttgcatttcctgcgttgctccgttctacgtgtgctctgcaggaatttcgcacgctcctgaatttcattcttaccgtgcacacatgggggctccgcttgaattcttaccaaagtaaattaactgttttttgtgttttt

SEQ ID NO: 1503 - DNA, 1171 bp, Eragrostis curvula
  misc_feature (840)..(841): n is a, c, g, or t
  misc_feature (845)..(846): n is a, c, g, or t
  misc_feature (858)..(858): n is a, c, g, or t
  misc_feature (893)..(893): n is a, c, g, or t
  misc_feature (1065)..(1065): n is a, c, g, or t
ggggggggaggggggtgaaatgggatccggatctttccttaaggtgctggtcagcaacatcgacgtgctcgcagggccactgatttctctggcttatccactatatgcttcagttagggcaattgagacaaaaaatcctatagatgatcagcaatggctcacttactgggtgctgtactcgtttatcaccttgtttgagctaacctttgctccaatcattgagtggcttcctttttggtcatatgcaaagctgttcttcaactgttggttggtcttaccttggtttaatggcgctgcttatgtttatgatcattttgtgcggccaatgttcttgaaccgtcagatagtgaacatatggtatgtgccaaggacggagaagtcaagtaagcctgatgatgtactctcagctgcagagagatacattgaacaaaatgggccagaggcatttgagaagctcatcagcaagtctacaaaggcatcaaaatcaaggggcacaaggcgatctatcttggaggaggctgaacgagaatcatggggcgaaaatccattctacgacaaaaattatcgtcactaagtaactcaatgtacaccagcagccttactggatcagcccagagacgacctttccgcatttctgacttgagcactgtaccttactgcatctactacgattcatatgctgggttatggactgctgtaaataggtgctagtgttgatgattcatgcgagctttcagatgctgtaatgtcattgctactcgtcttagttattcacgccttgactcgtgtcattgtcattgctagactttaactagatacaagccttgatttgtggtttcnnagannaaaaaaaaaaanaaaacaacggaaaaaaaacaagagaaacaaaaaangagggttcctccgggtttaaaccccggcttaaaccaaaaaaaaatcccccgcccccccggcggcccccaaaggggaaaaccccccccccggtgggaaaaaacaaattggaaaatataaaaggggccccaaaaacggggggggaaaccgggggaaaaaaatttataaaaaaanggggggggcagcatatacccccgcgccgccggggggccgcggggggggagataaggacccccatcctcctctacttggcctccttaaaatattttggggggacttt

SEQ ID NO: 1504 - DNA, 663 bp, Pennisetum glaucum
tccgagccatttttctgcacgcgctaccaggtttttagctgcggcggcacacaaggagagagataattcgtgctattgcaagaggaggaggaggcggcgacggcggtggcggcgggatggggtccggatctttcctcaaggtgctggcgaagaacttcgacgtgctcgcggggccaatattatcacttgcttatcctctatatgcttctgttagagcaatagagacgaaaaatccaatagatgatcagcaatggctcacttactgggtgctctactcatttatcactttgtttgaactaacctttgcaccaattattgagtggcttcccttttggtcatatgcaaagctgttcttcaactgctggttggtcttaccttggttcagtggtgctgcttatgtttacgaccattttgtgcggccaatgttcgtgaaccgccaaatagtaaacatatggtatgtcccaagaaatgataatccaagtaaacctgatgatgtactgtcagctgcagagagatatattgaacaaaatgggccagaagcatttgagaaactcatcagcaagtctacaaagtcttctaaatcgaggaccacaaggcggtcgatcttggaggaggcggaggctgaaagagaagcctggggtgaaaatcctttctacgacaaaa

SEQ ID NO: 1505 - DNA, 1452 bp, Oryza sativa
gaatctcactgtcactgacaccaccagcggcagagtagctgacctgaccgaccagccatggccatgaacagcggagagaaaggaggagaaaagtagtaaagaggaaaggggggagtgagtctcccgagcaacggctctccactactagcccacagctcccaagaatctctgccatttcttgagctggtcgatccatcggggagggagagaggtcgaggaggcggcggaaggggagaggatggggtctggatctttcctcaagctgctggccaacaacttcgacgtcctcgccgggccattagtttcacttgcttatccattatatgcctctgtgagagcaatagaaacaaaatctcctgttgatgatcagcaatggctcacttactgggtgctgtactcgtttatcactttgtttgagcttacttttgctccagtaattgaatggcttcctttttggtcctatgcaaagttgttcttcaactgctggttggtcttaccttgcttccatggtgctgcttatgtttatgatcactttgtgcggccaatgtttgtgaatcgtcaaatagtaaatgtctggtatgttccaagaaaagaaaacctgagtaaacctgatgatgtgctatcagctgcggagagatatattgaacagaatggaccagaagcatttgagaaactcatcagcaagtctacgaggccttcaacctccaaaagaagcacaaagcaatctatcttggaggaggtagaatctgaacacatggccagggctgaaagagaatcatggggcgaaaatccattctatgataaaaattatcgatgctagaacaatctgttgttcacgaccacatactcatcaggttgccggcttatctgggttgaggataaagctttccatgtatctgacttcaggatttgtactttgatgcatcatgcatccactgaatgtcattcagtcccagttcccagaaccaattgtgcattggctgaactattgtaaataggtgctagtgttgacaatatcccttagttcttaaatgatgttatgtaattctgttaatctgccttgcgtggtagtgacaacctctggacttggttggcagttatatttttcccttcttggagaagggccagaattcaaaaatagtcctgatatctatattctactgcttgcaaggcagaggagctgttgacatcccctgcatgatcagtctactctgtcattacatagcacattgttcacctgagtacagctagatcaactcttgcctgatgcctgacggtgacacggagttggctgttaatcacagctttccatctctgtacaacaggtggatgctgacatattttgtttggttgttaagctcactacagacagttgcattcaactcagcccgatttacagttctcaatttgcgttgaatttatttaagacttccctatgaagtttccaaacag

SEQ ID NO: 1506 - DNA, 837 bp, Saccharum officinarum
acgaaaagaagagaaagggagagagagagcgcgctcgaactagccaggcatcccccaacggctggctcgcgagaatcggagtctatttctgcacgcgcagacgcgcttccaggtttagctactccatcagggagggggagagcgatagttctgttctactggaggaagagagcagggagcaagatggggtccggatctttcctcaaggtgctggccaacaacttcgatgtccttgccgggccactcatatcacttgcttatcctctatatgcttctgttagagcaatagagacaaaaaatcctgtagatgatcagcagtggctcacttactgggtgttgtactcatttatcactttatttgagctaacttttgctccaattatcgagtggcttccattttggtcatatgcaaagctgttctttaactgctggttggtcttaccttggttcaatggtgctgcttatgtttacgaccattttgtgcggccaatgtttgtgaaccgccaaatagtgaacatatggtatgttccaaggaatgagaagctaggtaaatctgatgatgttctgtcggctgcagagagatacattgaacaaaatggaccggaagcatttgagaagctcatcagcaagtctacaaagtcttcaaagtcaaggaacacaaagcggtcgatcttggaggaggcagaggctgaaaacagagctaaagctgaaagagaatcgtggggggaaaatcccttttacgacaaaaattacggttctaaacccacgtcaaaattcactaagcagcttcaaacgacctttgctcacgagcctcatgccgagcttttacccacttct

SEQ ID NO: 1507 - DNA, 983 bp, Leymus cinereus x Leymus triticoides
gaggggaaagcgagtggacttgaggaagcagcaggggtaggagggagcctagaggggagggtgcgagagagatggggtccggatctttcctcaaggtgctggccaagaacttcgacgtcctcgccgggccactagtttcgcttgcttatcctctatatgcctctgtgagagcaattgaaacaaaatctcaagtagatgatcagcaatggcttacttactgggtgctgtactcgtttatcactttgtttgagctcacttttgctccgatacttgaatggcttccattctggccctatggaaaactgttcttcaactgctggctagtcttaccttgtttcaatggtgctgcttatgtttacgagcattttgtgcggccaatgtttgtgaatcgccaaatagtcaacatctggtacgtcccaaggaaggataagttaagtaaacctgatgatgtactctcagccgcagagaaatatattgaactaaatggaccagaagcatttgagaagctaattagcaagtctacaagtacaaagccttcaaagtttaggagcacgaggcgatcgatcttgcaggaggtggaagctgaaaagatgggcaaggctgagagagattcatggggtgaaaatccattctacgataaaaattaccgacactaaatcagtcttcttggattctgcctgatgaagagcttttccacgcacatgctcgaggattgcatgatgtgtctaccaaatcgtcattggtaccagaacaactatgcgacggctgaattcttgtaaataggtgccagcgttgacatgttcccagatgatttaatgttgtcttgcatattagtaacagatttggctagacaaactgatcatgtgcctttactagacatcgcctgcttcgaacatgcgatttcctgtgtgttagtgagggaaagttgtgcgtttcaaacattccgaagatttctctagaattaagaacttcaaatcggcgca

SEQ ID NO: 1508 - DNA, 1193 bp, Triticum aestivum
cgagagctgtggagagaaaactagagaaaagacgagtggaaaggaaagcgcgtgtaccaaacaccaacggctcgcaaaggaggagaatctgctcccattactgtgcgcacgccccgtcggcggcgcactagggtagtagtaggtgctacggaggggagagcgagtggagtcgaggaagcagcagggatagcaggaggagcgtaggaggaggggaggggtgcgagagagatggggtccggatctttcctcaaggtgctggccaagaacttcgacgtcctcgccgggccactagtttcgcttgcttatcctctatatgcttctgtgagagcaattgaaacaaaatctcaagtagatgatcagcaatggcttacttactgggtgctgtactcgtttatcactttgtttgagctcacttttgctccgatacttgaatggcttccattctggccctatggaaaactgttcttcaactgctggctagtctttccttgcttcaatggtgctgcttatgtttacgagcattttgcgcggccaatgtttgtgaatcgccaaatagtcaacatctggtacgtcccaaggaaggagaagttgagtaaatctgatgacgtactctcagccgctgagaaatatattgaactaaatggaccggaagcatttgagaagctaattagcaagtctacaagtacaaagccttcaaagtttaggagcacgaggcggtcaatcttgcaggaggcggaagctgaaaagatgggcaaggctgagagagattcatggggtgaaaatccattctacgataaaaattaccgacactaaatcagtcttcttggattctgcctgatgaagagctttccacgcacgcgcttgaggattgcatgatgcgtctaccaaatcgtaattggtaccacaagaactatgtgacggctgaattcttgtaaataggtgccagcattgacatgttcccagatgatgtaatgttgtcttgcatattagtaacagatttggctagacaaactgattatgtgcctctactagacatcgcctgcttcgaacatagcgatttcctgtgtgttagtgcggggaagttgtgcgtttcaaacattctgaagacttttttagaattaagaacttcaaatgggcgcaaagatctatttatttttgttatgtctaagttatgaaaaatgcagctttgtact

SEQ ID NO: 1509 - DNA, 1107 bp, Pseudoroegneria spicata
ccgttgctgtcgaccaaacaccaacggctcgcaaagaagaggaatctgctcccattactgtgctgtgcgcacgccccgacggcgccgcactagggtagtagtaggtgctggaaccaggaggggggagcgagtggagtcgaggaagcagcaggggtaggaggagcctaggaggaggggagggtgctccgcgagagagatggggtccggatctttcctcaaggtgctggccaagaacttcgacgtcctcgccgggccactagtttcgcttgcttatcctctatatgcctctgtgagagcaattgaaacaaaatctcaagtagatgatcagcaatggcttacttactgggtgctgtactcatttatcactttgtttgagctcacttttgctccgatacttgaatggcttccattctggccctatggaaaactgttcttcaactgctggctagtcttaccttgcttcaatggcgctgcttatgtttacgagcattttgcgcggccaatgtttgtgaatcgccaaatagtcaacatctggtacgtcccaaggaaggataagttgagtaaacctgatgatgtactctcagccgcagagaaatatattgaactaaatggaccagaagcatttgagaagctaattagcaagtctacaagtacaaagccttcaaagtttaggagcacgaggcggtcaatcttgcaggaggcggaagctgaaaagatgggcaaggctgagagagattcgtggggtgaaaatccattctacgataaaaattaccgacactaaatcagtcttcgtggattctgccttgatgaagagctttccatgcacgtgcttgaggattgcatgatgcatctaccaaatcgtcattggtaccagaacaattatgcaactgctgaattcttgtaaataggttccatcgttgtcatgttcccagatgatgtaatgttaccttgcatattaggacagaagcatttggcaaactgatcatgtgcctttactagacatcgcctgcttcgaacatagcgagttcctgtatgttggtgcgggaaagttgtgtatttcaaacattctgaagacttttctagaattaagaacttcaaatggtcgca

SEQ ID NO: 1510 - DNA, 1201 bp, Cenchrus ciliaris
  misc_feature (693)..(693): n is a, c, g, or t
  misc_feature (715)..(715): n is a, c, g, or t
  misc_feature (784)..(784): n is a, c, g, or t
aagaagagagagagagaaagcgctgcctgccagccttctcgaaccaggcggccgcccccaacggctggctggctcgcgagtatcccagccatttttctgcacgcgctaccaggtttttagctgcggcggcaccagagagagagagagagagagagagattagttcgttcgtgctattggaagaggaggcggcggcgagatggggtccggatctttcctcaaggtgctggccaagaacttcgacgtgctcgccggatatgcttctgttagagcaatagagacgaaaaatcctatagatgatcagcaatggctcacttactgggtgctgtactcatttatcactttgtttgagctaacctttgcaccaattattgagtggcttcccttttggtcatatgcaaagctgttcttcaactgctggttggtcttaccttggttcagtggtgctgcttatgtttacgaccattttgttcggccaatgtttgtgaaccgccaaatagtaaacatatggtatgtcccaagaaatgataagccaagtaaacctgatgatgtactgttggctgctgagagatatattgaacaaaatggaccggaagcatttgagaagcttatcagcaagtctacaaagtcttctaaatcaaggaccacaaggcggtcgatcttggaggaggcagaggctgaaagggactcctgnggtgaaaaccctttctacgacnaaagctaccgtcactaaactacttaaagtttaatcaacaggttagtgcaatcagaatgccaaggcgatntcccagtacttgtgtttgtcttctgtattttcaattgcaagattttccttgacaagccgttaccacacacctcattgcagccttgttgggtcacagcctggagacgaccttcccatgttcctgacttgaggactgtaccttgttgcatccactgctactaaactaagatgagttgtagagcaattgtggactactgtaaatgaaggcagatgctagtgttgctcgtttacatgggttttcgatggtgtaatatcgttgtcactcgttctggacctttagcaggatacaagcctagattttcagtttccatttcattctgagcatctagtccgcctccgctgttgcatttcctgtgctgttgtcccgttgtacgtatgctctgcaggaatttcacacgaaaatgcattctcctgaaca

SEQ ID NO: 1511 - DNA, 1263 bp, Hordeum vulgare
gtcggccataagcaaggagcgagaagcgtctcagaaaagaggccgaagaaagagtatctggcgcaaagaaaagaaaactagggcgagagagtaataaactagagaaaagacgagtgaaaaggaaagcgcgtgtaccaaacaccaacggctcgcaaaggaggagaatctgctcccattactgagctgtgcgcacgccctgacggcgccgcactagactagagtaggtgctgctgcggaaccaggaggggagagcgagtggaggagaggagggtgcgggagagagatggggtccggatctttcctcaaggtgctggccaagaacttcgacgtcctcgccgggccactggtttcgcttgcttatcctctatatgcctctgtgagagcaattgaaacaaaatctcaagtagatgatcagcaatggcttacttactgggtgctgtactcgtttatcactttgtttgagctcacttttgctccgatacttgaatggcttccattctggccctatggaaaactgttcttcaactgctggctagtctttccttgcttcaatggtgctgcttatgtttacgagcattttgcgcggccaatgtttgtgaatcgccaaatagtcaacatctggtacgtcccaaggaaggataagttgagtaaacctgatgatgtactctcagccgcagagaaatatattgaactaaatggaccagaagcatttgagaagctaatcagcaagtctacaagtacaaagccttcaaagtttaggagcacgaggcggtcgatcttgcagggggcggaagctgaaaagatgggcaaggctgagagagattcatggggtgaaaatccattctatgataaaaactaccgacactaaatcagccatcttagattctgcttgatgaagagctttccacgcacgatgcttgaggactgcatgacgcatctaccaaatcgtcattggtaccagaacaactatgcgacggttgaattcttgtaaataggtgccagcgttgacatgttcccagatgatgtaatgttgtcttgcatattagtaacagatttggctaggccaacttatcatgtgcctttactagacgtcgcctgcttcgaacatagcgatttcctgtgtgcggggtaattgtgcgttttaatttaaacattctgaagacttttctagaattaagaacttcaaatggacgtttatgatgtcaagcaattccagctttgatcaaaatgtcctggtcctgcacataatattacatatttttt

SEQ ID NO: 1512 - DNA, 1069 bp, Avena sativa
gaagaatctgctcccattactgtgctccgacggcgccgcactagactctctgagctgcctccggaaccagctcaagggaggggagaccggggccggggggatttggtggaaccgtggaaagcagagtgcagggcgcgagatggggtccggatctttcctcaaggtgctggccaagaacttcgacatcctcgccgggccactagtttcacttgcttatcctctatatgcctctgtgagagcaattgaaacaaagtctcaagtagatgatcagcagtggctcacttactgggtgttgtactcatttatcactttgtttgagctcacttttgctccaatacttgaatggcttcctttctggccctatggaaagttgttcttcaattgctggctagttttaccttgcttcaatggtgctgcatatgtttacgagcattttgtgcggccaatgtttttgaatcgccaaatagtaaacatctggtacgtcccgagaaaggataagtcaagtaaacctgatgatgtactctcagctgcagagaagtatattgaactgaatggaccagaagcatttgagaagctaattagcaagtctacaaagccttcaaactttaggagcaagaggctgtcggtcttgcaggaagcaaaagctgatagagcaggcaaggccgaaagagaatcctggggtgaaaatccattctatgataagaattaccggcactaaaatggcctatccttttcagccatccactcatcaggcttcgtggatgtgcccgaggagaggagctttccacgcatctcaacttgaggactgtactctgatgcgtccactatattgatatcttgttctggaactatgggatggttaaatttggttgtaaataggtgcgggtgttttgacaatttcccttgtgatttaggtgttgtaatgttgacttgtgtgtcgtagtgacagctttggcggtcaaattggtcatgtggaaggttaaatagcaacgactgttggattggtggtgtccgtgtttccatctgctctgcatccgccgtaatcagacatttcttgcttggaagattg

SEQ ID NO: 1513 - DNA, 1253 bp, Brachypodium distachyon
gccctgccaaacagagaacaccaacggctcggaagaatcttctccccctccactattacccgcacgctccgacgaacgccgcactagactctgagctgaaaccagggaggggtgagcgagggaactcggggaagcaggaggaggacggggaaaggtgcgagaacaccgagatggggtccggatctttcctcaaggtagtggccaagaacttcgacatcctcgccgggccagtaatttcacttgcttatcctctatatgcctctgtgagagctattgaaacaaaatctcaagtagatgatcaacagtggctcacttactgggtgttgtactcatgtatcactttggttgagcttacttttgctccagtaattgaatggcttcctttctggccctacgcaaagttgttcttcaactgctggctagtattaccttgcttcaatggtgctgcttatgtttaccagtattttgtgcggccaatgtttgtgaatcgccaaattgtaaacatatggtatgtccccagaaaggacaaattaagtaaacctgatgatgtactctcagcggctgagagatatattgagctaaatggaccagaagcattcgagaagctaattagcaagtctacaagggcttcaaactctaggagcatgaggcggtcaatcttgcaggagtcagaagctgataagataggcaaggctgaaagagaatcgtggggtgaaaatcccttctacgataaaaactaccgacactaaacagcctgttcttcttggccatccatctcatcagtatgtttggatctgccagaggaagagcttttcacacatctaactggaggatcttacttgacacgcctactaaatcgacatccagaacaaatacaatgtttcttgaaaatgggtgcttgtgttgaaaatttcccaggttcttagatgatgtaatatgttgcattgtatgttcgtgctagctttggttagataattttttttgacgccaattggttagacaaattggtcctgtgaaaggacagtgactacaaaatcgtgtgtgcgttaggggcagacagagcccttaacgtagcaatttcttgcgtgttagcacttatcttactgcaaaaatcgcgtgtttaaaacagacttctaaagcgttttgcagtcttgaagaacttcaaatgcatacaaatagagctttcgttctgcaaaaatcacgtgtttcaaacagacttctaaagcgttttgcagtcttgaagaacttcaaat

SEQ ID NO: 1514 - DNA, 1158 bp, Secale cereale
cgaaagggactggagagaaaactaagagaaaagacgaagtgaaaggaaagacgcgtgtaccaaacaccaacggctcgcaaagaaggagaatctgctcccattgctgtgcgcacgccccgacggcgccgcactagggtagtagtagtaggtgctgctgcggaaccaggaggggagagcgagtggagtcgaggaagcggcaggggtagcaggaggagcctagggggaggggagtgcgagagagagatggggtccggatctttcctcaaggtgctggccaagaacttcgacgtcctcgccgggccactagtttcacttgcttatcctctatatgcctctgtgagagcaattgaaacaaaatctcaagtagatgatcagcagtggcttacttactgggtgctgtactcgtttatcactttgtttgagctcacttttgctccgatacttgaatggcttccattctggccctatgggaaactgttcttcaactgctggctagtcttcccttgcttcaatggtgctgcttatgtttatgagcattttgcgcggccaatgtttgtgaatcgccaaatagtcaacatctggtacgtcccaaggaaggataagttgagtaaacctgatgatgtactctcagccgcagagaaatatattgaactaaatggaccagaagcatttgagaagctaattagcaagtctacaagtacaagtacaaagccttcaaagtttaggagcacgagacggtcaatcttgcaggaggcggaagctgaaaagatgggcaaggctgagagagattcatggggtgaaaatccattctacgataaaaattaccgacactaaatcagtcttcttggattctgcctgatgaagagctttccacgcatgcgcttgaggattgcatgatgcgtctaccaaatcgtaattggtaccacaagaactatgtgacggctgaattcttgtaaataggtgccagcgttgacatgttcccagatgatgtaatgttgtcttgcatattagtaacagatttggctagacaaactgattatgtgcctctactagacatcgcctgcttcgaacatagcgatttcctgtgtgttagtgccaggaagctgtgcgtttcaaacattccgaagactcttctagaattaagaacatcaaatgggt

SEQ ID NO: 1515 - DNA, 1125 bp, Secale cereale
gtgtaccaaacaccaacggctcgcaaagaaggagaatctgctcccattgctgtgcgcacgccccgacggcgccgcactagggtagtagtagtaggtgctgctgcggaatcaggaggggagagcgagtggagtcgaggaagcggcaggcctaggggcaggggagtgcgagagagagatggggtccggatctttcctcaaggtgctggccaagaacttcgacgtcctcgcggggccactagtttcacttgcttatcctctatatgcctctgtgagagcaattgaaacaaaatctcaagtagatgatcagcagtggcttacttactgggtgctgtactcgtttatcactttgtttgagctcacttttgctccgatacttgaatggcttccattctggccctatgggaaactgttcttcaactgctggctagtcttcccttgcttcaatggtgctgcttatgtttatgagcattttgcgcggccaatgtttgtgaatcgccaaatagtcaacatctggtacgtcccaaggaaggataagttgagtaaacctgatgatgtactctcagccgcagagaaatatattgaactaaatggaccagaagcatttgagaagctaattagcaagtctacaagtacaagtacaaagccttcaaagtttaggagcacgaggcggtcaatcttgcaggaggcggaagctgaaaagatgggcaaggctgagagagattcatggggcgaaaatccattctacgataaaaattaccgacactaaatcagtcttcttggattctgcctgatgaagagctttccacgcatgcgcttgaggattgcatgatgcgcctaccaaatcgtaattggtaccacaagaactatgtgacggctgaattcttgtaaataggtgccagcgttgacatgttcccagatgatgtaatgttgtcttgcatattagtaacagatttggctagacaaactgattatgtgcctctactagacatcgcctgcttcgaacatagcgatttcctgtgtgttagtgccaggaagctgtgcgtttcaaacattccgaagactcttctagaattaagaacatcaaatgggtgcaaagatctatttatttttgttgtgtctaagttg

SEQ ID NO: 1516 - DNA, 843 bp, Lolium multiflorum
ggaaagagagagagagagagagagcgtgccctcccgaacccaacaccaacggctcgcgacaagaagaatccgctcccattaacggcgccgcactagtctccgtgatctgctgccggaagcagggaggggagaccgggacgatttgggggaagcataggtgcgagcgagatgggctccggatctttcctcaaggtgctggccaagaacttcgacatcctcgccgggcccctagtttcacttgcttatcctctatatgcctctgtgagagcaattgaaacaaaatctcaagtggatgatcagcagtggctcacttactgggtgttgtactcgtttatcactttgtttgagctcacttttgctccaatacttgaatggcttcctttctggccctatggaaagttgttcttcaattgctggctagttctaccttgcttcaatggtgctgcttatgtttacgagcattttgtgcggccaatgtttctgaaccgccaaatagtcaacatctggtacgtcccaagaaaggataagttaagcaaacctgatgatgtactctcagctgcagagaaatatattgaactaaatgggccagaagcatttgagaagctaattagcaagtcttcaaagccttcaaactttaggagcaggaggctgtcggtcttgcaggaggcaaaagctgatagaacaggcaaggctgaaagagaatcgtggggtgaaaatccattctacgataatagttaccgacactaaaatgacctggccttttcagccatccactcatcagtcttcgtggatctgcccctaggaggaacctaccactcctctaacttgaggattgtattctga

SEQ ID NO: 1517 - DNA, 1748 bp, Zea mays
tgtaaaaatataaaagacccgtctccgtctcgggggagcaggagagggggagaggccaagaacccagccgcgaagccaagcccatctgatccggcccctgctgccctgccccagctcgtctctcaggtcgccttgccgttgccggttccgcgcccgggcccggctcagagtcgcgagctcgtctcgcagatccggcttcgcttgcttgaattctgttctttgggagcaaagaggtgctggccggtggcgtggcttggtgctctggggccggcgagtttttttttttgcgtccgctcgctctgcctgtagtcttcttgctgcggcggcggggtggagatgggggtggcgggggagaagttccagctggggacggtgggggcactcagcctctcggtggtgtcctccgtctccatcgtcatctgcaacaaggctctcatgagctcccttggcttcaacttcgccactactttgacaagctggcatctcctggttacattctgttctctccatgtggcattatgtatgaagctgtttgagcacaaacctttcgatgcaaggactgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcaacacagctcctgtaccagtcatgcccataccaggcattgacgttgttccttgtcggtccattcctcgatggatttttgaccaaccaaaatgtctttgctttcgactacacaactcaagttctgtttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcaaaggagggtgaatcgaacccgctgatctcggactccctgagcgctgccgaaaatggaggcagtgccaccgacgatgaacctctgaaggtaccaatgtggagctcgaagtactcgaaggcgtgaagtggctgttctggtattagtgcacacggtgctatacagaattcagcgtggtaggcagatactagggttggaaggcaaccctgttcctgttccatttttggccttctattttttcttcttcctggcacaaatactataaatatgtgctgtcagtaaatggatctcactcttgagaggaatacctcagctcgagaccgagtgttctgttctgcctgaaagctagtatttgtttgtgctccactccacgtgtaaagtggtagatggacatgatctcaacagtagtagtttgcattcttttgtactagtgatatacaatatttatgtattcctcgtgttcccta

SEQ ID NO: 1518 - DNA, 1220 bp, Pennisetum glaucum
cggcggtggagatgggggtggcgggggagaagttccagctggggacggtgggggcgctcagcctctcggtggtgtcctcggtctccatcgtcatctgcaacaaggccctcatgagctccctcggcttcaacttcgcaactactttgacgagctggcatctcctggttacgttctgctctctccatgtggcattatgtatgaagctctttgagcacaaacctttcgatgcaagaactgtcatgggatttggagtgctcaatggcatctcaattggacttctcaacttaagtctaggtttcaattctgttggtttctatcagatgacaaagctggctattattccctgtactgttatattggagacccttttcttcaggaagaaatttagtcggaatatcaaactctcacttagcgtgctccttcttggtgttggtgttgcaactgtgactgatttgcaactcaacgctgtgggatctgtactgtccctgctggcaatcatcacaacctgtattgctcaaattatgacaaatacaatacagaagaagttcaaggtatcttcaacccagcttctgtatcaatcatgcccgtaccaagcgttgaccttgttcgttgttggtccattccttgatgggtttttgactaaccaaaatgtctttgctttcgattacactactcaagttctgtttttcattgtgctgtcatgcctgatttcagtctctgtaaactttagcaccttccttgtgattgggaagacatctcctgtaacttaccaagtccttgggcatttgaaaacatgcttggttctcacctttggctatgtactgcttcacgacccatttagctggagaaatatactgggcatcctaattgctgtgattgggatggttttgtattcatacttctgcactagagagacccagcaaaaacccgcagaagtttctcctcaagtcagtcaggggaaggagagcgagtcaaacccattgatctcggactctttaaatgcggctgaaaacgggggcagtaccccagatgacgaacccctgaaggtaccaatgtggagctcgaagtactcaaggtcgtgaagattgctctgtcgttagtgtatggtattatacagaattcagtttagtaggcagataccagggttggaaggcaaccctgttcctgttccatttttggcatttttttgtctggcttatattatattatatgtactgttg

SEQ ID NO: 1519 - DNA, 1872 bp, Zea mays
aaataatataaaagttagccaagcgaaccgaaccacactctcgtctccctcctccccgttccttattcgccagaccggagggaggggtacgagcttcaccgctttcatcccgcccgcgctcctccccagatctcgtctccattaaagccgaccttgcccagattcgcgccctcctcgctcatatctgaaagcggctctgattttccaagccgaccgcaggagcggtgcaccgggccgcgtgattccggcggcttgatttggaatttgtgatctttcggggcattcgtcggtttgtctgtcggtgccggtggtgctgcgtttcgagggcagcgaagatgggtgtcggcggagagaagttccagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatcacaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgacccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctcccgctagacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggacatgttccacatcgtctaactgtaacttccaactggtacatggcatgcctatatccaaagatagatttctttttttttgtatcagaaagatccggtaagacttgcgcaaaatttgtagtactattggttcgagtttgtttctttcagttcatgttcactttaaaactttatcatgcaagttctgtatattacaagttcttgcatgcaaaggttttcctttatgatttctttatggtccaaac

SEQ ID NO: 1520 - DNA, 2966 bp, Triticum aestivum
accgacgaggcggccatccatataaaaatacctcgtctccctccccgcccctgattcgcaaggccaaagcaagaggggcaggagcgccaccgcgaatcccatcccatccccgcaccgccgccgatcccgcccgcccgcccctccgcagatctccccgacattgcccgctccccggccggattcgcccagatccaccgacgcggcgcgcggtgctcccggcggcgtggtccggtcggtctgatcgggaaggcttgatcttttttgttggtgctgttgtctggagggtggtggcagcggagatgggcgtcggaggggagaagttccagctggggacggtgggggcgctgggcctctccgtggtgtcctccgtgtccattgtcatctgcaacaaggccctcatgagctccctcggcttcaccttcgctaccaccttgacgagctggcatctcctggtcactttctgctcccttcatgtggcactatggatgaagttttttgagcacaaggcttttgattcgagaactgtcatgggattcggagtactcaatggcatctccattgggctcctcaatctgagtcttggtttcaattctgttggcttttaccagatgacaaagctggccatcatcccctgcactgttattttggagactcttttcttcaggaagaagttcagccggactatccagatctccctttccgtgcttcttttgggtgtcggtgttgcaaccatgactgatttgcaactcaatgctgtggggtccatactgtccttgctggccattatcacgacttgcatcgctcaaatcatgacaaacactattcagaagaaattcaaggtttcttcaacccagctgctatatcagtcttgtccttaccagtcattgacactgtttcttatcggcccgttccttgatggattcctgactaaccaaaacgtctttgctttcaattacacatctaacgttgtgtttttcatcgtcttgtcgtgtttgatatcggtctcagtaaacttcagcacctttcttgtgatcggaaagacatctcctgttacttaccaagtcctgggccatcttaaaacatgcctagttttgaccttcggctacgttttgcttcatgatccgtttagctggagaaacatacttggcatcctaattgcggttgttgggatggtactatattcatacttctgctcaacagagactcaaccaaaaaataccgatgtctccgcacagcagtcaaaagaaggtgactcggcacctttgatctctgattctttgagcaaagttgaaaatggaggtgatgacgatgagcctttgaaggtaccgatgtggagctcaaagtactcaagggcgtgagaattttgtctcttagacggcggatggcattatacaggattcaatttagtaggcagatagtagggttggaagccaactttccaacccaagtaatgaagcaatggacatttcagttacaattaaaatgatctgattctttggagggttttaccttccaaaattgcagatcgaccatgaaactagatagcagatattgtaaaattgtatctggatatggtccaaatcttctcactgtaacttcacgttgggacactggtctgcagatagactccattctttttgtaccaaaggtcccgaggtcaagaattgtgcaagactttaaagtatttataggttcaagtttgtaactgtactttcagatttaccttggaccatagtaatgcaagtgatgtacatttcagtttaaggagttaaaaataaccaggttcatttccatgtaacaacacaaacagctacagttcaaggaggaattggtgtttcacagatgaagcaatgaaacatttgcaccaatcttgtgatctgtagaggtgtacacggtgcctgtttttacttacacattctacaaaatgtagatgtagaagacaaattcttgcaacattgaaatcacacaggtcatatatcaaaactgtaatgagctagcaactgcacatacttcagtttgctaaatgttccgttatagcaaggaaaaacctataattcatctctcatttaactcgctatggttcaccggttcttcagatgcatgctattgtccacgctcccaagaaagctcaagttcacaatgtctttgtcggtgtttccataagtggacatttgttgataatccaacagcccctcgcggaaacatcactcaacctttgcaacccctccttcaggtagactgctatcagaaaccgcttctcgtacaaaccttgttaatttatcttgagatgattgcaatacatagattgcaaggatgaaggaaagaacaaggccagatccaaataacacatagaatcctgcagtaacatctatctctgattgttcctcccatgtataactaacaagtacatattttggccaattctgtggatcccagaaattcttctttatgtcaggatgaagttccacaaaatggtgaggcatgtccactactttagccgtaacaccaagcaaatcgtttccagtgtattttaaatggaaatcaatcagtggaacttcagagcttttgcgattaataacataaagccaaggaacatggaacttttcgtgtccaatctgaaatgttatcttatacggatccgcaccggtgaaccccgtcggcttggggatcggcatcagcacctcccggttgaccgcgaagaccgggcagtggcggccgatgacgtcgaaccacaccgacctcgagccgtggtactggccggagcggagcatggggatgatgtcgccggggcggtaggcggacgagagggggaggaggaacgagccgattagcagcaaggggaggaggagtaggaggagtcggtggtgggtggtggcggggctccggcgagtggccatggtggtcgccggagtcggtagcgggagtggagacggggcacgaatggggtacgtcagatttgctgatgc

SEQ ID NO: 1521 - DNA, 2669 bp, Triticum aestivum
cgcccgcccctccgcagatctccccgacattgcccgctccccggccggattcgcccagatccaccgacgcagcgcgcggtgctcccggaggcgtggcccgggccgtctgatcgggaaggctcgatctttttggttggtgctgttgtctggagggtggtggcagcggagatgggcgtcggaggggagaagttccagctggggacggtgggggcgctgggcctctccgtggtgtcctccgtgtccattgtcatctgcaacaaggctctcatgagctccctcggcttcacctttgctaccaccttgacgagctggcatctcctggtcactttctgctcccttcatgtggcactgtggatgaagttcttcgagcataaggcttttgattcaagaactgtcatgggattcggagtactcaatggcatctccattgggctcctcaatctgagtcttggtttcaattctgttggcttctaccagatgacaaagctggccatcatcccctgcactgttattttggagactcttttcttcaggaagaagttcagccggactatccagatctccctttccgtgcttcttttgggtgtcggtgttgcaactgtgactgatttgcaactcaatgctgtggggtccatactgtccttgctggcaattatcacgacttgcatcgctcaaatcatgacaaacactattcagaagaaattcaaggtttcttcaacccagctgctatatcagtcttgtccttaccagtcattgacactgtttcttatcggcccgttccttgatggattcctgactaaccaaaacgtcttcgctttcaattacacatctaacgttgtgtttttcatcgtcttgtcgtgtttgatatcggtctcagtaaacttcagcacctttcttgtgatcggaaagacatctcctgttacttaccaagtcctgggccatcttaaaacatgcctagttttgaccttcggttacgttttgcttcatgatccatttagctggagaaacatacttggcatcctaattgcggttgttgggatggtactatattcatacttctgctcaatagagactcaaccaaaaaataccgatgtctccgcacagcagtcaaaagaaggtgactcggcacctttgatctctgattctttgagcaaagttgaaaatggaggtgatgacgatgagcctttgaaggtaccgatgtggagctcaaagtactcaagggcgtgaaaatttcgtctcttagacggcggatggcattatacaggattcaatttagtaggcagatagtagggttggaagccaactttccaacccaagtaatgaagcaatggacatttcagttacaagtaatggacatgtcagttacaattttgtgtttatttagcgtcaccatctaaaagcagtaaaatgatctgattctttggagggttttaccttccaaaattgcagatttaccatgaaactagacagcagatattgtaaaattgtatctggatatggtccaaatcttctcactgtaacttcacgttgggacactggtccgcagatagactccattctttttgtaccaaaggtcccgaggtcaagaattgtgcaagactttaaagtatttataggttcaagtttgtaactgtactttcagatttaccttggaccatagtaatgcaagtgatgtacatttcagtttaaggagttaaaaataaccaggttcatttccatgtaacaacacaaacagctacagttcaaggaggaattggtgtttcacagatgaagcaatgaaacatttgcaccaatcttgtgatctgtagaggtgtacacggtgcctgtttttatatcaaaatgtagatgtagaagacaaattcttgcaacattgaaatcacacaggtcatataccaaaactgtaatgagctagcaactgcacatacttcagtttgctaaatgttctgttataccaaggaaaaacctataatccatctctcatttaactcgccatgttgtaactgtcagttccgtacaatgcatgcatacaaaatggttcaccggttcttcagatgcatgctattgtccacgctcccaagaaagctcaagttcacaatgtctttgtcggtgtttccataagtggacatttgtcgataatccaacagcccctcgcggaaacatcactcaacctttgcaacccctccttcaggtagactgccatcagaaaccgcttctcgtacaaaccttgttaatttatcttgagatgattgcaatacatagattgcaaggatgaaggaaagaacaaggccagatccaaataacacatagaatcctgcagtaacatctatctctgattgttcctcccatgtataactaacaagtacatattttggccaattctgtggatcccagaaattcttctttatgtcaggatgaagttccacaaaatggtgaggcatgtccactactttagccgtaacaccaagcaaatcgtttccagtgtattttaaatggaaatcaatcagtggaacttcagagcttttgcgattaataacataaagccaaggaacatggaacttttcgtgtccaatctgaaatgttatcttatacggatccgcaccggtgaaccctgtgggtttggggatcggcatcagcacctcccggttgaccgcgaagaccgggcagtggcg

SEQ ID NO: 1522 - DNA, 1636 bp, Secale cereale
gactcccgcccgcccgcccctccgccagatctccccgacattgcccgctccccggccggattcgcccagatccaccgacgcagcgcgcggtgctcccggcggtgtggcccgggccgtctgatcgggaaggctcgatctttttggttggtgctgttgtctggagggtggtggcagcggagatgggcgtcggaggcgagaagttccagctggggacggtgggggcgctgggcctctccgtggtgtcctccgtgtccattgtcatctgcaacaaggctctcatgagctccctcggcttcacctttgctaccaccttgacgagctggcatctcctggtcactttctgctcccttcatgtggcactgtggatgaagttcttcgagcataaggcttttgattcaagaactgtcatgggattcggagtactcaatggcatctccattgggctcctcaatctgagtcttggtttcaattctgttggcttctaccagatgacaaagctggccatcatcccctgcactgttattttggagacacttttcttcaggaagaagttcagccggactatccagatctccctttccgtgcttcttttgggtgtcggtgttgcaactgtgactgatttgcaactcaatgctgtggggtccatactgtccttgctggcaattatcacgacttgcatcgctcaaattatgacaaacactattcagaagaaattcaaggtttcttcaacccagttgctatatcagtcttgcccttaccagtcattgacactgtttcttattggcccgttccttgatggattcctgactaaccaaaatgtcttcgctttcaattacacatccaacgtgtttttttcatcgtcttgtcgtgtttgatatcggtctcagtaaacttcagcacctttcttgtgatcggaaagacatctcctgttacttaccaagtcctaggccatcttaaaacatgcctagttttgaccttcggttacgttttgcttcatgatccatttagctggagaaacatacttggcatcctaattgcggtagttgggatggtactgtattcatacttctgctcaatagagactcaaccaaaaaataccgatgtctctgcacagcagtcaaaagaaggtgactcggcacctttgatctctgattctttgagcaaagttgaaaatggaggtgatgacgatgagcctttgaaggtaccgatgtggagctcaaagtactcaagggcgtgaaaaattcgtctcttagacggcggatggcattatacaggattcaatttagtaggcagatagtagggttggaagccaactttccaacccaagtaatgaagcaatggacatttcagttacaagtaatggacatgtcagttacaattttgtgtttatttagcgtcaccatctaaaagcagcaaaatgatctgattatttggagggttttaccttccaaaattgcagatctaccatgaaactagacagcagatattgtaaaactgtatctggatatggtccaaatcttctcactgtaacttcatgttgggacactggtccgcagatagactccattctttttgtaccaaaggtcccaaggtcaagagttgtgcaacactttaaagtatttataggttcaagttt

SEQ ID NO: 1523 - DNA, 2591 bp, Triticum aestivum
gattcgcccagatccaccgacgcagcgcgcggtgctcccggcggcgtggtccgggccgtctgatcgggaaggctcgatcttttttgttggtgctgttgtctggagggtggtggcagcggagatgggcgtcggaggggagaagttccagctggggacggtgggggcgctgggcctctccgtggtgtcctccgtgtccattgtcatctgcaacaaggccctcatgagctccctcggcttcacctttgctacaaccttgacgagctggcatctcctggtcactttctgctcccttcatgtagcgctatggatgaagtttttcgagcataaggcttttgattcaagaactgtcatgggattcggagtgctcaatggcatctccattgggctcctcaatctgagccttggtttcaattctgttggcttttaccagatgacaaagctggccatcatcccctgcactgttattttggagactcttttcttcaggaagaagttcagccggactatccagatctccctttccgtgcttcttttgggtgttggtgttgcaactgtgactgatttgcaactcaatgctgtggggtccatactgtccttgttggcaattatcacgacttgcatcgcgcaaatcatgacaaacactattcagaagaaattcaaggtttcttcaacccagctgctatatcagtcttgtccttaccaatcattgacactgtttcttatcggcccgttccttgatggattcctgactaaccaaaacgtcttcgctttcaattacacatctaacgttgtgtttttcatcgtcttgtcgtgtttgatatcggtctcagtaaacttcagcacctttcttgtgatcggaaagacatctcctgttacttaccaagtcctgggccatcttaaaacatgcctagttttgaccttcggttacgttttgcttcatgatccatttagctggagaaacatacttggcatcctaattgcggttgttgggatggtactatattcatacttctgctcaatagagactcaaccaaaaaataccgatgtctccgcacagcagtcaaaagaaggtgactcggcaccgttgatctctgattctttgggcaaagttgaaaatggaggtgacgacgatgagcctttaaaggtaccgatgtggagctcaaagtactcaagggcgtgaaaatttcgtctcttaaacggcggatgggattatacaggattcaatttagtaggcagatagtagggttggaagccaactttccaacccaagtaatgaagcaatggacatttcagttacaattttgtgtttatttagtgtcactatctaaagcagtaaaatgatctgattctttggagggttttaccttccaaaattgcagatttaccatgaaactagacagcagatattgtaaaattgtatctggatatggtccaaatcttctcactgtaacttcatgttggtacactggtccgcagatagactccattctttttgtaccaaaggtcctgaggtcaagaattgtgcaagactttaaattatttataggttcaagtttgtacctgtactttcagatttaccttggactttaaagtaatgcaagcgatgtacatttcagtttaaggagttaaaaataaccaggttcatttccatgtaacaacacaaacagctacagttcaaggaggaattggtgtttcacagatgaagcaatgaaacatttgcaccaatcttgtgatctgtagaggtgtacacggtgcctgtttttacttacacattctacaaaatgtagatgtagaagacaaattcttgcaacattgaaatcacacaggtcatataccaaaactgtaatgagctagcaactgcacatacttcagtttgctaaatgttctgttataccaaggaaaaacctataatccatctctcatttaactcgccatgttgtaactgtcagttccgtacaatgcatgcataccaaatggttcaccggttcttcagatgcatgctattgtccacgctcccaagaaagcttgagttcacaatgtctttgtcggtgtttccataagtggacatttgtcgataattcaacagccccttgtggaaacatcactcaacctttgcaacccctccttcaggtagactgctatcagaaaccgcttctcgcacaaaccttgttaacttatcttgagatgattgcaatacatagattgcaaggatgaaggaaagaacaaggccagatccaaataacacatagaatcctgcagtaacatttatctctgattgttcctcccatgtataactaacaagtacatattttggccaattctgttgatcccagaaatccttctttatgtcaggatgaagttccacaaaatggtgaggcatgtcgactactttagccgtaacaccaagcaaatcgtttccagtgtattttaaatggaaatcaatcagtggaacttcagagcttttgcgattaataacataaagccaaggaacatggaacttttcgtgtccaatctgaaatgttatcttatacggatccgcaccggtgaaccctgtgggtttgggggatcggcatcagcacctcccggttgac

SEQ ID NO: 1524 - DNA, 1718 bp, Populus trichocarpa
accaacaacactctcccatttctttatttctcattctcatttctctcccatttatatataaataaatctctctctctctttctctcattctcaatcaaaacaaagagagttacaaaaataagctaaaaaacaaacaccctttttagtgttctctcttttatagattgatttcagtcatcaacaattctcaaagtttcagctgctttggttgtttttttgaaagttttggatccaattatgaggtgaatcagatctggatcaaggagatagcgtgatttggaattgaagtgaaaatgagtgagggccaaaaattccagctagggactgttggggctttgagtttatcagtggtttcgtcagtgtcgattgtaatttgcaataaggctcttattagcacacttggcttcacttttgctacaactttgacaagctggcatcttctggtcaccttttgttctcttcatgtagcattatgcatgaaattgtttgagcacaagccttttgacgcaagagcagtaatgggatttggcatactaaatgggatatccattggccttttgaatcttagcttgggtttcaattctgttggtttttatcagatgacaaaattggcgatcatcccatgcactgttcttttggagacacttttcttccggaagcaattcagtcgaaatatccagctttcacttagcattcttcttatgggtgttggaattgcaaccgtaaccgatcttcagctcaatgtcctgggatctgtcttgtctctgcttgcagttcttacaacatgtgttgctcagattatgactaataccatccaaaagaagttcaaagtctcttcaacacaacttctgtaccagtcttgcccctatcaggcattaactttgttcattgttggcccattcctggatgggcttctgacaaacaaaaacgtttttgctttcaaatacacccctcaagtgctgttcttcattgttctatcctgcctgatttctgtctctgtgaacttcagtacttttctggtgattggaaagacatctcctgtcacctatcaagtcctaggacatttgaaaacatgccttgttttggcatttggttatgttctacttcgtgatccatttagctggcgcaatattttaggaatccttattgcagtggttggaatggtgctgtattcttattgttgcactattgagagccagcagaagcaaaatgaagtgccagtaaaattgcccgaggtcaaggaaagtgaaactgatccgttaatcagcgtggaaaacggaactgggatcttagccgatgttgctgtaccaaatgttcccgtgtggacttcaaacaaggacttggacgcataagacattcccttttttataaattcatttgctctagatcaaagtcagtaaacaaaacggtttcagcgagggtgtatcacaattcacatggcacgagttgctttgttctgggatcattacactaatattatatcagataaagtattgaagaaacatgtcattattatagcagttttggtttattagttttgtatgaatcaaacatggcaatggtatgatactaggatttgaattgtcaaatgtatactgtggttaccggatactggaaattttttactgcttgttctctggttatattcctcttcatctgtgaagaacaacaaatgtatgtcttgttctttaagttgccagtaaattctgcttttctag

SEQ ID NO: 1525 - DNA, 1806 bp, Populus trichocarpa
aaagcttctcatcgccaacagcaacagcaacaccatcaccaacaacactctcccatttctttatttctcattctcatttctctcccatttatatataaataaatctctctctctctttctctcattctcaatcaaaacaaagagagttacaaaaataagctaaaaaacaaacaccctttttagtgttctttcttttatagattgatttcagttatcaacaattctcaaagtttcagctgctttggttgtttttttgaaagttttggatccaattatgaggtgaatcagatctggatcaaggagatagcgtgatttggaattgaagtgaaaatgagtgagggccaaaaattccagctagggactgttggggctttgagtttatcagtggtttcgtcagtgtcgattgtaatttgcaataaggctcttattagcacacttggcttcacttttgctacaactttgacaagctggcatcttctggtcaccttttgttctcttcatgtagcattatgcatgaaattgtttgagcacaagccttttgacgcaagagcagtaatgggatttggcatactaaatgggatatccattggccttttgaatcttagcttgggtttcaattctgttggtttttatcagatgacaaaattggcgatcatcccatgcactgttcttttggagacacttttcttccggaagcaattcagtcgaaatatccagctttcacttagcattcttcttatgggtgttggaattgcaaccgtaaccgatcttcagctcaatgtcctgggatctgtcttgtctctgcttgcagttcttacaacatgtgttgctcagattatgactaataccatccaaaagaagttcaaagtctcttcaacacaacttctgtaccagtcttgcccctatcaggcattaactttgttcattgttggcccattcctggatgggcttctgacaaacaaaaacgtttttgctttcaaatacacccctcaagtgctgttcttcattgttctatcctgcctgatttctgtctctgtgaacttcagtacttttctggtgattggaaagacatctccagtcacctatcaagtcctaggacatttgaaaacatgcctagttttggcatttggttatgttctacttcgtgatccatttagctggcgcaatattttaggaatccttattgcagtggttggaatggtgctgtattcttattgttgcactattgagagccagcagaagcaaaatgaagtgccagtaaaattgcccgaggtcaaggaaagtgaaactgatccgttaatcagcgtggaaaacggaactgggatcttagccgatgttgctgtaccaaatgttcccgtgtggacttcaaacaaggacttggacgcataagacattcccatttttataaattcatttgctctagatcaaagtcagtaaacaaaacggtttcagcgagggtgtatcacaattcacatagcacgagttgctttgttctgggatcattactaatattatatcagataaagtattgaagaatcatgtcattattatagcagttttggtttattagttttgtatgaatcaaacatggcaatggtatgatactaggatttgaattgtcaaatgtatactgtggttaccggatactggaaattttttactgcttgttctctggttatattcctcttcatctgtgaagaacaacaaatgtatgtcttgttctttaagttgccagtaaattctgcttttctagtgcttccgaaactttctacgttaattaatgcgtggagatcatgatttgcatcc

SEQ ID NO: 1526 - DNA, 1424 bp, Tripterygium wilfordii
acatattcgatcagttgagctgcttcggggctccaatttcatatcttttttcgctaaattatgctcgaatgaggtagatccagatcgaggagcaactgaatagaattggggggaaacagtgagcagagacggagaacatgagcgaggggccgaaattccagttggggacaggtgggggcgctgtccttgtctgtggtatcttcagtatcaattgtgatttgcaacaaggcgcttattagcacacttggcttcacttttgccacaactttgacgagctggcatctcctggtgacattttgttctcttcacgtggcactatggatgaaattttttgagcacaagccttttgatgcaagagctgtcatggtatttggcatattgaacggcatatccattgggcttctgaatctcagcttgggtttcaattctgttggattctatcagatgacaaaactggctatcattccctgcactgttcttttggagacccttttcttcatgaagaaattcagccggagtattcagttgtcactggctatcctacttttaggtgttggaattgcaactgtgaccgatcttcagctcaatctcctgggttctatcttgtctctgcttgcagttattacaacttgcgttgctcaaattatgaccaataccatccagaagaagttcaaagtttcttcaacccaacttctttatcagtccagcccataccaggctataacacttttcatcgttggtccatttctagatggccttttgactaacaaaaatgtttttgctttcaactacactcttcaagtggtgttcttcattgtcctctcctgcctgatatctgtctctgtaaacttcagtacatttctggtaattggaaagacatctccagtcacataccaagtcctagggcacctgaaaacatgcctagttttggcctttggctatgttttgcttcgtgacccctttagctggcgcaatattctcgggattcttgtagctatagttgggatggttctttattcttattattgcactcttgagactcagcagaaagctagtgaagcatcagcgcaagcgcaactggtcaaggaaggtgagtctgatcctctaataagtgtggaaaatggaagcgggatctcagcagacggtgttgttgccacgggtcctgtatggaagtcaaataaggaccttcaagcttaaaccttcttgatttaaatatttggtcgcccttaggatggaattaattgaggaaactctctcagcgatgaagatgtttctggacaaggtctcatataatgcatagcagcagttcgggtatttcaagattacaacttcaagtatggcagattcaatattgaatagcatttttttggttcttgcgagtgaggctatgggattgaaaccaggatttgatttgataaatatat

SEQ ID NO: 1527 - DNA, 1432 bp, Musa acuminata
atgcattgcctcatcgacctccgcctcataacaggactccattcatcggctttactaatctgttttagagcgcaagaggaatctctctctcccgccgcttctctgctcctcgcagcctcgagaaatcgagggaaaaaaaagggtgagtgccatacggtttgttttgtagatcgaggaagtgagaaggggttttgattggactggagatgggggagggcggggggttccagttgggaaccgtcggagcgctgagcctgtcggtggtatcgtcggtgtctattgtgatttgtaacaaggcgttgatgagctcccttggcttcatatttgccactactttgacaagctggcatcttcttgttaccttctgttctcttcatgtggcattgttgatgaaactatttgagcacaaaccttttgatcgaaaggctgtcatgggttttggagtactaaatggaatctccatagggctattaaatttaagcctaggtttcaactctgttggtttttatcagatgacaaagctagcaatcattccctgtactgtcttcttggagactgtatttttggcaaaaaaattcagtcggagtattcagctctcacttaccatccttttattgggtgttggaattgcaactgtgacagatctgcagcttaatttgctcggatctgtattgtctcttctagcagttgttaccacttgcattgcacagattatgacaaacactatacaaaagaagttcaaggtctcttcaacccaacttttgtatcaatctgccccttaccaagctttaactctgttcatatctggtccatttcttgatggccttttaacgaaccagaatgtctttgcatttaactacactcctcaagttcttatcttcattgtgctttcatgcctaatatcggtctccgtcaacttcagcacatttcttgtaattgggaagacatcgcctgtgacatatcaagttttgggtcatctcaaaacatgcctggttctggcttttggttatgtgttgcttcatgatccattcagttggagaaatatatttgggatcttagttgcaattgttggcatggtgttttattcttatttctgtacaattgagggccaacagaaagctcgtgaagcatcctctcaagtgttgcaggtgaaagacgatgagtctgatcctctgatcggaaccgagactggagctggcataaatgatgatggtgcagctcaaaccgcgcaagcatggagctcaaacaaagatttgcatgcatgaaatctgccctaatgtacagaatcatacatgcagaccagaaatcatcagaccagtttgcatagccagttttggagaacaagttgctgtatgtttttgtatgcaatttttatctatattcttacatgctcttcgaaaagcatattaattcttcttctttgtaagttgcg

SEQ ID NO: 1528 - DNA, 1461 bp, Platanus occidentalis
agttgagctggttttccgtcttcatttcgacatatttaggagaacatcggaatgagagtgttagatccggatcgagaaaggagtaattgatatcagagaagatgagtgagagcgagcggttccagctcggaaccatcggggcattgagtctgtcagtagtttcgtcggtgtcgatcgttatttgcaacaaggcacttatcagcactctaggttttacattcgccacaactttgacgagctggcatcttcttgtcacattttgctcccttcatgtggcattatggatgaaactttttgagcacaaaccttttgatgcacgagctgtaatgggctttggcgtacttaatgggatctcaattggacttttgaatcttagtttgggcttcaactctgttggtttctatcagatgacaaaactacgcaattattccttgtactgttcttttggagactcttttctttaggaagagatttagtcggagtatccagctcgcacttgtcatccttcttttgggtgttggtatcgcaactgtgactgatctgcagctcaatgttctgggttctgtcttatctctgcttgcaattgttacaacttgtattgctcagattatgactaataccatccaaaagaggtttaaggtttcttcgacccaactcttgtatcagtcttgcccctatcaagcaatgaccctgttcattactggtccatttctagatgggcttctgaccaatcaaaatgtttttgctttcaagtatacacctctagtgttggtcttcattgttctatcctgcatgatatctgtctctgttaactttagtacgttccttgttattgggaagacatctcctgtcacctatcaggttctgggacatctgaaaacatgcctagttttggcttttggttatgttttacttcatgacccatttagctggcggaacatttttgggatcctgattgctgttgttggaatgatactttattcttacttctgcactcgtgagagtcagcaaaaagctggtgaagtgactgcacaactgtcacagtcgaaggaaagtgaatctgatcctttattaagcgtggaaaatggaactggggttgcaactgatggtgttgtcccaaaagccccagtatggagctcaaacaaagatctgcatgcataggccttctctgcactttattaaattcatacaccctgcagtaatctgacggacaactgttccagcaatgaagatgtcatcagcaaggggatggatggtctccatgaattacatctatgaatggtccaggtgtggtttgttgagattatcaggaactccagctattttaatagttagaagagttgtaagaacgtgctttgttttccatagcaattttgtctattagcattatataaactattgtgtcaatttgtcagttgggtactgttcttaaacaccaaaaataaaagatgattcgttagg

SEQ ID NO: 1529 - DNA, 1552 bp, Sorghum bicolor
ccccacggtcttccgctacctcccgtgtctcgtcctctctccctctctctctctccttctctctcctcttcgattcccaatttgaaggctgcccaagcccaacccttgcgccggtaggcggcggcggcgaggatagagggttccccgaggaggaagtgatggcggccacggctaagtacaatcggagcaacccggcggtgaagcggatcctgcaggaggtcaaggagatgcagtccaatccctcacccgacttcatggcccttcccctcgaggaggacatcttcgagtggcaatttgctatccttggcccgagagacagcgagtttgagggtggaatctatcatggcaggatccagctaccctcggattatccattcaagccaccgtccttcatgctacttacgccaagtggacgctttgagattcagaagaagatttgtttgagcatatccaattaccaccctgagcactggcagccttcatggagtgtccgcacagcgttggtagccttgattgcattcatgccaacgaaccctggtggggcattgggctcactggattacaaaaaggaagatagacgagcacttgctataaaatcacgtgaagcgccgccaaaatttggctcctcagaacgtcagaaactaattgatgagatccatgagcaaatgctcagtaaggctcctcctgtcccccaagcgctaccaaatgtgccaaacgaggagtctaaccaattacccacacctaacgcttctggtgagcatgcagacaaggtagatgaaggtgacaacacatctgggtctatgtcaggctcgttgagtggccttcctgtgcctgaatctgaatcgggggttgcagaaaacactggtgaagcctcagctgttgaggttgccaaccatcatgtgcctgaagcgagccatagagagaacattccaacagttccttcgtctctgcagaatcctgctgttgcgatccagaagccaaagcatgacaggctgttgaccttggctgcatttgggctgactcttgctattatggcacttgtgataaagaagttcttaaaaatcaatggcttgggcggtttcattgagggcaagttctgagtagggattgtgcataagttggatgtaagagatcactcattcctcgtactgagcatatgctataagctatataacaccctaagatttgtaaatggctgttgtttagttataatagatgaaatcaaaatgggacagtactattaataccccattgtatgtagtacacttgatggaaaattgccggagttttgaagcagctgatctaatgtatatgtttgctacagcgtgcactttgtaaaaccggaaccctcaattctcaatctccctctggagggttttgattaagaatttcatgaaacttggtgttgcagaacctgagctggcactcggaacaaaaggattgtgaatagcatggttttccaaacctagctaatttcatccgtgttgttttctgtgcgtttcctatgaaaatgaaccggttcctgcagaaatcctgtattattcttgtgaaa

SEQ ID NO: 1530 - DNA, 1238 bp, Saccharum officinarum
cctctctctcacctcttcgattcccaatttgaaggctgcccatcccttgcgccggtaggcggcggcggcggtgaggatagagggttacctgaggaggcagtgatggcggcctcggctaagtacaaccggagcaacccggcggtgaagcggatcctgcaggaggtcaaggagatgcagtccaacccctcacccgacttcatggcactcccccttgaggaggacatcttcgagtggcaatttgctatccttggcccgagagacagcgagtttgagggtggaatctatcatggcaggatccagctaccctcggattatccattcaagccaccgtccttcatgctacttacgccaagtggacgctttgagattcagaagaagatttgtttgagcatatccaattaccacccagagcactggcagccttcatggagtgtccgcacagcgttggtagccttgattgcgttcatgccaacgaaccctggtggggcattgggctcgctggattacaaaaaggaagatagacgagcacttgctataaaatcacgtgaagcgccgccaaaatttggctccccagagcgtcagaaactaattgatgagatccatgagcaaatgctcagtaaggctcctcctgtcccccaagcgataccaaatgtgccaaacgaggagtctaaccaattacctgcacctgactcttctgagcatgcagacaaggtagatgaaggtgacaacacatctgggtcaatgtcaggctcgttgagtggccatcctgtgcctgaatctgaatcgccggttgcagaaaacactggtgaaacctcagcagttgaggttgccaaccatcatgtgcctgaagcgagccgtagagaaaacattccaagagttccttcgtctctgcagaatcctgctgttgcgatccagaagccaaagcatgacaggctgttgaccttggctgcatttgggctgactcttgctattatggcacttgtgatcaagaagttcttaaaaatcaatggcatgggtggtttcattgacggcaagttctgagtagggattgtgcataaattggatgtaagagatgactcgttcctcgtattgagcatatgctataagctatataaccccataagatttgtaaatggctgttatttagttataatagatgaaatcaaaatgggacggtactattaataccccattgtatgtagtacattgagttttgaagcatctgatctgattttatg

SEQ ID NO: 1531 - DNA, 1933 bp, Zea mays
gtcccacgcggcagagacctggccacgcctcacgcgcttccggccttccgctacatgtcgtctcttttcgtttctcactttctctcttcgttcccaatttgaaggctgcccaacccttgcgccggtaggtggtggcggtgaggatagagggttacctgaggaggcagtgatggcggccacgattcagtacaaccggagcaacccggcggtgaagcggatcctgcaggaggtcaaggagatgcagtccaacccctcacccgacttcatgtccctccccctcgaggaggacatcttcgagtggcaatttgctatccttggtccgagagacagcgagtttgagggtggaatttatcatggcaggatccagctaccttcggattatccattcaagccaccgtccttcatgctacttacgccaagtggacgctttgagattcagaagaagatttgcttgagcatatccaattaccaccctgagcactggcagccttcatggagtgtccgcacagctttggtagccttgattgccttcatgccgacgaacccaggtggggcattgggctcactggattacaaaccagaagacagacgagcacttgctataaaatcacgtgaggtgccgccgaaatttggctccccacaacgtcagaaactaattgatgagatccatgagcaaatgctcagtaaggctcctcctatcccccaaacgctgccaaatgtgccaaacgaggagctcgcacctgactcttgtgatgagcatgcagacaaggtagatgaaggtggcaacacatccaagtccatgtcaggctcgtcgagtggccatcctgtgcctgaagctgaatcgctggctgcagaaaacacgggtgaagcatcagcagttgaggttgccaaccatcaagtgcctgaagcgagccgtagagaaagcattccaagagttccttcgtctctgcagaatgctgctattgcaacccagaagccaaagcatgacaggctattgaccttggccgcatttgggttgactcttgctattatggcactagtgatcaagaagttcttaaaaatcaatggcttgggcggtttcattgagggcaagttctgagtaggattgtgcataagttggatgtacgagatgactcattcctcgtactcagcatatgctataagctatataaccccgtaagatttgtaattgtttagttatagatgaaatcaaaatggaacggtactatcaataccccattgtatatgtacactggattgaaaattgctgagtatttaagcatctgatgtatatattgtgctacagcatgcactttgtttggctgccgtttaggactgtttagggttaggagaccagaatcgtcaattcccaattttccctcgagggcacatgattaagaaattcatgaaacctggtgttgcagaacctgagttggcactcggaacagtggtgaataggcatggttttccaaacataactgattccatccgtattttttttccttttaagggcatgtacgaatatgagctcttcgattttcaaaatataaaagacagcatatttgaatatcgtatgctaaactttaatataatgctaaaactagccggttgcccgttcgttgcgacggtccacaacaatatttatataaattatccactaaaaagatcttaagattttttattggttgtctccgctccccgcataatatttttgatttgactaactgatgttgttgtttattttatccaatatgtcttggtacaacacgaccaatgaaggcaacgattagaataaagttcacaacgactgactgaacgaaccgagattatagaatgacataattccaccatacagagaccaaataagaggaagtttgtgagctcaagtttctaaaataaatcacatgaacttaaacttataaaaaaagataga

SEQ ID NO: 1532 - DNA, 1362 bp, Setaria italica
cccacgcgcttccactacctatcgtcctctctctcctctcttcgattcgcaattcgaaggcttcccagcctgcgccggtaggcggcggcggcgtgtagagggtttcctgaggcggcagcgatggcggccacggcgaagtacaatcggagcaacccggcggtgaagcggatcctgcaggaggttaaggagatgcagtccaacccctcccccgacttcatggccctgcccctcgaggaagacatcttcgagtggcaatttgctatccttggccctcgagacagcgagtttgagggtggaatctaccacggcaggatccagctgccttctgactatccattcaagccaccttccttcatgctgctcacgccaagtggacgctttgagattcagaagaagatttgtttgagcatatccaattaccaccctgagcactggcaaccatcatggagtgtgcgcacagcgctagtagccctgattgcattcatgccaacaaaccctggtggtgcgttgggctcactggactacaaaaaggaagatagacgagcacttgctataaaatcacgtgaagcaccaccaaaatttggctccccggaacgtcagaaactaattgaagagatccatgagcaaatgctcactaaggctcctcctgttccccaagctctaccgaatgggccaaacgacgagtctaaccaattacctgcagctgactcttttggtgagcatgcagacaaggcggatgaaggtgggtctgtgtcagtctcgagtgaccttactgagcctcaatctgagtcgggtgttgcagaaaacactgctgaacccccagtagctgaggttaccaaccctcatctgcctgaagcgagccacagagaaaacattccaagagttcccttggcaccgcagaatcctgttgttgcaatccagaagccaaagcatgacaggctgttgaccttggccgcatttgggctgactctggctattatggccctcgtgatcaagaagttcttgaaaatcaatggcctggcaggtttcattgagggcaagttctgagtagggttgtgcatactttggataagagatgccccattcctcgtctaaggggctttgctatgcggtcctataatttttataaccccgtaaggtttgtaaatggctgttgtctagttatagatgaaatcaaagtgggatcttattatgttaccccattgtatgtaggacactgatgaaaaattgctaaggctttgcatcatctgttactgtatataccgtattactgtgctatggcttgtttgtagtgcgcattttatttggccgtggtgcagtgatccatttgatttcgatgcgaagacatctcatattctcaac

SEQ ID NO: 1533 - DNA, 1481 bp, Panicum virgatum
tcaccgataagtgggtccaattactcgcctgtcccacggccagagacctaaccggctccattaatatcgcccacgcgcttccactacctctcgtcctctctctcctctcttcgattcccaattcgaaggctacccaacctgcgccggtaggcggcggcgccgaggctagagggttccctgaggcggcagcgatggcggccacggcgaagtacaaccggagcaacccggctgtgaagcggattctgcaggaggtcaaggagatgcagtccaacccctcccccgacttcatggccctccccctcgaggaggacatcttcgagtggcaatttgctatcctgggccctcgagacagtgaatttgagggtggaatctaccacggcaggatccagctgccctccgactatccgttcaagccaccttccttcatgctgctcacaccaagtggacgctttgagattcagaaaaagatttgtttgagcatatccaattatcaccctgagcactggcaaccatcatggagtgtgcgaacagcgctagtagccctgattgcattcatgccaacaaaccctggtggggcattgggctcactggactacaaaaaggaagatagacgagcacttgctataaaatcacgtgaagcaacaccgaaatttggctccccagaacgccaaaaactaattgatgagatccatgagcaaatgctcagtaaggctcctcctgttccccaagcactaccgaatgggccaaacgaggagtctaaccaattacctgcacctgactctttcgttgagaatgcagacagggcagatgaaggtggcaacacagttgggtctgtgtcagactcgttgaatgaccttactgggcctgaatctgaaacgggagttgcagaaaacactgttgaacccccagtagctgaggttacccaccgtcatctgcctgaagcgagccacagagaaaacagtccaagagttcctttggcgccgcagaatcctgttgtagcaatccagaagccaaagcatgacaggctgttgaccttggctgcatttgggcttacccttgctattatggccctcgtggtcaagaagttcttgaaaatcaatggcctggcaggtttcattgagggcaagttctgagtaggtttgtgcatacgttggataagagatgccccattccttgtgagtggctatgctatccgccgctataatttatataacccccttaaggtttgtaaatggctgttgtctagttatagatgaaatcaaagtgggatggtgccatcaataccccattgtatgtagtacactgattgaaaattgctgaggctttgcatcatctgttggtgtactagtggattgcgcgcgcgtagatttttggcatttttttgtggtttaattatgtaattataatgattgatgtttcaaatgcatgatgcgatttttcttgtatcacgtgttgttttcttaccttgtttcattcattgg

SEQ ID NO: 1534 - DNA, 1397 bp, Panicum virgatum
taaccggcctccattaatatcgcccacgcgcttccactacctctcgtcctctctctcctctcttcgattcccaattcgaaggctacccaacctgcgccggtaggcggcggcgccgaggctagagggttccctgaggcggcagcgatggcggccacggcgaagtacaaccggagcaacccggctgtgaagcggattctgcaggaggtcaaggagatgcagtccaacccctcccccgacttcatggccctccccctcgaggaggacatcttcgagtggcaatttgctatcctgggccctcgagacagtgaatttgagggtggaatctaccacggcaggatccagctgccctccgactatccgttcaagccaccttccttcatgctgctcacaccaagtggacgctttgagattcagaaaaagatttgtttgagcatatccaattatcaccctgagcactggcaaccatcatggagtgtgcgaacagcgctagtagccctgattgcattcatgccaacaaaccctggtggggcattgggctcactggactacaaaaaggaagatagacgagcacttgctataaaatcacgtgaagcaacaccgaaatttggctccccagaacgccaaaaactaattgatgagatccatgagcaaatgctcagtaaggctcctcctgttccccaagcactaccgaatgggccaaacgaggagtctaaccaattacctgcacctgactctttcgttgagaatgcagacagggcagatgaaggtggcaacacagttgggtctgtgtcagactcgttgaatgaccttactgggcctgaatctgaaacgggagttgcagaaaacactgttgaacccccagtagctgaggttacccaccgtcatctgcctgaagcgagccacagagaaaacagtccaagagttcctttggcgccgcagaatcctgttgtagcaatccagaagccaaagcatgacaggctgttgaccttggctgcatttgggcttacccttgctattatggccctcgtggtcaagaagttcttgaaaatcaatggcctggcaggtttcattgagggcaagttctgagtaggtttgtgcatacgttggataagagatgccccattccttgtgagtggctatgctatccgccgctataatttatataacccccttaaggtttgtaaatggctgttgtctagttatagatgaaatcaaagtgggatggtgccatcaataccccattgtatgtagtacactgattgaaaattgctgaggctttgcatcatctgttggtgtactagtggattgcgcgcgcgtagatttttggcatttttttgtggtttaattatgtaattataatgattgatgtttcaaatgcatgatgcgatttttcttgt

SEQ ID NO: 1535 - DNA, 1386 bp, Panicum virgatum
ctacctctcgtcctctctctcctctcttctttttttttttgggaacctctctctcctctcttcgattcccaattcgaaggctatacccaacctgcgccggtaggcggcggcgccgaggctagagggttcccctgaggcggcagcgatggcggccacggcgaagtacaaccgtagcaacccggcggtgaagcggatcctgcaggaggtcaaggagatgcagtccaacccctcccccgacttcatggccctccccctcgaggaggacatcttcgagtggcaatttgctatcctgggtcctcgcgacagtgagtttgagggtggaatctaccacggcaggatccagctgccctctgactatccgttcaagccaccttccttcatgctgctcacaccaagtggacgctttgagattaagaagaagatttgtttgagcatatccaattaccaccctgagcactggcaaccatcatggagtgtgcgcactgcactagtagccctgattgcattcatgccaacaaaccctggtggggcgctgggctctctggactacaaaaaggaagataggcaagcacttgctataaaatcacgtgaagcaccaccgaaatttggctccccagaacgccaaaaactaattgacgagatccatgagcaaatgctcagtaaggctcctcctgttccccaagtgctaccgaatgggacaaatgaggagtctaaccatttacccgcacctgactctttcgttgagaatgcagacagggcagatgaaggtggcaacacagtggggtctgtgtcaggctccttgaatgaccttactgggcctgaatctgaaatgggagttgcagaaaacactgttgaacccccagttgctgaggttaccaaccctcatctgcctgaagcgagccacagagaaaacagtccaagagttcctttggcgccgcagaatcctgttgtagcaatccagaagccaaagcatgacaggctgttgaccttggccgcatttgggcttacccttgctattatggccctcgtgattaagaagttcttgaaaatcaatggcctggcaggtttcatcgagggcaagttctgagtaggtttgtgcatacgttggataagagatgccccattccttgtgagtggctatactatccgctgctataatttatataaccccttcaggtttgtaaatggctgttttctagttatagatgaaatcaaagtgggatggtactatcaataccccattgtatgtagtacactgattgaaaattgctgaggctttgcatcatctgttggtgtatactgtagtatggcttgtttatattgtgcattttgtttggctgcggtgtggttttccatttgacttcataagaagtcattatattctca

SEQ ID NO: 1536 - DNA, 1327 bp, Panicum virgatum
ggtcctctctctcctctcttcttttttttttgggaacctctctctcctctcttcgattcccaattcgaaggctatacccaacctgcgccggtaggcggcggcgccgaggctagagggttcccctgaggcggcagcgatggcggccacggcgaagtacaaccgtagcaacccggcggtgaagcggatcctgcaggaggtcaaggagatgcagtccaacccctcccccgacttcatggccctccccctcgaggaggacatcttcgagtggcaatttgctatcctgggtcctcgcgacagtgagtttgagggtggaatctaccacggcaggatccagctgccctctgactatccgttcaagccaccttccttcatgctgctcacaccaagtggacgctttgagattaagaagaagatttgtttgagcatatccaattaccaccctgagcactggcaaccatcatggagtgtgcgcactgcactagtagccctgattgcattcatgccaacaaaccctggtggggcgctgggctctctggactacaaaaaggaagataggcaagcacttgctataaaatcacgtgaagcaccaccgaaatttggctccccagaacgccaaaaactaattgacgagatccatgagcaaatgctcagtaaggctcctcctgttccccaagtgctaccgaatgggacaaatgaggagtctaaccatttacccgcacctgactctttcgttgagaatgcagacagggcagatgaaggtggcaacacagtggggtctgtgtcaggctccttgaatgaccttactgggcctgaatctgaaatgggagttgcagaaaacactgttgaacccccagttgctgaggttaccaaccctcatctgcctgaagcgagccacagagaaaacagtccaagagttcctttggcgccgcagaatcctgttgtagcaatccagaagccaaagcatgacaggctgttgaccttggccgcatttgggcttacccttgctattatggccctcgtgattaagaagttcttgaaaatcaatggcctggcaggtttcatcgagggcaagttctgagtaggtttgtgcatacgttggataagagatgccccattccttgtgagtggctatactatccgctgctataatttatataaccccttcaggtttgtaaatggctgttttctagttatagatgaaatcaaagtgggatggtactatcaataccccattgtatgtagtacactgattgaaaattgctgaggctttgcatcatctgttggtgtatactgtagtatggcttgtttatattgtgcattttgtttg

SEQ ID NO: 1537 - DNA, 1299 bp, Pennisetum glaucum
gaaggcttcccaacctgcgccggtaggcggcggcggcggcgtgtagaggttccctgaggcggcagcgatggcggccacggcgaagtacaatcggagcaacccggcggtgaagcgtatcctgcaggaggttaaggagatgcagtccaacccctcccccgaattcatggccctgcccctcgaggaagacatcttcgagtggcaatttgctatccttggccctcgagacagcgagtttgagggtggaatctaccatggcaggatccagctgccttctgactatccattcaagccaccttccttcatgctgctcacgccaagcggacgctttgagattcagaagaagatttgtttgagcatatccaattatcaccccgagcactggcaaccatcatggagtgtgcgcacagcgctagtagccctgattgcattcatgccaacaaaccctggtggggcattgggctcactggactacaaaaaggaagatagacaagcacttgctataaaatcacgtgaagcaccaccaaaatttggttccccggaacgtcagaaactaattgatgagatccatgagcaaatgctcagtaaggctcctcctgttccccaagctctaccgaatgggccaaatgaggagtctaaccaattacctgcagttgactcttttggtgagtatggagacaaggtggatgaaggtgggtctgtgtcaggctcgttgagtgaccttgctgagcctcaacctgcggtgggtgttgcagaaaacgctgctgaacccccagtggctgaagttactaacccttatctgcctgaagctagccacagagaaaacattccaagagttcccttggcgccgcagaatcctgttggtgcagtccagaagccaaagcatgacaggctgttgaccttagctgcatttgggctgactctggctattatggccctcttgatcaagaagttcctgaaaatcaatggcctggcaggtttcattgatggcaagttctgaggtttgtgcatacaagagatgcctcattcctcgtctgagtggctatgctatgtgctcctataatgtaaccccgtaaggtttgtaaatggctgttgtctagttatagataaaatcaaagtgggatcatgttatgttaccccattgtacgtaggacactggacactgatggaaaattgctaaggctttgcatcatcagttagtgcatactgtgctgtggcctgtctatagtttacaatttgtttggctggctcggtgatccatttggtttctaagagaaggccatctcgtattctcaacaaaaa

SEQ ID NO: 1538 - DNA, 1895 bp, Oryza sativa
ggtactacctatatgatctttttttccattttttacaattttgaatttgtccaaactaaatgaatttatggatagatgatagctcttaatttgttgatggatgacataaattgaagggaaacaaccacctctattatagaagcttcttaggcccaacatttaaggcccagccgcccagctggcccaacgcaccaaaccaatcggaatattccattcactcaccgcacgacctataaaaccaatagcgacgtgccacgttagcccatccacgtcgccccccctcccactctgccctcgccgacacgtgggcccaacatagtaaccggtcccacgagccagggaaagaccagaaccagctcttcctcctttttaatccacccaccgttcccactcctccgctccttcctcccctctcccgattccccaattcggaggccaagcctgcaccggcaagcggcggcggcggcggcgacgaggcgagagggttcccttccgcggagccggcggagatggaggccacggcgaagtacaaccggggcaacccggcggtgaagcggatccttcaggaggtcaaggagatgcagtccaacccgtccccggacttcatggccatgcccctcgaggaggacatcttcgagtggcaatttgcgatcctggggccacgagacagtgagtttgagggaggaatctaccatggaaggatccagctgccatcggactatccgtttaagccaccatcattcatgctgctcacgccaagtggaagatttgagattcaaaagaagatttgtttgagcatatccaattaccaccctgagcactggcaaccatcatggagtgtgcgcacagctcttgtagctttgattgcattcatgccaacaccaggtggtggggcattgggttcgttggacttcaaaaaggaagatagacgggcactagctatcaaatcacgtgaaacaccaccaaagtttggctctgcagaacgccaaaaagtaattgatgagatccatgagcaaatgctcagtagggctccccctgttcctcagctgctgacaaatgaaactaatgaggagactaaccaattgcctgcatctgatgcttctgatgagcatgcacacaaggcagttggaggcgtgaacacggctgggtccaactcagactctgttaataatgaccttccaaggcctgattctgagtcagaaattgtacaacacattgttgaaggtcggacagaaggggttagcaaccattcaagggccaacttgagcagagaaaacattccaagagttgctccaacgccacagaatcctgttgttgcaatccagaagccaaagcatgacagattattgaccttggctgcatttggactcactcttgctattatggcccttgtgatcaagaagttcttcaaaatcaatggtctggccggttacattgagggcaagttttaggtaggtttgtgcatagatttgataagagctatactaccccattcggtgtctgagcggctgctatgcttaccataagttataaacccctaagaattgtaaatggctgtttagttatagacgaagttgaattggtccattggtactacccgtaccttattgtatatgcagtacacctgatgaaaatcgttctaaggtcttacatgatgtgcacaattgtatatgcggtactcatgaaaatcattacaagatattacatgatgtgcgcaactgcacgtatgttgtgcaatggccagcgatccgtttgttcttgacgggcatgaaaattcttactccctctctttcagattgctgccattctagcattcagtttgtcttatcaagacacttgtcatttctcacctcaaagcatttctctagccttcattaatgcagctacgcactact

SEQ ID NO: 1539 - DNA, 1274 bp, Cenchrus ciliaris
  misc_feature (411)..(411): n is a, c, g, or t
  misc_feature (427)..(427): n is a, c, g, or t
  misc_feature (438)..(438): n is a, c, g, or t
  misc_feature (453)..(453): n is a, c, g, or t
  misc_feature (460)..(460): n is a, c, g, or t
  misc_feature (472)..(472): n is a, c, g, or t
  misc_feature (603)..(603): n is a, c, g, or t
  misc_feature (619)..(619): n is a, c, g, or t
  misc_feature (722)..(722): n is a, c, g, or t
ccaacctgccccggtaggcggcggcggcggcgtgtagagggttccccgaggcggcagcgatggcggcggcggcgaagtacaatcggagcaacccggcggtgaagcggatcctgcaggaggtcaaggagatgcagtccaatccctcccccgacttcatggccctgcccctcgaggaagacatcttcgagtggcaatttgctatccttggcccccgagacagcgagttcgagggtggaatctaccatggtaggatccagctgccttctgactatccattcaagccaccttccttcatgctgctcacgccaagcggacgctttgagattcagaagaagatttgtttgagcatatccaattaccaccccgagcactggcaaccatcatggagtgtgcgcacagcgctagtagccntgatgcattatgccancaaaccctggnggggcattgggctcnctggctncaaaaaggaagncagacaagcacttgctataaaatcacgtgaagcaccaccaaaatttggctccctggaacgtcagaaactaattgatgagatccatgagctaatgctcagtaaggctcctcctgttccccaagctctaccgnatagtccaaacgaggngtccaaccaattacctgcagctgacccttttggtgagcatggagacaaggtggatgaaggtgggtccgtgtcaggctcgttgagtgaccttgctgagcctcancctgcctcgggtgttgcagaaaacactgctgaacccccagtggctgagtttactaaccctcatcagcctgaagctagccacagagaaaacattccaagagtacccttggcaccgcagaatcctgttgttgcaatccagaagccaaagcatgacaggctgttgaccttggctgcatttgggctgactctggctattatggccctcgtgatcaagaagttcctgaaaatcaatggcctggcaggtttcattgagggcaagttctgaggtttgtgcataaagagatgccccattcccggtctgagtggctatgctatgcgctcctataatgtaaccccgtaagttttgtaaatggctgttgtctagttatagatgaaatcaaagttggattgtactatgtccccccattgtatgtggggcactggacactgatggaaaattgctaaggctttgcaatttgcatcatctgttgttagtgtagtgtgctgtgacttgtctttagtttgcattttgtttggctgatgcggtgatccatttgacttaaatgagaaagca

SEQ ID NO: 1540 - DNA, 2715 bp, Sorghum bicolor
cagcgctggggtgcacgcggcgaacggcgccggcctacgccctggggctacggggcagatcgggccgtcccgctgcggcgccgccggaggcgaagtgaaaatagattgggagcgcgatgcccctcgcctcgaatgcgggctccgtcactcaccgccggcggccggcggttggtcgcgctgggccgcggtcctgccccaccccggtccccaagcctccgctttgaatatccacgacacgacggtaaccgaacaaacctcagatgatgtagcactttggtcacaactgggaacatcagaatttctcttagccacacgaagtgtgcatcattgctagatatgcacctccaccagtatatatttggcggaagaatcaaagtataaagaatatgttcctcgatcctcgcacctatgtcgcatggaaattattaaagatattgtccatggatagcttaaatgatagttactccgccaaaatctgaagaaaggagggcaaaaatacatagagagagaaaacaaaaaacatttcatcaatgtaaatcgttactatcatgtataggaatatccaggaggtcaacttctgtttgtgcttatttcaagtgttgaagcaacttacatatttgtatgaattatgaaagatgataaatttgacaatattcttttggtttaactggtttcgttgcagaccattctgcaatgtgtgttaggcaccattgcatgcaaaaatcttttcgctgccattgcatgttcatgtggtgttgccctgcctgctcaatcacaaattcataactgcgctcagttgtaggtgtagccctgcttctagattgaaatctcaagttattatgttataataatgggctatacgtgccaatacaaaatttgtttgacatcatctagttatatgaactacttaactgctttatgttttgtctaaccgcctacagaatgttcacaccagaaatagttcctgactatatctcatattgctgaggtcaagtactccttccattcagaatactcgggaacttttactgtaccaactttgagagtttttgactgggtatatatgttcaattaattaaagggacaacaatagtgataatagatttgtgatcattccatgtatcaacttgatgtattgctattgaaattctgaatcttcctctattgggaaaaaagatttgtgataaaaggtgctttaaagatattactccctctggtcactaaaagaaagacttatgacagctaaattgcactacatgcagtctatgcaggctgtcttaaacatcttcttttaatgactggagggagtatatgctttaatttgcgtatgcatatatcaaaacttaactttaaacaaaaaagtcaaagtggccaagtatatggaaacagagtattatttgatttattttttgtagtttatatagctgttaatatgttttcagaagtaaatattaatattccatggtgtaggtacaaaatgtaatactgtgaaatcctgctttgtttagcatcactttcctcttgcatattttcctttctcgtttctgctttcatctcatactcttgttcgatttggatagctcagttagaaagggtaagatcaaagcatctccgtgcctccacagcaaaccctggattcgcaattattgaggcccctccactataaaagggcatccagccacaaggaatgaacacagccagcaagcagacaacaaggacaacacagcaactgaaaccctagtaccaagaacaaacaactacaagagacttcgcaagttcacagaggctaggtgttgactgcgaatgaacatccagaggaagcctggagattggaactgcaagaactgccagcacctcaacttcagccgccgtgattactgtcagcgttgccgtgacccacgccctgacttgcagttcagtgacagctatagcacgggtggtgtgctgacctccctggacatccgtccaggtgactggtactgcagctgcggctaccacaactttgccagccgcagcagctgcttcaagtgcggcaccatcgtcagggacttcccagcaggacaaggtgcagccggtgctgaggttgacttcgctcgtggacgcgacagcgccgcagttcgtgctgggtggaaagctggcgactggatctgcacaaggcctggttgcaacgtgcacaactttgctagcaggatggagtgctataggtgcaatggaccaagggaggcagcaggcaccgggaagtaagaggcgaccgaggtgataccaagaccgtgagatgtgacgagctggccgagcgatggaaccaactgctgtcacacactcaccatcaggcatccaggaaggatgagtctactacgtacacaagtatattgttgattgccatttgccaagcgtagtaccgctgctgccgttgcgtgggtggagaagtacccaagcacaacaaccgttacgcgcgcgcgcgtgtgtgtttgctctttttttttgaggttgtgttgattcagtaactgctgaattttacggcttgatgatgtacttgcattatgtattggtcttaaacagcatatataataattatctaataagtgtttgcttatctatactctgttggtgcatgaccctacgcctattactgatcaatgttttgctggtcttgaaacctgtgtggtttactagcatgtatcatggcattgtcttttttttttgtgtgtgtgcacg

SEQ ID NO: 1541 - DNA, 1193 bp, Setaria italica
tttattttcttttgagtacattttatatagctgttaatacatattcagaagtaattaatatcccgtggtgtacatccaagatgtaacagtaacactgtgaaattctcctatctttagcatctttctcctcttgcatattttcctttcctgcttctgccttcgtctcgtactcttgttcgatttggatagctcagttagaaaggctaagatcaaagcatctcggtgcctccacagcaaaccctggattcgcaattattgaagtgcctccactataaaaggggaaccatccacaaggaatgaacacagcaagcaagcacacaacaaaagcagcacaacaactgaaaaccctaggaccaagaaaaagaagaggctttgcaagttcacaggagctagctgtttactgcgaatgaacatccagaggaagcctggagactggaactgcaagaactgccagcacctcaactttagccgccgtgactactgtcagcgctgccgtgatccacgccctgatttgcagttcagtgacggctacagcactggtggtgtcctgacctccctcgacatacgcccaggcgactggtactgcagctgcggctaccataactttgccagccgcagcagctgcttcaagtgtggcactattgttagggacttccctggggggcaaggtgcagccggtgctgagggtgactttgctcgtggccgtgacagcgccgcagttcgcgctgggtggaaagctggcgactggatatgcacaaggcccggttgcaacgtgcacaattttgcaagcaggactgagtgctacaggtgcaatgcaccaagggacgcagtaggcaccgggaattaagaaacgactgaggtgacccagaccgtgagatgtgacgagctggtcgagcatggaaccgattgctgtcacacactcaccatcaggcgtcgaggaaggatgagtttactacgtacacgattatattgttgattgccaagttccagtacttcactactgctgcatgcgcggctgtgagcgagggtggagaagtacccaagcttttcaattgttacctctgctgtttgccttatcttttttagtgtgtgtgtgtgttttgattcagtgactgctgaatgatgcggcttgatgcacttgcattatgtattgatgttaaatatcatatatacaattatctaagtgtttgctt

SEQ ID NO: 1542 - DNA, 3366 bp, Panicum virgatum
tttatttgcttttgagtggtttttattttatataacttgtaatacgtattaagaattaattaatatcccgtggtgtagatccaagatgtaacactgtgaaatcctcctatctttagcatctctttcctcttgcatatttcaattcttgtttctgctttcatctcatagtcttgttcgatttgcatagctcagttagaaaggccaagatcaaagcatctccgtgcctccacagcaaagcctagattcgcaattattgagctgcctccactataaaatgggaaccaaccacaaggaatgaacacagcaagcaagcgcacaacaaggacaacacagcaacagaaaccctggtaccaagaagaaagaagaggctttgcaagttcacaggagctagctgtttactgcgaatgaacatccagaggaagcctggagactggaactgcaagaactgccagcacctcaacttcagccgccgtgactactgccagcgctgccgtgaaccacgggcggacttgcaattcagtgacggctatagcactggtggtgtgctgacctccctcgacatccgcccgggcgactggtactgcagctgcggctaccataactttgccagccgcagcagctgcttcaagtgcggcactatcgtcagggacttcccggcagggcaaggtgcagctggtgctgagggtgactttgtttgcggccgtgacagtgccacagttcgcgctgggtggaaagctggcgactggatatgcacaaggcctggttgcaacgtgcacaatttcgcaagcaggactgagtgctacaggtgcaatgcaccaagggaagcagtaggcaccggaaattaagaaacgactgaggtgaccgagaccgtgagatgtgacaagctgctggtcgagcatggaaccgattgctgtcacacactcaccatcaggcgtcaagggaggatgagtctactactacctacacgagtatattgttgattgccaagtactgcactactgctgtcccagaggttgcgagggtggagaagtgcccaagcaaagctttcccattgttacgtgtgctgtttgccctttttttgtgtgttgattcagtgactgctgaatcgtacggcttgatgtactttcgtaatgtattgttcataaacatcatatatagttacccgagtgtttgcctatttactctgctggtgcatgtctcctacttcattcttttttggctgcccttgaaacctgtgctttacttgaatcacttgaagctcactagtgtggatctgcttgtaacttgtcctgtttgtgcaaagcttgtatcgttgtaaaccttttgcagccaggatgacacttgagaggatgctgtgcttgtaacttgtttgatttttcatctgcgcctgtaaattgtttcagatgcagctgaagactgcacatgcggccatgccaactttgaaaatgggagcaaattgtttcaccggatcgacataccgggccgacggcgagccttgccgtttgctgggctaggaaggcctggatgggcctccggcagcgacgaaacgggggcccacaagcaaattgatgatggcagcgacactccccgtccaggtccagtgattcaatccaagtggctgccgaccctaccctcctctgccgggaagaagctgcagccggcagcagctaccagacaaacccaccccaccgccatggccatccatctccgcgcccacgccttcgcggcaaacccgctgcgtggagtctccgcctccaccaccgccgtctcgccctccgcggccgccgaggccctgcgctccctcctcgaaccccagctccgccgccgcgggcgccgccagtccccacccgccgcacctctccaagatcctccctttccgccggggccgcccgctcgcgcgctccccggaccctcctgcctccgctccccctcccgcggcgccggcctggcgcctcgcgtggctcccaccctcccgcgtccccggggtggccccggacgccttcgtcttcctgggcgcgcacgccgagggggacggcaaggaggccgcggcgtactgggccgtcgatgtcagcgacgacgagggcccgagggtcgacagcggctccggggacggggatgggtcggcgtttgtggacctgaggacgctcatggtggccacggactggagcgacaaggacgccatgggggacctcgccatcgccggacatgctcgggcactgctggagtggcacaatacggcaaaattttgtggagcttgtggagcgaaggctgttcctacagaagccggaaggcgtaagcagtgcagcaacgagtcctgcaagaagaggatataccctcgagttgacccagttgtgatcatgctggtcatcgataaagaaaatgaccgtgcactcttaagccgccagtcaagatttgtgcctcgtatgtggagttgccttgctggttttatagagccaggagaaagcctggaagaggcagtgagaagggaaacgtgggaagagactggtattgaagtcggtcaagtaatatatcatagctcccaaccgtggcctgtcggtccaaatactatgccatgccaacttatggtgggtttctttgcatatgctaaatcattggagatacatgtggataagcaggagcttgaagatgcccagtggcacagccgtgaagacatcaagaaagcgctgacatttgcagaatatgagaatgctcagagaaccaacgctctaaaggtcaatcaaatgtgcaagggtgctgagaaagggcagagcatcgccgaagacttcaaagtgggaggtggcgaacctgttcctatgttcgtccctggacccttcgccattgctcatcacctaatatcggcatgggctttcgagggagcaccaaaggtgcctagttccttctcaaatctataagcctggaccctaaagtagggttcctattgttcagattcattggatggaaggtatagtgaattggaatccttgcaggcacatgaatcatgccttgtcgttgttgtgagatttgatatggtagtggtactattcattgccagttgtaatatgcggtcaagagaaatactagctaggtacaggagacttgccgaaggattcggcgtcactggacatttctatccattgtttgtcaaattttgatggttttagtacatggtatgttatgtgtatagatacaacgcaaatacactcatgtatagttattcagagaactggaacgaagcctgattttccatctttacctgagccttgaggcattggacaattcatttgtacatcaactttggtaaagtttatttttttgatcaaacgtacctgtattaaactaaaagatacggtacagagaccctttgtt

SEQ ID NO: 1543 - DNA, 823 bp, Panicum virgatum
tatattcatatatatatgtgtatataatattgcagcacaacaagagctagctgtttactgcgaatgaacatccagaggaagcctggagactggaactgcaagaactgccagcacctcaacttcagccgcgtgactactgcagcgctgccgtgaaccatgggcggacttgcaattcagtgacggctatagcactggtggtgtgctgacctccctcgacatccgcccgggcgactggtactgcagctgcggctaccataactttgccagccgcagcagctgcttcaagtgcggcactattgtcagggacttcccggcagggcaaggtgcagctggtgctgagggtgactttgctcgcggccgtgacagcgccacagttcgcgctgggtggaaagctggtgactggatatgcacaaggcctggttgcaacgtgcacaatttcgcaagcaggactgagtgctacaggtgcaatgcaccaagggaagcagtaggcaccggaaattaagaaacgactgaggtgaccgagaccatgagatgtgacaagctgctggtcgagcatggaaccggttgctgtcacacactcaccatcaggcgtcaagggaggatgagtctactactacctacacgagtatattgttgattgccaagtactgcactactgctgtcccagaggttgcgagggtggagaagtgcccaagcaaagctttcccattgttacgtgtgctgtttgccctttttttgtgtgttgattcagtgactgctgaatcgtacggcttgatgtactttcgtaatgtattgatcataaacatcatatatagttacccga

SEQ ID NO: 1544 - DNA, 4645 bp, Sorghum bicolor
gtgacgccgcacgacgccatcggtcgcacgcaccaggaggtttgcggcaccacaccagcactcggcactcggcagtcggcagcggcagaggggccccaagcccaagcccaaggctacgctacgaccacacgacacgggattccgacgcgattagccgcgtgctctgcttatccggcggatgccgcccttgatccttcgttaacactggagctctgatgcgcgtcgtcgtcttgttcgcgacagcgaaggaagcgggggggagttggtagtagatcgataaaagggcggcgtctttgtttcccatctttcctcacaaaagcgagagaccctggtggggtgggggatcacagacagacagagcagcggctgcccggcggcaccacaaaaagcgttcgtcggggctttggattcccaggaattccgttccaaagcaccgcagcacccgcagcagcagccgaatcgcgggaccccgacgcgcgcgccggaccgcctgcgcacaccaccgcacagcgcacgcacgcacgcacgcacgcctactcctcttcctcccctcccctcccctgtcccctcctccaaccgtccgtcaccctcctcccgccgcgcagcagccagagcagagcggagcgagcaaatcctggggccgggggggctttcgcacccgctccgatctccccggtgctggtggattcgctcgctccccttttcttgacgccgggtcgggttgggttggatttggttgcgaggtgaggaggtgtggttgagggtgggagaggagagcgagctcgcgcgctcgggtggtggcggagtggttactactgcttccccgcttggcttcttgctcgcgccccgctgggctgggccgtgtcgtgccattaaagccggcgcctttgggttttcttctctctccacctctctctatccgcccccgctctcccactcccctctccctctctagctccagattggtgccttccttccccccgtcctcctagcggtcggtggttggagctcgactggggctctgaggtccaaatccgccgccttcccgtggcgcgcccctccggaattcttgccttcttgggctccgaatctcgccgccggtccccgccgcgggggggagtttgattcgcggcgtttcttgccaattcgggggtgatttgggcccctggatggcgaggatttgagtggattcgtcgaggggaacaagtggaggtggggttctgatttggttcgccacttcgccgtggtatgtgccatgaggaagctcttcttctccgagtcggcctgcaaggagaccaagctccactccgcgccccactcatggctgcccctcgagagggggaagctctccaagttctccggccatgccgccgccagctcctccatagattccttgatgaagatgccggagccggcggtgcttccgcacttcaagccggccgactatgtcgacatactggcacagatacacgaggagctggagtcctgctctcctgacgagaagtcctgcctgtacctgctccagttccaggtcttccgcggccttggtgaggccaagctgtcgcggaggagcctccagtccgcgtgggagaaggcgagcaccatccacgagaagctcatctttggggcgtggctcaagtatgagaagaaaggggaggaggccattgccgacctgcttagctcgtgtggcaagtgctcgcaggagttcaggctgctggatttcgtgtcgcaggtctccactgggtcacatgtgatgagctatgatgatgatgatgatgagtctgatgagtttcagggttctgcggtggttcatttccggataagagatgacatgattgcatgtgatcggaggaagctcgcggctttgtcaactccgctttatgcaatgcttaacggtggatttagggaatcgtatctggaggtcattgacatgtctagaaatggcatctccccaattggcatgagggcaatcagtaaattcagtctatcaggaagactaccatacttgtccgctgatgctatcttggagatgcttgattttgccaataagttttgctgcaagggcctcaaggatgcctgtgagcgaaagcttgcttctttcgtctcttcaaggcaagatgctatagacttcatggagtgtgctcttgagctgggctgttccatccttgctgcttcgtgcttgcaagtgctcttgaatgagcttccagagtgcttgaatgatgaacaagtggttaggatattctcctctgcaaataaggcacagagattgacaatggttggcaatgcatctttctccctatattgccttcttagtgaagtctccatgagtaccaacccgacatcggatgtcactgtaagtttcttggaaaagctggtagagtcagcatcagattctaggcagaaacaactagccttacatcagctggcatgcaccagatttctaaggaaagattaccctgaatctgagcgcctgttcaatgctgccttttctgccggccatctctattcgttagtgggtttggctagattggccgctctgaggggtaataagcattttgctctcaagtttctagactctgttatgtcatctcggtggcctcttggttggatgtatcaagagagagcactatatttggaaggtgataacaagttagaaaatcttaacaaggctacagagttggaccctactcttacatatccctatatgtttcgagctgcatctttgatgaaaaggcaaagtgttgaagctgcattgatggagatcaaccggatccttggattcaagctggtgctggagtgcttagaactgaggttctgttgctaccttgctcttgaggattatagggctgccttatgtgacgtgcaggcaatcctcactcttgccccagattatcgtatgattggtggccgggttgctgccaagcagctgcgaatgctagtgctagagaatgtagagcagtggacagctgctgactgttggatgcaactttatgatcgctggtcatctgtggatgatatagggtccctctctgttatatatcaaatgctggagtcagataatgccaaaggagttttgtactttaggcaatctttgcttcttctcagattaaactgtcctgaggcggcaatgaggagtttgcagcttgctcgtgagcatgcttcaagtgatcatgaaaggcttgtctatgaaggatggatattgtatgatactggccactgtgaggaaggactgcagaaagcagaagcatcaattgcaatacaaaggtcatttgaggcattttttctgaaagcttatgctttggccgattcaagtcttgatccttcgacctcagcaacagttgtatcacttctagaagatgcattgcggtgtccctcagatagacttcggaagggtcaggctctaaacaacctcggaagtgtttatgtggattgtggaaagctagacctggcagctgaatgctacattaacgccctaaagattggccacaccagagcgcatcaaggccttgcaagggttcatttccttcggaacaacagagctggtgcatacgatgaaatgaccaagctgatagagaaggccaggaacaatgcatcagcatatgagaagagatccgagtactgcgaccgggagctaacaaaaacggacttgcagatggtcaccaaactggaccctctgcgagtctatccctacagataccgtgctgctgtgctgatggacaaccacaaggagaaagaggccatcgcggagctgaccaaggctatcgccttcaaggcggacctgaacctgctccacctgcgcgcggccttccacgagcacattggcgacatctcgagcgccctccgggactgccgcgcggccctttcggtggaccccaaccaccaggagatgctggagcttcaccaccgggtgaacagccaggaaccctgagcgagcgccccatggtgtacatacaggacaggacaggaaccctcatagccataccagtgtatgttttgtaccatacacagcagatcaatgtaaggatagtagaaagccagtttagatccctccctcctccccttgaaaaccaaacacccccattccttgtgtccggtaattagatgtgttgtttgctatagcctccccttagtaaattattgttgtcgattgtgattaagcctcctaattgtacccaccatgtggcccagcgggccattatgtcagaatcaagaagttttgactgtaccacgtgtatgtaaatgaaatggggaaaaggatgaatggaagcttttgtcggcgcaaaactgtcaggcttgcaggcaacttgccgatcactaattgattgcacatgtgcaggtttatgcttttggttgttgatttatctggagggttgtttgtttaatgctagtacccatcagtcaggattaggaatttagaatgaagtcattattgcactgattgggggtgaagactgaaggagagcaatggctgacaacagcttctgaaaatgaatggtcaatgggtgaggactggggacagggcagggagccagggcatcactttctgaggctgaatggtccatgaatcggaacgtctccctagtgatgggggaaagagagaaatcgtaggattccttttgcccatgatgagcagcacttggtggtg

SEQ ID NO: 1545 - DNA, 3837 bp, Setaria italica
gagggaggaggggatcactgcagcgggccagcggctgcacaaaagcgttcgcgtcggggctttggattcccaagaattcccttccaaagcggctgaatctcgggaccccgcctgccgcctgcgcacgcgcctgctcctcttcctccctccctcctcatcctcctccacaccgcagctccagcggaagcggagcagggcgagcaaatcttggtgggttcgctgcctgcctgccggtgccggccccgcccttttgcgggttgggttggatttggttgcgaggtgtggtgtggttgggggtgggagagctcgggaggagaggagggggggagtggttacttccccccttggcttcttgccccgctgggccgtgtcgtgccattaaagccggcgcctttgggtttccttctctctccacctccctctctctctacccgacccgctctctctctctctctctctctctctctctctctctctctctctctagctagatagctgcagattggttcctgcgccagcgcgcagctcgactggggctcgggagtccaaaggcgccgcctttccgggttcgcccccgccgcggaattcttgccttcttgggccccgaatctcgccgccgttccccggacaccggtttggcgcgggagggtcgattcgcggcgtttcttggctgtccggggggtgattccagccctggatgggaaggatttgagtggattcgggaagaggaggaggaggcggagctctgattcggttcgccgtggtatgtgccatgaggaagctcttcttctccgagtcggcctgcaaggagaccaagctccactccgcgccccactcgtggctgcccctcgagagggggaagctctccaagttctccggccatgccgccggcggctcctccatagagtctttgatgaagatgccggagccggcagtgctcccgcactttaagcccgcggactatgtcgacaaactggctcagatacacgaggagctggagtcctgccctccggatgagaagtcctgcctgtacctgctgcaattccaggtcttccgcggcctgggggaggccaagctgtcgcgacggagcctccagtccgcgtgggagaaggcgagcaccatacacgagaagctcatctttggggcgtggctcaagtatgagaagaaaggggaggaagcgatctcggacctcctcagctcctgcggcaagtgctcgcaggagttcaggctgctggatttcgtgtcgcaggtctccacggggtcacatgacatgagctatgatgatgagtctgatgaatttcggggctcagcagtggttcatttccggataagagatgatatgattgcatgtgatcggcggaagcttgcagctttgtcaaccccgctatatgcgatgctcaatggcgggttcagggaatcatatcttgaggtcattgacatgtctcgaaatggcatctcccctattggcatgagggcaatcagtaaattcagcctgtcaggaagattaccgtatttgtcagctgatgctattttggaaatgcttgattttgccaataaattttgctgcaagggcctcaaggatgcttgtgagcgaaagcttgcttctttcgtctcctcaaggcaagatgctatcgacttcatggaatgtgctcttgagctgggctgttccatccttgctgcttcatgcttgcaggtgctcttgaatgagcttccagagtgcttgaatgatgagcaagttgttaggatattctcctctgcaaataagcagcagagattgacaatggctggcaatgcatctttctccctatattgccttcttagtgaagtctccatgagtaccaacccgacatcggatgtcactgtaagtttcttggaaaagctggtggagtcagcattagattctagacagaagcagttggccttacatcagcttgcatgcacaaaatttctaaggaaagattatgctgaagctgagcgcctgttcaatgctgcattttctgctggccatttctattcggtagtgggtttggctagattggcctctctgaggggtaataagcattttgctctcaagttgctagactctgtgatgtcatctcggtggcctcttggatggatgtatcaagagagagcactatatttggatggtgatagcaagttagaaaatcttaacaaggctactgagttggaccctactctgacatatccctatatgttccgagctgcatctttgatgaaaaggcagagtgttgaagctgcattgatggagatcaaccggatcctgggattcaagcttgtgctggaatgcttagaactaaggttctgttgctaccttgctcttgaggattatagagctgcgctatgtgatgtgcaggcaatcctcacgcttgccccagaatatcgtatgattggcggccgggtggctgccaagcagttgcgtatgcttgtgctggagaatgtagagcagtggacaactgctgactgttggatgcagctctatgatcggtggtcatctgtggatgatataggatcactctctgttatatatcaaatgctggagtcagatactgccaaaggagttttgtactttaggcaatctttgcttcttctcagattaaactgtcctgaggctgcaatgaggagtttgcaacttgctcgtgagcatgctgcaagcgatcatgaaaggcttgtctatgaaggatggatattgtatgatactggccactgcgaggaagggttgcagaaagcggaagcatccatcgcaatacaaaggtcatttgaggcattttttctaaaagcctatgctctggctgattcaagtcttgatccttcgacctcagcaacagttgtatcacttctagaagatgcattgcggtgtccctcagatagacttcggaagggtcaggctctgaacaacctcggaagtgtttatgtggattgtgggaagctagacctggcagctgaatgctacattaacgccctaaagattggccacacaagagcacatcaaggccttgcaagggttcatttccttcggaacaacagaacaggtgcatatgatgaaatgacaaagctaatagagaaggccaggaacaatgcatcagcatacgagaagagatcagagtactgcgaccgggagctgacaaaggcggacttgcagatggtcaccaaacttgaccctctacgagtctacccctacagataccgtgctgctgtgctgatggacaaccacaaggagaaagaggccatcgcagagctaaccaaggcaatcgccttcaaggcggacctgaacctgctccacttgcgcgcggccttccacgagcacatcggcgacatctcgagcgccctccgggactgccgtgcagccctatcggtggaccccaaccaccaggagatgctggagcttcaccaccgggtgaacagccaggaaccctgagccccatggtgtacatacaggagctctcatagccaaccagccataccagtgtatgttttgtaccatacacagcagatgaatgtaaggatagtagaagccatttaggtcctctccttcaaaaccaaaccccattccttgtgtccctaattagatatgttgtttgccatagcctcctcttagtaaattattattgtcgattgtgattaagcctcctaattgtaccggccatgtgccccagcagcccatgttgccagaatcaaaaagttttgactgtatcattgtgtaaatgaaatgggaaaaagaatggaagctttgtcggcgctactaaactgtcaaactggtgaccacttgctatcctggctgattgattgcacatgtgcagatatgcttcctggctgttg

SEQ ID NO: 1546 - DNA, 3854 bp, Zea mays
ccagaaaagccgagcggagcgagaccagaccagtgtgagagagagagcggggtcacagcagcgcccagcggccgcagcacaaaagcgttcgtcgggggctttggattcccaggaattccgttccaaagcagccgaatcgcgggaccccgcctgctcgctcctcttcttccctccaaccgcccccccctcccctcctcctcccgccgccgcagcgagagccgagagcggagcgagcaaatcttggcgtttcgcgcccgctctcgcagtctccgggcgggggccgcctggcggagtggttacttccccgctggcttcttgctgcgccccgccattaaagccggcgcatttgggtttctctctccacctctctctatccgccccccaccgcgctctcgccctccctctccctctctagcggtagattggtgctgttcccccctaatcggtcggcggttgggggccgggttccgacgtctgcccgggagctcgaccgggcctccgatccgggctcccaagccgccgcctcccggggcgcccctccggaattcttgctttctcgggctccgaatctcgccgcctgtcgtcgccagcggctggcgcgggggcttggttcccggcgtttcattgcgaattcgggggcgatctggggcccctggtctggatggcgaggatttgagtggattcgagacgaacaagtggaggtggagccctgatctgggtggcgcccccgccgtggtatgtgccatgaggaagctcttcttctccgagtcggcctgcaaagagaccaagcttcactccgcgccccactcatggctgcccctcgagagggggaagctctccaagttctccggccatgccgccgccggctcctccatagagtccttgatgaagatgccagagccggctgtgcttccgcacttcaagcccgcggactatgtcgacgtactggctcagatacacgaggagctggagtcctgcccccctgacgacaagtcctccctgtacctcctccagtatcaggtcttccgtggcctcggcgaggccaagctgtctcggaggagcctccagtctgcgtgggagaaggggagcaccatacacgagaagctcatcttcggggcatggctcaagtacgagaagaaaggggaggaggccatctccgacctgctcagctcgtgcagcaagtgcttgcaggagttcaggctgctggatttcgtgttgcaggtctccactgggtcacatgtgataaactacgatggtgatgatgatgagtttcggggttctgcggtggttcatttccggataagagatgatatggttgcgtgcgatcgtcggaagctcgcggcgctgtcaactccactgtatgcaatgcttaacggtggatttagggaatcatatctagaggtcattgacatgtctagaaatggtatctcccctattggcatgagggcaatcagtaaattcagcctatcaggaagactaccgtatttgtcagctgatgctatcttggagattcttgattttgccaataagttttgctgcaagggcctcaaggatgcctgtgagcgaaagcttgcttctttcgtctcttcaaggcaagatgctatagacttcatggagtgcgctcttgagctgggctgttccatccttgctgcttcatgcttgcaagtgctcttgaatgagcttccagagtgcttgaatgatgaacaagtggttaggatattctcttctgcaaataaggcacagagattgacaatggttggcaatgcatctttctccctatattgtcttcttagtgaagtctccatgagtaccaacccaacatcggatgtcactgtaagtttcttggaaaagctggtagagtcggcatcagattctaggcaaaatcagctggccttacatcagctggcatgcaccaaatttctaaggaaagattaccctgaatctgagcgcctgttcaatgctgcattttctgccggccatctctattcgatagtgggtttagctagattggcctctctgaggggtaataagcattttgctctcaagttgctagactctgtcatgtcatctcggtggcctcttgggtggatgtatcaagagagagctctatatttggatggtgataacaagttagaaaatcttaacaaggctactgagttggaccctactcttacatatccctatatgttccgagctgcatctttgatgaaaaggcaaagtgttgaagctgcattgatggagatcaaccggatacttggattcaagctggtgctggagtgcttagaactaaggttctgttgctaccttgcccttgaggattatagggctgccttatgtgacgtgcaggcaatactcactcttgccccagattatcgtatgattggtggccgggttgctgccaagcagctgagaatgctagtgctagagaatgtagagcagtggacagctgctgactgttggatgcagctttatgatcgctggtcatctgtggatgatatagggtccctctctgttatatatcaaatgttggagtcagataccgccaaaggagttttgtactttaggcaatctttgcttcttctcagattaaactgtcctgaggcggcaatgaggagtttgcagcttgctcgtgagcatgctgcgagtgatcatgaaaggcttgtctatgaaggatggatattgtatgatactggccactgcgaggaaggattgcagaaggcagaagcatccattgcaatacaaaggtcatttgaggcattttttctgaaagcttatgctttggctgattcgagtcttgatccttctacctcagcaacagttgtatcacttctagaagatgcattgcggtgtccctcagatagacttcggaagggtcaggctctaaacaacctcggaagtgtttatgtggattgtgggaagctagacctggcagctgaatgctacattaatgcactaaagatcggtcacaccagagcgcatcaaggccttgcaagggttcatttcctacggaacaacagagctggtgcatacgacgaaatgaccaagctgatagagaaggccaggaacaacgcttcggcatatgagaagagatccgagtactgtgaccgggagctgacgaaaacggacctgcagatggtcaccaaactcgaccctctgcgagtttatccttacagataccgtgctgctgtgctgatggacaaccacaaggagaaagaggcgatcgcggagctgaccaaggccatcgccttcaaggcggacctgaacctgctccacctgcgcgcggccttccacgagcacgtgggcgacgtctcgagcgccctccaggactgccgcgcggccctctcggtggaccccaaccaccaggagatgctggagcttcaccaccgggtgaacagccaggaaccctgagcgcgctcccacggtgtacatacaggacaggaagcccctcatcatagccaaccggccataccggtgtatgttttgtaccatacacagcagatcagatcaatgtaaggacacagtagaaagccacattagatccctccccttgaaaaccaaacaccccattccttgtgtccctaattattagatatatatatgtgttgtttgctatagcctccccttagtaagttgttgctgccgattgtgattaagcctcctaattgtacccgccatgtgccccagcggcccgtgcttccagaatcaagaagttttgactgtaccatgtgtatgtaagtgaaatgggggaacaaaggatggtggaagcttttgtccgcgccaaactgtcaagcatgcaggcacctgttcttgccgagcacttgattgattgcatatacagatgtgtgtttctggct

SEQ ID NO: 1547 - DNA, 4520 bp, Panicum virgatum
cggaccacacggagtgtcggagtttggctgggtagcgattagccgcgtggttgcccggcggctagcctccccggacccctgattagcgcgtgtagctccaaactttttctcccagctcgggctcgcaacttcccctcctggcagagaccagagagagatagagagagatcacagcagcggccgcacaaaagcgttcgccggggctttggattcccgagaattcccttccaaagcggctgaatctcgggaccctgcgcacacctgcctgctcctctcttcctccccacccgtctccctcctcccgccgccgccgcctccagatcaggagcagggcgagcaaatcttggggatcccggctcgctcgcgcgccgccgcgcctggtggattcgcccgctccattgattccttttccgtcctcggggtcgagttggatttagttgcgaggtgtggttggggggtggtgggggagctcgctcgggactggaagggggagtggttactcccccaccttggcttcttgctgcgcgcccccgccccgctgggccgtgtcgtgccattaaagccggcgccttcgggtttctctctctccatctccctctccctctccctctacccgtcccgccctctctctctctctcctctctctacctagctagctagctgcagattggtccggtggttgttggggccgggttcctgcgcctgcccggagcgcgcggctcgactgggtgctcggagctccaaaggcgccgcctttccccgcggaattctcgggctccgaatccccgccgccggcggcgcgggcgagccggaggggtcgattcgcggcgtctcttggctgctgggggtggtctgtgcccctggatgggaaggatttgagtggattcgggaggagggggcagatctggtccgattcgccgtggtatgtgccatgaggaagctcttcttctccgagtccgcctgcaaggagaccaagctccactccgcgccccactcgtggctgcccctcgagagagggaacctctccaagtcctccgctcatgcctccggcggcacctccatagagtctttgatgaagatgccggagccggcagtgcttccgcacttcaagcccgcggactatgtcgacatactggctcagatacacgaggagctggagtcttgccctctggatgagaagtcctgcctgtacctgctccaattccaggtcttccgaggcttgggtgaggccaagctgtcgcggcggagcctccagtctgcgtgggagaaggcgagcactatacatgagaagctcatcttcggggcgtggctcaagtatgagaagaaaggggaggaggcaatttcggacctcctcagctcgtgtggcaagtgctcgcaggagttcaggctgctggatttcgtgtcgcaggcctccaccgggtcacatgacatgagctatgatgaagagtctgatgaattccggggctccgcggtggttcatttccggataagagatgatatgatcgcatgtgatcggcggaagcttgcagctttgtcaactccgctatatgcgatgctcaatggcgggttcagggaatcatatctagaggtcattgacatgtctagaaatggcatctcccctattggcatgagggcaatagtaaattcagcctgtcaggaagactaccgtatttgtcagctgatgctattttggaaatgcttgattttgccaataaattttgctgcaagggcctcaaggatgcttgcgagcgaaagcttgcttcttttgtctcttcaaggcaagatgctatagacttcatggaatgtgctcttgagctcggctgttccatccttgccgcttcatgcttgcaggtgctcttgaatgagcttccagagtgcttgaatgatgaacaagtggttaggatattctcctctgcaaataagcagcagaggttgacgatggttggcaatgcatctttctccctatattgccttctcagtgaagtctccatgagtaccaacccaacatcggatgtcaccttaagtttcttggaaaagctggtggagtcggcatcagattctagacagaagcagttggccttacatcagcttgcatgcacaagatttctaaggaaagattatgctgaggctgagcccctgttcagtgctgccttttctgccggccatctctattcggtagtgggtttagctagattgacctctctgaggggtaacaagcatttcgctctcaagttgctagactccgtgatgtcatctcgttggcctcttggatggatgtatcaagagaaagcactatatttggatggtgatagcaagttagaaaatcttaacaaggctactgagttggaccctactctgacatatccctatatgttccgagctgcatttttgatgaaaaggcaaagtgttgaagctgcattgatggagatcaaccggatcctgggattcaagcttgtgctcgaatgtttagaactaaggttctgttgctaccttgctcttgaggattacagagctgccctatgtgatgtgcaggcgatcctcacgcttgccccagattatcgtatgattggtggtcgggtggctgccaagcagctgcgtatgctagtgctggagaatgtagagcagtcgacaactgctgactgttggatgcagctttatgatcggtggtcatctgtggatgatataggatccctctctgttatatatcaaatgctggagtcagatacttccaaaggagttttgtactttagacaatctttgcttcttctcagattaaactgtcctgagtctgcaatgaggagtttgcagcttgctcgtgagcatgctgcaagcgatcatgaaaggcttgtctatgaaggatggatattgtatgatactggccactgtgaggaaggattgcagaaagcggaagcatccattgcaatacaaaggtcattcgaggcattttttctaaaagcctatgctttggctgattcaagtcttgatccttcgacctcagcaacagttgtatcacttctagaagatgcgttgcggtgcccctcagatagactccgaaagggtcaggctctgaacaaccttggaagcgtttatgtggattgtgggaagctagacctggcagctgaatgctacattaacgccctgaagataggccacaccagagcgcatcaaggccttgcaagggttcatttccttcggaacaacagaactggtgcatacggtgaaatgaccaaactaatagagaaggccaggaacaatgcatcagcatacgagaagagatccgagtactgtgaccgggagctgacgaaagcggacttgcagatggtcaccaaactcgaccctctgcgagtctacccttacagataccgtgctgctgtgctaatggacaaccataaggagaaagaggccattgaggagctgacaaaggcgattgccttcaaggcagacctgaacctgctccatctgcgcgcagccttccatgagcacattggcgacatctcgagcgccctccgggactgccgtgcggccctctcggtggaccccaaccaccaggagatgctggagcttcaccaccgggtgaacagccaggaaccctgaacctcgtgatgtacatatccggagctctctcttagagaaccagccaaccaaatataccagtgtatgttttgtaccatacacagcagatgaatgtaaggatagtagaagccatttaggtcgtccccttcaaagccaaacccccatcccttgtgtccctaattagatatgctgtttgccatagcctcctcttagtaaattattattgttgattgtgattaagcctcctaattgtacccgccatgtgccccagcagccccatactgccagaatcaaaaagttttgactgtatcatgtgtaaatgaaatgggaaaaaaagaatggaagcttttgtcggcgcaaaactgtcaaacctgctggccacttgctgatcacactgattgcgcatgtgcagatatgcctcttggctgttgatcaatgattattcaggggtgttctctgtttacccgtcatctgtgaggattagcatggggtcattgttgctctgattggggtgaagactgatggagggctacggctcgcagcttctgaaaatgaatggtcaatgagtgaggactgaagacgtgactctcaggctgaatggttcagaaatggtgcaccggtctagtggagggagaaatcgtaggattccttttttccccataatgagcagcacttgttgtgcttgtatgtgacgtttagctgcactgaattgacccaagcaacagtgatgatcatatgctgcgattttatgtcactgatggcgacatatttggagcagaaagagaacgaggattgagacttaaattctcagacaaagccccttctcagaaatagccatccttacccactcgtaagtaggactgcactacaaattcacctaaaacattctctaagaacgctttgtatgctctccctagccttgtgtcctaaagccaagatctctttgg

SEQ ID NO: 1548 - DNA, 4219 bp, Panicum virgatum
cgggggcgctttggattcccgagaattccccatccaaagcggctgaatctcgggaccccgcgccggcccgcacccgcgcacgcctgctcctctctccctcctccccacccgtctccctcctccctcctcccgccgccgcctccagagcaggaggctaggagccgcccggggcgagcaaatcttgggggatcccggctcgcccgcgccgcgcctggtggattcgctccagcgggagggccggccgccccttttccgtactcggggtcgggttggatttggttgcgaggtgtggttgggggtggtgggggagctcgcgcgctcggggcggcagggggagtggttactactggttactcccccccttggcttcttgctccgcgcccgccccgctgggccggccgtgtcctgccattaaagccggctcctttgggtttctctctccatcctcctctcccccctctctctctctctacccgtcccgccctctctctcttctcctctctctagctagctagctagctgcggattggtgcggtggttctcggggccgggttcctgcacctgcccggagcgcgcggctcggagctccaaaggcggcgccgcctccccggcgctcccttccccgcggaattctcgggccccggatccccgccgctggtggcgcgggaggggtcgagtcgcggcgtgtctttggctcccggggggcggggctgggccccctggatgggaagggtttgagcggattcgggaggcggaggggggcagatctggtctggctcgccgtggtatgcgccatgaggaagctcttcttctccgagtcagcctgcaaggagaccaagctccactccgcgcctcactcgtggctgcccctcgatagagggggcctctccaagtccgccgcccatgcctccggcggcacctccatagagtctttgatgaagatgccggagccggcggtgcttccgcacttcaagcccgcggactatgtcgacatactggctcagatacacgaggagctggagtcttgccctccggatgagaggtcctgcctgttcctgctccagttccaggtcttccgcggcctgggtgaggccaagctgtcgcggcggagcctccagtccgcgtgggagaaggctagcaccatacatgagaagctcatcttcggagcgtggctcaagtatgagaagaaaggggaggaggcgatctcggacctcctcagctcgtgcggcaagtgctcgcaggagttcaggctgctggatttcgtgtcgcaggtctccaccgggtcgcatgacatgggctatgatgaagggtctgatgaattccggggctccgcggtggttcatttccggataagagatgatatgattgcatgtgatcggcggaagctcgcagctttgtcgactccgctatatgcgatgctcaacggtgggttcagggagtcatatctagaggtcattgacatgtctagaaatggcatctcccctattggcatgagggcaatcagtaaattcagcctgtcaggaagactgccatatttgtcagctgatgctattttggaaatgcttgattttgccaataaattctgctgcaagggcctcaaggatgcctgcgagcgaaagcttgcttcttttgtctcttcaaggcaagatgctatagacttcatggaatgtgctcttgagctgggctgttccatccttgccgcttcatgcttgcaggtgctcttgaatgaacttccagagtgcttgaatgatgaacaagtggttcggatattgtcctctgcaaataagcagcagaggttgacgatggttggcaatgcatctttctccctatactgccttctcagtgaagtctccatgagtaccaacccgacatcggatgtcaccttaagtttcttggaaaagctggtggagtcggcatcagattctagacagaagcagttggccttacatcagcttgcgtgcacgagatttctaaggaaagattatgctgaggctgagcccctgttcagtgctgccttttctgccggccatctctattcggtagttggtttagctagattgacctctctgaggggtaacaagcattttgctctcaagttgctcgactccgtgatgtcatctcgttggcctcttggatggatgtatcaagagagagcactatatttggatggtgatagcaagttagaaaatcttaacaaggctactgagttggaccctactctgacatatccctatatgttccgagctgcatctttgatgaaaaggcaaagtgttgaagctgcattgatggagatcaaccggatcttgggattcaagcttgtgctcgaatgtttagaactaaggttctgttgctacctcgctcttgaggattatagagctgcactatgtgatgtgcaggcaatcctcacgcttgcccctgattatcgtatgattggtggtcgggtggctgcgaagcagctgcgtatgctagtgctggagaatgtagagcagtcgacaactgctgactgttggatgcagctttatgatcggtggtcatctgtggatgatataggatccctctctgttatatatcaaatgctggagtcagatacttccaaaggagttttgtactttagacaatctttgcttcttctcagattaaactgtcctgaggctgcaatgaggagtttgcagcttgctcgtgagcatgctgcaagcgatcatgaaaggcttgtttatgaaggatggatattgtatgatactggccactgtgaggaaggattgcagaaagcggaagcatccatcgcaatacaaaggtcatttgaggcattttttctaaaagcctatgctttggctgattcaagtcttgaaccttcgacctcagcaacagttgtatcgcttctagaagatgcattgcggtgcccctcagatagactccgaaagggtcaggctctgaacaaccttggaagtgtttatgtggattgtgggaagctagacctggcagctgaatgctacattaacgccctgaagataggtcacaccagagcgcatcaaggtcttgcaagggttcatttccttcggaacaacaggatcggtgcatatgatgaaatgaccaaactaatagagaaggccaggaacaatgcatcagcatacgaaaagagatccgagtactgtgaccgggagctgacgaaagctgacttgcagatggtcaccaaacttgaccccctgcgagtctacccttacagataccgcgctgctgtgctaatggacaaccataaggagaaagaggccattgaggagctgacaaaggcaattgccttcaaggcagatctgaacctactccacctgcgcgcagccttccatgagcacattggcgacgtttcgagcgccctccgggactgccgtgcggccctctctgtggaccccacccaccaggagatgctggagcttcaccaccgggtgaacagccaggaaccctgaaccccgtggtgtacataacggagctctctcttagagaaccagccaaccaaatatactagtgtatgttttgtaccatacacagcagatgaatgtaaggatagtagaagctatttaggtcctccccttcaaagccaaatccatcccctgtgtccctaattagatatgttgtttgccatagtctcttagtaaattattattgtcgattgtgattaagcctcctaattgtacctgccatgtgccccagcagccccatactgccagaatcaaaaagttttgactgtatcatgtgtaaatgaaatgggaaaaaagaatggaagcttttgtcggcgcaaacctgtcaaacctgttggccacttgcggatcacactgattgattgcgcatgtgcagatatgcctcttggctgttgattaattgattaattcttggctgttctctgtttaccggtcatctgtgaggattagcatgcggtcattgttgctctgattggggtgaagactgatggagagcaacggctcgcagcttctgaaaatgaatggtcaatgagtgaggactgaagacatgacttcactttctcaggctgaacggtccagaaatggtgaaccgatctagtggagggagaaatcgcaggattcttttccccccataatgagcagcactttgttgttgggcttgtatgtgacgtttagctgcactgaattgacccaagagaacgaggaatgagatccatgttcttagatacaaagctcctcactaatttagg

SEQ ID NO: 1549 - DNA, 3904 bp, Oryza sativa
caacaacttcctctctgtttcactaccctctctctctctctctctctctctctacacgctttgcaattttgcatcgtgccatcgtcctgtctctctctcttcctcgagaaagaaaggaggagaggggataaagcgcacaaagagcagccgctttgtgccaatctctctctctctctctctctctctctcttctctctctctctctctcatcttctcctccccaaaaagaagagatcaccaattctgtggctgcttgtttcagctgcttaggattcccaagaattccattccaaagcagcagctgctcctcctccttgaatcttgggattcagtgcacgcctccctgcttcttccttcctcctcctgccttgcaaatcttggagctttttttttttttcccctcttctcttgtaggagtaggagagtaggaggggttggagtggaggagattggatttggtggtggtgttttgtgcggcggttgggggtagaggaaaggggagtttgtggggggagtggttagttcttggcttcttcttcttcttcagcgagagctactacagctacagctcgtgctcgtgcgccattaaagtcctcgcctttgcgtctcccccctctttctaccagcccacctcctcctcttcttctttggattagggcttcgaaggcggctgctttctctgcggagggggttgaattcttgcgattcttggaggggggatttgtcctgagtgatttggtatgtgggcagcatgaggaagctcttcttctccgagttgacctcctgcaaggagaccaagctccactccgcgccccactcatggcttcccctcgagaaagggaagctctccaagttcgccggccactccacctcctccatagaatcgctgatgaaaatgccggagccggtggttcttccccacttcaagcctgcggattatgtggacatattggcccagattcatgaggagctggagtcttgccctcctgatgagaagtcgtgcctgtacctgctccagttccaggttttccgcggcctcggcgaggtgaagctgtcgcggaggagcctccagtccgcgtgggagaaggcgagcacgatacacgagaagctgatattcggggcatggctcaagtatgagaagaaaggggaggagccgatatccgacctcctcagctcgtgtggcaagtgctctcaggagttcaagctgctggatttcgtgtcgcagatctccaccgggtcgcatgagataagctatgatgatgagtcggatgtgttttggggctctccggtggtacatttccggataagagatgatatgattgcatgcgatcggcgaaagcttgctgctttgtcgactccgctgtatgcaatgcttaacggtggctttcgggaatcacatcttgaggttattgatatgtctcggaatggcatctcctcgattggtatgcgagcaatcagtaaattcagcttgacaggaaggttaccgtatttatcagcagatgctattttggaaatgcttgattttgctaataagttttgctgcaatggcctcaaggatgcttgtgagcgaaagcttgcttctttcatttgctcgaggcaggatgctatagacttcatggagtgtgctcttgagctgggttgttccatccttgctgctgcatgcttgcaggtgctcctgaatgagcttccagagtgcttgaatgatgaacaagtggttaggatattctcctgtgcaagtaagcagcagcgatccacaatggctggaaatgcttctttctccctatattgccttcttagtgaagtctccatgagcatcaacgcgacatcggatgtcacggtgaccttcttggaaaaattggtggattcagcatcagattctagacagaagcagttggccttgcatcagctggcgtgcacaagacttctaaggaaagattatgctgaagccgagcgcctgttcaatgccgcctttaccgctggacatctctattcagtagtgggtttggctagactggcctctatgaggggtaataagcatttttctctcaagttgcttgattctgtcatgtcatctcgctggccacttggatggatgtaccaagagagagcactatatttggagggtgataacaagttggaaaatcttaacaaggccactgagttggatcctacccttacatacccctacatgtttcgagctgcatctttgatgaaaagacaaagcgttgaagctgcccttatggagattaaccggatcctgggatttaagcttgttctggaatgcttagagctaaggttctgttgctatcttgcacttgaggaccatagagctgctttatgtgatgtccaggcaatcctcactcttgctccagattatcgtatgattggtggtcgggtgtctgcaaagcagctgcgtatgcttgtgatggagaatgttgagcagtggacaactgctgactgttggatgcagctttatgatcgttggtcatctgtggatgatataggatccctctcggtcatatatcaaatgctggagtcagatgctgctaaaggagttctctactttaggcaatctttgcttcttctcagattaaattgtcctgaggctgcaatgcgcagtttgcagctagctcgtgaacatgctgcaagccaacatgaacagcttgtttatgagggatggatattgtatgataccggccactgtgaggagggactgcagaaagcagaagcatccatcgcaatacaaagatcatttgaagcattctttctgaaagcttatgctttggctgattcgagtcttgacccttcaacttcagcaacagttgtatcacttcttgaagatgcattacgctgcccctctgatagactacggaagggtcaggctctgaacaaccttgggagtgtttatgtggattgcgggaagcttgacctggcagctgaatgctacatcaatgccctaaagattggtcataccagagctcatcaaggccttgccagggtccatttcctcagaaacagcagaactggtgcatatgaggaaatgaccaagctaatagagaaggccaggagcaacgcatcagcttatgagaagaggtcggagtactgtgatcgtgagctaacaaaatcagacctgcagatggtgaccaaactagaccctctgcgtgtatacccctacagataccgtgctgctgtgctgatggacaaccacaaagagaaggaggccatcgcggagctgacaaaagcaatcgccttcaaggcggacctgaacctgctccacctgcgagccgccttccacgagcatgtcggcgacatctcgagtgcactccgggactgccgcgcagcgctctccgtggatcctaaccaccaggagatgctcgagcttcatcaccgggtgaacagccaagaaccctgagccccccattgttgtacatacaggagctctacatagccaaccataccccaagtgtatgttttgtaccatacacagcagatcaatgtaaggatagtagccaatttaggccctccacccccaaaaccaacccaattccttgtgtccttaattagaatatgttgctcatcatagagtcctttttttagtaaattattatatttttgtgattaagcccccctcctaattgtaccctccatgtgccctcccccaaccccatgttcccaacaagttttgactatctcatgtgtaaatgaaaaatggaagaaaaagaatggagaaggtttgtgtcggcgtctgcgcaaaactgtcaaagttgatgctaatcactgattgcacatgtgctttgtttctcttctgattataaacaaaatgaactgatgaaactatcagaaacaatgccatgtggattagaagaacttggaattgtttctttgcttaatttgtttattaaca

SEQ ID NO: 1550 - DNA, 4533 bp, Brachypodium distachyon
gctctttatcttgcaattgcaaattcccctccccagtctcttcgccctgctttgcgagtgtggaattgcgctggctggcggctctctctctctctctctgtacgcaccgagcgccgagagaacgaaagcacgccctcttttccttctcgcctccgccaaaaagagcagcgagagagagagagaaagatcacaggcgggtcggggtctctcagcataggattccaagcaattccactcgccaaggaggagcactggagcagcccccgcctccctgaatcttgggagtctgtgcgcccgtgctcccttccgtcctgctctgctccagggaaagcgaaggcgaccgcatctcgggggatttcttcgtcctcgcggtgttggaggattgagttcgactgtgcgaaggggaagggagttggatttggttcggcggtgtggttgggggtgggggaaattaaaaagttggggggagtggttagttcttggcttcttgtactcgtataagcgggaggagcgcatcgttggctcgctcgtgccattaaaggcggcgcctttgggtctctctccttcccttcctccctccctctctctgtctgcagattggtggtggctgcctacctggtggttgggtttggtttccggatcctcgaggagccccttctttctctcccccgttcgattggggctagaaaggcgccttctttttcttgcgccttcctgcgcaatttcgtgccgctcccggcggctgccgcaggttcttgtgttccaaatcttggcgccgaggccgcatccctccctttccttggtttcttggaggatctgtggcggttcttgggagggatttgggcgcctggatgccagagatttgagaaatttgggagcaagaggaagaagaggggggataggccctgattcgctgtggtatgtgccatgaggaagctcttcttctccgagttgacctcctgcaaggagaccaagctccagtccgccacccactcatggctgccactggagaaagggaagctctgcaagttcactgggcactccagctcctcctcctccatagaatctctgatgaaaatgccggagccggcggttcttccacacttcaagcccgctgactatgtcgatattctggctcagatacatgagcagctggagtattgcgcacccgatgagaagtcttgtctgtacctgctccagtttcaagttttccgcgggcttggggaagcaaagctgtcgcggaggagcctccaggctgcgtgggagaaggcgagcacgatacatgagaagctgatatttggggcatggctcaagtacgagaagaaaggagaggagccgatatctgaccttcttggctcatgtggcaagtgttcccaggagtttaagctgctggattttgtctcgcagatctctgctgagtcacatggattaagctacgacgatgagtctgatgaattccagggctctccggtggttcatttccggataaaagatgacatgattgcgggtgatcggcgaaagcttgcagcgttgtcaactccactgtatgcgatgcttaacggtggttttagggaatcacatcttgaagtcatcgacatgtctcgaaatggcatctcacctattggtatgcgggcaatcagtaaattcagcctctcaggaagactaccatatttatcagcagaagctattttggaaatgcttgattttgctaacaaattctgctgcaagggcctcaaggatgcttgtgaacgaaagcttgcttcttttgtttgtaccaggcaagatgctgtagacttcatggagtgtgctattgagctgggctgttccatcctcgctgcatcatgcttgcaggtgctcttgaatgaacttcccgagtgcttgaatgatgagcaagtggttaggatattctcctctgctaataagcagcagagatccacgatggctggcaatgcatctttctctctatattgtcttcttagtgaagtctccatgagcatcagtgcaacatcagatgtcaccataagcttcttggaaaagctggtggagtcggcatcagattctagacagaagcagttggccttgcatcaactggcttgcatgaggctgctaaggaaagatcacactgaagctgagcgcctattcaatgccgccttcaacgctggtcatcactactcagtagtgggtctggctagattggcctctcttaggagtaacaaacatttttctctcaagttgcttgactctgtcatgtcatctcgttggcctcttgggtggatgtatcaagagagagcactgtatctggatggtgatagcaagttggaaaatctcaataaggctactgagttggatcccacccttacatatccctatatgtttcgagctgcatctttgatgaaaaggcaaagtgttgaagctgcactgatggagattaaccggatcctgggattcaagctggttttggagtgcctagagctaaggttctgttgttaccttgctcttgaggactacagagccgccttatgtgatgtccaggcaatcctcacgcttgctccagattatcgtatgattggtggtcgggtggctgcgaagcagctacgtatgcttgtcatggagaacgtagagcaatggacgactgctgattgctggatgcagctttatgatcggtggtcctctgtggatgatattggatccctctcggtcatatatcaaatgctggagtcagatgctgctaaaggagttctgtacttcaggcaatctttgctacttctcagattaaattgtcccgaggctgcaatgcgcagcttgcagcttgctcgtgagcatgcggcaagccaacatgaacggcttgtttacgaaggatggatactgtatgatactggccactgcgaggaaggactgcagaaagcggaagcatccattgctatacagagatcatttgaggcgttctttctaaaggcttatgctttggctgattcgagtcttgagccgtcaacctcagcaacagttgtatcgcttctcgaagatgcattacggtgtccctcagatagacttaggaagggccaggctctgaacaatcttgggagtgtttatgtggactgcgggaagctagacctggcagctgaatgctatatcaacgccctaaagattggccacaccagagcgcatcaaggcctcgccagggtccatttccttaggaacaacaggaccggtgcatttgaagaaatgaccaagctgatagagaaggccaggagcaatgcgtcagcatacgagaagaggtctgagtattgcgaccgggatctaactaaagctgatcttcagatggtcaccaaacttgaccctctgcgagtctacccttacagataccgtgctgctgttctgatggacaaccacaaggagaaagatgccatctcagagctgaccaaggcgatcgccttcaaggcggacctcaacctgctccacctgcgcgcggccttccacgagcacgtcggcgacatctcaggtgccctccgggactgccgtgcagcactctccgtggaccccaaccaccaggagatgctggagcttcaccaccgggtgaacagccaagaaccctgagcccaccgttgtaaatacaggagcccccatagcaaaccccataccagtgtatgttttgtaccatacacagcaagcagatcaatgtaaggagatagtagccagccatttaggtcccttccccccaaaaccaccattccttacgtccttaattagatatatcctggcccaccataggctgtcttgttagtaaattattgtcattttgtgattaagcccttcctaattgtaccaccctccctccatccatgtgccctagcccatgttgccaacaagttttgactgtcacatgtgtaaaggaaatggaaaagaaaaaggaaatggagaagtgcgccgggtgttgcgcaaaaactgtaagccttttgcaactccctgatgctttactgattgcacattttggtttgcttggctagtggtggccactgattataaatcaaagcaatgccagtgccttatgggttagaagtgctctttgtttaatcagctggcattaccagccagtcagagactgagaatctgtccagccagcgcatgccgctgccatgattgtagcactgaagggagcgagaatgatggaagtgtattgaactgtagatgatgatggatctgaaagtgtactggacagaggaaatttctatgggattcccttctgagtaaagaggcatctgcagcttcagactttcagtagtaccaccacgctggctgaacatcggattccgatatactgctgtactgggtactgatgattcctgagtaactgcaggacaggctagtcgacagaaaatggacggtccggatggtccatggatgttgtacagaggtggctttatccgttgggtttgtcacattcacatggctatctttggaatttgctacttactagattaacttgtaactgagccaaagactcgaagctgattaataccacttttgaaaatggct

SEQ ID NO: 1551 - DNA, 3234 bp, Secale cereale
ggttctcggcaggggtttgggcagattcgaggaatctgggtgtaggaggaaggaaggaacaagacgggggcggggtctgattcgccctggtatttatgtgccatgaggaagctcttcttctccgagttgacctcctgcaaggagaccaagctccagtccgccacccactcatggctgcccatggacaagggcaagctctccaagttcgctggccactccagctcctcctcctcgatagaatctctgatgaaaatgccggagccgccggtcctcccgcacttcaagcccgctgactacgtcgacatattggctcagattcacgaggagttggagtactgccctcccgatgagaagtcgtgcctgtacctgctccagttccaggttttccgtgggcttggagaggccaagctgtcgcgaaggagcctccaggctgcgtgggagaaggcgagcacgatacatgagaagctcatattcggggcatggctcaagtacgagaagagaggggaggagccgatatctgaccttcttggctcgtgcggcaagtgctctcaagagttcaagctgctggatttcgtctcgcagatctccgccgagtcgcacgggataagctttgaggacgaatctgatgaattccagggatccccagtggttcatttccggataagggatgacatgattgcttgcgataggcggaagcttgcggccttgtcaactccactgtatgcgatgcttaatggtgggtttaaggaatcacatctcgaggtcattgacatgtctcggaatggcatctcccctattggcatgcgggccatcagtaaattcagcctgtcaggaagactaccgtatttgtcagcagaagctatcttggagatgcttgattttgctaacaaattctgctgtaagggcctcaaggatgcctgcgagcaaaagcttgcttcttttgtttcgtccaggcaagatgccatagatttcatggagtgtgctattgagctgggctgttccatccttgctgcatcatgcttgcaggtgctcttgaatgagcttccagaatgcttgaatgatgagcaagtggttaggatattctcctctgcgaataagcagcagagatccactatggctggcaatgcatctttctccctgtattgccttcttggcgaagtctccatgaccatcggtgcaacatcagatgtcaccgtaagcttcttggagaagctggttgactcagcatcagattctaggcagaagcagttgtccttgcatcaattggcttgcgtgaggctgctaaggaaagatcatgctgaagctgagcgcctgttcaatgccgccttcaccgctggtcatgtctactcggtagtgggcttggctagattggcctctttgagaagtaataagcattattctctcaacttgcttgactctgtcatgtcctctcgttggcctcttgggtggatgtatcaagagagagccctatatttggatggtgatagcaagttggagaatctcaataaggctactgaactggatcctacccttacatacccctatatgtttcgagctgcatctttgatgaaaaggcaaagtgttgaagctgccctgatggagattaaccggatcctggggttcaagctggtcctggaatgcttagagctaaggttctgttgctaccttgctctagaggactacagagctgccttatgcgatgtacaggcaatcctcacgcttgctccagattatcgtatgattggtggtcgggtggctgcgaagcagctgcgtacgcttgtgatggagaatgtggagcaatggacgactgctgattgttggatgcagctttatgatcggtggtcctctgttgatgatattggatccctctcggtcatatatcaaatgctggagtcagatgctgctaagggagtactctacttcagacaatctttgctacttctcagattaaattgtcctgaggctgcaatgcgcagcttgcagcttgctcgcgagcatgcggcaagccaacatgaacgacttgtttatgaaggatggatactgtatgatactggccactgcgaggaaggattgcagaaagcggaagcatcgattgccatacagagatcatttgaggccttctttctaaaagcttatgctttagctgattcgagtcttgagccgtcaacctcagcaacagtcgtatcgcttcttgaagatgcattacggtgtccctcagatagacttaggaagggccaggctttgaacaaccttgggagtgtttatgtggattgcgggaatctggacttggcagctgaatgctacatcaacgccttaaagattggccacacgagagctcatcaaggcctcgccagggttcatttccttaggaataataggaccggtgcattcgaggaaatgaccaagctgatagagaaggccaggagcaatgcatcagcatacgagaagaggtctgagtattgtgaccgggatctaactaaagctgatctgcagatggtcaccaaacttgaccccctgcgggtctacccctacagataccgtgctgctgttctgatggacaaccacaaggagaaagatgccatctcagagctgactaaggcaatcgcctttaaggcggacctgaacctgctccatctgcgtgcggccttccatgagcacgtgggtgacatctcaggcgccctccgggactgccgtgcagcactttccgtggaccccaaccaccaggagatgctcgagcttcatcaccgggtgaacagccaagaaccctgagcccgttgttgtacatacaggaggggctcccatagcgaaaacccataccagtgtatgttctgtaccatacacagcaagcagtaatttttagttttgatggtgtctagtgcggctgtaaggattgtggtcatcaaaacatctaaaattaagccacgtgctatatggaaaatattacattccacctgtgtcacttggctacactaactgggcaataggcttcagcatgcaacaagacactgcatactgccgattggactgaaggcctggctgttgtgttcttcagtttttgcactgctgtaagatccacttcatttgtgttagtagtgaatctgttggaacatgcaatttaatatgtccattgtgtaaccattttcatattttgtaaactgctgaatagcactattagttgatcctcaggctgcagatgtaaagatagttcatgtagttgtttttgcgtagaaaatt

SEQ ID NO: 1552 - DNA, 2916 bp, Triticum aestivum
tgcggcggttcttgccaggggtttgggcagattcggaggaagaagacggggcccggctctgattcgccgtggtatttatgtgccatgaggaagctcttcttctccgagttgacctcctgcaaggagaccaagctccagtccgccacccactcatggctgcccatggacaaaggcaagctctccaagttcactggccactccagctcctcctcctcctcgatagaatctctgatgaaaatgccggagccgccggtcctcccgcacttcaagcctgctgactacgtcgacatattggctcagattcacgaggagctggagtactgccctcctgatgagaagtcgtgcctgtacctgctccagttccaggttttccgcgggcttggagaggccaagctgtcgcgaaggagcctccaggctgcctgggagaaggcgagcacgatacacgagaagctcatattcggggcatggctcaagtacgagaagagaggggaggagccgatatctgaccttcttggctcgtgcggcaagtgctctcaagagttcaagctgctggatttcgtctcacagatctccgccgagtcgcacgggataagctacgacgacgaatctgatgagttccagggctcccctgtggttcatttccggataagggatgacatgattgcatgcgataggcggaagctggcggccttgtcaactccactgtatgcgatgcttaacggtgggtttaaggagtcacatcttgaggtcattgacatgtctcggaacggcatctcgcctattggtatgcgggccatcagtaaattcagcctgtcaggaagactaccgtatttgtcagcagaatctattttggagatgcttgattttgctaacaaattctgctgcaagggcctcaaggatgcttgcgagcaaaaacttgcttcttttgtttcttccaggcaagatgccatagattacatggagtgtgctattgagctgggctgttccatacttgccgcgtcatgcttgcaggtgctcctgaatgagcttccagaatgcttgaatgatgagcaagtggttaggatattctcctccgcgaataagcagcagagatccactatggctggcaatgcatctttctccctatattgccttcttggtgaagtctccatgagcatcagtgcaacatcagatgtcactgtaagcttcttggagaagctggttgactcggcatcagattctagacagaagcagttgtccttgcatcagctggcttgcgtgaggctgctaaggaaagatcatgctgaagcggagcgcctgttcaatgctgcctttaccgctggtcatgtctactcggtagtgggcttggctagattggcctctctgaggagcaataagcattattctctcaacttgcttgactctgtcatgtcatctcgttggcctcttgggtggatgtatcaagagagagccctatatctggacggtgatagcaagttggagaatctcaataaggctactgaactggatccgacgcttacatacccctatatgtttcgagctgcatcgttgatgaaaaggcaaagtgttgaagctgccctgatggagattaaccggatcctggggttcaagctggtcctggaatgcttagagctaaggttctgttgctaccttgctctagaggactacagagctgccttatgcgatgtacaggcaatcctcacgcttgctccagattatcgtatgattggtggtcgggtggctgcgaagcagctgcgtacgcttgtaatggagaatgtagagcaatggacgactgctgattgctggatgcagctttatgatcggtggtcctctgtggatgatattggatccctctcggtcatatatcaaatgctggagtcagatgctgctaagggagtactgtacttcagacaatctttgctgcttctcagattaaattgtcccgaggctgcaatgcgcagcttgcagcttgctcgtgagcatgcggcaagccaacatgaacgacttgtttacgaaggatggatactgtatgatactggccactgcgaggaaggattacagaaagcggaagcatcgattgccatacagagatcatttgaggccttctttctaaaagcttatgctttagctgattcgagtcttgaggcgtcaacctcagcaacagtcgtatcgcttcttgaagatgcattacggtgtccctcagatagacttaggaagggccaggctttgaataaccttgggagtgtttatgtggattgcgggaatctggacttggcagctgaatgctacattaacgctttaaagattggccacacgagagctcatcaagggcttgccagggttcatttccttaggaataacaggaccggtgcattcgaggaaatgaccaagctgatagagaaggccaggagcaatgcatcagcgtacgagaagaggtctgagtattgtgaccgggatctaactaaagctgatctgcagatggtcaccaaacttgaccccctccgggtctacccctacagataccgtgctgctgttctgatggacaaccacaaggagaaagatgccatctcagagctgactaaggcaattgcctttaaggcggacctgaacctgctccatctgcgtgcggccttccacgagcacgtgggtgacatctcaggcgccctccgggactgccgcgcagcactttccgtggaccccaaccaccaggaaatgctcgagcttcatcatcgggtgaacagccaagaaccctgagcccgttgttgtacatacaggaggggctcccatagcgaaaacccataccagtgtatgttctgtaccatacacagcaagcagtaatttttagttttgatggtatctagtgcggctgtaaggattgtgatcatcaaaccgactaaaattaagccacgtgctata

SEQ ID NO: 1553 - DNA, 2784 bp, Pennisetum glaucum
agatacacgaggagctggattcctgccctccggatgagaagtcctgcctgtacctgctgcaattccaggtcttccgcggcctcggggaggccaagctgtcgcggcggagcctccagtccgcgtgggagaaggcgagcaccatacatgagaagctcatcttcggtgcgtggctcaagtacgagaagaaaggggaggaggcgatctcggacctgctcagctcgtgtggcaagtgctcgcaggagttcaggctgctggatttcgtgtcgcaggtctccaccgggtcacatgacatgagctatgatgatgatgagtctgaatttcggggctccgcagtggttcatttccggataagagatgatatgattgcatgtgatcggcggaagctcgcagctttgtcaaccccgctatatgcgatgctcaatggcgggttcagggaatcatatcttgaggtcattgacatgtctcggaatggcatctccccaattggcatgagggcaatcagtaaattcagcctgtcaggaagattaccgtatttgtcagctgatgctattttggaaatgcttgattttgccaataaattttgctgcaagggcctcaaggatgcttgtgagcgaaagctggcttctttcgtctcctcgaggcaagatgctatagacttcatggagtgtgctcttgagctgggctgttccatccttgctgcttcatgcttgcaggtgctcttgaatgaccttccagagtgcttgaatgatgagcaagttgttaggatattttcttctgcaaataagcagcagagattgacaatggctggcaatgcgtctttctccctatattgctttcttagtgaagtctccatgagtaccaacccgacatcggatgtcactgtaagtttcttggaaaagctggtggagtcagcatcagattctagacagaagcagttggccttacatcagcttgcatgttcaaaatttctaaggaaagattatgctgaagccgagcgcctgttcaatgctgcattttctgctggccatttctattcggtagtgggtttggctagattggcctctctgaggggtaataagcattttgctctcaagttgctagactctgtcatgtcatctcggtggcctcttggatggatgtatcaagagagagcactatatttggatggtgatagcaagttagaatatcttaacaaggccactgaattggaccctactctgacatatccctatatgttccgagctgcatctttgatgaaaaggcagagtgttgaagctgcattgatggagatcaaccggatcctgggattcaagcttgtgctggaatgcttagaactaaggttctgttgttaccttgctcttgaggattatagagctgcactatgtgatgtgcaggcaatcctcacgcttgccccagattatcgcatgattggcggccgggtggctgccaaacaattgcgtatgctagtgctggagaatgtagaacagtggacaactgctgactgttggatgcagctctatgatcggtggtcatctgtggatgatataggatcactctctgttatatatcaaatgctggagtcagatactgccaaaggagttttgtactttaggcaatctttgcttcttctcagattaaactgtcctgaggctgcaatgaggagtttgcaacttgctcgtgagcatgctgcaagtgatcatgaaaggcttgtctatgaaggatggatattgtatgatactggccactgcgaggaagggttgcagaaagcggaagcatccattgcaatacaaaggtcatttgaggcattttttctaaaagcctatgctctggctgattcaagtctcgatccttcaacctcagcaacagttgtatcacttctagaagatgcattgcggtgtccctcagatagacttcggaagggtcaggctctgaacaacctcggaagtgtttatgtggattgtgggaaactagacctcgcagctgaatgctacattaatgccctaaagattggccacacaagagcacatcaaggccttgcaagggttcatttccttcggaacaacagaacaggtgcatacgatgaaatgacaaagctaatagagaaggccaggaacaatgcatcagcatacgagaagagatcagagtactgcgaccgggagctgacaaaggcggacttgcagatggtcaccaaacttgacccactacgagtctacccctacagataccgtgctgctgtgctgatggacaatcacaaggagaaagaggccattgcggagctaaccaaggcaatcgccttcaaggcggacctgaacctgctccacttgcgcgcggccttccatgagcacatcggcgacatctcgagcgccctccgggactgccgtgcagccctctcggtggaccccaaccaccaggagatgctggagcttcaccaccgggtgaacagccaggaaccctgaggcccccccatggtgtacatacagagctctcatagccaaccagccatacccgtgtatgttttgtaccatacacagcagatgaatgtaaggatagcagaagccatttaggtcctccccttcaaaaccaaacccccattccttgtgtccctaattagatatgttgtttgccatagcctcctcttagtaaattattattgtcgattgtgattaagcctcctcctaattgtaccggccatgtgctccagcagtccatgttgccagaatcaaaaagttttgactgtatcattgtgtaaatgaaatgggaaaaaaagaatggaagctttgtcgg

SEQ ID NO: 1554 - DNA, 2778 bp, Triticum aestivum
cagtccgccacccactcatggctgccatggcaaaggcaagctctccaagttcaccggccactccagctcctcctcctccatagaatctctgatgaaaatgccggagccgccggtcctcccggcacttcaagcccgctgactacgtcgacatactggcccagattcacgaggagctggagtactgccctcctgacgagaagtcgtgcctgtacctgctccagttccaggtcttccgcgggcttggcgaggccaagctgtcgcgaaggagcctccaggctgcctgggagaaggcgagcacgatacacgagaagctcatattcggggcatggctcaagtacgagaagagaggggaggagccgatatccgaccttcttggctcgtgcggcaagtgctctcaagagttcaagctgctggatttcgtctcgcagatctccgccgagtcgcacgggataagctatgacgacgaatctgatgagttccagggctccccggtggttcatttccggataagggatgacatgattgcctgcgataggcggaagcttgcggccttgtcaactccactgtatgcgatgcttaacggtgggtttaaggagtcacatcttgaggtcattgacatgtctcgtaatggcatctcccctattggcatgcgggccatcagtaaattcagcctgtcaggaagactaccgtatttgtcagcagaatctatcttggagatgcttgattttgctaacaagttctgctgtaagggcctcaaggatgcctgcgagcaaaagcttgcttcttttgtttcttccaggcaggatgccatagattacatggagtgtgctattgagctgggctgttccatccttgccgcgtcatgcttgcaggtgctcctgaatgagcttccagaatgcttgaatgatgagcaagtggttcggatattctcctctgcgaataagcagcagagatccactatggctggcaatgcatccttctccctatattgccttcttggtgaagtctccatgagcatcagtgcaacatcagatgtcactgtaagcttcttggagaagctggttgactcggcatcagattctagacagaagcagttgtccttgcatcagctggcttgcgtgaggctgctaaggaaagatcatgctgaagcagagcgcctgttcaatgccgcctttaccgctggtcatgtctactcggtagtgggcttggctagattggcctctctgaggagcaataagcattattctctcaacttgcttgactctgtcatgtcatctcgttggcctcttgggtggatgtatcaagagagagccctatatctggacggtgatagcaagttggagaatctcaataaggctactgaactggatccgacgcttacatacccctatatgtttcgagctgcatctttgatgaaacggcaaagtgttgaagctgccctgatggagattaaccggatcctggggttcaagctggtcctggaatgcttagagctaaggttctgttgctaccttgctctagaggactacagagctgccttatgcgatgtacaggcaatcctcacgcttgctccagattatcgtatgattggtggtcgggtggctgcgaagcagctgcgtacacttgtgatggagaatgtagagcaatggacgactgctgattgctggatgcagctttatgatcggtggtcctctgtggatgatattggatccctctcggtcatatatcaaatgctggagtcagatgctgctaagggagtactctacttcagacaatctttgctacttctcagattaaattgtcctgaggctgcaatgcgcagcttgcagcttgctcgcgagcatgcggcaagccagcatgaacgacttgtttatgaaggatggatactgtatgatactggccactgcgaggaaggattgcagaaagcggaagcatccattgccatacagagatcatttgaggcattctttctaaaagcttatgctttagctgattcgagtcttgagccgtcaacctcagcaacagtcgtatcgcttcttgaagatgcattacggtgtccctcagatagacttaggaagggccaggctttgaataaccttgggagtgtttatgtggattgcgggaatctggacttggcagctgaatgctacattaacgctttaaagattggccacacgagagctcatcaagggcttgccagggttcatttccttaggaataacaggaccggtgcattcgaggaaatgaccaagctgatagagaaggccaggagcaatgcatcagcatacgagaagaggtctgagtattgtgaccgggatctaacaaaagctgatctgcagatggtcaccaaacttgaccccctccgggtctacccctacagataccgtgctgctgttctgatggacaaccacaaggagaaagatgccatctcagagctgactaaggcaattgcctttaaggcggacctgaacctgctccatctgcgtgcggccttccacgagcacgtgggtgacatctcaggcgccctccgggactgccgcgcagcactttccgtggaccccaaccaccaggaaatgctcgagcttcatcatcgggtgaacagccaagaaccctgagcccgttgttgtacatacaggaggggctcccatagcgaaaacccataccagtgtatgttctgtaccatacacagcaagcagtaatttttagtttgatggtatctagtgaggctgtaaggattgtgatcatacaaaacgactaaaattaagccacgtgctatat

SEQ ID NO: 1555 - DNA, 2840 bp, Triticum aestivum
agaatctctgatgaaaatgccggagccgccggtcctcccgcacttcaagcccgctgactacgtcgacatactggcccagattcacgaggagctggagtactgccctcccgatgagaagtcgtgcctgtacctgctccagttccaggttttccgcgggctgggtgaggccaagctgtcgcgaaggagcctccaggctgcctgggagaaggcgagcacgatacacgagaagctcatatttggggcatggctcaagtacgagaagagaggagaggagccgatatcggaccttcttggctcgtgcggcaagtgctctcaagagttcaagctgctggatttcgtctcgcagatctccgccgagtcgcatgggataagctatgacgatgaatctgatgagttccagggctcccctgtggttcatttccggataagggatgacatgattgcatgcgataggcggaagctggcggccttgtcaactccactgtatgcgatgcttaacggtgggtttaaggagtcgcatcttgaagtcattgacatgtctcggaatggcatctcgcctattggtatgcgggccatcagtaaattcagcctgtcaggaagactaccgtatttgtcagcagaatctattttggagatgcttgattttgctaacaaattctgctgtaagggcctcaaggatgcttgcgagcaaaagcttgcttcttttgtttcttccaggcaagatgccatagattacatggagtgtgctattgagctgggctgttccatacttgccgcgtcatgcttgcaggtgctcctgaatgagcttccagaatgcttgaatgatgagcaagtggttaggatattctcctctgcgaataagcagcagagatccactatggctggcaatgcatccttctccctatattgccttcttggtgaagtctccatgagcatcagtgcaacatcagatgtcactgtaagcttcttggagaagctggttgactcggcatcagattctagacagaagcagttgtccttgcatcagctggcttgcgtgaggctgctaaggaaagatcatgctgaagcggagcgcctgttcaatgctgcctttaccgctggtcatgtctactcggtagtgggcttggctagattggcctctctgaggagcaataagcattattctctcaacttgcttgactctgtcatgtcatctcgttggcctcttgggtggatgtatcaagagagagccctatatctggacggtgatagcaagttggagaatctcaataaggctactgaactggatccgacgcttacatacccctatatgtttcgagctgcatcgttgatgaaaaggcaaagtgttgaagctgccctgatggagattaaccggatcctggggttcaagctggtcctggaatgcttagagctaaggttctgttgctaccttgctctagaggactacagagctgccttatgcgatgtacaggcaatcctcacgcttgctccagattatcgtatgattggtggtcgggtggctgcgaagcagctacgtacacttgtgatggagaatgtagagcaatggacgactgctgattgctggatgcagctttatgatcggtggtcctctgtggatgatattggatccctctcggtcatatatcaaatgctggagtcagatgctgctaagggagtactatacttcagacaatctttgctgcttctcagattaaattgtcctgaggctgcaatgcgcagcttgcagcttgctcgtgagcatgcagcaagccaccatgaacggcttgtttacgaaggatggatactgtatgatactggccactgcgaggaaggattgcagaaagcggaagcatcgattgccatacagagatcatttgaggcgttctttctaaaagcttatgctttagctgattcaagtcttgaggcgtcaacctcagcaacagtcgtatcgcttcttgaagatgcattacggtgtccctcagatagacttaggaagggccaggctttgaataaccttgggagtgtttatgtggattgcgggaatctggacttggcagctgaatgctacattaacgctttaaagattggccacacgagagctcatcaaggccttgccagggttcatttccttaggaataacaggaccggtgcattcgaggaaatgaccaagctgatagagaaggccaggagcaatgcatcagcgtacgagaagaggtctgagtattgtgaccgggatctaactaaagctgatctgcagatggtcaccaaacttgaccccctccgggtctacccctacagataccgtgctgctgttctgatggacaaccacaaggagaaagatgccatctcagagctgactaaggcaattgcctttaaggcggacctgaacctgctccatctgcgtgcggccttccacgagcacgtgggtgacatctcaggcgccctccgggactgccgcgcagcactttccgtggaccccaaccaccaggaaatgctcgagcttcatcatcgggtgaacagccaagaaccctgagcccgttgttgtacatacaggaggggctcccatagcgaaaacccataccagtgtatgttctgtaccatacacagcaagcagtaatttttagttttgatggtatctagtgcggctgtaaggattgtgatcatcaaaccgactaaaattaagccacgtgctatatggaaaatattacattccacttgtgtcacttggctaacactaactgggcaataggcttcagcatgcaacaatatgcattgaaccgaaggcctggctgttgtgtccatcagtttttgcactgctgtaaaatccacttcttttgtgt

SEQ ID NO: 1556 - DNA, 2863 bp, Secale cereale
gccgccggttcttcctcacttcaagcccgctgactacgtcgacatactggctcagattcacgaggagctggagtactgccctcctgatgagaagtcgtgcctgtacctgctccagttccaggttttccgtgggcttggtgaggccaagctgtcgcgaaggagcctccaggctgcgtgggaaaaggcgagcacgatacatgagaagctcatattcggggcatggctcaagtacgagaagagaggggaggagccgatatctgaccttcttggctcgtgcggcaagtgctctcaagagttcaagctgctggatttcgtctcgcagatctccgccgagtcgcatgggataagctttgacgacgaatctgatgaattccagggctccccggtggttcatttccggataagggatgacatgattgcctgcgataggcggaagcttgcggccttgtcaactccactgtatgcgatgcttaatggtgggtttaaggaatcacatcttgaggtcattgacatgtcccggaatggcatctcccctattggcatgcgggccatcagtaaattcagcctgtcaggaagactaccgtatttgtcagcagaagctatcttggagatgcttgattttgctaacaaattctgctgtaagggcctcaaggatgcctgcgagcaaagcttgcttcttttgtttcttccaggcaagatgccatagatttcatggagtgtgctattgagctgggctgttcgatccttgccgcgtcatgcttgcaggtgctcttgaatgagcttccagagtgcttgaatgatgagcaagtggttaggatattctcctctgcgagtaagcagcagagatccactatggctggcaatgcatctttctccctatattgccttcttggcgaagtctccatgagcatcagtgcaacatctgatgtcaccgtaagcttcttggagaagctggttgattcagcatcagattctagacagaagcagttggccttgcatcaattggcttgcgtgaggctgctaaggaaagatcatgctgaagctgagcgcctgttcaatgccgcctttaccgctggtcatgtctactcggtagtgggcttggctagattggcctctctgaggagtaataaacattattctctcaacttgcttgactctgtcatgtcatctcggtggcctcttgggtggatgtatcaagagagagcgctatatctggacggtgatagcaagttggagaatctcaataaggctactgaactggaccctacccttacatacccctatatgtttcgagctgcatctttgatgaaaaggcagagtgttgaagctgccctgatggagattaaccggatcctggggttcaagctggtcctggaatgcttagagctaaggttctgttgctaccttgctctagaggactacagagctgccttgtgcgatgtacaggcaatcctcacacttgctccagattatcgtatgattggtggtcgggtggctgcgaagcagctgcgtgcgcttgtgatggagaatgtagagcaatggacgactgctgattgctggatgcagctttatgatcggtggtcctctgtggatgatattggatccctctcggtcatatatcaaatgctggagtcagatgctgctaagggagtactctacttcagacaatctttgctacttctcagattaaattgtcctgaggctgcaatgcgcagcttgcagcttgctcgcgagcatgcggcaagccaacatgaacgacttgtttatgaaggatggatactgtatgatactggccactgcgaggaaggattgcagaaagcggaagcatcgattgccatacagagatcatttgaggcattctttctaaaagcttatgctttagctgattcaagtcttgagccgtcaacctcagcaacagtcgtatcgcttcttgaagatgcattacggtgtccctcagatagacttaggaagggccaggctttgaataaccttgggagtgtctatgtggattgcgggaatctagacttggcagctgaatgctacattaatgctctaaagattggccacacgagagctcatcaaggccttgccagggttcattccttaggaataacaggacaggtgcattcgaggaaatgaccaagctgatagagaaggccaggagcaatgcatcagcatacgagaagaggtctgagtattgtgaccgggatctaactaaagctgatctgcagatggtcaccaaacttgaccccctgcgggtctacccctacagataccgtgctgctgttctgatggacaaccacaaggagaaagatgccatctcagagctgactaaggcaatcgcctttaaggcggacctgaacctgctccatctgcgtgcggccttccatgagcacgtgggtgacatctcaggcgccctccgggactgccgtgcagcactttccgtggaccccaaccaccaggagatgctcgagcttcatcaccgggtgaacagccaagaaccctgagcccgttgttgtacatacaggaggggctcccatagcgaaaacccataccagtgtatgttctgtaccatacacagcaagcagtaatttttagtttgatggtgtctagtgcggctgtaaggattgtggtcatcaaaaacgtctaaaaattaagccaacgtgctatatggaaaatgtacattccacctgtgtcacttggctacactaactgggcaataggcttcagcatgcaacaatacactgcagtactgccgattggactgaagcctggctgttgtgttttttctacgtttttgctactgctgtaagactccacttcatttgtgttagtagtgatctgttagggacatcgatggggg

SEQ ID NO: 1557 - DNA, 2733 bp, Triticum aestivum
ctgtcgcgaaggagcctccaggctgcgtgggagaaggcgagcacgatacacgagaagctcatatttggggcatggctcaagtacgagaagagaggggaggagcccatatctgaccttcttggctcgtgcggcaagtgctctcaagagttcaagctgctggatttcgtctcgcagatctccgccgagtcgcacgggataagctatgacgacgaatctgatgagttccagggctccccggtggttcatttccggataagggatgacatgattgcctgcgataggcggaagcttgcggccttgtcaactccactgtatgcgatgcttaacggtgggtttaaggagtcacatcttgaggtcattgacatgtctcggaatggcatctcgcctattggtatgcgggccatcagtaaattcagcctatcaggaagactaccgtatttgtcagcagaatctattttggagatgcttgattttgctaacaaattctgctgcaagggcctcaaggatgcttgcgagcaaaaacttgcttcttttgtttcttccaggcaagatgccatagattacatggagtgtgctattgagctgggctgttccatacttgccgcgtcatgcttgcaggtgctcctgaatgagcttccagaatgcttgaatgatgagcaagtggttaggatattctcctccgcgaataagcagcagagatccactatggctggcaatgcatctttctccctatattgccttcttggtgaagtctccatgagcatcagtgcaacatcagatgtcactgtaagcttcttggagaagctggttgactcagcatcagattctagacagaagcagttggccttgcatcaattggcttgcgtgaggctgctaagaaaagatcatgctgaggctgagcgcctgttcaatgccgcctttaccgctggtcatgtctactcggtagtgggcttggctagattggcctctctgaggagtaataaacattattctctcaacttgcttgactctgtcatgtcatctcggtggcctcttgggtggatgtatcaagagagagccctatatctggacggtgacagcaagttggagaatctcaataaggctactgaactggatcctacccttacatacccctatatgtttcgagctgcatcattgatgaaaaggcaaagtgttgaagctgccctgatggagattaaccggatcctggggttcaagctggtcctggaatgcttagagctaaggttctgttgctaccttgctctagaggactacagagctgccttatgcgatgtacaggcaatcctcacgcttgctccagattatcgtatgattggtggtcgggtggctgcgaagcagctacgtacacttgtgatggagaatgtagagcaatggacgactgctgattgctggatgcagctttatgatcggtggtcctctgtggatgatattggatccctctcggtcatatatcaaatgctggagtcagatgctgctaagggagtactgtacttcagacagtctttgctacttctcagattaaattgtcctgaggcagcaatgcgcagcttgcagcttgctcgcgagcatgcggcaagccaacatgaacggcttgtttacgaaggatggatactgtatgatactggccactgcgaggaaggattgcagaaagcggaagcatcgattgccatacagagatcatttgaggcattctttctaaaagcttatgctttagctgattcgagtcttgagccgtcaacctcggcaacagtcgtatcgcttcttgaagatgcattacggtgtccctcagatagacttaggaagggccaggctttgaataaccttgggagtgtttatgtggattgcggtaatctagacttggcagctgaatgctacatcaacgccttaaagattggccacaccagagctcatcaaggcctcgccagggttcatttccttaggaataacaggaccggtgcgttcgaggaaatgaccaagctgatagagaaggccaggagcaatgcatcagcatacgagaagaggtctgagtattgtgaccgggatctaactaaagctgatctgcagatggtcaccaaacttgaccccctccgggtctacccctacagataccgtgctgctgttctgatggacaaccacaaggagaaagatgccatctcagagctgactaaggcaattgcctttaaggcggacctgaacctgctccatctgcgtgcggccttccatgagcacgtgggtgacatctcaggcgccctccgggactgccgcgcagcactttccgtggaccccaaccaccaggagatgctcgagcttcatcaccgggtgaacagccaagaaccctgagcccgttgttgtacatacaggaggggctcccatagcgaaaacccataccagtgtatgttctgtaccatacacagcaagcagtaatttttagttttgatggtgtctagtgcggctgtaaggattgtgatcatcaaaacgtctaaaattaagccacgtgctatatggaaaatattacattccacctgtgtcacttggctacactaactgggcaataggcttcagcatgcaacaatacactgcatactgccgattgaaccgaaggcctggctgttgtgttcttcagtttttggactgctgtaagatccacttcatttgtgttagtacttagtagtgaatctgttgcgacatgcaatttgatatgtccattgtgta

SEQ ID NO: 1558 - DNA, 2758 bp, Panicum virgatum
cggctgtgcgtcgccttttgaccgccaaccactctgcagtccgctgcgccggtacgcacccgtccgtcagctgacagcaaatcccattccggagagcagccgcgagaacagctcaagaaaggcgagccctttccgcagaggccgccgccgccgccatcgccatgtgctccgccccgggcaacggcgggaaggagggccccgcggccttctccgtggacctcgcggccgccgcgcgccggctgctggcgttcctgcgcgcggcgccgcccggggtggggccgcggtccgtgcggaggtacgaggagcactggctgccgctcgcggcggcggagggcggaggcccaggaggggaggcggcgatgctgctgctgccgccgcccgacgtgcagctcgtctggctttgccactgcttccaccatgagagctactccgcatattgcttatcgaggtttggacgcctcattgaccgcccatccatccttgacacggagaatgaagaatatgccgaggaccgttgccgggatgtctgggccgcgcattacccatctgagccgtttgacctctgcagtaacgagtttgatggtaacagtgttgatgaaattgcctgtgacggtgccaacagtgaaattgtggaaatggtgagatgctacgctggcctagcagcacgctttgtctcaccctttgtgcgggaaggtgtctaccatgttgctgcatggcggcgatatgtgcgtttcctggacctcatcaagaaggttgggtgcacaacccaagaacacataaggcttgtgccaagcctggacatactactgatgtggcttgctcaccagagttttcctgtgagttatgccaaggacatgacaacaatgacaatcatggaaaatgtggcaaaagtggggctgtcttatggggagatggtgagtgatgaggaggtagaaagaacaagggcattgtgggaggatgcatataatgagccatatgatatggctggatcagagattgatgtgggagcagttagcgcagcacgggaggcattttattgggcgccagcagcatcagaagaggatgccaaccggttgtacaaaattttacaaccaaggtttcttatggaggtatatgtgttcttgaaaggagatattgataaggagcacatcaacaaggagttcctacggctgcgaacacagaggtctcacagatcattaaaactgaacaaatcaatggtcaacttatcctgcaaaaactggcagaaaacatggcacttgtactgtgaatttgcaacccggggtgttgtcattgaggtcagacgcaccacaagtgggtgcttcagaaacagcaagtttctcaaaagcatctcattttcgtggagtgatatgttgcatgagaaagcactcgctctcaccgaggaactagaagtcgggatgagagcaatggcatcaattacccctccagttcaagcaccatacttgttgaagtgtgttcctgatcgagtcactgatgatggtggggccatgatttctgatgtcatattgcgcatgagaaattaccgtccacaagaaggacgatggttgacccgcactgtgcttgatcatggtgggagagaatgttttgtggtccgaatgagaataggtagagggatttggcggagaggtgctgaaactcctgtggcagtgaaatgggaggacaggagcattgaggttcgagaaggatcatggtcatatgttgcaagtacaagctctgttggttatgctcctgagaaggtagtgggcacagcaacggcaatgaaggatcaacaggagaataaggtggtttggagattgtcaacaggagatatactcacaatatgtttgggagatgagctcagctttcagcttaaaaatgagaaattagaagaagaggcaaggttgcttgtggggaggagattgagctacaaggtaaatacagatggtgtttcgagcaaccacgctgaggaagagcaatacatcactcttgttcgtaagtcaccagatcatcatggtgacagagcaactgtgcttataaactggaaattacttgaccgtggagttcttacctgaagaggatgcagtttttgttcttctcctatgcatggtgattgcaaggaccatgacagagatcaggagagaagatgtggctgggcttttagtgcgccgaagaataggtgaagcaagggtggggcagagagactggggttccgtgatgcttcctgacttgctttccccagatcctaatttgcagccttggtatcggaatggggcgcaggttttgagctctgcagaaacagggacaatgctcgctaagtactcccctgctgacggaaaagacttgttatacaggcaagctcttatgacctgaagttctcatagtgacgattgccctgaggatttgcttgatagccaagcattggaccaattgcagggggcaactatttcatttcctccttcaatcctaaagcacttcatctctgtacaggattcactaattgcagggaccagatttgactatatgaaacttgttgattcactaactatgacaacgacaatatttgacacgaatctggtgattgttgtcatatactgtttgtaattagaaatgttacatttcattttaaaacggtttgatttctcttgtgtgtccctgaacttaaaaaaaaggtttatgttcatttgaacaaactgttctagaagacaatgattcaagatttgatatccaaaggagtttatgaatgttcattgcaagcatgtta

SEQ ID NO: 1559 - DNA, 2527 bp, Setaria italica
gccgccgccacggccatgtcctccgccttgggcgtcggcgggaaggaggggccctcggccttctccgtggacctcgtagccgccgcgcgccggctgctggcgttcctccgcgcggggccgcccggggtggggcggcggtccgtgcggaggtacgaggagctgtggctgccgctcgcggtggcggagggcggcgaagggggaggagggggaggggaggcgccgatgctggtgccgccacccgacgtgcacctagtctggctctgccactgcttccaccatgagagctactctgtatactgcttatcaaggttcggacgcctcattgaccgtccatccatccttgacgcagagaatgaagagtatgccgaagagcgttgccgggatgtctgggctgcgcattacccttctgagccgtttgacctccaccgtaatgagattgatgggaacagtgatgatgacattgcctatgccaatgccaacagtgaaattgtggaaatggtgagacggtacgctggcctagcagcccacttcgcctcaccctttgtgcgggaaggtgtctaccatgttgctgcgaggcggcgatatgtgtgtttcctggacctcatgaagaaggttgtgggtacaacccaagatcagacacggcttgtgcctagcctggacatattactgatgtggcttgctcacctgagttttcctgcaagttatgccacagacatggtagcaatggccatcagtgacaatattgcaaaaatgggggtgggttatggggaggtggtgactgatgaggtgctcaaaagaacacgggcattatgggaggaagcatatgatgtgccatatgatatggctggatcagaggttgagatggcggcagttagggcagcacgggaggcattttactgggcaccagcagcatcagatgaggatgcgaaccggttgtacaaaagtttgcaaccaaggtttcttatggaggtgtatgtgttcttgaaaggagaaagtgataaggagcacatcaacaaggagttcctacggttgcgaacacagaggtgtcacagatcactaaaactgaacaaatcaatggccaacttatcctgcaaaaactggcagaaaacatggcacttgtactgtgaatttgcaacccggggtctcctcattgaggtcaggcgcaccacaactggatgtttcaggaacagcaagtttctcaagaacatctcattttcatggagtgatatgttgcatgagaaagcacttgctctcacggaggaacttgaagtcaggatgagagcaatggcatcaattacccctccagttcaagcaccgtacttattgaagtgtgttcctgatcgagtcactgatgatggtggggccatgatttctgatgtgatattgcgcatgagaaattaccgtccacaagaaggacggtggctgacccgcactgtgcttgatcatggtgggagagaatgttttgtcatccgaatgagaataggcagagggatttggcggagaggtgctgaaactcctgtggcagtgaaatgggaggacaggagcattgaggttcgagaaggatcctggtcatacgttgcaagtacaagctctattggttatgctcctgagaaggtagtgggcacagcaacagcgacgaaggatcaacaagaaaataaggtggtttggagcttatcaactggatatatactcacggtaaatttgggtgatgagctcagctttcagcttaaaagtgagagcttagaagaagaggcaaggttgcttgtggggaggagattgagctacagagtaaacacagatggagcatcaagcaaccacaatgaggaggagcaatacctcactcttgttcgtaattcaccagatcatcatggtgacagagcaactgtgcttctaaactggaaattacttgctgtggagttccaacctgaagaggatgcagtttttgttcttctactatgcatggtgattgcacggactatgacagagatcaggagagaagatgtggctgggcttttagtgcggcgaagaataggagaagcaagggtggggcaaagagactggggttcggtgatgcttcctgacttgctttctccagatcctaatttgcagccttggtatcggaatgcggctcaggttttgagctctgcagagacaggagcaatgctcgctaagtattcacctgctgatggaaaggacgtgttgtaccggcaatctcttataccctgaagataagatggttgcccagaggatttgcttgaccaaatcttcctcagaatatcaggggaactatttcatttcctcgctcaatccttagcattgcatttttgtacagaacaaatcctgtctttgacttattgattcactaattatgatgatctttgatatgaatctggtttgtcatacatggtttgtaattagaaatttcacatttgagtttaaaatggtttgatttctctggtttgtcgctgaattaaaaaaaaggtttctgttcacttgaacaaactggttctagaggatacatgattca

SEQ ID NO: 1560 - DNA, 1837 bp, Panicum virgatum
cattaaattagcaaacaagtgccactccagatggaaatcaggccgcaattagaaaaattgaaagtctatgtacttaagcgaaaatatgttcccgatgcctataaatccaggaaccaacccccacgatttcgaaaattcgatcacaaactccccctttccggctttccctgctgctgttgctgctgctcctccacctctggaagcatcgatctctctctcgagccatggcgaaggcaagggcacactcgtcgaagcgaaccacccatcacctcctactcgcggtttccctctctgtttgcgttctcctcccgctgctcttgccggcggcggcaaccgccgcggtggcggtggcggagggggatggggagatcaagtcggcgctgggggccgggaggcagtgggtgaccgggaaggacgaggtgaatctggttgcggagggggatactgctcgagtcggtttggtggaggaggacgaattcgctggtggcttcggctccctcgatagcatgctgcagtgggctattggaaattctgatccggagaagctgaaagaggaggcagctgatgtgcagaaattgtctgcagatgagctgctgaagcggcgtcaggagatcaaggagttgatggagaagttaaagatgccatcagatgctgacttaatgaaaattgcaattgctgacttaaaaaactcttccatttctctggaggatcgccagcgtgcattgcaggaacttttagttcttgttgagcccattgacaatgctaatgatcttgacaaacttgggggtcttcttcctgtgattcaagagcttaataatgcaaatgaagaaatacggaccacctctgcatgggtccttggtacagccagtcagaataatgcacttgtacaaaaccagatcctcgattatggagctttggtgaggttggtgaagatgggctattcgacatctacagaagaagctgcaaaagcattatatgctatatctgctttgatcagaaacaatgtaaatggtcaagaggcattccattcagaaaatgggggttcaatgttgcagcacatattggtgagcaacagtattgatgttaggctacagaagaaagcagtgtttttagtaacagatctggcagactttcagctaaattctggaaacccacaacttcctttcttaagtgaccgccttttcttgaagtcaatggttgatatgttgtcaaactttgacctagatcttcatgaaaaggtcttgttggccattaagagtctgctgaaactttcctcaactgatgtggaggattttgagttctatgacctcgagggtgttctgctcagactaggggtacagttggaggatttgacaccagaggatcaaaaggagttcgctgcggaggttgatggccttcgaagggaagttcagacgctcttccaacagaagctcaagcagggtaaagcgactgcgacatgatatttggaaagccaccagaagatttgcccttttggatgcagtataatccatcattttttgtgggatgctaatgttacagacttacagttagatgggcaggtttgggttcccttttcttgcagtattcaggaatgaccagtcggagtcggaggggcgggaggaatgtcaggtagtaatgtcgtggtgttgtagtatatgatggacatgataggttcggttcctaggcacgtgctcatgacttcattttggcaaactaattatcattctcacaacgttctgtaatacgggcactgcagtgaagcaatttttccttgtgccgttgcagcttcagcttccttttgaggccagttgaattttatgttgatcatattcatatc

SEQ ID NO: 1561 - DNA, 1916 bp, Panicum virgatum
ctgaaagcacacaacccaaatcatattgatcgagatacgaacggtctagatttccaagcagtcttgggagacccccgatgtgatgtcatccgaccaatgggaggcgccccaacaccggatctccgggcccacttgccgtagcctttctaaagtcctccctgacaatcattaaattagcaaacaagtgccactccagatggaaatcaggccgcaattagaaaaattgaaagtctatgtacttaagcgaaaatatgttcccgatgcatataaatccaggaaccaacccccacgatttcgaaaattcgatcacaaactccccctttccggctttccctgctgctgttgctgctgctcctccacctctggaagcatcgatctctctctcgagccatggcgaaggcaagggcacactcgtcgaagcgaaccacccatcacctcctactcgcggtttccctctctgtttgcgttctcctcccgctgctcttgccggcggcggcaaccgccgcggtggcggtggcggagggggatggggagatcaagtcggcgctgggggccgggaggcagtgggtgaccgggaaggacgaggtgaatctggttgcggagggggatactgctcgagtcggttcggtggaggaggacgaattcgctggtggcttcggctccctcgacagcatgctgcagtgggctatcggaaattctgatccggagaagctgaaggaggaggcagctgatgtgcagaaattgtctgcagatgagctgctgaagcggcgtcaggagatcaaggagttgatggagaagttaaagatgccatcagacgctgacttaatgaaaattgcaattgctgacttaaaaaactcttccatttctctggaggatcgccagcgtgcattgcaggaacttttagttcttgttgagcccattgacaatgctaatgatcttgacaaacttgggggtcttcttcctgtgattcaagagcttaataatgcaaatgaagaaatacggaccacctctgcatgggtccttggtacagccagtcagaataatgcacttgtacaaaaccagatcctcggttatggagctttggtgaggttggtgaagatggggtattcgacatctacagaagaagctgcaaaagcattatatgctatatctgctttgatcagaaacaatgtaaatggtcaagaggcattccattcagaaaatgggggttcaatgttgcagcacatattggtgagcaacagtattgatgttaggctacagaagaaagcagtgtttttagtaacagatctggcagactttcagctaaattctggaaacccacaatttcctttcttaagtgaccgccttttcttgaagtcaatggttgatatgttgtcaaactttgacctagatcttcatgaaaaggtcttgttggccattaagagtctgctgaaactttcctcaactgatgtggaggattttgagttctatgacctcgagggtgttctgctcagactaggggtacagttggaggatttgacaccagaggatcaaaaggagttcgctgcggaggttgatggccttcgaagggaagttcagacgctcttccaacagaagctcaagcagggtaaagcgactgcgacatgatatttggaaagccaccagaagatttgcccttttggatgcagtataatccatcattttttgtgggattctaatgttacagacttacagttagatgggcaggtttgggtccccttttcttgcagtattcaggaatgaccagtcggagtcggaggggcgggaggaatgtcaggtagtaatgtcgtggtgttgtagtatatgatggacatgataggtttttggattgttggaaaaatagacaactgtaagtttaaattccgaactagatttatcatgacgagaattaaacctag

SEQ ID NO: 1562 - DNA, 3854 bp, Panicum virgatum
tcgctcgtcggaaatgatctgaaatttctgcgtccggaacagtgaacaccaggccggtcagcacgcagtcaacgtgccaatctgccaggcaagggcaagggcaagccaagcaggcaacggaacggaaggaagcagcgaggaagcaaccgttggccggagcgtctccctcccctgccgagcgccaccgcggcggcgtgggcgtctccgttacaaatcccccgcccgcaccacaaaacaaagcgacaagccgggctcgcatcgcgggaggacctcaggacccggcgccagctcactcgcgcacgcctcccccccagatcccatctcgcgctcgccctccccgacgggggcccatggccaccgccgccaccgcctcgcatccggcctccgcctccacctccggccgcgacgccctcgccgcggcctgctcctcccccgccgccgtctgcctcgtcccgttcaggtggtgggcgcgggtgcgggaggaggaggcggcgggcggggtgcggtacgcggccaccgccgcggcctcgccctcctactacggcctcaggctgctccacagcttcctgcacccggatctcgtcctgcgcctcgagcgcggggacggccgcgcgggcggcacaggcgcgggggggcgcagctacgcgctcgtcccggccgacgagctctccagggcgctcgccaggcagaactctggttttggtttgcaaaataagcattcgtttgctggagatagtgctggtgcttatcctttggtgcttaggatatctgtccgagaaacaagtattttgacactgaagattagcaaaaaggacaatccagttgagaactacaaacgagcaaacaaaattttcaatgttgattctcaaccagttcatgtttgggatttttcagggcagacaaatctaatattaatgaacgaatggaataggctacatcatgactgttgccatgcagatcaagagaatcttctagaagtccaagtctacgcaatgtctgattccttaacatccaaaattggaggtaccaacaaagaaagccctggaggtgttaatgatttgaatgctgattcgtactacagaagctttggaagagctggctctatggggttaataggattggagaatcttggaaatacttgctttatgaacagttcgatccaatgtttggctcacacaccaaagcttgttgattatttccttggtgattatgccagaaatataaatcgtactaatccattgggattgaatggtgaacttgctttggcgtttggagaattgttgaggagcttatggaccactgacagaaaaccagttgcgccacatcatttcaaggaaaagattgcctgttttgctcctcagttcagtggctttaatcagcatgattcacaggagcttcttgcttttttattggatggtctccatgaagatcttaaccaggttaagtgtaaaccgtatgaagaagcaaaggatgcaagtggccgtcctgacgaagaagtagcagatgagtactggagcaaccatttagctcgaaatgattctgtgatagttgatacctgccatgggcaatacaaatctatgttaacttgtcctacttgcagtaaaaaatctgtcacttttgacccatttatgtacttatctttgcccgtaccttccatggcaaagagggcaatgactgtaacagttttcagcactgatggtagtagagaaccttgctcatatgatgtcagtgtgccgaagtttgggactcttagtgatcttgttcaggctttaagcattgcttgcttacttggagatgatgagatcctacttgttgcggaggtctataataactgcattcttcgatacctggaggaaccttctgattcggtttcattgctgagggatggggataaactggcagcctaccgcctacccaaaaaatatgagaaatccccacttgtgatttttacacaccagcattttgatgagcattctagtggtgataatgtaactccacaaaagaaggaatttgaggccccacttttggcagcgcttccagagagagtcaatggattatcccttcagaatatctacctgaaattgctgaatccattccaactttccaagggggctagctcacttaatggttctgcagggtttaatggtgactctgctgacttgatggatggaatgccttctgattcaggcagtaattttcaggatattcaattggatgatgaccctcgaaacagtaactgcagtactaatgattgtgaaataacaaacgcacccggtgagttatatgatgggggtaaagctgatcctaacaaggaaaggagagtggaagattttgaattttatttaaaaagtgaaaggggtgatgtccagcaacagaaaatagaaattaatgagcttgatttactggagacaataccaagccggttgcatgtgaatgtccactggcaacaaaatgcgtcaagacagtatgctgcctcaatgctgaacaatctacctgagattcacaagcttgagcttaccccgaaaggaactgaagattctattgcactacatggctgtctggaagcctttctgaaagaggagccattgggcccagaggacatgtggtactgcccatgctgcaagaagcatcaacaagcgatgaagaaattggatctctggaggctgcctgaagtcctggtgatccacctcaaaaggttctcgtacactcagttcacaagaaacaagctcgagacattcgttgacttccccaccactgatttggatctgtcatcatacgttgccgacaagagcgagcagccaagcagccattatcgcttgtatgccattagcaaccactatggaaacatgggaggagggcattacaccgccagcatctatcacgaggaaggtaaaggatggtataagttcgatgatgactgtgtgactcctataagcgaagacagcataaagacgccggcggcttatgttctgttctacagacgacagtgaggatacagtagcattttgtgcaggtgttttccagttggcaactccagacttccctgcatacctgccgtttcaccatgactgatttcaacatgtcggcacttggatctctcaagtcacgctaacttacctatacaacagcatgtacagattcagctgccaacaggagagagcagaagaacctagctgatgcaacattctttttttccagctcacaatattcttatattcttttgggtacatcatacatggcccgggccccctcccacccccagcattgtagtgtgaaggaagggtcaatgaacacaattcttctgtctctgcccgcagaattcgcgccggggattcgaggcggcgatgtaacagctctgtaaattaactcccgtgtgatctgttcttctccagatttccccatgatctgttcttgtccagattgctgcgtgtggtgtgaccgtgacgccgcagcttctcccccatgctgttgctccatccatgagccggcaattcgccgtctctccagtcagccccgacggcgacgcggtgatcattgaaggcgtggaaagcccctgcccagctgggagacttttcctgaccagccatatctccaggatcgccatgatggacgctgacccctcgccggagctcgccggagctcgtctcctcaggttacacgagctgggtgctgcgatcgctgctggtagctgctagtgtggttcgacaaatattctgccctatctgggaaccattccttgtgacgacgcgtcttagggccggaccgggtgggatgagcttcggagctttttgggcgagatgagcctgtgggggcgatctactggtgtcggaggacaagtccatggccagctgcaa

SEQ ID NO: 1563 - DNA, 4073 bp, Panicum virgatum
ctactaaatttggagagttatttacaaagtctgttgaagacgtattttttttaacaatagttaaatttatctttgcaaaagtaatttagctaatctttcggagatgctccaatctgaaattttctgcgtccgcagcaccagctcgggagctccggtcagcaggcagtcaacgtgccaagcaagggcaagccaagcaggcaacggaacggaaggaagcagccaggaagcaaccgttgggcgagcgtctcctccgtcccctccaccgcggcggcgcggcgtgtctctgtttacaaatcccccgctcgccccgcaccagaaaacaaaagacggctcgcatcgcgggaggacccggcgacagctcactcgcgcacgcctcccctcccccccctcgccgcccccagatcccatctcgcgcgcgccctccccgctccccggcggggccccgcccatggccaccgccgccaccgcctcgcaccgggcctcggcctccacctccggtcgcgacgcgctcgccgcggcatcctccgccccggccgccgtctgcctcgtcccgttcaggtggtgggcgcgggtgcgggaggaggaggcggcgggcggggtgcggtacgcggccaccgccgcggcctcgccctcctactacggcctcaggctgctccacagcttcctgcacccggatctcgtcctgcgcctcgagcgcggggacggccgcgcgggcggcgcaggcggcggcgccgggggacgcagctacgcgctcgtcccggccgacgagctctccagggcgctcgccaggcagaactctggttttggtttgcaaaataagcattcgtttgctggagatagtgctggtgcttatcctttggtgcttaggatatctgtccgagaaacaagtattttgacactgaagattagcaaaaaggacaatccagttgagaactacaaacgagcaaacaaaattttcaatgttgattctcaaccagttcatgtttgggatttttcagggcagacaaatctaatattaatgaatgaatggaataggctgcatcatgactgttgccatgcagatcaagagaatcttctagaagtacaagtctacgcaatgtctgattccttgacgtccaaaatcggaggtaccaacaaagaaagttctagagatgttaatgatttgaatgctgattcgtactacagaagctttggaagagctggctctatggggttaataggattggagaatcttggaaatacttgctttatgaacagttcgatccaatgtttggctcacacaccaaagcttgttgattatttccttggtgattatgccagaaatataaaccgtactaatccattgggattgaatggtgaacttgctttggcgtttggagaattgttgaggagcttgtggaccactgacagaaaaccagttgcgccacatcatttcaaggaaaagattgcctgttttgctcctcagttcagtggctttaatcagcatgattcacaggagcttcttgcttttttattggatggtctccatgaagatcttaaccaggttaagtgtaaactatatgaagaagcaaaggatgcaagtggccgtcctgacgaagaagtagcagatgagtactggagcaaccatttagctcgaaatgattctgtgatagttgatacctgccatgggcaatacaaatcaacattaacttgtcctacttgcaataaaaaatctgtcacttttgacccatttatgtacttatctttgcccgtaccttccacggcaaagagggcaatgactgtaacagttttcagcactgatggtagcagagaaccttgctcatatgatgtcagtgtaccgaagtttgggactctcagtgatcttgttcaggctttaagcattgcttgcttgcttggagatgatgagatcctactagttgctgaggtctataataactgcatccttcgatacctggaggaaccttctgattctgtttcattgctgagggatggagataaactggtagcataccgcctacccaaaaaatatgagaaatccccacttgtgatttttacacaccagcattttgatgagcattctggtggtgataatgtaactccacaaaagaaggaatttgaggccccacttttggcagcgcttccagagagagtcaatggattatcccttcagaatatctacctgaaattgctgaatccattccatctttccaagggggatagctcacttaatggttctgcagggtctactggtgactctgctgacctgatggatggaatgccttctgattcaggcagtaattttcaggacattcaatttgaagatgaccctggaagcagtaactgcagtactaatgaatgtgaaataataacaaaagcacccggtgagtatgatgggggtaaagctgatcctaacaaggaaaggagagtggaagattttgaattttatttaaaaagtgaaagggctgatgttcagcaacagaaaatagaaattaatgagcttgatttactgaagacaataccaagccggttgcatgtgaatgtccactggcaacaaaatgcgtcaagacagtatactgcctcaatgctgaacaatctacctgagattcacaagcttgagcttaccctgaaaggaactgaagattgggttgcactacatggctgtctggaagcctttctgaaagaggaaccattgggcccagaggacatgtggtactgcccgtgttgcaagaagcatcagcaagccatgaagaaattggatctctggaggctgcctgaagtcctcgtaatccacctcaaaaggttctcgtacactcagttcacaagaaacaagctcgagacattcgttgacttccccaccactgatttggatctgtcatcatacattgctgacaagagcgagcagccaagcagccattatcacttgtatgccattagcaaccactacggaaacatgggaggagggcattacactgccagcatctatcacgaggaaggtaaaggatggtataagttcgatgatgactgtgtaactcctataagtgatgacggcataaagacgccagcggcttacgttctgttctacagacgacagtgaggacacgagcattttgtgcaggtgttttccagttggcaactccagatttccctacatacctgccgcttcaccatgactgatatcaacatgtcggcacttacctatacaacagcatgtacagattcagctgccaacaggagagaccagttaacctagctgatgcaatattcttttttccagctcaccatattcttatattcttttgggtgcatcatacatggcccgggccccctcccaccaccagcattgtagtgtgaaggaagggtcaatgaacacaattcttttgtctctgcccgccgaattcgcgctggggattcgaggcggcgatgtaacagctctgtaaattaactcccgtgtgatctgttcttgtccagatttccccatgatccgttcttgtccagattgatgcgtgagtatgtgaccgtgacgccgcagcttcaccccatgttgttgctccatccatgagccggcaattcgccgtctctccagtcagccctgatggcgacgcggtgatcattgaaggtgtggaaagcccccgcccagctgggagacttttccagaccggccatatctcggggatcgccatggacgctggcccctcgccggagctcctctcctcagtggcaggttacacgagatgggtgctgcgagatcactgctggtagctgctagtgtggttcgacaaatattctgccctatctgggaactattccttgtgacgacgcttcgtagggccggaccaggtgggatgagcatcggagctttttgggcgaggcgcgcctgtggggggcgccgcccttctactggtgtcggaggacaagtccatggccagctgcaacgaacagcagcaggtctaaagttctcaactcttcatgggcaagccaacaccggtaccctccttcaataatccaactttttttctcccgctcctgatccttagtgcttgatccatcatttcttgacgggtatctatccaagt

SEQ ID NO: 1564 - DNA, 3017 bp, Setaria italica
ggctgcgagctccccggtgtgtggcttgattccgcgactgatttcgacaatgcggcgtgcaggtggtgggcgcgggtgcgggaggaggaggccgcgggcggggtgcggtacgcggccaccgcggcggcctcgccctcctactacggcctcaggctcctccacagcttcctgcacccggatctcgtcctccgcctcgagcgcggggacggccgcgcgggtgccggcgctggcggaggaagcgggggaggaggacgcagctacgcgctcgtcccggccgacgagctctccagggctctcgccaggcagaattctggctttggtctgcaaaataagcattcgtttgctggagatagtgctggtgcttatcctttggtgcttaggatatctgtccgagaaacaagtattctgaatctgaggatcagcaaaaaggacaacccagttgagaactacaaacgagcaaacaaaattttcaatgttgattctcaaccagttcatgtttgggatttttcagggcagacaaacctaatattaatgaatgaatggaataggctacatcatgactgttgccatgcagatcaagagaatcttctggaagtgcaagtctatgcaatgtccgattccttaacatccaaaatcggaggtaccaacaaagaaaattccggagatgttgatgatttgagtgctgattcatcctacagaagctttggaagagctggctctatggggttaataggattggagaatcttggaaatacttgcttcatgaacagttcaatccaatgtttggctcacacgccaaagcttgttgattatttccttggtgattatgccagaaatattaatcggactaatccattgggattgaatggtgaacttgctttggcgtttggagaactgttgaggagcttatggaccactgacagaaaaccaattgcaccacatcatttcaaggaaaaaattgcctgctttgctcctcagttcagtggctttaatcagcatgattcacaggagcttcttgcttttttattggatggtctccatgaagatcttaaccaggttaagtgtaaaccatatgaagaagcaaaggatgcaagtggccgtcctgacgaagaagttgcagatgagtactggagcaaccatttagctcgaaatgattctgtgatagttgatacctgccatggacaatacaaatctacattaacttgtcctacttgcagtaaaacatctgtcacatttgacccatttatgtacttatctttgcccgtaccttccacggcaaagaggacaatgactgtaacagttttcagcactgatggtatcagagaaccatgctcatatgatgtcagtgtgcccaagtttgggactcttagtgatcttgttcaggctttaagcattgcttgcttacttggaaatgatgagatcctgcttgttacagaggtctataataactgcatcattcgatacctggaggaaccttctgattcggtttcattgctaagggatggagataaactggcagcatacaggctacccaaaaaatatgagaaatccccacttgtggtttttacacaccagcatatggatgagtattctagtggtgataatgtaactccacaaaagaaggaatttgaggccccacttctggcaacccttccagagacagtcaatggattattgcttcaggatatctacctgaaattgttaaatccatttcaactttccaagggggctaactcacttagtggttttgcagggtctaatggtgaccctgttgatctgatggatggaatgccttctgattcagacagtaattttcagaacattcaattggaagatgacactgaaagcagtaactgcagtactactgattgtgaaataagaaaaggacccagtgagttatatgatatgggtacagctgattctgacaagggagcaaacgtggaagagtttgaattttacttaaaaaatgaaaggggtgatggccagcaacagaaaatagatattaatgaagtggatttgcttgagacaataccaagccggttgcatgtgaatgtccactggcaacaaagtgcgtcaaggcaatatgacacctcaatgctgaacaatctacctgagattcacaagcttgagctaatcccgaaaggaactgaagattctgttgcactacatggttgtctggaagcctttctaaaagaggaaccattgggtccggaagacatgtggtactgtccgtgctgcaagaagcatcaacaagcgatgaagaaattggatctctggaggctgcctgaagtccttgtgatccacctcaaaaggttctcgtacactcagttcacaagaaacaagcttgagacatttgttgactttcccaccactgatttggatctatcatgctacatcgccaacaagagtgagcagccgagcagccattatcacttgtatgccattagcaaccactacggaaacatgggaggggggcattacaccgccagcatctatcatgaggaagggaaaggatggtataagtttgatgatgaatgtgtaactcctataagtgaagacggtataaagacgtccgcagcttatgttctgttctacagacgagagtgaggatacaggagcattttctgcatgtgttttttggctggcaactccagaattccctacataccagccgcttcaccatgtctgatttcaccatgtcggcacttggatctctcgagtcatactaacttacctatacaacagcatgtacagattcagctgccaacaggagacaccgaaagaacctagctgatgcaatattctttttcccagctcacaatattcttatattctttagggtacatggcccgggcccccccatccccagcattgtaatctccaccagtgaaggaagggtcaacgaacacaattcttttgtcgccgccgcccgcttgaattcttgctgagaattcgaggcagcgatgtaacagctctgtaattaactccagtgtgatctgttcttgtccagatttccc

SEQ ID NO: 1565 - DNA, 2034 bp, Sorghum bicolor
gcaggtcgcagcgctgctgtccgcccgacacctgctcctatgccaggctgcctagtgctcatgctcacccccagcccggagctgtggcaacacgtttgaatgaaaggtaccgatgcggtttggccgtgaccggcgcctcctacagcgacggacggacgagatgggccggctgcccgccgaaatgatggggacgcccctgtaaaaggccatgccaaagggctgcagtgcattggccatttatatctgcggcgccgggcgagggcgcgtagccagcctagaccctggctagctgttgccctgttgccgtctactagcggactgctcgcggcagcagagtgcacggcagcatcaggcatcggcgacggcgagagcgttggcagcaaagcctatttgcctgtctggctgtctgtctccaagcttgaagcccacccagttggtgttgtccgggacatcatcacgcacgcgcagagctgacactggaacgactgaacatggctggagatccgggggacgcgccggaggtgggggaaggtggcatacgctctgtgctcaccatgggctcgctcgtcgatccctccgggaacgaggttcagtttccagagatcgacggcaagatgatcggcctctacttcgcggcgaactggtacccgaaatgcgaggctttcaccccggtgctggccgcggcctacgagcagctcaaggagcgcggcgccggcttcgaggtcgtgctggtgtcgtgcgacgaggaccggccgtcgttcgagcggttccaccgaaccatgccgtggcccgccgtgccgttcggcgacctccgctgcaagaagcgcctcagcgagaggttccaggtggagggcatcccgcgcctggtggtgctcgctgcggacggcgcggtcgttcacccggacgccgccgacctcgtgcaccgctacggcgagagagcgttcccgttcacggccgcgaaggtggcggagctggaggcagacgaccagcgcaagtacgcgtcccagacgctggagaagctcttctccatcaacgggaaggagtacgtgaacggtgccaatgaacaggtcccgatctcgagcctggtggggaagacggtggggctctacttctccgctaaccattgcgcgccgtgcatcaagttcacgacgaagctggcggccatctacagcagcctcaagggcaaggcggaggacttcgagatcgtgtacgtgcccatggacaaggaggaggacgggtacctgcgctcctgcagagacatgccgtggctcgcgctgccctacgacggcgtgccgtcgcgcgcgctggcgaggtacttcgacgtgcgggagatcccgacgctggtggtggtcgggcccgacggcaagacggtgacgcgggacggccgcaacctggtgaacctctacttcgacatggcgttcccgttcacggacgcgcagatcaggctgctgcaggaggccgaggacgaggcggccaaggagtacccgcagtcgctgcgccaccggggacacagacacgagctcagcatcgtgtcggacaagtccgggggaggaccctacatctgctgcgagtgcgaggagcaggggctcggctgggcgtaccagtgcatcgcctgcggctacgagatacacctcaggtgcggccagaatgcggagggcggcggcgcaggaactgcttagcgacgacgagttaacagcgtcaacactaatatctatctagactgctgcatgcatactggacatggttctatgtttgttcccaacaaaccgtcagcttgctctatcaaggctgatgctaaagtagtaaaatagatgagaaatggccttccttgtaaggtttaggtggttagcagagtgcacatgaaaagaaatgaagctgcatcctcggcggcaggtgttaagcaaatcttgctgcactgcccaatcaatctacttatgcatgaaggattgcttcggttcagaagtacatccagtttgtccggctaaagcgttagccaaagaaaacaaacagattccagaccacaacataagacaa

SEQ ID NO: 1566 - DNA, 1640 bp, Setaria italica
agggcagcggcgcgttggccatttatatctgtggtgccgcgcgagggcgcgtcgcgtcgcgtagtcgcgggctgcggaggcacagtgcacggcagcgtcaggcaccggcgagccttcggcctctcggcttaatatctccgcgcgtctccagaccagctgctgttggccgggacagggaaagcgtcggaggaagagcacgggaagtggacatggctggtgttctgctggaggtggaagaagcgccggagggtgggggaggcatacgctccgtgctgaccatgggttcgctggtctctccctccgggaacgaggtgcactttccagagctcgatggcaagatcatcggcctctacttcgctgcaaactggtacccgaaatgcgaggccttcaccccggtgctggccgcggcctaccagcatctcaaggagcgcggcgccggcttcgaggtggtcctggtgtcgtgcgacgaggaccggccgtcgttcgagaggttccaccgcaccatgccgtggccggccgtgcccttcggcgatctccagtgcaagaagcgcctcagcgagaggttccaggtcgagggcatcccgcgcctggtggtgctcgccccggacggcgaggtcgttcacccggacgccgccgacctcgtgcaccgctacggcgagagggcgttcccgttcacggcggcgcgggtggcggagctggaggctgacgaccagcacaagtacgcgtcccagacgctggagaagctcttctccatcgacgggaaagagttcgtgaacggtggcaacgaacaggttccgatctcgagcctggtggggaagacggtgggcctctacttctcggcgcaccagtgcgcgccgtgcatgaagttcacggcgaagctggcggccatctaccgcagcctcaaggggagagcgaaggacttcgagatcgtgtacatccccatggacaaggaggaggacgggtacctgcgctcgtgcagcgacatgccgtggctggcgctcccctacgacggggcgccgtcgcgggcgctggcgaggtacttcgacgtgcgggagatcccgacgctggtggtggtcgggcccgacggcaagacggtgacgcgcgacggccggaacctggtgaacctctacttcgacatggcgttcccgttcacggacgcgcagatcaggcagctgcaggaggcggaggacgaggcggccaagggatacccgcagtcgctgcgccaccggggccaccgccacgagctcagcatcgtgtcggagaagtccgggggagggccgtacatctgctgcgagtgcgaggagcaggggcttggatgggcgtaccagtgcatcgcctgcggctacgagatccacctcaggtgcggccggaacgccgagggcggcagcgcggggaccggttagcgggtatctacctagactagctagctgtgtattggacgtggtctgtgttttgttcccaacaaacgtcagcttgctcttgtcaagtctgatgctaaaatagatgagaaatggccttcgttgtaaggtttaggtggttggctgagtgctgaagaattgcagctgcagccttgcaggtgttaagcaaaccttgatgatgcccaatcaatctagttgagtttctactgtgccattgatcaa

SEQ ID NO: 1567 - DNA, 2586 bp, Panicum virgatum
ccttttcaaatagacggtgaaaaaagaggcgcaaggccaggccgatccagctccccccgcccacgcctcacgcgtcaggtatgcacgcgtacccgccgatgcggccagctacgggatgctacgacccctacgctgctggcacgcacacgtcgattccccacgggtggccgcgtcccgagaatcttgccaacatcgacgcctttcccacgccaccgtgctcgacacgcacggcgggtgctgcacaccctgccggccgcgcgtccaccccacgcacgccggccgcgccacggaacgctaaccgcggcggcggcacacgctggtggcggccagtcgcgtcgcggcagatcggtcggtcagagcgggagcgcagtagcgcactgcccctgcccctcctccccgtctcgtccttttccacccaccgctggccgcacggcaggcgcggcccgctccctcggccatcgccacccacgtaccccgcgcacgaaacggtgggggctccgttccgttccggcccggccccgccgcagccagccagcgggcgccgccctcggcccgacacctgcgccaacgccaggctgccagcccccatcttcggctcttcccccgcgcgcggccgtgccagactgccagccaacacgcgcgttgaaaggcccccggtgcggttcggccttgaccggcgccctacagcgacggccaggacgtgctgcgctgttgggttgggagcgccccgaccaatgacggggacgcccctgtaaagggtggcccagcccaggccaaagggctcgcgctgaggtgacgcgcgggccatttatatctgtggtgccggggcgcgtggtgtagagctagagcagccggctgcctgctgcggcgtcgcggacagcggaggcgggggcaggctcagagtgcacggcagcctcaggcaccggcgagcctccagccagcagctgctggccggccggggcagggaaggcgtcggaattaagagcagcggaagtggacatggctggagttccggaggcggacgaggcggcggagggcggcggaggaatacgctccgtgctgaccatgggatcgctggtctctccctccgggaacgaggtgcactttgcagagctcgatggcaagatcatcggcctctacttcgctgcgaactggtacccgaaatgcgaggccttcaccccggtgctggccgcggcgtaccagcagctcaaggcgcgcggcgccggcttcgaggtggtcctggtgtcgtgcgacgaggaccggccatcgttcgagaggttccaccgcaccatgccgtggccggccgtgccgttcggcgacctccagtgcaagaagcgcctcagcgggaggttccaggtcgagggcatccctcgcctggtggtgctcgccccggacggcgaggtcgtacacccggacgccgccgacctcgtgcaccgctacggcgagggggcgttcccgttctcggcggcgagagtggcggagctggaggcagacgaccagcgcaagtacgcgtcccagacgctggagaagctcttctcggtcgacgggatcaagaaagagttcgtgaccggtggcaacggacaggtcccgatctcgagcctggtggggaagacggtgggcctctacttctcggcgcaccagtgcgcgccgtgcatgaagttcacggcgaagctggcgggcatgtacagcagcctcaagggcaaggcggaggacttcgagatcgtgtacgtccccatggacaaggaggaggacggctacctgcgctcgtgcagcgacatgccgtggctggcgctcccctacgacggcgcgccgtcgcgggcgctggcgaggtacttcgacgtgcgagagatcccgacgctggtggtggtcgggcccgacggcaagacggtgacgcgggacggccggaacctggtgaacctctactttgacatggcgttcccgttcacggacgcgcagatcaggctgcggcaggaggcggaggacaaggcggccaagggcttcccgcagtcgctgcgccaccggggccaccgccacgagctcagcatcgtgtcggagaagtccgggggagggccctacatctgctgcgagtgcgaggagcaggggcttggctgggcgtaccagtgcatcgcctgcggctacgagatccacctcaggtgcggcggcagcgcaggaaccggctagcgaagcgacgggctatcaggatcacgggttatctataattaggctagctgtgtaccattggacaagatcttcgctttgttcccaacaaacgtcagcttgctcttgtcaagtctgatgctaaaataggtgagaaaagaaatgaccttcgttgcaaggtttaggtggttggctgagaacacaagaattgcagctgcagccttgcaggcgttgagcaaaccttgatgcaatgcccaatcaatctagttatgcacttctactgtggctttgagcaatcggctgacagtatgagctctccagactccagagtgaggtcctgcaatgtcccaagcccacgggttgaagggtctccagtttactctcgaacacatccagtttgttcggcagtcctgttaaagcgttagctgg

SEQ ID NO: 1568 - DNA, 2143 bp, Panicum virgatum
tcaaggcacctgctaaacggaaccatgagaaattttcgctctacaaacctacaaagttaagacctcattagactatccaaacagtctactttattaaaggtttcagcacagtggttaggggtcgtcttaacaattactccctccattctcaaatatttgaaactgatgtgagtctttaccaagaacactgatgtgagtctttaccaagaagctcaccccagtttcaacagaattgtgccacgcgcatatttgccaaatccacgcgtccaaactcatatttctttgcccaacaaaccaaaccaatcttgcttaatcagcgtgacacgtgttcacgctgggacctctctaaacttccaagtttcatgctgtattgtacgtcaaatcgaaccagaatatctgcaccaattgcaccgcgctttttgcttttaggactgtccagcagctcatcccgaattcctacactggactagaatcagaatcgcatcgtgcagattgcgtttacaatttttagactctagtagacgcgtcgtcatgtcgcccattattttctcgtagtcatcagacatggtcttgcatttcagtcattcttcatgtttaacttttcaatctacatgtctccatttttttctgttgcacacgcgcacatgaattgtatgatcacaacatcgaagatgtctttcttgacaggtgcactttgcagagctcgatggcaagatcatcggcctctacttcgctgcgaactggtacccgaaatgcgaggccttcaccccggtgctgaccgcggcgtaccagcagctcaaggcgcgcggcgccggcttcgaggtggtcctggtgtcgtgcgacgaggaccggccgtcgttcgagaggttccaccgcaccatgccgtggccggccgtgccgttcggcgacctccagtgcaagaagcgcctcagcgagaggttccaggtcgagggcatcccgcgcctggtggtgctcgccccggacggcgaggtcgtgcacccggacgccgccgacctcgtgcaccgctacggcgagacggcgttcccgttctcggcggcgagagtggcggagctggaggcagacgaccagcgcaagtacgcgtcccagacgctggagaagctcttctccatggacgggatcgggaaagagttcgtgaccggtcgcaacggacaggtcccgatctcgagcctggtggggaagacggtgggcctctacttctcggcgcaccagtgcgcgccgtgcatgaagttcacggagaagctggcggccatctacagcagcctcaagggcaaggcggaggacttcgagatcgtgtacgtccccatggacaaggaggaggacggctacctgcgctcgtgcggcgacatgccgtggctggcgctcccctacgacggcgcgccgtcgcgggcgctggcgaggtacttcgacgtgcgggagatcccgacgctggtggtgctcgggcccgacggcaagacggtgacgcgggacggccggaacctggtgaacctctacttcgacatggcgttcccgttcacggacgcgcagatcaggctgctgcaggaggcggaggacgaggcggccaagggcttcccgcagtcgctgcgccaccggggccaccgccacgagctctgcatcgtgtcggagaagtccgggggagggccctacatctgctgcgagtgcgaggagcaggggcttggctgggcgtaccagtgcatcgcctgcggctacgagatccacctcaggtgcggccgcgaccgcgatgaggagggcggcagcgcaggaaccggttagccacgagttaacaggatcacgagtatctatctaggctagctgtgtactattgcaaaagatcttcgttttgttcccaacaaacttcagccagcttgctcttgtcaagtctgatgctaaaatagatgagaaaagaaatgaccttcgttgcaaggtttttaggtggttggctgagtgctgaagaattgcagctgcagccttgcaggtgttgagcaaaccttgatgcaatacccaatctatctagtgatgcatttctactgtggctttcagcaatcagctgacagtatgagctctccatagtgagagagaggtcctgcaatgtcccgtaagcgcacgggctgaagggtttgctccg

SEQ ID NO: 1569 - DNA, 1401 bp, Saccharum officinarum
ccagatcccaatcgtgcgtgttgttccacacgtccactcctcagctccgacctccacgggcccacggggcccgcccgacgcccagcggctttgccccagtgcgctatggccttctcttcgtcgctggcgcccttcttcgcaccttctggaaccttcggagcccatcccgccaagaggctccgggccgatgcacccgggaggttcgtggcgtcctcctcgccccctcctgacgtcgtggtgacgcgggagcagggaaagaacgccaggctcatcgccgcactggaaaagcataatatacactctctggaacttcctcttattaagcatgttgaaggccctgatacagataggctttcagatgtcctacgtaatgacaagttcgactggattactataacctctcctgaggcagctgcagtgttccttcagggatggaaggctgctggaagtcctaaggtgcgagtagctgttgttggagcaggaactgcaagggtttttcatgaagtatcagaatctgatgatcaatctcttgaggttgcattttcaccttccaaagctttaggtaaagtcttggcttcagagcttccaaggagcaatgagaattcatgtaaagtattgtatcctgcatctgcaaaggctggccatgaaattcaggatgggctatcagaacggggatttgacgtgacacgactgaatacatatacaactgttcctgtagaagatgtggaaccactaacattaaatcttgctatatcagctccagttgttgcggtagcttctccttctgcactgagggcatggttaaatcttatttcaaaagttgataactggaacaactctgtggcttgcatcggtgagaccactgcatcagcggcgaagaaattgggcctgaagagcatatattatccaacaacccctggacttgaggggtgggttgaaagcattcttgaggcgctcagagtccacaggacatcaaaagaggccccaagatgttgaaaacgggcagcccattctaccggatggcggagcttcttcttgacgttggtatagccggctgtctgtatgtcgaagaattctttgcttctttgactgcaatcacacctgttgttgttccatcagtgaaaccgtatcgtcagctgatgtagatgaaactacttgtaatgtgaggtgttcagtgtagcattcaattagtgctgaatcgcggttccatgatgtggtgggacaccaagttttgttgacctgtacatgtatagtacagtaatttcttttgtcagaagaaaatcagataagcatgtgcatgcggaggaaaatcagtccgtactctgttgggaggtgttgtcaacgcatggcttttccggcccaagtcgtaattgtttcccaggccgaaaggcccatccctgt

SEQ ID NO: 1570 - DNA, 1030 bp, Sorghum bicolor
atatgaccacgtttcctcttcttcgttctctcctcccccagatcccaatcgtgcgtgttgttccactcctcagctccgacctccacgggcccacggggcccgacgcccagcggctttgccccagtgcgccatggccttctcttcgtcactggcgcccttcttcgcaccttctggaaccttcggagcccgtcccgaaaagaggctccgggccgatgcacccgggaggttcgtagcgtcctcctcgccccctcccgacgtcgtggtgacgcgggagcagggaaagaacgccaggctcatcgccgcgctggaaaagcataatatacactctctggaacttcctcttattaagcatgttgaaggccctgatacagagaggctttcagatgtcttgcgtaatgacaagttcgactggattactataacctctcctgaggcagctgcagtgttccttcagggatggaaagctgctggaagtcctaaggtgcgaatagctgttgttggagcaggaactgcaagggtttttcatgaagtatcagaatctgatgatcaatcttttgaggttgcattttcaccttccaaagctttaggtaaagtcttggcttcagagcttccaaggagcaatgagaattcatgtaaagtattgtatcctgcatctgcaaaggctggccatgaaattcaggatgggctatcagaacgaggatttgacgtgacacgactgaatacatatacaactgttcctgtagaagatgtggaaccactaacattaaatcttgctatatcagctccagttgttgcggtagcttctccttctgcactgagggcatggttaaatcttatttcaaaagttgatagctggaacaactccatcgcttgcatcggtgagaccactgcatcagcagccaagaaattgggcctgaagagcatatattacccaacaacccctggacttgaggggtgggttgacagcattcttgaggcgctcagagtccacaggacatcaaaagaggttctgctctttccctttcagtga

SEQ ID NO: 1571 - DNA, 1227 bp, Setaria italica
ctccagtctcctctccacccacgagctccatgcggccatggccttctcttcttcgctggcgttccccttcccttccccaccttctggccaagcccgacccgcaggaaggctccgagccggcgccaccggtaggttgctggggtgctcctcgccaccgcccgacgtcgtggtgacccgcgagcgggggaagaacgccaagctcatcgccgcgctggaaaagcacaatatacagtctctggaacttcctcttattaagcatgttgatggccctgatacatataggcttccagatgtcttacgtaacgacaagtttgactggattactataagctctcctgaggcagctgcagtgttccttcagggatggaaggcagctgcaagtcctaaggtgcgagtagcggttgttggagcaggaactgcaaaggtttttgatgaagtatcacagtctgatgatcaatctcttgaggttgcattttcaccttccaaagctatgggtaaagttttggcctcagagcttcccaggggcagtgagagtacatgtaaagtgttgtatcctgcatctgcaaaggctagccgtgaaattcaagatgggctatcagatcgaggatttcatgtgacaagactgaatacatatacaaccgtacctgttgaagatgtcgaaccactaactttaaagcttgctatttcagctccagttgttgcagtagcttctccttccgcattgaaggcttggttaaagctgatctcaaaagtcgataactggaataattccatcgcttgcattggtgagaccactggctctgcagcgaagaaattgggtctgaagagcatatattatccaacaacccctggacttgaagggtgggttgaaagcattcttgaagcgctcagagtccacaggcaattaaaagaggccccaaaatgttgaacacggacagccccttgtactggatgacgcatgacggagcttcttgacgttggtggccgcttgtagactcaggaattctttgcttctttggccttataacgcctgatgtacagcctattgttgtttcgtcagtgaaacttgatcatctgttgtgattaaactagctgtaaattgtgtgagctgtacagggtagcatgtgaacaagttctgaatcgcggttcagcgttgtggtgtggcgccaagttggactgtttctactaattttcataagaagatgagagaatccttgttacctgtac

SEQ ID NO: 1572 - DNA, 1871 bp, Sorghum bicolor
tgccagctccccctcccaatctccattctcctcatcacatatccgctcagtcccagctcactctgccgatgaaccttccagagagagtggctccacaaataagcctgtaccctgtagactgcaggcatacacaccagctcttagcctcttacatagtatataaaaaccgcgccacgcttgctgcagagagctcaaaaaccaacgctgctgccagggcttctaactgtttcttccttcttgtttgaagggaacagacgccgagatgtacctggtgaaggacattagcggcgccatcgggctgatggcggtggcgttggtgctcctgggcacctggccggttgtcctggcggtgctagagcggcggggccggctgccgcagcacacgttccttgacttctccgtcaccaacttcctggccgccgtgctcgtcgcgctcaccttcggccagatcggccccgacacgccggagacgcccaacttcctcacccagctcgctcaggttcagaacaactggccttcggtgttgttcgcgatggcgggcggcgtcaccctcagcctggggacacttgccacgcagtacggctgggcgttcgtcggcctttccgtcactgaagtcatggcctcaagcctcaaggtcgttatagggacgacgctcaactatttcctcgacggccggatcaacaaggcagagatcctcttccccggtgtcggctgcttcctgattgcggccatccttgggtcacttgtccacgcttccaatgccgccgacaaccaggaaaagctggcaaactccttggcgaagtacagcaaaaatacaaggaagaacactgcagacgatgaggatctcaccaaacacctccttaacaaagagataccaaaggatccagaagctgcaaagccggatgcagcagatcaggctactgaggccccggagaaagtagaggcaggaacggcagagttcctggttaacctggaggagaagagatcgattaaagtgctgggttcgcacacgctgctgggcctcgggatcgtggtgttcgcgggcgtcttctacgcgctgttcgcgccggcgctgaacctgtcgaccaacgaccagtggcacgcgctccccgccggcgtgccgcacctggtggtgtacacggcctacttctacttctccctcgcctgcctcgccgtcagcgcggcgctcaacgtgtggctcctgtaccggcccatcatggccggcgtgccggcgagctccaccgtgtccgcgtacctccgggacggcggcgagggcagggcgcccgcgatgctggcggggatggtgtgcgggctcgggaacgccttcacgttcatggcggggcaggcggccgggtacgccgccgccgactccgtgcaggcgctgccgctcgtcagcaccttctggggcgtcgtgctgttcggcgagtaccgccggtcgtcaagacgcacgtacacgctgctggccagcatgctgctcatgttcaccgtcgccatggtcctcctcatggcttcctccaaccacaggaagccgctctgactgacctccatcatcagcaggcgctcccatcgtccacatcatcagtgagctgggcacgtggatggatatgccgtagtatgcgacgaggagaatgtagatcggcagcatgggtcaggtggtggggcccactagctgaaacagagctcaactgctaacgtccacccattcttccaagaagtgtatgtactgtactctgctgctcaactgctacaggattagatctggtccctttctatcttcttttgtgtatcactgccacatactagactttgtttagttataattatctatccaatcatgaattaattagactcaaaagattcgtctcacaaat

SEQ ID NO: 1573 - DNA, 1889 bp, Setaria italica
gtgataccacaggtactagtagcctgcaggcgtagctcctacaaatagaggtaacggccacacgctgacagagcgctccagaaccaaagctccaaaggcttccaatcatttcttccttccggtttgtccctggtccctgttcgccagcacagacaacgccgagatgtacttggtgaaggacattagcggtgccatcggcctgatggcggtggcgctggtgctcctgggcacctggccggttgtcctggccgtgctggagcgccggggccggttgccgcagcacaccttcctggacttctccatcaccaacttcctcgccgctgtgctcatcgccctcaccttcggacagatcggccccgacacgccggagacgcccaacttcctcacccagctctctcagaataactggccttcagtcttgtttgcaatggcgggcggtgtcacgcttagcctcgggacattagcgacacagtatggctgggcgttcgtcgggctttcggtcaccgaggtcatggcatcaagcctcaaggttgtcatagggacaacgctcaactattttctcgacggccggattaacaaggcggaggtcctgttccccggtgtcgggtgctttctggttgcggccatccttgggtcacttgtccattcttccaatgccatcgacaaccaggagaagctggctaactccggagtagtcaattacagcaaaaacactaggaactctgcatacgaggatctggccgaacacctccttgagaaagagggacaaaaggatcttgaagaagcaaagctggatgcgccagaagcaaaactggagaaagtacaggccggaactgcagagttcctggttcatctggaggagaagaggtcaattaaagtgctgggctccaacacgctgctgggcctcggcatcgtcgtcttcgccggcgtcttctacgccctcttcacgccggcgttcaacatcgccaccaacgaccagtggcacgccctccccgccggcgtgccgcacctggtggtttacacggcctacttctacttctccctggcctgcttcgccgtcagcgtcggcctcaacgtgtggttactctaccaccccatggtcggcgtgccgaggtccaccgtggcggcgtacctccgcgacggcgagggcaggggcctcgcgctgctggcggggatggtgtgcgggctcgggaacgcgttcacgttcatggccgggcaggcggcggggtacgcggcggcggactccgtgcaggcgctgccgctggtcagcacgttctggggcgtggtgctgttcggtgagtaccggcggtcgtcgcggcggacgtacacgctgctggcgagcatgctgctcatgttcgccgtcgccatggtcgtgctcatggcctcctccaaccaccggaagccgctctgaccgctgcaaccggcccaatgacagtgattcagatgctctgttcaagctaagatggataaatcacaaatgctctgttctgaaagcaaacatgatcagggaactggggacggatgtgtgatgaggagaatggggattgggaccgagcctggtggtggggcccactttgtctggtcagttcaccaagcagagcagctgacgtggagctgaaatgctaggtccaccatcacgtaaatgaactatcatagttgctgattacattaggatcatctttgtttttctttttgccagatgtcttatcttagtgcggtctggtgctagggtaaaccatgtcggagggtaaggttatttccattgtgatattttttttaatgttttgtatgaactagaggtaacaaatattccaataactacgtacagcttatgttgtcttttgcaagtgttcctgattactggtatatgaatatatgattatttttag

SEQ ID NO: 1574 - DNA, 2976 bp, Sorghum bicolor
gagaaaaaagggcctatgtgaatattccgcgccgtcatcatcagacctccgttccatttccaaatgtgtgtgatccatggctagcctagctagccgtagtattttgccagcgagagagccttctgaattgaactgcggtgcggccatggccatcagatttggactgcctttctttctgcacgcactcccacaccacacactcgccaccactgtcttaaaaagcactagtcctacaaataagctgcactgtcctctgtcctgacgcccacgtaaacatatttaggcgtgcatccctttgcagtgtctgcttgcttgcttgcttcattggagagagaaagagagcgagggaaagaagaggactcgaggagagagcgagagacagacagacagacagagagatgggcgtggcgacggtgacagagctgaagcagagcatctccgggaagaggacattccggccgagcctcatcagccgccacgccaatgagtggcctccgaccgacgtctccagcgacctcaccgtcgaggtgggcacctccagcttcgcgctccacaagctgttcgcgcagttcccgctggtgtcccggagcggcaagatccggcggctcgtggcggaggccaaggacgcgaagctggcgcggctcagcctgcacggcaccccggggggcgcgccggcgttcgagctcgccgccaagttctgctacggcgtgcacgtggacgtgaccgtcgccaacgtcgccatgctgcgctgcgccgcgcactacctgcagatcaccgacgacttctccgacaagagcctggagctccgcgccgagtccttcctccgcgacgccgtgctccccagcatcgccagctccgtcgccgtgctccgcagctgcgaggcgctgctcccggccgccgaggacgtcggcctcgtgccccgcctcatcgccgccatcgccaccaacgtgtgcaaggagcagctcacctcggggctgtccaagctggaccagtgcgccgcgcagctgaagcccgccgcggcgttcgccgccgacctcgactcgccgggcccgggcgactggtggggcaagtccgtggccgcgctcggcctcgacttcttccagcggctgctctccgcggtgaaggccaaggggctcaagcaggagacggtgaccaggatcctcatcaactacgcgcagaactcgctgcacgggctcatggccagggacgtgcacagatgcggcgccgcggacgccgacgccgtcaagaagcagcgcgccgtcgtggaggccatcgtgggcctgctcccggcgcagtccaagaagagccccgtgcccatggccttcctctcgggcctcctcaagacggcgatggcggtgtccgcgtccagcatctgcagggccgacctggagaagcggatcggcatgcagctggaccaggccatcctcgaggacatcctcatcgccgccggcgcgggcgctggcgcggccacgccggccgggcacgggcagcagcacgcgctgtacgacacggacgtggtggcgcgcatcttctcggtgttcctcaacctcgacgacgaccacaacgaggaggacgccgccgcgttcgactacgacagcccgcggtcgcccaagcagagcctcctggtgaaggccgccaagctcctggacagctacctcgcggaggtggcgctcgactccaacatcctcccgtccaagttcatctccctcgccgagctgctccccgaccacgctcgcgtcgtcaccgacggcctctaccgcgccgtcgacatcttcctcaaggtgcacccgaacatcaaggaggcggagcggtaccggctgtgcaaggcgatcgactgccagcggctgacgccggacgcgtgcagccacgcggcgcagaacgagcggctcccggtgcagatggcggtgcaggtgctctacttcgagcagctgcggctgcggagcgcgatccaggccagcgggggcggcggcagcatgggcgggcacgacgcggcgctcttcttcgggtgcgccgcggccgccgccgcgtcgtcggtgtcggtgcagggcagcgtgaacatgcgctccggcagcggcgtgggcagcggcgcaatgtcgccgcgggacaactacgcgtcggtgcggcgggagaaccgggagctcaagctggaggtggcgcggatgcggatgcggctcacggacctggagaaggaccacgtgagcatgaagcgggagctggtgcgggtcggcccggccaaccgcctgctccggggcttcgctcgcagcctcagcaggctcttccgcatgcgacccgccgccgagccggggctgcagcagctcggcgccaaggccaccgccgacgccaaggtgctcttccagcgccgccgccgacactccatctcatgatcaacggagaggtggaggtgcccgggcccggacccagcggcgacgcgacgctgcccatcgagcttgctcgcgaggatgagtgggtggccaataagctcctgctcctgctgtacgtacagcaaagttcgcgtgtgcaactgtgcatagcatacaagaagagagattggtttgagtgagtgcagtgcagtgcagtgcagatttacttctttcccggatttcgtgcagccatcgcatggtcttctgctgatgaaagtcatggcgttcgacacagcatgcgatgcgatgcatgtatatggatggttggacggattatggaaaggtttcgactttcgagtggtgtatgtatcattgagtgtccagagtatctgagtatggagaaattgggttcagaggagacatggttattgttttctctgtagtttgggggccaaattctgttcagacgagcgatttcaatttcttctttcagcgaaattgggctttgtttagtttcacccaaatacccaaaatttttcaagattccccgtcacatcgaatctttagacacatgtatgaaatattaaatgtagacgaaaataaaaactaattgcac

SEQ ID NO: 1575 - DNA, 2890 bp, Panicum virgatum
gagagagagagagagggagggagaagggagaggagagagaaagagagatgggcgtggcgacggtgacagagctgaagcagagcatctccgggaagaggacgttccggccgagtctcatcagccgccacgccaatgagtggcctccgaccgacgtctccagcgacctcaccgttgaggtcggcacgtccagcttcgccctccacaagttcccgctggtctcccggagcggcaagatccggcggctcgtggcggaggccaaggacgccaagctggcgcggctcagcctgcacggcacgcccggcggcgcgccggcgttcgagctcgccgccaagttctgctacggcgtccacgtcgacgtcacggtcgccaacgtcgccatgctccgctgcgccgcgcactacctgcagatgaccgaggacttctccgacaagaacctcgaggcccgcgccgaggccttcctccgcgacgccgtgctccccagcatcgccagctccgtcgccgtgctccgcagctgcgaggcgctgctcccggccgccgaggacgtcaacctccccgcgcgcctcatcgccgccatcgccagcaacgtgtgcaaggagcagctcacctcgggcctgtccaagctggaccagtgcgcgcagctcaagccgcccgcggcgttcgtcgccgagctcgactcgccgggcgactggtggggcaagtcggtggccggcctcgggctcgacctgttccagcgcctgctctccgccgtgaaggccaaggggctcaagcaggagacggtgacgcggatcctcatcaactacgcgcagaactcgctgcacgggctcatggcgagggacgtgcacggcgccgccaagtgcggcggcggcgcggacgccgacgccgttaagaagcagcgcgccgtcgtcgagaccatcgtgagcctgctcccggcgcagtcgaagaggagccccgtgccgatggccttcctctcggggctcctcaagacggcgatggcggtgtccgcgtccagcatctgcagggccgacctcgagaagcggatcggcatgcagctggaccaggccatcctggaggacatactcatcgccgccggcgcgggcgcgggcgcgggcacgggcacgccggccgggcagcagcacgggctgtacgacacggacgtggtggcgcgcatcttctcggtgttcctcaacctcgacgacgacaacgaggaggacggcgggttcgactacgacagcccgcggtccccgaagcagagcctcctggtgaaggccgccaagctgctggacagctacctcgcggaggtggcgctcgactccaacatcctgccgtccaagttcatctccctcgccgagctgctccccgaccacgcccgcctcgtcaccgacggcctctaccgcgccgtcgacatcttcctcaaggtgcacccgaacatcaaggaggcggagcggtaccggctgtgcaaggcgattgactgccagcggctgacgccggacgcgtgcagccacgcggcgcagaacgagcggctgccggtgcagatggcggtgcaggtgctctacttcgagcagctgcggctgcggagcgcgatccaggccggcggcggcggcggcagcatgggcggcgggcacgatgcggcgctcttcttcgggtgcgcggcggcggcgcagggcggcgtgaacatgcggtccggcagcggcgtgggcagcggcgccatgtcgccgcgggacaactacgcgtcggtgcggcgcgagaatcgggagctgaagctggaggtggcgcgcatgcggatgcggctgacggacctggagaaggaccacgtgagcatgaagcgggagctggttcgcgtgggccctgccaaccgcctgctccggggcttcgcgcgcagcctcggcaggctcttccggatgcgcccggccgccgagcccggcctgcagcagctcggcgccaaggccaccgccgacgccaaggtgctcttccagcgccgccgccgccactccatctcgtgatcgagctcgctcgctcgcccgcgaatgatgagagcgatcaagctcctgtacttagttaaaagttcgcgtgtgcatagcatacaagaaagatgaatggttggagtgatgctttattggttcccgatttttgtgcgggaattgcatggtctttgatctgttggcgaaaaatcatggcgcacgacagcatgcgatgcagttcatgtatatggattatggagtggtttttgagtgttgtatcttgtatgtgtatgtatcaatcagcgggcaatgaaaataatagggaatcggccgtgccgagagcattggcgcttgggattgtatggttgcatttagtttgattttcaaattttaggaaagacacggttgggcaagcacagattgaatggttgcatttagtttgattttcaaattttatgaaagacacggttgggcaaaaagatagtgaaattatacaaaaagcacagtttggaaaaataatactaaaaacacgctgatagtgaaattatacaaaaagcacagtttttaaaaataatactaaaaacacgctagaggaagggcttgaaccttcgaccttgtggttaacagccacacgctctaaccaactgagctactccagctatgcgaggggctgacacaatgaaatttttaattctgtatacagagatctgtataggtcgggcctaggcccagaaggtcacattggcacagctcgaattctgatccagcccagcaaaccgtcaatccatcctttggttccaaattgtttcgttaccaaatttccccggtgggctgcacgtttgttttccggacatcactgtatatgttctctctcttccagaattctccagcctcgtacaagtccaatagtgaagagtagtctatgtgagaag

SEQ ID NO: 1576 - DNA, 2261 bp, Setaria italica
ccacgtaaacatatttaggcgtgcatccctttgcggtgcttgcttacttcattagagagagaaagagagagaagaggagaagagaggagagagagagatgggcgtggcgacggtgacagagctgaagcagagcatctccgggaagaggacgttccggccgagcctcatcagccgccacgccaatgagtggcctccgaccgacgtctccagcgacctcaccgtcgaggtcggcacgtccagcttcgccctccacaagttcccgctggtgtcccggagcggcaagatccggcggctcgtcgcggaggccaaggacgccaagctggcgcggctcagcctgcacggcacgcccggcggcgcgcaggcgttcgagctcgccgccaagttctgctacggcgtccacgtcgaggtcacggtcgccaacgtcgcgatgcttcgctgcgcagcgcactacctgcagatgaccgaggacttctccgacaagaacctggagctccgcgccgaggccttcctccgcgacgccgtgctccccagcatcgccagctccgtctccgtgctccgcagctgcgaggcgctgctcccggccgccgaggacgtcaacctcgtcgcgcgcctcatcgccgccatcgccagcaacgtgtgcaaggagcagctcacctcggggctctccaagctggaccagtgcgcgcagctcaggccggcggcggcgttcgtggagctcgactcgccgggcgactggtggggcaagtcggtggccggcctcgggctcgacttcttccagcggctgctctccgctgtgaaggccaaggggctcaagcaggagactgtgacgcggatcctcatcaactacgcgcagaactcgctgcacgggctcatggcaagggacgtgcacggcggcgccaagtgcggcggcggaggcgcggacgccgacgccgccaggaagcagcgcgccgtcgtggaggccatcgtgggcctgctcccggcgcagtcgaagaggagccccgtgccgatggccttcctgtcggggctcctcaagacggcgatgtcggtgtccgcgtccagcatctgcacggccgacctcgagaagcggatcggcatgcagctggaccaggccatcctggaggacatcctcatcgccgccggcgccggcgcgggtgcggccacggcgtgcgggcagctgcacggtctgtacgacacggacgtggtggcgcgcatcttctcggtgttcctgaacctggacgacgacagcgaggaggacggcgggttcgactacgacagcccgcggtccccgaagcagagcctcctggtgaaggccgccaagctgctcgacagctacctcgccgaggtggcgctcgactccaacatcctcccctccaagttcatctccctcgccgagctgctccccgaccacgcccgcctcgtcaccgacggcctctaccgcgccgtcgacatcttcctcaaggtgcacccgaacatcaaggaggcggagcggtaccggctgtgcaaggcgatcgactgccagcggctgacgccggacgcgtgcagccacgcggcgcagaacgagcggctgccggtgcagatggcggtgcaggtgctctacttcgagcagctgcggctgcggagcgcgatccaggccgggggcggtggcggcggcatgagcatgggcgggcacgacgcggcgctcttcttcgggtgcgcggctgcggcggcgtcggcgcagggctgcggcggcgtcacgaacatgcggtccggcagcggcgtggggagcggcgccatgtcgccgcgggacaactacgcgtcggtgcggcgcgagaaccgggagctgaagctggaggtggcgcggatgcggatgcggctcacggacctggagaaggaccacgtcagcatgaagcgggagctggtgcgcgtcggccccgcgaaccgcctgctccggggcttcgcgcgcagcctcagcaggctcaacgcgctcttccgcatgcgccccgccgccgagcccggcctgcagcagctcggcgccaaggccaccgccgacgccaaggtgctcttccagcgccgccgccgccactccatctcgtgatcacggactggcgcgccatgctgctgctgatcgagctcgagctcgcgagtgacgactgatgagagcgatcgagctcttgtctgtactgtacgtactaaagttcgcgtgtgcatagcatacaagaaagatggttggagtgttgctttacttgttcccgatttttgtgcggggattgcgaggtcttgat

SEQ ID NO: 1577 - DNA, 2286 bp, Panicum virgatum
gagaaagagagatgggcgtggcgacggtgacagagctgaagcagagcatctccgggaagaggacgttccggccgagtctcatcagccgccacgccaatgagtggcctccgaccgacgtctccagcgacctcaccgttgaggtcggcacgtccagcttcgccctccacaagttcccgctggtctcccggagcggcaagatccggcggctcgtggcggaggccaaggacgccaagctggcgcggctcagcctgcacggcacgcccggcggcgcgccggcgttcgagctcgccgccaagttctgctacggcgtccacgtcgacgtcacggtcgccaacgtcgccatgctccgctgcgccgcgcactacctgcagatgaccgaggacttctccgacaagaacctcgaggcccgcgccgaggccttcctccgcgacgccgtgctccccagcatcgccagctccgtcgccgtgctccgcagctgcgaggcgctgctcccggccgccgaggacgccaacctcgtgtcgcgcctcatcgccgccatcgccggcaacgtgtgcagggagcagctcgcctcgggcctgtccaagctggaccagtgcgcgcagctcgtcaagccgccggccgagctcgactcgccgggcgagtggtggggcaagtcggtggccggcctcgggctcgacctgttccagcgcctgctctccgcagtcaaggccaaggggctcaagcaggagacagtgacgcggatcctcatcaactacgcgcagaactcgctgcacgggctcatggcgagggacgtgcacggcgccgccaagtgccagctgcggagcggacgccgacgctatcaagaagcagcgcgccgtcgtcgagaccatcgtgagcctgctcccggcgcagtcgaagaggagccccgtgccgatggccttcctctcggggctcctcaaaacggcgatggcggtgtccgcgtccagcatctgcagggccgacctcgagaagcggatcggcatgcagctggaccaggccatcctggaggacatcctcatcgccgccggcgccggcgccggcgccggcgctggggctgccgcgccgggcggccagcagcagcacgggctgtacgacacggacgtggtggcgcgcatcttctcggtgttcctgaacctcgacgacgacgccgaggaggacggcggcgggttcgactacgacagcccgcggtccccgaagcagagcctcctggttaaggccgccaagctgctcgacagctacctcgccgaggtggcgctcgactccaatatcctgccgtccaagttcatctccctcgccgagctgcttcccgaccacgcccgcctcgtcaccgacggcctctaccgcgccgtcgacatcttcctcaaggtgcacccgaacatcaaggaggcggagcgctaccggctgtgcaaggcgatcgactgccagcggctgacgccggacgcgtgcagccacgcggcgcagaacgagcggctgccggtgcagatggcggtgcaggtgctctacttcgagcagctgcggctgcggagcgcgatccaggccgccggcggcggcggcagcatgggcggcgggcacgacgcggcgctcttcttcgggtgcgcggcggcggcgcagggcggcgtgaacatgcggtccggcagcggcgtgggcagcggcgccatgtcgccgcgggacaactacgcgtcggtgcggcgcgagaaccgggagctgaagctggaggtggcgcgcatgcggatgcggctgacggacctggagaaggaccacgtgagcatgaagcgggagctggttcgcgtgggccccgccaaccgcctgctccggggcttcgcgcgcagcctcggcaggctcttccggatgcgcccggccgccgagcccggcctgcagcagctcggcgccaaggccaccgccgacgccaaggtgctcttccagcgccgccgccgccactccatctcgtgatcgagctcgctcgctcgcccgcgaatgatgagagcgatcaagctcctgtacttagttaaaagttcgcgtgtgcatagcatacaagaaagatgaatggttggagtgatgctttactggttcccgatttttgtgcgggaattgcatggtctttgatctgttggggaaaaatcatggcgcacgacagcatgcgatgcagttcatgtatatggattatggaatggtttttgagtgttgtatcttgtatgtgtatgtatcaatcagcgggcaatgcaaataatagggaatcggccgtgcagagagcattggcgcttgggattg

SEQ ID NO: 1578 - DNA, 2105 bp, Panicum virgatum
agatgggcgtggcgacggtgacagagctgaagcagagcatctccgggaagaggacgttccggccgagcctcatcagccgccacgccaatgagtggccgccgaccgacgtctccagcgacctcaccgtcgaggtcggcacgtccagcttcgccctccacaagctgttcgcgcagttcccgctggtctcccggagcggcaagatccggcggctcgtggcggaggccaaggacgccaagctggcgcggctgagcctgcacggcacgcccggcggcgcgcaggcgttcgagctcgccgccaagttctgctacggcgtccccgtcgacgtcacggtcgccaacgtcgccgcgctccgctgcgccgcgcactacctgcagatgaccgaggacttctccgacaagaacctcgaggcccgcgctgaggccttcctccgcgacgccgtgctccccagcatcgccagctccgtcgccgtgctccgcagctgcgaggcgctgctcccggccgccgaggacgccaacctcgtgtcgcgcctcatcgccgccatcgccggcaacgtgtgcagggagcagctcgcctcgggcctgtccaagctggaccagtgcgcgcagctcgtcaagccgccggccgagctcgactcgccgggcgagtggtggggcaagtcggtggccggcctcgggctcgacctgttccagcgcctgctctccgcagtcaaggccaaggggctcaagcaggagacagtgacgcggatcctcatcaactacgcgcacaactcgctgcacgggctcatggcgagggacgagcacggcggcgccggcgccaggtgcggagcggacgctgacgctatcaggaagcagcgcgccgtcgtggaggccatcgtgagcctgctcccggcgcagtcgaggaggagccccgtgccgatggccttcctctcggggctcctcaaaacggcgatggcggggtccgcgtccagcatctgcagggccgacctcgagaagcggatcggcatgcagctggaccaggccattctggaggacatcctcatcgccgccggcgccggcgctggggccgccgcgccgggcggccagcagcagcacgggctgtacgacacggacgtggtggcgcgcatcttctcggtgttcctgaacctcgacgacgacgccgaggaggacggcggcgggttcgactacgacagcccgcggtccccgaagcagagcctcctggtgaaggccgccaagctgctcgacagctacctcgcggaggtggcgctcgactccaacatcctgccggccaagttcatctccctcgccgagctgcttcccgaccacgcccgcctcgtcaccgacggcctctaccgcgccgtcgacatcttcctcaaggtgcacccgaacatcaaggaggcggagcgctaccggctgtgcaaggcgatcgactgccagcggctgacgccggacgcgtgcagccacgcggcgcagaacgagcggctgccggtgcagatggccgtgcaggtgctctacttcgagcagctccggctgcggagcgcgatccaggccggcggcggcggcagcatgggcggcgggcccgacgcagcgctcttcttcgggtgcgcggcagcggcgtcgcagggcggcggcgtgacgaacatgcggtccggcagcggcgtgggcagcggcgccatgtcgccgcgcgacaactacgcgtcggtgcggcgcgagaaccgggagctgaagctggaggtggtgcgcatgcggatgcggctgacggacctggagaaggaccacgtgagcatgaagcgggagctggtgcgcgtcggccccgccaaccgcctgctccggggcttcgcgcgcagcctcaccaggttcttccggatgcgccccgccgccgagcccggcctgcaccagctcggcgccaaggccaccgccgacgccaaggtgctcttccagcgccgccgccgccactccatctcgtgatcccggacaggaagggtgacactaccagattcactggctttgccgagtgccggttacactcggcaaagaccagtttgcactcgacaaattttttgtcgagacggcaaagcctcccacggcaaagggatctttgccgagagc

SEQ ID NO: 1579 - DNA, 2622 bp, Hordeum vulgare
tctgtttctctctttctccccctacaagacagagagggcactgaagactgaaccagaagtgttggacacaaagacgtagctgagtcctagagagaagcatatatagcacagcgcatccattttgcagcaccttcgctggttgtttgtttgtgagttccgcgcgtgtgtgcgagaaagataataagatgggtgtggcgacggtgacggagacgaagcagagcgtgagcgtctccgggaagaagatgttccgggcgagcctcaacaatcggcacgccaacgaatggcctcccaccgacgtctccagcgacctcaccgtggaggtcggcacgtccagctttgcgctccacaagttcccgctggtctccaggagcggcaagatccggcggctggtggcggaggccaaggacgccaagctcgcgcgcctcaccctccacgccacgcccgggggcgccccggcgttcgagctcgcagccaagttctgctacggcgttcacgtcgacatcacggttgccaacgtcgccatgctccgctgcgccgcgcgctacctgcagatgaccgacgacttctccgacaagaacctcgagctccgcaccgaggcgttcctccgcgatgccgtcctccccagcatcgccagctccgtcgccgtgctccgcacctgcgaggcgctgctcccggccgccgaggacgtcaacctcgtcgcccgcctcatcgccgccatcgccaacaacgtgtgcaaggagcagctcgcgtccgggctgctctccaggttggagcagagcgcgcagctcaaaccggcggccgggatcgtcgagcttgactcgccgggggattggtggggcaagtcggtcgccggcctcgggctggacttgttccagcgactgctctccgccgtcaagtccaaaggcctcaggcaggagacggtcacccggatccttatcaactatgcccagaactccctgtacgggctcatggccgccgagaaatgcgacggcgtcatggatacggacgccgtcaagaaacagcgcgccgtcgtcgagaccatcgtcggcttgctaccggcgcagtcgaagaagagccccgtgccaatggccttcctctcggggctcctcaagacggcgatggcgctgtccgcttccagcatatgcaagaccgacctcgagaagcggatgggcatgcagcttgaccaggccatcctggaggacatcctgatcgccacaaggtccggcgaggcgtcgacggcggggacggggacggttgctgccgtgcagcaccacactctgtacgacacggacgtggtggcgaggatcttctcggtgttcctcaaccttgacgaggacaacgaggaggaggacggcgggtgcggcggcttcgactacgacagcccgcggtccccgaagcagagttccatagtcaaggcttccaagctgctggacagctacctagccgagatcgcactcgattcgaacctcgtcccacccaagttcatctccctcgccgagatcctccctgaccacgcccgcctcgtcaccgacggcatctaccgcgccgtcgacatcttcctcaaggtgcacccgaacatcaaggaagcggaaaggtaccggatgtgcaaggcgattgactgccaacggcttacgccggacgcgtgcagccacgcggcccagaacgagcggctcccggtgcagatggcggtgcaggtgctctacttcgagcagatccgcctgcggagcgcgatccagtccggtggaggcggcggcggcggtgtcttcggccatgacggggccatcttcttcggcggcacggtgtccgcggcgacggctcaaggcagctgcagcaacatgcggtccgggagcggggtggggagcggcgccatgtcgccgcgggacaactacgcatcggtgcggcgggagaaccgggagctgaagctggaggtctcgcggatgcggatgcggttgacggacctggagaaggaccacgtgagcatgaagcgggagctggtgcgcgtcaacccggcgaaccgcctgctgcggagcttcgctcgcagcttcggcagactcaacacgctcttccggatgcgcccggctgccgaacccgggttgcagcagctcggcgccaaggccaccgccgacgccaaggtgctcttccagcgccgccgccgccactccatctcttaaataggccaccacctgcgtggggatctcgtacgtacgtgtgtgtgcataggaggtgataaaacgttgcattgacccagcatatctggtatatcagtgtttcagcacttgtacccggcttcttttgtgcggattgcatgatgttctgttgataaaattcactagtgtcaaaaaaagtatgggacggaggaagtacaaatgtgacgtgtagtttttttttatgtcgagggctaatgtgacgcaatgtggcgtgcagttcacgtattgattagggatgatcaatgtgcgtgatggcgaggcgaactccggatttttcatcctctacgcgaccaagcgcgcaagctcaactttaaggacgcattcggattcactccgactccacgactccgtgctggagcggagtgacatctaataataaatcttgaagttgataaaaggtcgctctcggcgctcc

SEQ ID NO: 1580 - DNA, 2623 bp, Oryza sativa
ttcagatactcactcatgcagagtcacagcttgtatagttgtaatgcatgcatgtagctctagctttacgcacgcactcccacaccgcacactcgccagttagcccttaaatcctaattataagatttaagacctttctcttcacttcacctctctctctctctctctctctctctctctctctctctctactctctccctacaagtttcttgacacccaactgcaagtctgcaaagcacagaagaagcttagcacacgcttgcagctgaactaggagacaaccaaacaagccatccttttgcactgatcacacttactgttagtactccattgtgatttgtggagagagagagggagagagagagagagagagagagagagagagatgggcgtggcgacggtgacagagctgaggcagagcttctccgggaagagggcattaagaccaaccctcaccagccgccatgccaatgaatggcctccgaccgacgtctccagcgacctcaccgtcgaggtcggcacgtccagcttcgccctgcacaagctgctcgcgcagttcccgctggtgtcccggagcggcaagatccggcgggcggtggccgaggccaaggacggcaagctggcgcgcctcgggctccacggcacgccgggcggcgcggcggcgttcgagctcgccgccaagttctgctacggcgtgggcgtggacgtcacggtgggcaacgtcgccacgctccggtgcgccgcgcactacctgcagatgacggaggacttctccgacaagaacctggagctccgcgccgaggcgttcctccgcgacgccgtgctccccagcatcgccggctccgtcgccgtgctccgcagctgcgaggcgctgctcccggccgccgaggacgtcaacctcgtcccgcgcctcatcgccgccatcgccaacaacgtctgcaaggagcagctcacctccgggctgtccaagctggaccagctcaagccgccgccgccgccgcaggcggtggtggtggccgccgccgccgccggcgacctcgactcgccgggggactggtggggcaagtcagtcgccggcctcgggctcgacttcttccagcggctgctctccgccgtcaagtccaaggggctcaagcaggagacggtcacccgcatcctcataaactacgcccagaactcgctccacgggctcatggcgagggacatcgcggccgccgccaaatgcggcggcggcggcggcgacaccgacgccgtcaagaagcagcgcgccgtggtggagaccatcgtggggttgctcccggcgcagtcgaagaagagccccgtgccgatggccttcctgtcggggctcctcaagacggcgatggcggcgtcggcgtcgagcatctgcagggccgacctggagaagcggatcgggatgcagctcgaccaggccatcctggaggacatcctcgtcgccgccgggcccgtctccgccgcggcggcggcggcggcggtggagcacacgctgtacgacacggacgtggtggcgaggatcttcgcggtgttcctcaacctcgacgacgacagcaacgacgaggacgccgtcgtcgtcggcggcgggtgcggcgcgttcgactacgacagcccgaggtcccccaagcagagcctcctcgtgaaggcgtcgaagctgctcgacagctacctcgccgagatcgccctcgactccaacctcctcccctccaagttcatctccctcgccgagctcctccccgaccacgcccgcctcgtcaccgacggcctctaccgcgccgtcgacatcttcctcaaggtgcacccgaacatcaaggaagcggagaggtacaggatgtgcaaggcgatcgactgccagcgcctgaccccggacgcgtgcagccacgcggcgcagaacgagcgcctccccgtgcagatggccgtgcaggtgctctacttcgagcagctccgcctccgcagcgcgatccaggccaccggcaccaccaccacaaccactaacaccagcatcggcggcgcgcacgacgcggcgctcttcttcgggtgcgccgccgccgccgcggcgccgcggtcggggagcggggtgggtagcggggcgatgtcgccgcgggacagctacgcgtcggtgcggcgggagaaccgggagctgaagctggaggtggcgcggatgcggatgcggctgacggacctggagaaggaccaggtgagcatgcggcgggagctggtgcgcgtcggcccggcgaaccgcctcctccgcggcctcgcgcggcgactcggctcgctcttccacttccggggcgccgccgccgagccgggcctccagcagctcggcgccaaggccaccgccgacgccaaggtcctcttccagcgccgccgccgccactccatctcctgatcatggtgacgacgatggtgatggtgcaattaatgaatttttggatgttgttgttgttgtgaatttttgtgggatttggatgcgaatttgcagttgttgtaatatggggattgttattgatggatggatggatgatttcgatgtaggtgtacaaattaatgtgcagattatggatcatatgctaagtttctgtgatgtataagatggctgattgttcttcc

SEQ ID NO: 1581 - DNA, 683 bp, Zea mays
ggccgggaggcaaagccaagctcagccagagccgatcatcacatgacgatggagccggccgccgatggcaacgacgtgcacgggaagagacgggacggagggcagcatgcgccggtggtgtcgctccgggcgttgggcctggcggacgcggacgccttcatggcgtgggcgtcggaccgcgaaatgcggcacctgaagcagccgctctgcgccacccgagagcaggccatggcacatattagggacaccgtgctgggccacccatggttccgcgccgtctgcgtcagtgactcgcccgtggggcaggtgtccgtgtggccgtacgccgacgagggcggtcgcagggccaacctcggctacgccctcgcgcacgaccagtggggctggggcatcgccgtcgccgccgtcaggatggtggtgggcagggtgttcgacgacctgccggggctggaacggctggaggcggtgacggacgtggtgaacgtgcggtcgcagagagtactggagaaggtcggcttccacagggaggggtgctgcgccggtacatcgccggacgccgcggcagcggggccagagatgcggtgatctataacttcttgtcgtctgatgatcatgtgtgacctggtgaccggtgtcgctatgctaccagcatatgatttgtgtgtgcgttccagaaattgtgc

SEQ ID NO: 1582 - DNA, 2449 bp, Sorghum bicolor
cagaaaccatgctgacgtgtaccgtaccgcagccccaagaaacaatcgtttataggcggcggcgcgtggtctctgaatgctcaagtcaacaccatggaccactagtactactgtactacacctccgtcgtttctggtcaagcttggctgctcaatcaagagaccaagaccggctacatgcatgccttgcctacatatacacaagcacaatcgagcagacacgccggagagtttacgttaagtgacagccggcgagctcgagctcgaggcgttgaggtgacgatcgaagaggaagagagcatggaggtccagcaccagcaccagcagcagcagggagagggaggagcccctgccccagcggcggagctcgaagtctccctccgcgagttcacgctgtccgacgcggacgcggaggcgttcatgtcgtgggcgtcggaccctcgcgtggtcctcttccagcgccgcgacgcctacgaccacatcgaccaggcccgccgctacatcgccgaccacgtcctgccgcacccgtggtaccgcgccatctgcgccggtaccagcgccggcgccggcgcgcccctccccgtggtcgggtccatctccgtgaagcctgctgcccccgccgaagccgacgacgacgggcggctgttcagggcgtccgtggggtaccgcgtggcgcacgcgcactggggccgcggcgtcgccacgcgcgcggtgcgggcggcggccgcggccgtgttcgcggcgtggccgtggctgctgcgcctggaggccgtggccgacgtggacaacccggcgtcgcagcgcgtgctggagaaggccgggttcgtcagggagggcgtgctgcgcaagtacatcctgctcaaaggccggcccagggacatggtcatcttcagcatcgtcgtcgatacggatacggatacggaccgtcgccagcagcagcagcagagtgacaacaagcccgatgggccgtagatgatgggccgcgatgctatgctcttcctggccttttgctgtcgcgtatcatgtgtgtgagtgatacataatttgggaaaaaaaaaaatatgaacagacgtaccaccgtactatatgaattggaaagtcaaaagaagagcaaaataagatgattcggtagtgcgtgcagtgcaacgttgttaattactcgaacaatcatgttcttatccaaatgacgattgacgaccgaccgattgaccgcgacacgtacgtttgacgcgaatcgcaacacatcaaagtcgcacctacggttgcagcgatcgatcgatgcgcacacgcctgcctgggcctggggctgggactgggaggccaaattgagcaaagctccgtcctccgtcggagccgagcaacgacgatggacgagccagccggcgacggcggcgtgcacgggcagcgacgggacggagggcggcagcacgcgccggcggtggtgtcgctgcgggagctgagcctggcggacgcggacgtggacgccttcatgtcgtgggcgtcggacgaccgcgtgatgcggtacctggtgaagcggccgcggtgcgacactcgagagcaggccgtggcgcagatccgggacaccgtgctgggccacccgtggttccgcgccgtctgcgtcggcggcggcgacggccgccccgtgcccgtggggcaggtgtccgtgtggccgtacgccgacgagggaggacgcagggccaacatcggctacgccctcgcgcacgaccagtggggccggggcatcgccgtcgccgccatcaggatggtggtgggcagggtgttcgacgacctgccggggctggagcggctggaggcggtgacggacgtggagaacgtgcggtcgcagagggtgctggagaaggccggcttccacagggagggggtgctgcgccgctacatcgccggacgcggcggcgaggccagagacgcggtgatgtatagcttcttgtcgtccgaccgtgcgtgatcgactcggtgtcgtaccgggcgctgatagctatgccacctgaacatggttgtctgttcggtgatgtgcgttccagaatttgtgtattgcaacttggtagtgacggttttattacactacaaagaaacaatcaatttcctcgggtggaatgactaggcatggtgttcaagcttaattgtactattgtgtagtactacagtccattactccattgtccccgtcagcttacatctttgagtgcaagtggtcaccacatgcagttcgatgacttttgggtgcaaccgtgcaactcatcaggagttcaggacatacaacttaatttaatttaacatcaatcaaggttataaaaatccctgacttcgaattctagccaacaccacttcattatgtctatacggagttctgcgtgaagctaatacacggtattggacggaccagatggctttgtccatgtttctgcaatatttttgtgagaacatagcat

SEQ ID NO: 1583 - DNA, 1900 bp, Panicum virgatum
aagtcaacaccatggacaactcctcgagtctctggtcaagcccgccggctcgtccaggtccggctacatatacctgccggtagagtggcgtcctgctcgagatcgaggtgttgagggccggcatggagctcgagcagggaggatccccggcggcggagcctggtgaggaggaggtcaccctccgcgagttcacgctgtcggacgcggacgccgaggcgttcatgtcgtgggcatcagatccacgcgtggcccgcttctagcgccgcgacgcctacgagcacgtggaccaggcccgccgctacatcgccgcccacgtcctgccgcacccgtggtaccgcgccatctgcgccggcggcgtggtggtggggtccatctccgtgaagccggcggcggcggcggctgcggccggggaggacgggcgcgcgctcagggcgtccgtgggccgggtaccgcgtggcgcgcgcattggggcgggcggcggcggaggccgtgttcgcggcgtggccgtggctgctgcgcctggaggccgtggccgacgtggagaacccggcgtcgcagcgcgtgctggagaaggccggcttcgtcagggaggggacgctgcggaagtacatcgtgctcaagggcaggcccaggacatggtcatgttcagcctcctcgatacggaccgtcgccatcagatgaagcccgtcgagcccagtgggccgtaaatgggctgcggtgctctctcactgggctttcctcagcaacgcacagtcgtagcgcattctgattctgtaacgttgtattgagagtactcttgtatgtatgccatgccacgtatgatctgtgagtgcatataaaaaataagaaattttgaaggtaggatggagagaagataagatcacctgtagtgcgtgcaacattgttaattagccgtagcatcatgttcttatccatacgaccgatcgaccgcgacgacacgcttgatgcaaaccgtggtacatccaagccgtgcggttgcaccgatgcgcacgcctccaaggcaaagctagctcatcagggcagcaatggaaccgccggccggcgacggcgacggcgacgcgcaggaccggcagcgacgggacgacggagacgcccccgcggccgcggcgccggtcgtgtcgctgcggccgctgggcctggcggacgcggacgccttcatggcgtgggcgtcggacgaccgcgtgatgcggttcctgaagcggccgctctgcgccacccgggagcaggcggtggcgcagatccgggacaccgtgctgggccacccgtggttccgcgtcgtctgcgtcggcggccgccccgtggggcaggtctccgtgtggccgtacgccgacgagggcggccgcagggccaacatcggctacgccctggcgcgggaccactggggccggggcatcgccgccgccgccatcaggatggtggtggggagggtgttcgacgacctgccggggctggagcggctggaggcggtgacggacgtggagaacgtgcggtcgcagcgggtgctggagaaggccggcttccagagggagggggtgctccgcaggtacatcgccggacgcggcggcggccaggccagggacgccgtgatctacagcttcctgtcgtccgaccgaccgcctgtgaggccgtgactcgcaatggtcgcagtggctcgagttcagaagaattccctgttacaagagagccagaatggtagtgtactgatgttgtgacttgtgaaaaaggagggaaacagtgcacgcatcttgaatccaacattgtaacgcaattagaaatatctgttttcttccatcaagtcccaatttgcattttctaaattaaaaaagagcactgtacacgcagtctcaacagaaaagggaaaagaagtcaagtcgctccg

SEQ ID NO: 1584 - DNA, 351 bp, Sorghum bicolor
caagaagaagggtacgtgatggcggagagggtgtctagactgtcgacggagaaggcggtggtgatcttcacgacgagccagtgcccgatgtgccacacggtgacgagcctcttaatctccgagctcggcgtgtgcgcggcggtgcacgagctcgacaaggacccgcgcggccgcgacatggagcgggagctcgcccgctgcctcggccgcgcgccgcccgtccccgccgtcttcatcggcggcaggctcgtcggctccaccgacaagatcatgtcgctgcacctcgccggcaagctcgtgcccatgctcaaggctgccggcgccatatggctctgaatccatccatccatc

SEQ ID NO: 1585 - DNA, 382 bp, Sorghum bicolor
agctagctcagtgttcgcaaggcagctaaaccaagaagaagggtacgtgatggcggagagggtgtctagactgtcgacggagaaggcggtggtgatcttcacgacgagccagtgcccgatgtgccacacggtgacgagcctcttaatctccgagctcggcgtgtgcgcggcggtgcacgagctcgacaaggacccgcgcggccgcgacatggagcgggagctcgcccgctgcctcggccgcgcgccgcccgtccccgccgtcttcatcggcggcaggctcgtcggctccaccgacaagatcatgtcgctgcacctcgccggcaagctcgtgcccatgctcaaggctgccggcgccatatggctctgaatccatccatccatc

SEQ ID NO: 1586 - DNA, 706 bp, Setaria italica
agagacacttcagcgcatagccaaacacttcacacgctagcaagctaagcatcctcctagctcattctcactccgttccaagctcgatctagaagtacagaagagcggcgatggcggagagggtgtcgaggctgtcaacggagaaggcggtggtgatcttcacgacgagccagtgcccgatgtgccacacggtgtcgagcctcttctccgagctcggcgtgtgcgcggcggtgcacgagctcgacaaggacccccgcggccgcgagatggagcgggagctagcacgccgccttggtcgtgtgccgcctgtccccgccgtcttcatcggcggcaagctcgtcggctccactgacagggttatgtctcttcacctcgccggcaatcttgtgcccatgctcaaaggcgccggcgccatatggctctgaatccatccacccatcggcgcagcgactatatatttaatcactcacaaccctgattttgctgggtttatatataaatttgcaccttttgcacggatgcaaattaatcaaactgaagggtgcatccaacaagaatattcgaaaagttttgttttgcggctagagtaacctcgcagatgaaaagagtgagcgaggaatgtgtagcgcttgtcattgaatgtaaatggacatgtaatcctgtcttttccagtatttcaatgggatatgaattttgatattttatt

SEQ ID NO: 1587 - DNA, 824 bp, Setaria italica
cacaaattaacatcaacattgtttgctagcaagttcgagttagcttagagaaatcaagaaagacggcggcggcaatggcggagagggtgtcgaggctgtcgacggagaaggcggtggtgatcttcacgcgaagccagtgcccgatgtgccacacggtgttgagcctcttctccgagctcggcgtgtgcgcggcggtgcacgagctggacaaggacccccgcggccgcgacatggagcgggagctcgcccgccgcctcggccgtgcgccgcccgtccccgccgtcttcgtcggcggcaagctcgtcggctccaccgacacgatcatgtcgctgcacctcgccggcaagctcgtgcccatgctcaaggccgccggcgccatatggctctgaatccctgcatccaccggcgacagcaactataatcactcacaagtcacacccctaaattttgtaccttgcgtgcatgcacctgaccaattgcaggcacgtaaattaagagctatgtatacacatgcacatatttgcatgggtataagtatacacgattatagagtgtgttcactagtcaaggataagaataagatgcacacctgtcaggaccgtccgatcgtaatggatggctaggatataagccagtgatagggcaagttctaacgtgaaggtaacagagtcaaatgaacatgtgagaggttttgtttagctgctaatgtgtaacctagcagtgctgaaaagggtgtaagggacttgtttgtaacctccccctttgaagtttctccaatgagatacgaattttggactagcgctcttcctgttcttggattgttt

SEQ ID NO: 1588 - DNA, 733 bp, Panicum virgatum
cagccacaaacactcacatacttgaggactatactagctggcacatccaagtttagcttatctacttttcaccttcaagctcgatccagagaaaccaagaatggcggagagggtgtcgaggctgtcgacggagaaggcggtggtgatcttcacgaggagccagtgcccgatgtgccacacggtgtcgagcctcttcgccgagctcggcgtgtgcgcggcggtgcacgagctggacaaggactcgcgcggccgcgacatggagcgggagctcgcccgccgcctcggccgcgcgccgccggttcctgctgtcttcgtcggcggcaacctcgtcggttccaccgacaaggtcatgtcgctgcacctcgccggcaagctcgtgcccatgctgaaggccgccggcgccatatggctctgaagtctgaatcctacatccatcggcgacagcaactatatatataaatctctcgctccgatccagtattgttcagttctccaatatagttcccaaatcccaacaagaatatatgataagttttgttcagcggctagtgtaaccacttgcagggctgataagggtctggaatgaccagtccgtgtctttgaatgtacatggacatatgtaaacctgacctttccaggattttcagagtgagatatgatgtggactttgagttaattgtctctccttgctagtcttttggtttttggattgtgccatactgagcaggggccg

SEQ ID NO: 1589 - DNA, 1332 bp, Sorghum bicolor
cctcccctatcgatacatatctcatacaagcacccactgttctcctcatcctctgttggatgaacactataaaagggcatcgatcccaccctgcactgcactcgcaacaacaaagagcacgcaggtatagctagctagcccacaaacacttcagctacacataatacctagctagagatatatatatatatatatatatatagccagctcgatcgatcgactgaccggcggcaaattaaaccaagaagaagggtacgtgatggcggagagggtgtcgagactgtcgacggagaaggcggtggtgatcttcacgacgagccagtgcccgatgtgccacacggtgacgagcctcttaatctccgagctcggcgtgtgcgcggcggtgcacgagctcgacaaggacccgcgcggccgcgagatggagcgggagctcgcccgccgcctcggccgcgcgccgcccgtcgtccccgtcgtcttcatcggcggcaggctcgtcggctccaccgacatgatcatgtcgctgcacctcgcaaacaagctcgtgcccatgctcaaggctgccggcgccatatggctctgagaattttgctagctactagcagctggaccgtaacgtaaccccccgaattttgcaccttaattaattatatatttcgattccatgcatgcaactaactaaatactccgatcctacggaggggtcttaaattaatataagagctaattaagtacgtattctccgcgtgcatatgtttgctgggtgcactgagaatctgcctggcccaggcgttggattttggtggcctgaggttcagatccttgttgcctggctgtaaactttgcctcgcaggcatgcagcaagcaaacaaacaggcctatatatatgcatgggtataggctatagagtgtgttcacaaatcgtaagatatatatgaggaacctatttggaccgtccggtcacaatgggttggttaggttgagagaaaaaaaaatttaatgcatgagatgctgtgaggttttgttttgccgctagctagcagggctgaaaagggtgtgaataaaggaacttgtaacctcccatttccagtttttcaatgagatatatatgaattttgaagtacctctatatcttgctattcttggactgttcttgcatcttattatatataatcatgggtgaacatgcatggcacagatgttttgggtgtcagtgtgtgtttgtttattatatgcgaggattcaaatagtccgtacttgtaaagatgaaaggcaaagtgtgtatgttcctttgtttgacagccaaccgaactacttacgtggaatcgaattaag

SEQ ID NO: 1590 - DNA, 999 bp, Panicum virgatum
cttatccctctccgagtctccaacaagcacccaccattctccccttcctctagcggatgaacactataaaagggcatcacgccctgcattgcaaagcacacagccctagagaaatcaagaagagacgacggcgatggcggagagggtgtcgaggctgtcgacggagaaggctgtggtgatcttcacgcggagccagtgcccgatgtgccacgcgatgttgagcctcttctccgagctcgacgtgtgcgcggcggtgcacgagctcgacaaggacccgcgcggccgcgacatggaacgggagctcgcccgccgcctcggccgcgcgccgccggtccctgctgtcttcgtcggcggcaacctcgtcggctccaccgacaaggtcatgtcgctccacctcgccggcaagctcgtgcccatgctcaaggccgccggcgccatatggctctgaatccctccatccatcggcgacagcaactatatatataaatccctcgctccgatccaatatagttcccaaatcccaccaagaattttgagaagttttgttcagcgcggctagtagtgtaaccacttgcagggctgaaaagggtttggaatgaccagtccatgtctttgaatgtacatggacatatgtaaccctaacctttccaggattttcagagtgagatgtggactttgatgagttaattgtctctcctagtcttttggtttttggattgtgccctgatactaattaagcagggcccgggccgggttgatagactcgatataactttttttttctaaaaaatgaactatagaactacaagcttaaatgaagaatatgcttgtaaaggtgttaaaaaagatatcctttaaatttggttattaccatggaaactaggtgtatagcccgcgcatttgtgcgactagtattgaaaattcaaaaatttgcatgacgttgtatccttacttaaatgttatactattttttttaccatacatcagcttgttcattat

SEQ ID NO: 1591 - DNA, 1354 bp, Panicum virgatum
accttgcgaatctttgccctctccctatctcatacatgcacccactattttccccttcctcgatctaccggatgaacactataaaagggcatcacacccttctcgcaaagcacacaaccacacaattcaattcaattcagacacaagcttcaacatctcttgctagcaagtagcaagtccggtctagctagagaaatcaagaagaagacggcggcgatggcggagagggtgtcaaggctgtcaacggagaaggcggtggtgatcttcacgaggagccagtgcccgatgtgccacacggtgttgagcctcttctccgagctcgacgtgtgcgcagtggtgcacgagctggacaaggacccgcgcggccgcgacatggagcgggagctcgcccgccgcctcggccgcgcgccgccggtccctgccgtcttcgtcggcggcaacctcattggctccaccgacaaggtcatgtcgctgcacctcgccagcaagctggtgcccatgctcaaagccgccggcgccatatggctctgaatctccatccatccatccatccatgatgacaacacgccgtaaattttgctgggtttataaaaaaaaatcacaccttattagcttgcctagagggaaactaactaattgcaggcatctaaattaagacttaagttcccctcaaaaaaataaagtaagactaaatgatacactacagaatatgttcacaagtcatagatatatatgactatgaggcgcctttgtgggccgtccgatcgaaatggaggtggttaggattataggatataaaccaaatatgtgagagggtttttttttccgctggtgtaactgcagggctaaaaagggtgcaaagggacttgtagcctcccctttccagtttttccaatgagatatgaattttgagttacctctcttcctgtgttcttggatatacgaattcccccaacttttaggttttgttgatttatttgctaatgattttattgaaaaagttcgtcaactagtatcaaaccatcaagcaaaacacacagtacaattcaaatgaagctttgaaaatattgatataaacaccagaaattggtgctgatctcagaaaagataactaaaataccatgaggtatacttaaaatagcactcatcttctaaaaactagaatttcatattggaaaatatttaggattatatgcttagcgaaggatgctattttttgttcttttattagttttagtggtttttcaggaacatacatatcccttgatttcgtttgaaatttcagagatttactggtagtgatcttgttgatgtcaaaagatgatgatctcgtggggaggaaaaaagaaataaa

SEQ ID NO: 1592 - DNA, 431 bp, Panicum virgatum
tcacatacttgaggactatactagctgggacatccaagtttagcttatctacttttcaccttcaagctcgatccagagaaaccaagaagacgacggcgatggcggagagggtgtcgaggctgtcgacggagaaggcggtggtgatcttcacgcggagtccgtgcccgatgtgccacacggtgttgagcctcttgatctccgagctcagcgtgtgcgtggcggtgcacgagctggacaaggacccgcgcggccgcgacatggagcgggagctcgctcgccgcctcggccgctcgccgccggtccctgccgtcttcatcggcggcaacctcgtcggctctaccaacaaggtcatgtccctgcacctcgccggcaagttcgtgcccatgctcaaggccgccggcgccatatggctctgaatccctccatccatc

SEQ ID NO: 1593 - DNA, 455 bp, Zea mays
acgctataaaagggtttgtcaaagcacagaaccacacacaaaataaacacacagccacacacactactagagtcccggtgttcgctaggcagctcgaccaagaagccaagaaagactgtgatggcgaagagggtgtcgagactatcgaagaaggcagtggtgatcttcacgacgagccagtgcccgatgtgccacacggtgtggagcctcttccaggagctcggtgtgtgcgcggcggtgcacgagctcgacaaggacccccgcggccccgagatggagcgggagctcgctcgccgcctcggacgtgcaccatctgtcgtccccgccgttttcatcagcggcaagctcgtcggctccaccgataagatcatgtcgctgcacctcgacggcaagctcgtgcccatgctcaagggttccggctgggacatatggctctgaatccacccgcccattcc

SEQ ID NO: 1594 - DNA, 789 bp, Cynodon dactylon
ggggatcccacaaccacaaactctccgtatcttcatacacacaagcattgtccagctctgcctagctcattgactcgcagtctttagctacatagaacagaggactcggacatggcggagagggtggcgaagctttcgacggagaaggcggtggtgatcttcacgacgagccagtgccccatgtgccactcggtggtgagtctcttctctgacctcagcgtgtccgcggcggtgcacgagcttgacaaggacccccggggacgcgagatggagcgggagctcgcccgccgcctcggccgctcgccgccggtccctgctgtcttcatcggcggcaaacttgtcggctccattgacaagataatgtcactgcatctcgcaggaaagctcatgcccatgctcatggctgccggggccatatgggtatgaaccgccgcccctatcatcgatcgatccaacgaagatataccatgagacattataatcacttgcagtcataattttgttgggtttatatatatgcagttgcaccttgcatgcataaacctaagaaaattagttgaagggcactataattaatgagctacctatatatacaaatatatacaggtcatagagtgtgctcatcacgagtaaaaaatatgatcacaacattaaggaaggtccagatagggacttcctaacaagagagaaattttgttttcccgcttgtgaatctagcaggcctgtcaaggcgaggaatggccattccgcacatttgtgtaaacgaacctgctgtaacctgtcttttta

SEQ ID NO: 1595 - DNA, 618 bp, Triticum aestivum
tagctttctttctcagagaaaaacactagctttccaactagctcctttcacaatccatcaagaagatcgacgagaaaatatggagagggtgacgaggctatcgacggagaaggcggtggtgatcttcacgccgagcaacgactgcccaatgagctacacagtgacgaccctcttctcgggcctcggcgtttgcgcggccgtgcacgagctggacaaggacccccggggccgtgacatggagcgcgacctcgcccgacgccttgggcgtacgccgcccgtcccggcagtcttcatcggcggcaagctcgtcggttccaccgacagggtcatgtcgctgcacctcggtgggaagctggtgcccatgctcaaggccgccggggcgatctggctctgagcctgagaggctgagagcagcatcaagttaactcccgcgtataagtaccgttagtaatcaaaattttacactgcatgcatgcgcgcgtagagaggttcggtttgtattttgcctactaaaccatcctcacatgagtacgtaaaaagaagacgggagcaccagaagttttggcctctatcgataagggaatgacaaagctgcgtatctttatatgagaagtggac

SEQ ID NO: 1596 - DNA, 710 bp, Hordeum vulgare
aacactagctttccttctcaaagaaaaacactagctttcaaactagctcatttcacaacccatcaggaagatcgacgagataatatggagagggtgacgaggctatcgacagagaaggcggtggtgatcttcacaccgagcaacgactgcccaatgagctacacagtgacgaccctcttctctggcctcggcgtgtgcgcggccgtgcacgagctagacaaggacccccgcggccgcgacatggagcgcgacctcgcccgccgcctaggccgcacaccggccgtcccggccgttttcatcggcggaaagctcgtcggttccaccgacagggtcatgtcactgcacctcggtgggaagctggtgccgatgctcaaggccgccggagcgatctggctctgagcccgagaggctgtgagagcataagttaactcccacgtataagtactgcatgcatgcgtagagaggcttggtttgtattttgcctactaaaccgtcctcacgtgagtacgtataagaagacgggagcaccagaagttttggccgctatcgataagagaatcacaaagctgcgtatctttgtatgaaaaaagtggacttcttaattctcattgcacccctttttcaggcttcttcttttcagcaccgagtttgtgctttgaaaccattcacaaataatgaaaactcgttcactaacggccacgccaacggcc

SEQ ID NO: 1597 - DNA, 1191 bp, Oryza sativa
ctctagatttctctctctctcatgcacaattgcacagtacacgattctcctcttcctctctctcatgcacgaacgctataaaaacccatgtacaccctgcactcgatcgcaagccacaacaaacatccatcactgcagcaaatcatcatcatcatcatcatcacatacactaatcgatcgatcagcagcagatagctaattaagcttgtttgattagtttcgccggagatcgatcgatatggagagggtggcgaagctgtcgacggagaaggcggtggtgatcttcacggcgagcaactgcccgatgtgccacacggtggtgagcctcttctccgacctcggcgtcggcgccgccgtccacgagctcgaccgcgacccgctccacggccgggacatggagcgcgacctcgcccgccgcctcggccgctccccgcccgtccccgccgtcttcatcgccggcaagctcgtcggctccaccgaccgcgtcatgtcgctccacctcgccggcaagctcgtccccatgctcaaggccgccggcgccatttggctctagatcgctcatcataattaagctcaattaattaattaacctttctaaacttcactgttttaatcgctactacattcgttttaaaatataaaaatatagaagattcttatattttaagatggagggggtatatttttactactaccgttatatatattatatatatgttatttacacatatgcaatgcacctttgtattgcatgcacgtgtgtaaaaaaaaggcacacatacgagtttaccacttacgcgagtgactgagaagtactatatatatcttatctaagagagattatctaagagagactatactcacctgaggactgccaatatttaattgttagtttgatatacataaagggtgagtgagttttgccgctagctagcattaactagtagcaattacatatgagggcgaggaatatatatagcgagtcttttacatgtaaaataggctttaatgttatccctctccagctcttttttccaatgagagctgtgttttgtaacctcgtgatcgggaatataatgaagcattttaattatacatatgccggcgcctaaaataattgtgtcatctataccattctcttacaaatatatgatgcaatctagtggctgatatgttgtactaactctagtt

SEQ ID NO: 1598 - DNA, 640 bp, Secale cereale
gtaacactagctttctttctcagagaaaaatactagctttccaactagctcctttcacaatccatcaagaagatcgacgagaaaatatggagagggtgacgaggctgtcgacggagaaggcggtggtgatcttcacgccgagcaacgactgcccaatgagctacacagtgacgaccctcttctcgggcctcggtgtgtgcgcggccgtgcacgagctggacaaggacccccggggccgcgacatggagcgcgacctcgcccgccgcttgggccgcacgccggccgtcccggccgtcttcattggtggcaagctcgtcggttcaaccgacagggtcatgtcgctgcacctcggcgggaagctggtgcccatgctcaaggccgccggggcgatctggctctgagcgtgagaggctgagagaagcatcaagttaactcccacgtataagtaccgttagtaatcaaaattttacactgcatgcatgcgcgcgtagagaggtttggtttgtattttgcctactaaaccaccctcacatgagtaagtaaaagaagacgggagcaccagaaattttggccgctatcgacaagggaatgacaaagctgcgtatctttatatgaaatgaaaagtggactttttcccaaa

SEQ ID NO: 1599 - DNA, 1165 bp, Brachypodium distachyon
tcagtagtagtattaagtcccagctaaaaacacacacagagagacagacgtgcactataaaaagaaggcaccgcgcctccattaaccacaagtccacaccacaacaacacaacaaacacctgagcgtgcaaaactagttaccaagtgtagtacacacactagctagccagatccaccaagaagaagaagatcatggagagagtgacgaagctatcctccgaaaaggcggtggtgatcttcacggcgagcgagtacccgatgtgccacacggtgaccagcctcttctccgacctcggcgtggcggcggcggagcacgagctggacaaggacccccggggccgcgagatggagcgggacctcgcacgccgcctcggaggccgcgcgccgcccgtccccgccgtcttcatcggcggcaagctcgtcgggtcaaccgacagggtcatgtcgctccaccttggtggcaagcttgtgcccatgctcaaggccgccggggccatctggctctgacaaccaatctagctagctgttgctagtaaattttgcatccatgcgtgtgtgcgtaagagaaatgtgtgcgtgaggttaattcggctaagttcgatcctcaggtgagagagatcgagagaatagataatttcccaagaaggcgagagtatgagaagttttttttctctgcagctagccataattattaaggaatatgataaatctaagtaatctttcaaggaaaagttgacttgttttctgtttccaactattttttggacaacggtgtactattacatgcatggcaactattactagtacctccgttcctataagaagtcgtatcaatgtaatatcaagctaacagaattctctttttgtcaatcggtgggtgacatggcaactccgagcgccaaagccatccacttgtcacagatcctgctttgtgggggatgagggacctttagtgtgcagtttcgataattcggggagaagagtatatatatgaaacaaaatagagatcatttgcatacttttcatcaagttgggggcgaaaaatgtgtatgaaacacaaatagagaccatctgtgtatttttcatcaagttggaaacgaaaaaatatacttttatctcttcccggtgtaccattcaaaatgcttaaactctcaccacgacccta

SEQ ID NO: 1600 - DNA, 718 bp, Cynodon dactylon
tagacacttcaagacatctgaacaacactagctcgcttactcacacgctagctcggtccatttcaacgaggccaagaaggcggcgatggcagataggttggcgaagctttcgactgagaaggcagtagtgatattcaccacaagccagtcctcgatgagccatacggcggccagcctcttctccgaccttggcgtctgtgccgtggtgcacgagctcgacaaggacccctggggacgtgacatggagcgggagctcgcacgccgcctcggccgctcgccgccggtccctgcagtctatattggaggcaagctcgtcggctccaccgaccgggtcatgtccctgcacctcgccggcaagctcgtgcccatgctcaagggcgcaggagccatgtggctctgaatccatctccatcctaatcatccagccatccgtacatgtcgaaatgacataacaaccattcacatcccaaattttgctgggtttatatacgaagtggggaccttgcatccatcaaaacctatctacttattgcaggttccttaattaaagagctgcgcacttgcatgtgggtgcgtaatatagagtgttctaactagtcataagttttatgaggctatcttgactgcccgatcataagagatggggagtataggtccaggtaattttccaaataagattataagagaatttttgttttaccgccaatgcaacctagat

SEQ ID NO: 1601 - DNA, 775 bp, Secale cereale
cagaaaatagttcagctgagcatactaacaccaagtccattacatgcgatcgtaaagaagacaagaacactctgacctgccggcgatggagagggtgacgaagctgtcgtccgagaaagcggtggtgatcttcaccatgagcaactgcccgatgagccactcggtgacgagcctcttctcgagcctcggtgtgggtgccgcggtccacgagctggacaaggacccacgcggccgcgacatggagcgcgacctcgccagacgccttgggcgtacgccgcccgtcccggcagtcttcatcggcggcaagctcgtcggctccaccgacagaatcatgtccttgcatctcagcgggaagctcgtggtcatgctcaaggccgcaggagccatgtggctctgatcatgggtgcaacatcacgttcaccccccccccccccccggcaaaatttttttttagttcatcccagctttggcaattttcgcacctcgccatgcatgtatgtatcggccgcgcttaccacaagtagggaaatttttgcttgtactagttattgggctggtcgccacatgagcatagcgtcgtagttcctctttccaggatgacgggaactcaagaagttttgttttgtcgttggtgagataacactgagagtctacggaataatacatacatgtgtctttaaatgagaaatgtaatttattacgtccatttccaaccgttgtggttagggtttcacaaacgctaattgaaagtcggtttttcctgaaaaaaaaagtc

SEQ ID NO: 1602 - DNA, 614 bp, Panicum virgatum
agaaatcaagaagagacgacggcgacggcggagagggtgtcgaggctgtcgacggagaaggctgtggtgatcttcacgcggagccagtgcccgatgtgccacgcgatgttgagcctcttctccgagctcgacgtgtgcgcggcggtgcacgagctcgacaaggacccgcgcggccgcgacatggaacgggagctcgcccgccgcctcggccgcgcgccgccggtccctgctgtcttcgtcggcggcaacctcgtcggctccaccgacaaggtcatgtcgctccacctcggcggcgagctcgtgcccatgctcaaggccgccggcgccatatggctctgaagtctgaatcctccatccattggcgacagcaactatatataaaaattcctcgctccgatccaatatagttcccaaatcccaacaggaattttgagaagttttgttcagcgcggccagtagtgtaaccacttgcagggctgaaaagggtttggaatgaccagtccgtgtctttgaatgtacatggatgtatgtaaccctgacctttccaggattttcagagtgagatgcatgtggactttgatgagttaattgtaacaacccacgtaataattacc

SEQ ID NO: 1603 - DNA, 885 bp, Brachypodium distachyon
ccacacgaccaaacacacatttcagctacaaattaacaccatttcattcgtaccatccagttatccagacaagaacaccttccaatactagatcgatggatagggtgacaaagctgtcgtctgaaaaggcggtggtgatcttcacggcgagcgagtacccgatgtgccacacggtgaccagcctcttctccgacctcggtgtggcggtggcggagcacgagctggacaaggacccccgcggccgtgaaatggagcgggacctcgcacgccgcctcggaggccgctcgccgccagtccccgccgtcttcatcggcggcaagctcgtcggctccaccgacaagatcatgtcactgcaccttggtggcaagctcgtgcccatgctcaaggctgccggggccatatggctctgagaacggcatgcatatcagtcggttcatcggattctgcatttagtaaattttgcactacttcaaaagatgagcatatcgatcatacagttggatcgaagagggcgagcacaagaagttttgtattgccgctagccataaccataagagtaccgtgtgttctctaagggatgacatacattcaaggtgtcttcgaatgataaatatatttggtttcctgttccaactgtttttttagatgatgtactaccttggtcacaaaattcagaaatccagagaactaccgtgcgatgagtcctaaggtttcacgcaccggttcaccattttcttccatggggggatgagattggcggaggtaaccgaaaatacatttatccaaggggttttcttatcaaattttaaattcatttttagaaagataattatgtattgcatttcgcagatgaaaccatagcatacttaaactgaaacaaataaa

SEQ ID NO: 1604 - DNA, 1194 bp, Panicum virgatum
tgagggaaaagaaagcaaatgcagagtcatatctagagatatgttatgccctatcgcactgttcatttcgagctgcaatgcacacgtcgaagattcttgcccacacaatctctctctctctctctctcatacaagctagcacgcacacccactgttctcctcttcctctatccgatcagccctataaaaggacgtcacaccacacccagctctcaagccacacaacaacaaacacttgaacatataccagctagaactcatcgactcatctagaccagctagctcatagcccaattcatttagtagtgaggtactagctagcaagagagaaattaagagagagccagtcaggcaggcaagaatcaatggccgatagggtggcgacgctgtcgacggagaaggcggtggtggtcttcacggcgagccagtgcccgatgtgccacacggtgctgagcctcttctccgacctcagcgtgtgcgcggcggtgcacgaggtggaccaggacctgcgaggccgcgaggtggagcgggagctcgcccgccgcctcggccgcacgccgcccgtccccgccgtcttcatcggcggcaacctcgtcggctccaccgacagggtcatgtcgctgcacctcgccggaaagctcgtgcccatgctcaaggcggccggggccatatgggtctgagatctgaatccgtcggccgtccatctatccatccacgcatggagagatcaagaataaggctaactaatatatatatatatatagtcccgccatcaattttgtttcatttataaatttgcgcaccacatgcatgcaactaattaagtcaaaggatcctaattaaattaaggagcatacgacatatatccatgcatgcctatagagagtgtatgttcataagtcaatatatatgaggatatacgacggtacgtacggtgaccggccaagtccttaagtcatgcaacgaaaggtacctatagctagctacagttcccagcaaagagcattggtcttgatgctaatataacctatagtatgagtttggtcttgatgctagctagtataacctatatatagtagggttgaaaagggcgagtggtgacatgtctgtgtcttttgatgtaaacggacttggtattcctccctttttccggtttttcgaatgagatagtatatgaattaattttgggatcaa

SEQ ID NO: 1605 - DNA, 674 bp, Pseudoroegneria spicata
  misc_feature (9)..(9): n is a, c, g, or t
agaaaatantttcagttgagcatactaataccaagctagtccatcacttgcgatccaaaagaagacaagaacgctctgacctgccggcgatggagagggtgacgaagctgtcgtccgagaaagcggtggtgatcttcaccatgagcaactgcccgatgagccactcggtgacgagcctcttctcgagcctcggcgtgggcgccgcggtccacgagctggacaaggacccacacggccgcgacatggagcgcgacctcgccagacgccttgggcgtacgccgcccgtcccggcagtcttcatcggcggcaagctcgttggctccaccgacaggatcatgtccttgcatctcagtgggaagctcgtggtcatgctcaaggccgccggagccatgtggctctgaccatgagagtaacatcagttcatcccagttttggcaattttcgcaccccgccatgcaagcatgtatcctccgcgcttaacacaagtaggggaaatttcgcttgtactggttattgggctggtcgccagatgagcatagcgtagttcctctttccaagatgacgggaacacaaaaagttgtgtttagtcgttggcgagataacagtgtgagtctatggaataacgcatacaagtgtctttaaatgagaaatgcaatttattacgtccatttcca

SEQ ID NO: 1606 - DNA, 2882 bp, Setaria italica
atggcctcccttgggacaccacccactcaccattgcagagagctgcactgctactccctcaggtatccagcagggaagcagggtgaggaagaagcaggggcgctaatggtgaagttctccaagcagttcgaggcccagctcgtgccggaatggaaggaggcctttgtggactactggcagctcaagaaggacgtcaagaagctgcaggccatggctggggatgatgtcgtggtgccagcagcagtggcatcaccatggttgcgccagacaccaccgaccacggctcactgggtgatgaggttgccgttcctccaaccccatggacaccacagggagcctgccgccattcaggcatgcactagctttatttgtgtgcacaggaagctggtgattgatgggagcgtcgacggtgcaatcgccggggaggtgtacgagacaggggttgcagatggcgccggttttgcggatgcagaggcggccaaggcctttttccacaggctggaccagcagttgaacaaggtgaacaggttctatgagaggaaggagggggagttcatggagcgcggcgagtcgctccggcggcagctgcagatcctcgtcgagctcaaggccgccatcacccagcagcagcaggcacggcggcatggcgggtcctcgaaagggagtgccgacatggatgatctctccatttcttgctccatccagcttggagaccaatctccaagggtcattgcagagcaagaagaagatgaccaagaaaaacttaccaaagatgtaactgctaaaagcacagatgaagaacttggtgaatcagggagacttgggaggacaaacgaagaagctgcccgcaagctgaggacactctcagggagggtggtcacctgccagggcaggaacgtgaggatcaacatcccagtcacgacgccatcaaggaccgtcactgccatacgcgaactgctgtttgaggatatgctcagccaatcaaagaagactggaacacatggtagtgatgccaatgagaagttgagcatcaacaagaggaagttgcgccaggcagagaagatgatcagaggtgctctgattgagctatacaagggactgggataccttagaacttaccggagcttgaacatgatggcctttgtgaagatcctgaagaaattcgacaaggttacagacaaggaagtgcgtcagatttacctcaaagtagtggagagctcctacttcaatagctctgacaaggcggtcaggctaatggatgatgtcgaggagctgtttgtgagacatttcactgaaggtgacaaaaggaaagcaaagatgtatctgaagccaaatcagagggaagaatcacactctaccacgtttttcattgggttattcactggtggcttcttagcactattcatcggttactgtatcatggcacgtgttactggaatgtacactcagcagtcgaacaaggtgtacatgtcaacatcttatcctgtccttagcatgttcagcctcttctttctgcatctcttcctctatggatgcaacattttcatgtggagaaagacacgcataaactacacattcatatttgaattcgcgcctactaaagagctcaaataccgcgacgttttcttgatatgcacaagctccatgacaattgttgttggtgtaatgtttgcgcacctgacaatcattgttaaaggaaattcatcaagtgcagtccaagcaataccagggtccctacttttggtgttcttgtcaatattagtctgccctttcaacatcatctaccgatcaagtcgttatcaattccttagagttattagaaacatcattctgacccccttttacaaggttgtcatggttgatttcttcatggctgatcagctctgcagccaggtaccagtgctcaggaccctggagtatttggcatgttactacataacaggcagctacatgacacaagactatggatactgcacaagagttaaacattttagagacctggcttatgcagtatccttcctgccttactactggagagccatgcagtgtgcaaggagatggttcgatgaaggggatataaaccacattgtcaaccttgggaagtatgtgtcagcaatgcttgctgcaggaacaaaagtggcatatgagaataataatggtgctggatggctgtcacttgttatcattgtatcaagtattgcaactatctaccaactgtactgggactttgtcaaggattggggtcttctgcagttcaattccaagaacacttggcttcgtaatgatttgatacttaaacaaaaatacatttatttcttatccatgggtttgaaccttgtcttgaggcttgcttggcttcagactgtcatccaccctaacattggaagcctggattctagagtaaccctgttctttttagcagcacttgaggtgattcgacgaggtcactggaacttctacaggttggagaatgagcacctaaacaatgctgggaagttcagagctgtgaaggtcgttccacttccttttcatgaggtggaagacaactaacaaaatagggcatcgttgtaggggttcagaatacaaacagttcagcgtgcactattaccatgataagatttaactttggtgtgaggaatgaagggctcccacatgaccagtatggagaagttgtattctaccaacaaatagtttacatagaacgcaggagttcctaaaagtttccaagcaagaattggtattgatatcatatgaaattgacaattgttagtaaatcagaacaatagaagcagcagctcagctctacagttgtattttaattttttagcatctcaaccactttgtatttccctttgcttcggaaatgtaacaatatccattta

SEQ ID NO: 1607 - DNA, 3161 bp, Sorghum bicolor
tcaggcttgatgctcatccagtgatcacaattcagaacaggtacgtacgtagctaagagccacaaccccccataggcaacaattcccccccatgttgcatgctaacagatacttgagaatgtgctaacctaaccctgtcacaatagattctagtcccaattgtccaacgaactgaactctgcagcacactccatcatgcacatgatataagtccacacacccaaagcatggcctcccttgagacgacgcaccatctcaatcccagagcactgcactgcttctccctcctctggtcgtctacggaggacgacaaggaagaagcagcagcaggtgccccagcaatggtgaagttctccaagcagttcgagggccagctggtgcccgaatggaaggaggccttcgtggactactggcagctcaagaaggacgtcaagaagctgcaggccgcagcagatggtgccgtggcgctggcatcgccgctgcagccagcggtggctccggctcactgggtgatgaggctgccgttcttccatccccatgggcagcctgccgccattcaggcatgcacttaccagctttccttggcgctgcctaataaagttccgtttgatgctgcaacgccacgtttggaaaataaacaagcttgcacatacacctactttgctataagtatatcgtactattatattagtagctactcgaaagtgcacaagaagctggctgtagacaggagcatcgacggcgcgatggccggggaggtgtacgagacggcggtggcggatggtgccgggttcgtggatgccgaggcggccaaggccttctttcagaggctggatcaacagctcaacaaggtgaaccggttctacgagcggaaggagggggagttcctggagcgcggagagtcgctcaggcggcagctgcagatcctcgtcgacctcaaggctgccatcacccagcagcagcaggcacaggcacaggcacggcgcggggccgactccaaagggagcaccgacacggatgatcatgatcccgccgtttcttgctccatccagcttggaggccaatctcttagggagattgcagagaaagaacaagagtgtgaagaaaaactcaacgacgatgtcactgccaagagcactgacgaaggacctgaggaccagctctccgtccctcaaggccttattagtgaatcagggagacttggcaagccgaatgaagaagttacgagcaagctgaggacactctcagggagggtggtcacctgccacggcaggaatgtgaggatcaacatcccagtcaccacgccttccaggactgtcactgccatacgcgaactgctgtttgaggacatgctgagccaatcgaagaagattggcacacatggtaccgatggcaatgagaagctaagcatcaacaagaggaaggtgcaccaggcagagaagatgatcagaggtgctctcgttgagctatacaaaggactggggtacctcaagacataccggagcttgaatatgatggcctttgtgaagatcctgaagaaatttgacaaggttacagcaaaggaagtgcagcaaatttacctcaaagtagtggagagctcctactacaatagctctgacaaggcagtcaggctcatggatgatgttgaggagctgtttttgagacatttcacagatggtgacaaacggaaagcaatggtgtatctgaagccaaatcagagggaagaatcacattgtactacgtttttcattggattattcactggtggcttcatagcattattcataggttactgtatcatggcacgcattgctggaatgtacactcagcagtcaaacaaggtgtacatgtcaacatcttatcctgttcttagcatgttcagcctcttctttctgcatctcttcctctatggatgtaacattttcatgtggaggaagacacgcataaactacacattcatatttgaattcacgcctactaaagagctcaagtaccgagatgtgttcttgatatgcactacttccatgacaattgttgttggtgtaatgtttgcgcacctcacaataattgttaaaggaaattcatcaagcgcagtccaagctataccagggtccttacttctggtgttcttgttgatattagtctgccctttcaacttcatctaccaatcaagtcgttaccaattccttagagttatcagaaacatcattctaacacccttttacaaggttgtcatggttgatttcttcatggctgatcagctctgcagccaggttccggtgctaaggagcctggagtatttggcatgttactacataacaggcagctacatgacacaagactatggctactgcacaagagtgaaacactttagagacctcgcttatgcagtatccttcctgccttattactggagagccatgcagtgcgcacggagatggtttgatgaaggggatataaaccacattgtcaaccttgggaagtatgtgtcagccatgcttgctgcaggaacaaaggtggcatatgagaataacaatagtactgggtggctgtcacttgttatcattgtatcaagtattgcaactatctaccaactgtactgggactttgtcaaggactggggtcttctacagttcaactccaagaatacctggcttcgtaatgatttgatacttaaacaaaaatacatttatttcatatccatgggtctgaaccttgtcttgaggcttgcttggcttcagactgtcatccaccctaatattggaagcctggattctagagtaactctattctttctagcagcacttgaagtgataagacgaggtcactggaacttctacaggctggagaatgaacacctaaacaatgcagggaagttcagagcagtgaaggttgttccgcttccttttcatgaagtggaagaggactaacaaaataggaccaccactggagcaggttgtaggtgttaaaaatacaaacagttcgtatgtaacaccaactaatgctagaaagcatgcactacactaccattaataagattcatttttttgtatgagcaataaaggccattccgcattgtcagtatggacaagttgtatgggagcagtaggcacttacatagaatgtagatttcctataagttccccaacattgttagaaaa

SEQ ID NO: 1608 - DNA, 3412 bp, Hordeum vulgare
gagacacccaccgcgcaccggtgccaccaccacagctgcggcgagctgcactgctgcaccctgaggccgccaatggtaaagttctccaagcagttcgagggccagctcgtgccggaatggaaggaggccttcgtcgactactgtctgctcaagaaggacatcaagagggtgcaggccgccgaggcagcgcccccggcggcacagtgccagccgcccgtggctgccagccactgggtgatgaggctcccgttcctcaacccccatggccaccacaaggagcacggcgccatacaggtgcacaggaagctggcaagcggcggcaacgacggcgcggtggccggagaggtgtacgagacggaggttcttgacgcggcagggttcgacggcgtggaagcggaggcggccagggccttcttccagaggctggacgagcagctgaacaaggtgaaccggttctacgagaggaaggagggagagttcctggagcgcggcgagtgcctcaggcggcagctgcagatcctcatcgagctcaaggccgccgttgtcgaggcgcggcgccgcgggggctcgacggcggctgggagcaccgacccggaggacccatccgtgtcttgctctatcctgcatggagaccagtccctcaggggcattacagagcaagaacatgtaagtcaagaaaagctcgccggcgatgctgctgcaaaaaacaccgatgaaggggaggaccatgttcccatctccgaaggtctgggtgactcggggaggactgagaagccaagagacgaagctgccaacaagctgaggacattctcggggagggcggtcacttgccagggcaggagcgtgaggataaacattccagtcaccacgccgtcgaggacggtgttcgccatccgtgaacttctgttcgatgacatgctaagccagtcaaggaagactggggggaatggtggcgatggcggtgagaaattgagcatcaacaagaaaaaggtgcaccaggcagagaagatgatcagaggagccctggttgagctgtacaagggcttggggtacctcaagacgtatcggagcttgaacatgttggcttttgtgaagattttgaagaaatttgacaaggttacagcgaaggaagtgcagacaatttacctgaaagtagcggagagctcctactttaatagctctgataaggcaatcaggctaatggacgatgtcgaggagctgtttgtgagacatttcacaagcggtgacaaaaggaaagcaatgaaatatctgaagccaaatcagaaagaagaatcacatgctaccacatttttcataggactattcactggtggctttgttgcactatttatcggttattgtatcatggcgcacatagctgggatgtacactcatcagtcaaacaaggtctacatgtcaacatcctaccctgtccttagcatgttcagcctcttctttctgcacctcttcctctatggatgcaacatcttcatgtggagaaagacacgcataaactacgcattcatattcgaatttgcacctaccaaagagctcaagtatcgtgatgtgttcttgatctgcactacctctatgacgattgttgttggtgtcatgtttgcacacctcacactcattgtcaaagggtattcttcaagtacagtccaagcaatcccagggtgccttcttctggtgttcttattagtattggtctgccctttcaaaatcctctaccgatcaagtcgttatcacttcctaagtgtgatcagaaacatcattctaacccccttttacaaggttgtcatggttgatttcttcatggctgatcagctttgtagccaggtacccgtgcttcggaccctggaatacctggcatgttattacataaccagcagctataagacacaagactatggatactgcacaagagtgaaacattttagagatttggcttatgcagtatccttcctgccctactactggagagccatgcagtgtgcaaggagatggtttgacgaaggggacataaaccacattgtcaaccttgggaagtacgtgtcagcaatgcttgctgcaggaacaaaagtggcatatgagaatgataacagtgctggatggctgtcacttgtcgtcatcgtgtcaagtatcgccactatctaccaactgtactgggactttgtcaaggactggggtcttctacagttcaactccaagaacccttggcttcgtaatgatctgatacttaaacaaaaatacatctatttcatatccatgggtttgaaccttcttttgaggcttgcttggcttcaaactgtcatccaccctaacattggaagcctggattctagagtaactctattctttttagcagctcttgaggtgattcgacgaggccactggaacttctacaggctggagaacgaacacctaaacaatgcagggaagttcagagctgtgaaggttgttccacttccttttcatgaagtcgaagagcactaacagcatggggcatcattgcagcacgctctaggattgcagaactcccaaacagttcagatgtaacaccaactaatgttagaaagcatgcactacactactgtaattcaattcattttttggtgtgacaaataaagggcattcaaatgtaccgtttggagaggagaagtgatatgcaaataatgacagtatatacatagagcacataagttccaactagttttccatgtaagaattggtactggtatcatgtaaactgaagtcagatcacttcatgaaatccaagtactcaacaaatggttgctctacagttcttcttttgactgttccacccatcttgtaatttgggtatctgggaaatgtgattatatctagttaatggcagtccagtcatgcataaattacctcaaaagagatcaaccaaggatcaatatgactagcagaatttgcagtgactaatcaacttacattacaagctcaactagggatgcaaagtggcatcctgctaaggcccactaaactaagctaccagtataaaatgcactgattacagcaaataggggccagacttggtctttttatcaactgaaggaagcaggctgacgtgggacgccactttgcatccctaggctcaacaaaatcgcacgaatcatcacatactgacatatattgagtagtgaagctccagtgttttgaattgtgaatagtaagcacatacaagatcctggtatacagattgttgatgttgcagttaacctgacattagcatattacaacttaatttacaaatcagagagcatatataagaagagctgggcaatgctcatactgaccttccattgcaggttgaatgcaaaaagggtatcaatgcctggcattgcatttgcttccaataatgggattacacctctaaatttcc

SEQ ID NO: 1609 - DNA, 1336 bp, Sorghum bicolor
cgcaaatccactgcctttgcccaaagccgtgcggcccaaaggatgttccaccacccgcggcgagcctataaatgccgccctcggcagctgcactccggtaccaatccgcgattccttacacgctaaggcatagaggcacgcacgcgcacaatcggcgccagccaacgagatcgatcagccaagctaagctctctgcctgctcctcctcctccgctaagctctcggcagccatgaggaagtcgtcgagctgcagcggccatgtcatcggggtcccggtcacctccaaggcgtacgggatagaggaggtgtcgtccagggatccgtcgtccttcaggaagggcgacgccgccggcgatcaccttgctgtctcgttgacgcaccccagcccttatgcgtctttcggctacaagcacagcagcaagggtcaggtgatccactgggtgagcaagctgggcagaagggcgcaagggttcagggagcacgtgaccctggggccgaagctgtcggagacggtgaaggggaagctgagcctgggcgcgcggatcctgcaggccggcggcgtcgagcgcgtgttccggcaggccttctccgccgagaaaggcgagcggctggtgaaggcgctgcagtgctacatctacaccacgggcgggcccatcgccgggatgctcttcgtctccaccaagaaggtggccttccgcagcgaccgacccatcaccgtcacctcccccaagggcggcacgacggcgcgggtcacctacaaggtggtggtcccgctccggaggatcgacaaggtgcggcccagcgagaacgtcgaccggccggaggagaagtacatccacgtcgccaccgtcgacggcttcgagttctggttcatgggattcgtcagctaccagcggtcctgcaagtacatgcagcaggccgtctcggagctgcagctgcaatgatcgaccgcaccgccgtccgtcggggccggcgacctacaggttgatgaggaggtccggacgtgccggttgcgaggctgcccggtcggcacgatgtgaagagaggatgttatgggcttgcttcgccagcttttgtcgcgaagtagccgtagctaggattgccctgtctaattccggatcggtgcaattgttccttccgcgtacgatgttggaccaacacctgtgttgttccaaagtggttgctttgtactagtaaatggatcaagaaattaatcatttgtgcatgatcttgtccaatggagtactagttcagtatgtttctcatggtttatttctttctctctactagtaggaagtaagcgtcagaacatacataatgcaaaatgcaaaatata

SEQ ID NO: 1610 - DNA, 2219 bp, Panicum virgatum
cggctgcggacgagcgcgatctcgggaacagtgttttctgtcgctccccctctttgctgtgcgatctaggccgtcgacatcacccgatcggccacgcatgttactcctagccacagcacacaccgtgtcccagtgcgacgcacgaacggcctctgctccacaagagcactggtgacaccgcgccacacccctttctctccatgtagccccggtgcgggcgagaatgtgcgggcacatggggcgcttctcggaaagccgccgggcctccggatcccgtagagaaatccggaatcgtttcgcctttgggggccggccgatgaatatcccgcgcgcacctggccttcacatggccgacgcggccgcacgcgaggcgaaccgaaccagtaggccgacgggaggaggaggaggggtctacggctctacgcctgcctgctttaggcgaacgtggaccgctcctttctgagccgctggtgactcggccggcccggctgctgactcggccagcgtcgcccaagcaaagcttccaccaccgcgccgcgcctataaatggcgccctctcggcggctgcgctccggtaccaatccgcgattccttacacgctaaggcgtcgacctccagctcttcttcttccatccttcaccgcgacgccggcgagaccagcggcgcccagatctctgctcttttccgctgagcttgctctagcagacatgaggaagtcgagcagcaccggcgcccatgtcatcggggtcccggtcacctccaaggcgttcgggatagaggcggcggcttccaccagggatccgtcgtcgttcaggaagggcaacggcgaccacctcgctgtctcgctcacgcaccccagcccgtatgcgtctttcggctacaaccacagcagcaagggccaggtggtccactgggtcagcaagctgagcaggcgggcgcagggcttcagggagcatgtgaccttgggcccgaagctgtcggagacggtgaaagggaagctaagcctgggcgcgcggatcctgcaggccggcggcgtcgagcgcgtgttccggcaggccttctccgccgacaagggcgagcggctggtcaaggcgctgcagtgctacctctacacgacgggcggccccatcgccgggatgctcttcgtgtccaccaggaaggtcgccttccgcagcgaccgccccatcacggtgagctcgcccaggggcgacacggcgcgggtcacctacaaggtggtggtcccgctccggcggatccgcgaggtgcggcccagcgagaacgccgacaggccggaggagaagtacatccgcgtcgccacggtggacggcttcgagttctggttcatggggttcgtcagcttccagcggtcgtggaggtgcatgcagcaggccgtctcggagctgcagtgaccgcgcggcctgggtggtgaggaggaggaggtccggtgcatgtacggctgccctgtcggcacgacgagaagaggatgctacggcctgcgtcgccatcttttgttgcgaggtagccgtgtagctaaaggttgccccaataatctaagccggggcaattgagttccttccgcgtacgatttggatcaactttgtgttgctcgaagcggttgcgtgaagcatggaccgggaaattaaccatttatgcatgttgttgttgaatggaagagctcgcctttttttttaaaaaaaaatgctgtgcctctctcatctttgtactactgtgtgtccagaagatggtgaaaatttacctctgacgagttttggtggtacgagattcaaaaactgaaaaatattgtggactattattattcgagacgagtttcttcatgtttgttggcgatctgcgtattcgtgtttgttggcgagaaaataaaataattttccgaggtacttaaaatagtacggatgtcaacactgccagttatgtgggctcgcactagtagcgaaaagctgcaaccagcccaagatcaggccggacacaaattgctgaaatgaggaggccgaatatcgcgtgcgtcgaagctgggccattagccagcaccgaacgacagatgtttgggctgggtctgaaccgaattctcaaatgggtcggatgctttgatcggcccaactaggttgctctcggaggcacaaaactacgaccagaagacaaggtggcggtgtgccgcgtacatagaacatcatcctgcgggctgtggcggtgccgacggg

SEQ ID NO: 1611 - DNA, 1941 bp, Panicum virgatum
cggcgcgggcgagaatgtgcgggcacatggggcgcttctcggaaagccgccggccgggcctccggatcccgtagagaaatccggaatcgtttcgcctttgggggcagatgaatatcccgcgcgcacctggccttcacatggccgcacgcgaggccgaaccgaaccagtaggccgccgacggaggagaggaggaggggtctacgccttgcctgctttaggcgaacgtggaccgcgcctttctgagccgctggtgactcggccggcccggctgctgactccgcaaatccactcgcctttgcccaagcaaagcttccaccaccgcgcctataaatggcgccctcggcggctgcgctccggtaccaatccacgattccttacacgctaaggcgtcgacctccggttcttcttcttcttccatccttccgcgcgacgcaggcgagaccagcgcccagcactctgctctttcagctgagtttgctcctagcagacatgaggaagtcgagcagcggcggctgcggccatgtcatcggggtcccggtcacctccaaggcgttcgggacagaggaggcggcgtccaccagggatctgtcgtcgttcaggaagggcgacggcgaccacctcgccgtctcgctcacgcaccccagcccgtacgcgtctttcggctacaaccacagcagcaagggccaggtgacccactgggtgagcaagctgagcaggcgggcgcagggcttcagggagcatgtgaccctgggcccgaagctgtcggagacggtgaaggggaagctgagcctgggcgcgcggatcctgcaggccggcggcgtcgagcgcgtgttccggcaggccttctccgccgacaagggcgagcgtctggtcaaggcgctgcagtgctacctctacaccacgggcggccccatcgccgggatgctcttcgtgtccaccaggaaggtcgccttccgcagcgaccgccccatcacggtgagctcgcccaggggcgacacggcgcgggtcacctacaaggtggcggtcccgctccggcggatccgcgaggtccggcgcagcgagagcgccgacaggcccgaggagaagtacatccgcgtcgccacggtggacaacttcgagttctggttcatggggttcgtcagctaccagcggtcgtggaggtgcatggagcaagccgtctcggagccgcagtgacagcgcgcggcccgggtggtgaggaggaggtccggtgcaatggcggccctgtcggcacgacgagaagaggatgctacgggctgcatgcgtcgccatcttttgttgcgacgaggtagccgtagtagctaaagattgcccccaatctaaatccggatcggggcaattgagttccttccgcgtacgattttagatcaactttgtgttgctcgaagcggttgcgtgaatcatggaccgacccagtgattacagtgattaaccatttgtgcatgttgttgttgaatggaagagcgagcttacctttccgaattgttttctgctgtgcctttctgatctttgtactagactactagtgtgtgtaagaagatgaaaatataactccgactcggagctttggtagtacgagatttaaaaactgaaaatattgtggagctattattcaagacgaatttcttcacacgtttgccgatctgcgtgttcatgtttgttggcgagaaaataaaataattttcagaggtactgtacttaaaatagtacggatatcaacgctgccagttatgtgggctcgtgctagtagcggaaaagctggcagcccaagatcaggtcgcagacaaactgctgaactggaggaggccaaatatcgtgtgggttgaagctgggccacggggcagcaccgaacgagctgtttgggctgggtctgaaccttctcttggcgccgcttcctcaacgacggcgaggcggaggacaccg

SEQ ID NO: 1612 - DNA, 1222 bp, Panicum virgatum
  misc_feature (320)..(320): n is a, c, g, or t
  misc_feature (343)..(343): n is a, c, g, or t
  misc_feature (376)..(376): n is a, c, g, or t
  misc_feature (384)..(384): n is a, c, g, or t
  misc_feature (829)..(829): n is a, c, g, or t
  misc_feature (831)..(832): n is a, c, g, or t
attccttacacgctaaggcgtcgacctccagctcttcttcttccatccttcaccgcgacgccggcgagaccagcggcgcccagctctctgctcttttccgctgagcttgctctagcagacatgaggaagtcgagcagcaccggcgcccatgtcatcggggtcccggtcacctccaaggcgttcgggatagaggaggcggcgtccaccagggatccgtcgtcgttcaggaagggcaacggcgaccacctcgctgtctcgctcacgcaccccagcccgtatgcgtctttcggctacaaccacagcagcaagggccaggtganccactgggtgagcaagctgagcnggcgggcgcagggcttcagggagcatgtgaccntgggcccnaagctgtcggagacggtgaaggggaagctgagcctgggcgcgcggatcctgcaggccggcggcgtcgagcgcgtgttccggcaggccttctccgctgacaagggcgagcgtctggtcaaggcgctgcagtgctacctctacaccacgggcggccccatcgccgggatgctcttcgtgtccaccaggaaggtcgccttccgcagcgaccgccccatcacggtgagctcgcccaggggcgacacggcgcgggtcacctacaaggtggcggtcccgctccggcggatccgcgaggtccggcgcagcgagagcgccgacaggcccgaggagaagtacatccgcgtcgccacggtggacggcttcgagttctggttcatggggttcgtcagctaccagcggtcgtggaggtgcatggagcaagccgtctcggagccgcagtgacagcgcncnncccgggtggtgaggaggaggtccggtgcaatggcggccctgtcggcacgacgagaagaggatgctacgggctgcatgcgtcgccatcttttgttgcgacgaggtagccgtagtagctaaagattgcccccaatctaaatccggatcggggcaattgagttccttccgcgtacgattttagatcaactttgtgttgctcgaagcggttgcgtgaagcatggaccgacccagtgattacagtgattaaccatttgtgcatgttgttgttgaatggaagagcgagcttacctttccgaattgttttctgctgtgcctttctgatctttgtactagactactagtgtgtgtaagaagatgaaaatataactccgactcggagctttggtagtac

SEQ ID NO: 1613 - DNA, 1200 bp, Setaria italica
attccttacacgctaaggcatcctcttcggctcttcgcttcattcagcgcgaagcaggctagatcggcgccgagctctctgctctctctctgcttagcttgtgttgtggtcactagtcggccagcactcctaacagccatgaggaagtcgggcagcagcggccatgtcatcggagttccggtcacctccaaggcgtatgggatagaggagggaacgtgcaggaagagcgacggcgatcaccttgctgtctcgttgacgcaccccagcccttacgcgtctttcgactacaagcacagcagcaaagatcatcaggtgatccgctgggtgagcaagctgagcaggcgggcgcaaggcttcagggagcatgtgaccctgggcccaaagctgtcggagacggttaagggaaagctgagcctgggcgcgcggatcctgcaggccggcggggtggagcgcgtgttccggcaggcgttctccgccgagaagggcgagcggctggtcaaggcgctgcagtgctacctctacaccaccggcggccccatcgccgggatgctcttcgtgtccaccaagaaggtcgccttccgcagcgaccgccccatcacggtggcctctcccaagggtgacacggcgcgggtgacctacaaggtggtgatcccgctccggaggatcggcaaggtgcggcccagcgagaacgccgacaggccggaggagaagtacatccacgtcgccacggtggacggcttcgagttctggttcatggggttcgtcagctaccagcggtcgttcaagtacatgcagcaggccgtctcggagctgcaatgacttgcacggccggcctggggcctggttgatgaggaggtccggtgcagtgctagtggctgccctgtcggcacgatgagaagaggatgttacgggttgcttcgccatcttttgttgcgaagtagccgtagctaggattgccccatctaatcccggatcggcgcaatttagttccttccgcgtacgatttggatcaactttgtgttgctccaagtggttgctttgtagcacggaccgagaaattaaccattttgtgcatgttcttgaatggaagagctcaccttttcgaattgtttccagttgtgcctttatgatcttgcactagtatgtatcagaagatttagggatttataacctgaaaatgttgtgaaactattattcaag

SEQ ID NO: 1614 - DNA, 955 bp, Pennisetum glaucum
ggccatgtcatcggagttccggtcacctccaaggcgtatggtatagaggaggggtcgtgcaggaagagcagcgacggcgatcaccttgctgtctcgctgacgcaccccagcccttacgcgtcgttcgactacaagcacggcagcaagggtcaggcgatccactgggtgagcaagctgagcaggcgggcgcaaggcttcagggagcatgtgaccctgggcccaaagctgtcggagacggtgaaggggaagctgagccttggcgctcggattctgcaggccggcggggtggagcgcgtgttccggcaggcgttctccgccgagaagggcgagcgtctggtcaaggcgctgcagtgctacctctacaccacgggagggcccatcgccgggatgctcttcgtttccaccaagaaggtcgccttccggagcgaccgccccatcacggtggcgtcgcccaagggcgacaccacggcgcgggtgacctacaaggtggtgatcccgctccggaggatcggcaaggtgcggcccagcgagaacgccgacaggccggaggagaagtacatccacgtcgccacggtcgacggcttcgagttctggttcatgggcttcgtcagctaccagcggtccttcaagtacgtgcagcaggctgtctcggagctgcaactgcaatgacttgcgcagccggacatggggcctggttgatgaggaggtccgccggtgcagtggctgccctgtcggcacgatgagaaggggatgttacgggttgattcgccatcttttgctgcgaagctgccgtagtagctaggattgccccatctaattccggatcggtgcaattaaattccttccgcgtacgatttggatcaactttttgttgctccaagtggttgctctgtagcacggaccgagaaattaaccattctgcgcgtgttcttgaaggcaagagcttaccttacga

SEQ ID NO: 1615 - DNA, 1165 bp, Brachypodium distachyon
ccaatccccgataccttactcgctaagtcaccagcgccaacgcacgcacgcagcctggtgagtccccattaagtgtcgatcgatctgcgttgagctcgatcaacttgcagctagcaccggcagtatcatccagcatcaatcgatcgatccaagatgaagtccagcagcggccatgtcatgggagttccggtgacctccaaggcgtatggcatagaagaggtgtcgaccagggatcagtcgtttcggaagcaggtcgacggcgatcaccttgctgtctcgttgacgcacccaagcccgtacacgtctttcggatataagcacagcagcaagggccaggttgtccactgggtgagcaagctgggcagaagggcacaaggcttccgtgagcatgtgacattgggcccaaagatatcggagacagtgaaggggaagctgagcctgggggcgaagatcctgcaggcaggcgggatcgagcgggtgttccggaaggcgttctcgaccgagaaaggcgagcggctggtgaaggcgctgcagtgctacctctacaccaccggcgggccaatcgccgggatgctcttcgtctccaccaagaaggtggccttccgcagcgaccggcccgtggcggtcacctcgcccaagggcgacgtggcccgggtgtcctacaaggtggtggtgccgctcaagaggatcggcaaggtgcggccgagcgagaacgccgacaggccggaggagaagtacatccacgtggccacggtggacgggttcgagttctggttcatggggttcgtcagctaccagaggtcctgcaagtacatgcagcaggccatctccgtctcgcagcagaaatgactaggggtggatgatgatgcgtggtggtcgtgtgttgttgttgttgttgttattgttgttgtttgttctgtcgtcgtcggcacgatgagaagaggagttttgggctactgcgccatcttttgctgcggagtagccctagctaggagaattgctcgatctcatttcggatcggagcagctcgagagttccttccgcgtacggtttgtatcggcttgtgttttgccttgcgattgctgtgtagggtgggtcgagaggtgggtcgagaaattaaccatgctgcatggtaatgaatggaaaggcagttgttcaaaaatca

SEQ ID NO: 1616 - DNA, 1056 bp, Zea mays
atggcgccctcggcagctgcactccggtaccaatccgcgattattccttgcacgctaaggcacggctctagaagtgtagaactagccatgatgaagaagtcgagcagcggccatgtcatcggggtcccggtcatctccaaggcgtacgggatagaggaggaggcgtccagggatccgtcgtccttcagcaagggcggcgacgtcgacgccgatcaccttgctgtctcgttcacgcaccccagcccttacgcgtctttcggctacaagcacagcagcagcaaccactgggtgagcaagctgagcagaagggcgcaaggcttcagagagcatgtgaccttgggcccgaagctgtcggagacggtgaaggggaagctgagcctgggcgcgcggatcctgcaggccggcggggtggagcgcgtgttccgccaggccttctccgccgccgacgacgacaagcagggggagcggctgctcaaggcgctgcagtgctacatctacaccaccggcgggcccatcgccggcatgctcttcgtctccaccaggaaggtggccttccgcagcgaccgccccgtcaccgtcgtcacctcctcctcctccccggccggggtcgtgcgcggcacggcgcgggtcacctacaaggtggtcgtcccgctccggaggatccgcagggtgcggcccagcgagaacgtccaccggccggaggagaagtacgtccacgtcgccaccgtggacggcttcgagttctggttcatgggcttcgtcagcttccagaggtcgtgcaggtgcatgcagcaggccgtctcggaggtgcagacgcaatgaatgaggatgttatgggctgggctgccatgtcggcacgatgtgaagagagaggatgttatgggcttgcttcgccgtcttttgttgccaagcagccgtagctaggattgccctgtctaatttagggtcggtgcaatcgagttccttccgcgtacgatattggaccaacatccgtgttgttccaaagtggtcgctttcattgtacttagtagtatatggaccgataaattaaccatt

SEQ ID NO: 1617 - DNA, 929 bp, Sorghum bicolor
tctcgactctcgagcaggggaaacgagagatcatccgacccagcaatggagtctaccgcgctaatgaccgcgaggttaccacttccgacctctggctcccgttccaaacccctctcccctgcctccttcactagggtggctcgccttctcgcctccgtccccttctgctccggcagcggcggcttcgtcttgctctcgcgccggagccgcgattatgccggcgttggtcccttggtctccgcggccgcggcttccggggatacggcggacgccggatccgagtccatcctgctcagtgtccaggggatgatgtgcgacgggtgcgccgcgagcgtgaagcggatcctggagagccaaccggaggttacttctgctaccgttgattataaggaagcaagtgcagttgtatggacaacagatgaggccaaggggacacaaggctggcagaagcagtatggagagaagcttgctaaacaccttggcacttgtggatttgagtctcgcgtacaagagtaaggtgaagccaaaaagaaccgatactgaagttcggatgtcacctcaatgagcaatttgtaccagcatctctgttactgagaattctggtacccaaattacatctttgctgtgcatggagctataagcctcagtgctagtgttgtggcataatactacgtacctacctttcccatgggctttagctaggtcatttggaatggaatagggtaatgtgctaaaattgtaggagtaggccattgttgcaaggaaggagtttgcactgtcttccccgttacttcgaagatataaagtgtactccctctatctcagtatgaatcatctgtcctaaaataaaacaacttctaaaatcattataagtcaaattatcttaaatttaagtgcttaacaaactttataagaaagaataacatcat

SEQ ID NO: 1618 - DNA, 725 bp, Saccharum officinarum
caacaatagtgcttatccttctatacctacctcccttgttctcgtcccttccattgtacctccagcccatcatacaaagacaagctaagactaagatcaccatggccaactccttgctcctcctcgtggcgctggtcgtcgccgggtgcacggctctggcctcggccacgacgtacaccgtcggcgactcgcagggctggacgaccaacttcgactacagcacctgggccagcggcaagagcttcgccgtcggagacaaactagtgttcagctacatgagcaaggcgcactcggtgacggaggtgagcaagagcggctacgacacctgctccggcaccaacccgctgagcgacgacgagagcggctccaccgtcatcacgctccagaccccggggacgcactacttcatctgcaacgtccccggccactgcgccaacggcatgaagctagccgtcgccgtcgccgccacgccatcgggaacgacgccttccgcggcgggcgccctgcaggtcccggcgatggcctccgtcgtcgccgcggccgccggcgctgcgatcaagctcgcgctcttctgacggagcacggctgtcgatcgtcagagtcgtctcagggtagagacagtgcatgcagctggctatgttcttggccgttgatggttcgtgtaatcggtgattgttcgccgtgcaagtcgctggcgattgttcgccgtgcagttcatgtatgta

SEQ ID NO: 1619 - DNA, 3919 bp, Oryza sativa
accacaaaagatatagtatatcttcaggacaaacgatagaaaagcaagcagacaacacacagagagcctcttgcttctctcctctcctcccctcctaccagctacctctccctcctcttcattctctctctaaaaaaaggcaaagaaaagcttgccgtgcttataaataagcttccccttctctccccgtgccggctcctcccctctcccccgatccccttcctccacctccaccccccacccgccgatcgccccccgcgagctcgtcccgtcgcggcgggcgatcgctccacccacccatccacctccaccttcccgcgcgattccccgagaggcgaggcgaggcgaggccgctatagctccgctccgctccccgaccaccacgacgcggctggcggcggatcctccactccacccacccaccccgcttccgccgatcggatcgcgtgctccccccgaggtagaggtgatgataaatcatagttagtgacttagcttgcagcagttctttcttgcagctaagacaaataataattggcgttatggcatatagaaatacggtatgcactccccaagtaattgatctagaaactgaacaagggcactctcatattcattctgaaagttttaatcgcactgggaatgattcatctgaccaaggtgcacaacatgctgtcagaggggtaggaaatgctacaaacattggtctatctgatatgcgaagttactatgatgcgggcatgaaccatccacatcaacctgttcataacttgcctccaaatttaggagttgattcaggttttgtcttcccatccagtatgtacaacccctgcatgtcgacaacatctatgaaccaatatgtttctcacactcagagcttcggattgccatcaaaccaagttgttctaggaagcatggatgaaggtagcagaaatgaaaatgctggtgaaagtgctagaggattcattaaaaggaaaaatgctgcagttgcaggaagttaccactgtgctaatggatttgcaagttcaagctcttctcatgcatctctgaatcctacacataggccatgggatccttcttttgagtcaaatgttttgcctaacactgcatcatataacccatcagagtaccatagccagaccagttggccatctatggaaggatcttccattcccagtaatggctttaatttgatgggtgctcacccagaatcagcacagcatggtaattatgcatttccaactagtcacatcagccagtgctttcaacctactagcaatacatggatttcccagtctgcaaatggtattgctgatggaataccacagtgggaatatgtcaatggaatgaataatgctccaggcagattttcccgttcaggtatgacagaaacagtgaatggaagcttccgtgaatatcagaatggcccttcaaccttatgtcgagggcctttaccctattttcatcagcatgctggcatgcatgctcataatctgcttgatcatacacaagtgcaagctccttaccaacaatgccacaataatcctgtcttacatggtgtaaatcattctggcaaccggttccatttgggtccaaggattccagttcttttctctaattctgaacgtacttttgggcctccacatcatccactcttggcaaatccagtgaaccacagaaatatacgaatcctgccacctgagcatgctacaataatggatttttcaagattgtatgaagtgtcaaatgttgtagatgagcatagagatatgcggctagatatagacagcatgacatatgaggagcttttagcattagaagagcagattggagatgtaaatactggtctggcaaaaagctacattgtagagaaattgaagactagcttatttgtgccaggatcatcctgcatgtctaataagtcttctgaatcttccatggagaatgatgcttgcataatatgccaggaagagtatcaggttaaagaatgcattggaacccttgactgtggccacaggtaccacgaagattgcataaaacaatggttgatggtaaagaatttatgccccatctgcaagacgacagctttgtcaaccggaagaagaagtggataacgaacaggaataatcttattagttatttacttccgacaaatattcagctcaattttgtatataagaaacggtagaccattctgctacctgtatttgttgctcactttgttgtgatccgggagtaactcagcttcctaaactgtacagccataacattgatcattttcttcggtgtagaatattttaaattactcagttcgcccccatctgtatcataaggcggaccgacaaaaaaactcacaatgtcatttctaggcaaacattgtatctaccatcagattaaaaatcagaacagaacatgtgctcttctgtacattttgttttctcctaattccgtaactcgggaggaccaaaaagattcttatggtcgtcggagcgtgattgcatcgattcgccttttgtttgtttatgcattgttcgccccaaattatctgtcgcacgtccatttgattgccttgattcgtcttttgattgtttatgcatcgttcgtcacaaattatcatccgtcgcacgtctatctgggtggcatttctcgaaacgccacggcttatatcaaaatttgggcaaattatctgtcgagcttgaattagtctctcatttctctccggtcccaaaatgcatgtcgctatctctgatcaacaaatacacgtcttcaaaatgcaaccttttgatcccaattctcaagtttgtagtatcaatcagcagtgacgaaaacacacggtataaacaaagctgtgaacggtggcaatttgcatagctcgacgacgatgagtttgagcgagtcaaagtcaagacgagcagcaccctgagctgttcacgggggtgacggcgtcatccttggcgctgacgtcgatggtccgcccccggggcggcgcggcggggtcgtcgccgatgtcgagcgcgttccggctgacgacgcggtagatctgcgcgagcacctcggtgaaggcgccctccacgttggtggcctccagcgccgacgtctccatggagaaggtcccgtgcgcctcggcgaacgccctggcgtcctccgcggggacggcgcggaggtggcgcaggtcggccttgttgcccacgagcatgacgacgatgttggcgtccgtgtggtcgcggagctccttgagccaccgctccgcgttctcgaacgtgatgcggcgcgtcacgtcgtacaccaccagcgcgcccaccgcgccgcggtagtaggcgctcgtgatggcgcgtaatggtacctctcttggccggcggtgtcccagatctgggccttgacgagcctgtcgtcgacgcggacggtcttggtggcgaactcgacgccgatggtggacctggtctccaggctgaactcgtcccgcgcgaaccgcgacagcaggttcgacttccccacgccgctgtccccgatcagcaccaccttgaacaggtagtcgtactcctcctccgccctgtaccccgccgccgccgccgccgccgccatccccccctcctctcgagcctcgactacgtgcaagcccgcaacccaccgatccgccgattcgctccgcctcccccgcgcgttgagctggatgcagcgagcgagcgcaccgcttcccttcaattatacccacgcggctcggcgcggcgcggcgcgttctctcttcttttcgggcgaggttgctttggatttttgggggaaaaaggaaaagaaaggcgtgtggagtgtggtcgcgtggcgcggtgcggacgaggtcgccgcggttagctgcgggttgttgccccccgcgtcgcgctgctctgtctttggtttggtcgtattattatcgggcggtgcgagg

SEQ ID NO: 1620 - DNA, 1264 bp, Hordeum vulgare
ggagacgaagccaggaccgggacaacgggtcgatcgatggtcgtcgtcatctctcgcttggccttctccacctcccacgaaaccaacaccatccgccgcgacctcttcttcccttcccaccccagcccccctgagatacttttccccaaagcgaaaccaactggaaagaagagagacgcgccgcgcctcatcgcatcgcaccgcaccgcaccgcgttgcctttgtatctatcgcggctctatttagctcaagaagaggagaggggaggcgcgcgggaaggggggcgagatcaaatcaagatcaaatcgtaggaaaccgtcggtcgatcgagcagcggcgacgcagaagcaggaggggggatggcggtggcgtatcgcgcggaggaggagtacgactacctgttcaaggtggtgctgatcggggacagcggcgtgggcaagtccaacctgctgtcgcgcttcgccagggacgagttcagcctcgacaccaggtccaccatcggcgtcgagttcgccaccaagaccgtccgcgtcgacggcaagctcgtcaaggcgcagatctgggacaccgccggccaagaaaggtaccgggccatcaccagcgcctactaccggggcgccgtgggcgcgctcgtggtgtacgacgtgacgcgccacatcacgttcgagaacgcggagcggtggctgacggagctgcgcgaccacacggacgccaacatcgtggtgatgctggtcgggaacaaggcggacctgcgccacctcagggccgtctcgccggaggaggccagggccttcgcggagcgccaccgcaccttctccatggagacgtccgcgctggaggccaccaacgtggaggacgccttcaccgaggtgctgggcgagatctaccgcgtcgtcagcaagaaggcgctcgacatcggcgacgaccccgccgcgccgcccaggggcaagaccatcgacgtcggcgccaaggacgacgtcaccccggtgaactcgggcggctgctgctcggcttagtcaaaactcggttggtgtggtgatgccgtgtgtgcgtgctaggacatgaagggcatgtcgcagaccgtgatgattattttggtcaaaacgctctgggggtggttgacacgacatgcttgattgatatgatgatactccatacagcgtgttatactgggagaagacgtcgtgctgtgctgttgcaaagttgcagccgcggtccgcatctgtgttccatttcattcgttggtctgtttggtgcggttgag

SEQ ID NO: 1621 - DNA, 1034 bp, Leymus cinereus x Leymus triticoides
cttcccttcccagcccccctgagatacttccccccaactgaaaagacgcgccgcgccgcgccgcaccgcaccgcaccgcgttgccttttgtattgtggctctatttagctcaagaggagaggcgcgcgggaaggggaaggagatcaaatcgtacgagaccatcgattgatcgcagaagcaggaagcaggtattaggaggggaggggtatggcggtggcatatcgcgcggaggaggagtacgactacctgttcaaggtggtgctgatcggggacagcggcgtgggcaagtcgaacctgctgtcgcgcttcgccagggacgagttcagcctcgacaccaggtccaccatcggcgtcgagttcgccaccaagaccgtccgcgtcgacggcaagctcgtcaaggcgcagatctgggacaccgccggccaagaaaggtaccgagccatcaccagcgcatactaccggggcgccgtgggcgcgctcgtggtctacgacgtgacgcgccacatcacgttcgagaacgcggagcggtggctgacggagctccgcgaccacacggacgccaacatcgtggtgatgctggtcgggaacaaggcggacctgcgccacctgagggccgtctcgcccgaggaggccagggccttcgcggagcgccaccgcaccttctccatggagacgtcggcgctggaggccaccaacgtggaggacgccttcacggaggtgctcggcgagatctaccgcgtcgtcagcaagaatgccctcgacattggcgacgacccggccgcgccgcccaggggcaagaccatcgacgtcggcgccaaggacgacgtcaccccggtgaacacgggcggctgctgctcggcttagtcaaaccctctctctctctctctctctctctctctctctctctgccggagggagacggtggttggtgataccgtgtgcgtgctaggatatgacagacatgttgcgaccgtgatgattattggtcaaaacgctctgggggtggttgatacgcttgattgatatttgataca

SEQ ID NO: 1622 - DNA, 1499 bp, Zea mays
cctcgttgtctgtctgtcactttgtccacctcagcagtcaccacgcgtcccaactgccagtgccaacccagtctccaaggccacaaccacggctcccggctggctccaggctctagttccaacctccacctgcgccgcccgatagcaaaacgcagcgacctcgccccccctgccccgctcctccccttttcccggtagcagagacggagcaccgcagcccgccagaaaggaagacgaaacgcgccgcggcgcaacgcaccgcgtgctagtgaaagggcgcagcggaaggccgccgccgcgctgctatttagacaggaagcggggcgatcgaatcgcgtctctcaaccaatcgataaatctgccggtaggtcgatcaaggagagcgcggtccacgtctccgttccgttccgttgcggggaaggaaggaaggagagagaggagcgatggcgtccgggtaccgcgcggaggaggagtacgactacctgttcaaggtggtgctgatcggggacagcggcgtggggaagtcgaacctgctgtcgcggttcgccagggacgagttcagcctcgagaccaggtccaccatcggcgtcgagttcgccaccaagaccgtccaggtcgacgacaagctcgtcaaggcacagatctgggacaccgccgggcaggagaggtaccgcgccatcacgagcgcatactaccgcggcgcggtgggcgcgctggtggtgtacgacgtgagccgccgcaccaccttcgacaacgcggagcgctggctgcgggagctgcgggaccacacggacgccaacatcgtggtcatgctggtgggcaacaaggccgacctgcgccacctccgcgccgtctcgcccgaggacgcggcggccttcgccgagcggcacggcaccttctccatggagacgtcggcgctggacgccaccaacgtggagcgcgccttcgccgaggtgctccgccagatctaccacgtcgtcagccggaacgcgctcgacatcggggacgaccccgccgcgccgcccaggggcaagaccatcgacgtcagcgccgccaaggacgaggtctcccctgtgaacgcgggcgggtgctgctcgtcggcttagccctggtcaaacatacgctttgctgattaaggaagacataacgtgatgacaatctttgttgacttcgtcaagcggttgggggtggttggcgctcgtgatgtgtttgcagactagcaatcgctgtcctcgattgtatttttcgggctattttttgattgatgcacttgggtgacgcacacatttacaagtggcaggttatggaccatatggggagcgatttacactgatttggatgaaatattgacatgttttgacaacttcgagcaaaaaaacatggataaattgccattttgatgccgtcatcttcaaaaaaaaatgtacagcaggatccatgttctattaattccatcaaagtaaataaatatatacagtgctgcctacgcctacctagag

SEQ ID NO: 1623 - DNA, 1284 bp, Setaria italica
agccgcgcaaccgcggcgacctcgtccccccaccccactcctccgtcttccccgtagcagcgcagcccaccaaaaagaagaagaaacgcgccgcgccgcgccgcaccgcgttgcccagcgccgcgtccgcggttatatgattggggcgggggcagaggaaggccggcgccgcgctgctcctgctatttagagagcccgcaccgtcgcgcgggaagcgggagcgatcgaatcgtatcaatctatcgacaaaccaatccaatcagtcgatcgatcgatcgaggagagcgccctgcacgtctcccggttgtgaggggaagagagaggtatagagatggcggcggggtaccgcgcggaggaggagtacgactacctgttcaaggtggtgctgatcggggacagcggcgtgggcaagtcgaacctgctgtcgcggttcgccagggacgagttcagcctcgagaccaggtccaccatcggcgtcgagttcgccaccaagaccgtccaggtcgacggcaagctcgtcaaggcgcagatctgggacaccgccggccaggagaggtaccgcgccatcacgagcgcatactaccgcggcgcggtgggcgcgctggtggtgtacgacgtgacccgccgcgtgacgttcgagaacgcggagcggtggctgcgggagctgcgggaccacacggacgccaacatcgtggtcatgctggtgggcaacaaggccgacctgcgccacctccgcgccgtctcgcccgaggacgccgccgccttcgcggagcgccacggcaccttctccatggagacgtcggcgctggacgccaccaacgtggagcgcgccttcgccgaggtgctccgccagatctaccacgtcgtcagccggaacgcgctcgacatcggggaggacccggccgcgccgcccaggggcaagaccatcgacgtcggtgccgccaaggacgaggtctcgcccgtgaacacgggcgggtgctgctcggcttgacaccctggtcaaacaaagaaatgctttgctggttaaggaagacaacgtgatgacaatcttttcttgacatggtcaagcggttggggtggttggggctcgacatggacaccgtgttttggagagggcagcatgttgttttacaaccttgcaatcgctgtcgtcgtgtgtattcatcagcccatttgattgatacggtagcatatataattataagtgacaggttatgacttttgaaaatccgtcatgcagatatattgacaatgggaatttgcagtgcttttcaccgatttgaa

SEQ ID NO: 1624 - DNA, 948 bp, Pseudoroegneria spicata
cctcaccgcagcgcaccgcgtcgcctttgtatcgcggctctatttagctcaagacgggaggagaggcgcgcgggaaggggaaggagatcaaatcagatcaaatcgtagtttgtagaaaaccatcgagtgatcgagcagcgtcgacgcagaagcagcaggaagcaggagggagcggggatggcggtggcgtatcgcgcggaggaggagtacgactacctgttcaaggtggtgctgatcggggacagcggcgtgggcaagtccaacctgctctcgcgcttcgccagggacgagttcagcctcgacaccaggtccaccatcggcgtcgagttcgccaccaagaccgtccgcgtcgacggcaagctcgtcaaggcgcagatctgggacaccgccggccaagaaaggtaccgggccatcaccagcgcgtactaccggggcgccgtgggcgcgctcgtggtgtacgacgtgacgcgccacatcacgttcgagaacgcggagcggtggctgacggagctccgcgaccacacggacgccaacatcgtggtgatgctggtcgggaacaaggcggacctgcgccacctgacggccgtctcgcccgaggaggccagggccttcgcggagcgccaccgcaccttctccatggagacgtcggcgctggaggccaccaacgtggaggacgccttcacggaggtgctcggcgagatctaccgcgtcgtcagcaagaaggccctcgacatcggcgacgaccccgccgcgccgcccaggggcaagaccatcgacgtcggcgccaaggacgacgtcaccccggtgaacacgggcggctgctgctcggcttagtcaaactctctctctctctctctctgccggagacggtggtaggtgatgccgtgtgtgtgcgtgctagggtgtaacaggcatgttgcgaccgtgatgattattgattattggtca

SEQ ID NO: 1625 - DNA, 1012 bp, Secale cereale
gcacaggcaacagcccatccgccggcggacccccttctcccctccccggacgataacttttccccaaacgcgaacccagctgaaaagaagcgagccgcgccgcgccgcaccgcgttgcctttgtatcgtggccctatttagctcaagaggagaggagaggcgcgcgggaaggggaaggagatcaaatcagatcaaatcgtaggaaagccatcgattgatcgcagaagcagcaggaagcaggaggggagggggatggcggtggcgtatcgcgcggaggaggagtacgactacctgttcaaggtggtgctgatcggggacagcggcgtgggcaagtccaacctcctgtcgcgcttcgccagggacgagttcagcctcgacaccaggtccaccatcggcgtcgagttcgccaccaagaccgtccgcgtcgacggcaagctcgtcaaggcgcagatctgggacaccgccggacaagaaaggtaccgggccatcaccagcgcctactaccggggcgccgtgggcgcactggtggtgtacgacgtgacgcgccacatcacgttcgagaacgcggagcggtggctgacggagctccgcgaccacacggacgccaacatcgtggtgatgctggtcgggaacaaggcggacctgcgccacctgagggccgtctcgcccgaggaggccagggccttcgcggagcgccaccgcaccttctccatggagacttccgcgctggaggccaccaacgtggaggacgccttcaccgatgtgctcggcgagatctaccgcgtcgtcagcaagaaggccctcgacatcggcgacgaccccgccgcgccgcccaggggcaagaccatcgacgtcggcgccaaggacgacgtcaccccggtgaacacgggcggctgctgctcggcctagtcaaactctatctctctctccctctgccggagacggcggtaggtgatgccgtgtgtgtgcgtgctagggtgtaacaggcaggatgattattgatttttggtca

SEQ ID NO: 1626 - DNA, 1057 bp, Secale cereale
gttgcctttgtatcgtggccctatttagctcaagaggagaggagaggcgcgcgggaaggggaaggagatcaaatcgtaggaaagccatcgattgatcgcagaagcagcaggaagcaggaggggagggggatggcggtggcgtatcgcgcggaggaggagtacgactacctgttcaaggtggtgctgatcggggacagcggcgtgggcaagtccaacctgctgtcgcgcttcgccagggacgagttcagcctcgacaccaggtccaccatcggcgtcgagttcgccaccaagaccgtccgcgtcgacggcaagctcgtcaaggcgcagatctgggacaccgccggccaagaaaggtaccgggccatcaccagcgcctactaccggggcgccgtgggcgcgctggtggtgtacgacgtgacgcgccacatcacgttcgagaacgcggagcggtggctgacagagctccgcgaccacacggacgccaacatcgtggtgatgctagtcgggaacaaggcggacctgcgccacctgagggccgtctcgcccgaggaggccagggccttcgcggagcgccaccgcaccttctccatggagacttccgcgctggaggccaccaacgtggaggacgccttcaccgatgtgctcggcgagatctaccgcgtcgtcagcaagaaggccctcgacatcggcgacgaccccgccgcgccgcccaggggcaagaccatcgacgtcggcgccaaggacgacgtcaccccggtgaacacgggcggctgctgctcggcctagtcaaactctctctgccggaggcggtggtaggtgatgccgtgtgtgtgcgtgctagggtgtaacaggcatgtcgcgaccgtgatgattattgatttttggtcaaaacgctctgggggtggttgatacctcgatatcatatgcttgattgatacatacagcgtctagtaccgagagaagacgtcgtgcgtgtgctgttgcaagttgcaaccacggtccgcgtcttgtattcattccgtttcattgctcagtttggtgcagttcaggtccaaaa

SEQ ID NO: 1627 - DNA, 1214 bp, Saccharum officinarum
gaaacgggcccctccgcaccgcgttgccctgcccagcgccgcgttataattgaggcggggggcagacagagaggaaggccggcgccgcgctgctatttacacaggaagcggagcggggcagacagagaggaaggccggcgccgcgctgctatttagacaggaagcggggcgatcgagtcgcgccaaccaatcgatcgatcaatcggccggtagttcgatcagcgagagcgcgttccgcctctccgttcgttccgttgcgggccgggaggaaggagaaagagagatggcggcggggtaccgcgcggaggaggagtacgactacctgttcaaggtggtgctgatcggggacagcggcgtcgggaagtcgaacctgctgtcgcggttcgccagggacgagttcagcctcgagacgaggtccaccatcggcgtcgagttcgccaccaagaccgtccaggtcgacgacaagctcgtcaaggcgcagatctgggacaccgccgggcaggagaggtaccgcgccatcacgagcgcatactaccgcggcgcggtgggcgctctggtggtgtacgacgtgacgcgccgcatcaccttcgacaacgcggagcgctggctgcgggagctgcgggaccacacggacgccaacatcgtggtcatgctggtgggcaacaaggccgacctgcgccacctccgcgccgtgacgcccgaggacgccgcggccttcgcggagcggcacggcaccttctccatggagacgtcggcgctggacgccaccaacgtggaccgcgccttcgccgaggtgctccgccagatctaccacgtcgtcagccggaacgcgctcgacatcgggcacgaccccgccgcgccgcccaggggcaagaccatcgacgtcggcgccgccaaggacgaggtctcccccgtgaacgcgggcggctgctgctcggcttagcttttcgtttcgtttcgtttcttttttcggttgggatagccctggtcaaacatacgctttgctgagtaagttaaggaagacaaaacgtgatgacaatctttcttgacattgtcaagtcaagcggttgggggtggttggcgctcgacattgacaacgtggtttggagagggcgccacgatgttttgcttgcagacttgcaatcgctgtcctcgattgtatttctcgggctatttgattgatacactagtatacatttacaaagtggcaggct

SEQ ID NO: 1628 - DNA, 1170 bp, Triticum aestivum
ccatccgcggcgaccccttcttcccttccctgagacacttctccccaaagcgaaccaacccagctgaaaagaagcgagacgcgccgcaccgcgttgcctttgtatcgtgcctctatttagctcaagagggagaggataggagaggcgcgcgggaaggggaaggagataaaatcagatcaaatcgtaggaaaccatcggttgatcgagcagcggcggcggcgcagaagcagcaggaagcaggaggggaggggggatggcggtggcgtatcgcgcggaggaggagtacgactacctgttcaaggtggtgctgatcggggacagcggcgtgggcaagtccaacctgctgtcgcgcttcgccagggacgagttcagcctcgacaccaggtccaccatcggcgtcgagttcgccaccaagaccgtccgcgtcgacggcaagctcgtcaaggcgcagatctgggacaccgccggccaagaaaggtaccgggccatcaccagcgcgtactaccggggcgccgtgggcgcgctcgtggtgtacgacgtgacgcgccacatcacgttcgagaacgcggagcggtggctgacggagctccgcgaccacacggacgccaacatcgtggtgatgctggtcgggaacaaggcggacctgcgccacctgagggccgtctcgcccgaggaggccagggccttcgcggagcgccaccgcaccttctccatggagacgtccgcgctggaggccaccaacgtggaggacgccttcacggaggtgctcggcgagatctaccgcgtcgtcagcaagaaggccctcgacatcggcgacgaccccgccgcgccgcccaggggcaagaccatcgacgttggcggcaaggacgacgtcaccccggtgaacacgggcggctgctgctcggcctagtcaaactctctccctctttctctctgccggagacggtggtaggtgatgccgtgtgtgtgcgtgctagggtgtaacaggcatgttgcgaccgtgatgattattgattattggtcaaaacgctctgggggtggttgataccttgatatcatatgcttgattgatacatacagcgtgtagtactaccgagagaagacgtcgtgcgtgtgctgttgcaagttgcaaccatggtccgcgtctgtgttcactccatttcattggtc

SEQ ID NO: 1629 - DNA, 1570 bp, Panicum virgatum
agagcagcgcgaccgcggcgacctcgtcccccctgcctgccgcccccaccctcctctctcctcttcttccccgcagcagcgccagcccaccagatagaagagacgcgccgcgccgcgttgcccagcgccgcgtcctccgcgtggttgggggctgcttatgattgaggcgggggccggcgccgcgcctgctatttagggagcccgcaccgccgcgcgggaagcggagcgatcgaaccgtagcaatcgatcgatcaatcaatcaatcagcctgccgatcgaccgatcgaggagagcgccctgcacgtctgctgcggcctgcgggggagggggggagatggcgtcggggtaccgcgcggaggaggagtacgactacctgttcaaggtggtgctgatcggggacagcggcgtcggcaagtccaacctgctgtcgcggttcgccagggacgagttcagcctcgagaccaggtccaccatcggcgtcgagttcgccaccaagaccgtccaggtcgacgacaagctcgtcaaggcgcagatctgggacaccgccggccaggagaggtaccgcgccatcacgagcgcctactaccgcggcgcggtgggcgcgctggtggtgtacgacgtgacccgccgcgtgacgttcgagaacgcggagcggtggctccgggagctgcgggaccacacggacgccaacatcgtggtcatgctggtgggcaacaaggcggacctgcgccacctccgcgccgtctcgcccgaggacgccgcggccttcgcggagcggcacgggaccttctccatggagacgtccgcgctggacgccaccaacgtggagcgcgccttcgccgaggtgctccgccagatctaccacgtcgtgagccggaacgcgctcgacatcggggaggaccccgccgcgccgcccaggggcaagaccatcgacgtcggcgccgccaaggacgaggtctcgcccgtggacgcgggcgggtgctgctcggcttgagccttttttccctttccccctttttagccctggtcaaacgatgagacgctttcctggtaaccaaacagggcctaaggaagaaaagacaggacgtgctgccaactgccgcaatctttcttgacaattgacagggtcaagcggttggggtttgttggcgctcgacaattgacaccgtgttttggagagggccgcatgttgttttccaaccttgcaatcgctgtcctagtgtgtattcatcggcccgcccatgatacggtagcatatagtacatataattattataattattacaagtgaaaggttatgacttgtgaatgtagtctttgcatgttgaactgggatgtgcaattgtgagcacgaccgtcgacgaagtgcacgcttaaagaaaatatgaacactcaaaactcaaactgcagaaaagctatcctcagtggatgcagtgatgccaccatcactgattcatcgtccagggtcatttaggccctgtcaaagttctaaaaaatgtacaggaggatccatgctgtattagtttcattaaagttaacatagatacaaggctgcctagcgatgccatta

SEQ ID NO: 1630 - DNA, 1489 bp, Sorghum bicolor
aagcctccaacctcctccctcccgcgccgccccgatagcacctcatcacaaacaaacaaacagagcagcgcaagcgcaacacaagaacaacaacccgtagcaaaacgcggcgacctcgtctgtcgtctcccctgcccctccccctccccctttttccccgtagcagaggcaccagaaagaaagacgaaacgcgccgagccgcgccgcaccgcgttgccctgccctgcccagcgccgccgcgtccgcgtggaagtggaagtggaaggggttataattgaggcgcgggggagagcaaggccggcgccgcgctgctatttagccaggaagcggggcgatcgaattcgaatcgcgccgaccaaaccaatccgatcgatcgatcagccggtacccggtagttcgatcaacgagagcgagcgcgttccttccacgtctccgttccgttgcgggccgggaggaaggagagagagagagagagggagaaagagagatggcgtcggggtaccgcgcggaggaggagtacgactacctgttcaaggtggtgctgatcggggacagcggcgtgggcaagtcgaacctgctgtcgcggttcgccagggacgagttcagcctcgagaccaggtccaccatcggcgtcgagttcgccaccaagaccgtccaggtcgacgacaagctcgtcaaggcgcagatctgggacaccgccgggcaggagaggtaccgcgccatcacgagcgcatactaccgcggcgcggtgggcgcgctggtggtgtacgacgtgacccgccgcatcaccttcgacaacgccgagcgctggctgcgggagctgcgggaccacacggacgccaacatcgtggtcatgctggtgggcaacaaggccgacctgcgccacctccgcgccgtgacgcccgaggacgccgcggccttcgcggagcggcacggcaccttctccatggagacgtcggcgctggacgccaccaacgtcgaccgcgccttcgccgaggtgctccgccagatctaccacgtcgtcagccggaacgcgctcgacatcggggaggaccccgccgcgccgcccaggggaaagaccatcgacgtcggcgccgccaaggacgaggtctcccccgtgaatacgggcggctgctgctcggcttagcttttttttatttcgtttcgtttcgtttcttttttttttcccccgttgggatagccctggtcaaacatacatacagtacgctttgctgattaagaaagacaaaacgtgatgacaatcttctttcttgacactgtcaagcggttgggggtggttggcgctcgacattgacaacgtggtttggagagggcaccatgatgttttgcagacctgcaatcgctgtcctcgattgtatttctcgggctattcgattgatacactagtagtacatgtacatttacaaagtggccggctatgacctttgtactgtcatacatatagggaaagcgattgaaactgatttgg

SEQ ID NO: 1631 - DNA, 1531 bp, Panicum virgatum
ccccgcaggccgcagcagcgccagcccaccagaaagaagagacgcgccgcgccgcgtggttggggggcggcttatgattgaggcgggggccggcgccgcgcctgctatttagagagcccgcaccgtcgcgcgggaagcggagcgatcgaatcgtatcggccgagcaatcaatcagcctgcctgctgctgcgggagagatggcgtcggggtaccgcgccgaggaggagtacgactacctgttcaaggtggtgctgatcggggacagcggcgtgggcaagtccaacctgctgtcgcggttcgccagggacgagttcagcctcgagaccaggtccaccatcggcgtcgagttcgccaccaagaccgtccaggtcgacgagaagctcgtcaaggcgcagatgtgggacaccgccggccaggagaggtaccgcgccatcacgagcgcctactaccgcggcgcggtgggcgcgctggtggtctacgacgtgacccgccgcatcacgttcgagaacgcggagcggtggctccgggagctgcgggaccacacggacgccaacatcgtggtcatgctggtgggcaacaaggccgacctgcgccacctccgcgccgtctcgcccgaggacgccgcggccttcgcggagcggcacgggaccttctccatggagacgtccgcgctggacgccaccaacgtggagcgcgccttcgccgaggtcctccgccagatctaccacgtcgtcagccggaacgcgctggacatcggggaggaccccgccgtgccgcccaggggcaagaccatcgacgtcggcgccgccaaggacgaggtctcgcccgtgaacgcgggcgggtgctgctcggcttgagcctttttcctttttcctttcctcccctttagcccctggtcaaacaatgaaacgctttcctggttaaggaagacgagaggacgtgctgccaactgccgcaatcttgcttgacatggtcaagctgttggggtggttggcgctcgacattgacaccgtgttttggagagggccgcatgttgttttccaaccttgcaatcgctgtctaaagcatgtattcatcggctgatcggcccatatgattgatacggtagcatatagtactatataattattacgagtgacagacaggttatgaattctgaaattccgtcatactgatatgttggcgctggaaatttgcagtgcttttcacctatttggatgtagtctttgcatgttgaactgggatgtgtaattgtgagcacgaacgtcgacaaattcaccgtgttcggctggtgtaccagcctccagccctacagtatttctctctcacaccgctccagcaccagcctctagccaccagtcaggcaacagtgtttttctctcacaccactccagctccagcctgtcgaacagatgcattgtgagcaagaaaatatgaacactcagaactcaaattgcagaaaaactatcctcagtgggtgcaatgatgccaccaccatcactgactcatcgtccagggtcattttagccct

SEQ ID NO: 1632 - DNA, 1159 bp, Panicum virgatum
  misc_feature (88)..(88): n is a, c, g, or t
  misc_feature (215)..(218): n is a, c, g, or t
  misc_feature (221)..(221): n is a, c, g, or t
  misc_feature (223)..(223): n is a, c, g, or t
  misc_feature (225)..(225): n is a, c, g, or t
  misc_feature (232)..(232): n is a, c, g, or t
  misc_feature (235)..(235): n is a, c, g, or t
  misc_feature (241)..(241): n is a, c, g, or t
  misc_feature (243)..(245): n is a, c, g, or t
  misc_feature (254)..(254): n is a, c, g, or t
  misc_feature (259)..(260): n is a, c, g, or t
  misc_feature (301)..(301): n is a, c, g, or t
  misc_feature (316)..(316): n is a, c, g, or t
  misc_feature (779)..(779): n is a, c, g, or t
aacagagcagcgccaccgcggcgacctcgtccccccaccctccctcctcttcttccccgcaggccgcagcagcgccagcccaccaganagaagagacgcgccgcgtcctccgcgtggttgggggctgcttatgattgaggcgggggccggcgccgcgcctgctatttagggagcccgcaccgccgcgcgggaagcggagcgatcgaaccgtagcnnnngancnancaatcantcnatcagncnnncgatcgacngatcnnggagagcgccctgcacgtctgctgctgcgggagagatggcntcggggtaccgcgcngaggaggagtacgactacctgttcaaggtggtgctgatcggggacagcggcgtcggcaagtccaacctgctgtcgcggttcgccagggacgagttcagcctcgagaccaggtccaccatcggcgtcgagttcgccaccaagaccgtccaggtcgacgacaagctcgtcaaggcgcagatctgggacaccgccggccaggagaggtaccgcgccatcacgagcgcctactaccgcggcgcggtgggcgcgctggtggtgtacgacgtgacccgccgcgtgacgttcgagaacgcggagcggtggctccgggagctgcgggaccacacggacgccaacatcgtggtcatgctggtgggcaacaaggcggacctgcgccacctccgcgccgtctcgcccgaggacgccgcggccttcgcggagcggcacgggaccttctccatggagacgtccgcgctggacgccnccaacgtggagcgcgccttcgccgaggtgctccgccagatctaccacgtcgtgagccggaacgcgctcgacatcggggaggaccccgccgcgccgcccaggggcaagaccatcgacgtcggcgccgccaaggacgaggtctcgcccgtggacgcgggcgggtgctgctcggcttgagccttttttccctttccccctttttagccctggtcaaacgatgagacgctttcctggtaaccaaacagggcctaaggaagaaaagacaggacgtgctgccaactgccgcaatctttcttgacaattgacagggtcaagcggttggggtttgttggcgctcgacaattgacaccgtgttttggagagggccgcatgttgttttcc

SEQ ID NO: 1633 - DNA, 1563 bp, Brachypodium distachyon
cttttgccaatccaactcgcgtccaatctgccgcaagcgagcgagcgagcggccgataaataaaaaaagatcagcgaggcaacccccggcgacctcttcgcgtttctttcccccaaagcatcaaagcaaaacccaaccgaaaagaagagaaacgcgccgcgcccgcaccgcacggctctgctctagtatttagctcctcgcaccggcgcgcgggaaaggggaacgagatcaaatcaaacggcaaggccggccacgcagattcggtattggggtgagttcaggaagtcttgagggagagagagatggcggtggcgtaccgcgcggaggaggagtacgactacttgttcaaggtggttctgatcggggacagcggcgtgggcaagtccaacctgctgtcgcggttcgcgagggacgagttcagcctcgacaccaggtccaccatcggcgtcgagttcgccaccaagaccgtccaagtcgatggcaagctcgtcaaggcgcagatctgggacaccgccggccaagaaaggtacagagccatcacgagcgcctactaccggggcgcggtgggcgcgctggtggtgtacgacgtgacgcggcacatcacgttcgagaacgcggagcggtggctggcggagctccgcgaccacacggacgccaacatcgtggtgatgctggtggggaacaaggcggacctgcggcacctgagggccgtgccgccagaggaggccagggcattcgcggagcggcaccgcacattctccatggagacctccgcgctggagtccaccaacgtggagggcgccttcacggaggtgctcggcgagatctaccgcgtcgtcagcaagaaggcgctcgacatcggcgacgaccccgccgcgccgcccaggggcaagaccatcaacgtgggcgccgccaaggatgaagtctctccggtgaacacggggggttgctgctcggcttaaactttgctactccagctcgattggtatgtacgtggttgctgatggatggattgatgggggcacgttgtgttgcacttgttgcatgatgttgcgatcgtgatggatttgtggaacgctcctttgcattggggtgccgtggtggttgattgggtagtatgctcgattgatatgatattcattggtctgcttgatcctgcatcagtttgctgctgtttaggtccaaaagatgcctcacaggccagaggccgtggctactttgtcagtaagcgccgactggatgaacgttaggatatagtattgcgagatgcatttggaaccaaaacacactaccattcctttctcacaatccatcttctctccctttgacgtaccagtccagtcacaaccacaaccttttttcctcaccatagaaacaaaatggattggagcttcgaaggaccccttgcaaagagtcatgtttgccaatggagtattgtgcttttaccaggtgtgaatcagtgtgttgtggctgattttggacacgaaaaactcatcatttgtaatctcgttcgtggtaatataatacagatggagaccttctcccccgttgattacctcgaaa

SEQ ID NO: 1634 - DNA, 974 bp, Avena sativa
ggcgcttgcggtatttatctcctcataccggcgcgcggaagggcggggacgagatcaaaactgccgcgactcgaatcaagggatcgatcgagcagcaatcccggacgccagaggagtccgaggagagagatagagagagatggcggttgcgtaccgcgcggaggaggagtacgactacctgttcaaggtggtgctgatcggggacagcggcgtgggcaagtcgaacctgctgtcgcggttcgccagggacgagttcagcctcgacaccaggtccacatcggcgtcgagttcgccaccaagaccgtccgcgtcgacggaaagctggtcaaggcgcagatctgggacaccgccggccaggaaaggtaccgagccatcaccagcgcgtactaccgcggggcagttggcgcgctggtggtgtacgacgtgacccgccacatcacgttcgagaacgcgcagcggtggctgacggagctccgggaccacacggacgccaacatcgtggtgatgctggtcgggaacaaggcggacctgcgccacctcagggccgtcacgcccgaggagtccagggccttcgcggaggtgcaccgcacattctccatggagacgtccgcgctggagtccaccaacgtggaggaggccttcacggaggtgctcggggagatctaccgcgtcgtcagcaagaagacgctcgacatcggagaagacccggccgcgccgcccagggcaagaccatcaacgtcggcgacgtctccccggtcaacaccggctgctgctcctcggcttagttgtccggagacgtggttggtgatgccgtgtgcgtgctaggacatgatgatcgacgcagattgacggcacgttttgttgcgcttagcatgttgccatctgatgattattggttgttcatgcggctgggtacttggggttggttcatacttgatactacttcttctttgcctgattgatactactagtac

SEQ ID NO: 1635 - DNA, 631 bp, Pennisetum glaucum
ttgcgggaggaaggaagagggagaggcggagatggcagggggttaccgcacggaggaggagtacgactacctgttcaaggtggtgctgatcggggacagcggcgtcggcaagtccaacctcctgtcgcggttcgccagggacgagttcagcctcgagaccaggtccaccatcggcgtcgagttcgccaccaagaccgtccaggtcgatgacaagctcgtcaaggcgcagatgtgggacaccgccggccaggagaggtaccgcgccatcacgagcgcatactaccgcggcgcggtgggcgcgctggtggtgtacgacgtgacccgccgcgtgacgttcgagaacgcggagcggtggctccgggagctgcgggaccacacggacgccaacatcgtggtcatgctggtgggcaacaaggccgacctgcgccacctccgcgccgtctcgcccgaggacgccgccgccttcgcggagcgccacggcaccttctcaatggagacgtcggcgctggacgccaccaacgtggagcgcgccttcgccgaggtgctccgccagatctaccacgtcgtcagccggaacgcgctcgacatcggggaggacccggccgcgccgcccaggggcaagaccatcgac

SEQ ID NO: 1636 - DNA, 1306 bp, Panicum virgatum
cctccacctcgccctcccctcccgcggcagccccgagaagcgctgcgggcctcacctgcccgtcctccttgccccaagaaccgcggttcaggaagggaagggaagggagggaagcgcctgcctgcctgctgccggggccgagctgcgagagcgaccatggcgtacagggcggaggacgactacgactacctcttcaaggtcgtgctcatcggcgactccggggtcggcaaatccaacctgctctcgcggttcacgcgcaacgagttcagcctcgagtccaagtccaccatcggggtcgagttcgccaccaggagcatcagggtcgacgacaaggtcgtcaaggcccagatctgggacaccgctgggcaggagaggtatcgggcgattacaagtgcgtactatcgaggggctgtgggcgcacttgtcgtgtacgacgtgacacgccatgtgacctttgagaatgtggagaggtggttgaaggagctccgggatcacacggatgcaaacattgtcatcatgcttgtcggcaacaaggcggacctgcgacaccttagggccgtgtccgtggaggatgccaagggcttcgccgagagggagagcaccttcttcatggaaacctctgcgctggagtccatgaacgttgagagtgccttcaccgaggtcctaactcagatctaccgtgtggtcagcaagaaggccctcgacattggagatgaccctgctgccccaccgagagggcaaaccatcaatgttggaggcaaggatgatgtctctgctgtgaagaagtcagggtgttgttcatcctaaatcatcccttacgaccatggaaaggattaaccatatctatgctcatcccttgtgctgcctagcctgctggttggttacgagattatgtgttggtacatacaccagaagaatgcatggtttagaggttaagaacttaattccagctaggttgggacaaaaactaacttttcgcagtgtcagtgacattcatggtttacttgtgtatggtttatatgcaccactgttcaacactaataggcattagaattctctctcccacacctcactacgtaacattcccggcctgctaaagtgttgtaattggagctactgatgatgatgtttgcttgctgggagcaaagagtataactttgtctttcatgtcacgaggggttatgttccactcggtaaatgttcatctgtcattggtaggcagcaagtgtttttagagggttatatcatgtaattctcacagatgtacaaaatttggattattgaaggtttatgttcctcgtcagcc

SEQ ID NO: 1637 - DNA, 1237 bp, Panicum virgatum
cgcggcagccccgagaagcgctgcgggcctcacctgcccgtcctccttgccccaagaaccgcggttcaggaagggaagggaagggagggaagcgcctgcctgcctgctgccggggccgagctgcgagagcgaccatggcgtacagggcggaggacgactacgactacctcttcaaggtcgtgctcatcggcgactccggggtcggcaaatccaacctgctctcgcggttcacgcgcaacgagttcagcctcgagtccaagtccaccatcggggtcgagttcgccaccaggagcatcagggtcgacgacaaggtcgtcaaggcccagatctgggacaccgctgggcaggagaggtatcgggcgattacaagtgcgtactatcgaggggctgtgggcgcacttgtcgtgtacgacgtgacacgccatgtgacctttgagaatgtggagaggtggttgaaggagctccgggatcacacggatgcaaacattgtcatcatgcttgtcggcaacaaggcggacctgcgacaccttagggccgtgtccgtggaggatgccaagggcttcgccgagagggagagcaccttcttcatggaaacctctgcgctggagtccatgaacgttgagagtgccttcaccgaggtcctaactcagatctaccgtgtggtcagcaagaaggccctcgacattggagatgaccctgctgccccaccgagagggcaaaccatcaatgttggaggcaaggatgatgtctctgctgtgaagaagtcagggtgttgttcatcctaaatcatcccttacgaccatggaaaggattaaccatatctatgctcatcccttgtgctgcctagcctgctggttggttacgagattatgtgttggtacatacaccagaagaatgcatggtttagaggttaagaacttaattccagctaggttgggacaaaaactaacttttcgcagtgtcagtgacattcatggtttacttgtgtatggtttatatgcaccactgttcaacactaataggcattagaattctctctcccacacctcactacgtaacattcccggcctgctaaagtgttgtaattggagctactgatgatgatgtttgcttgctgggagcaaagagtataactttgtctttcatgtcacgaggggttatgttccactcggtaaatgttcatctgtcattggtaggcagcaagtgtttttagagggttatatcatgtaattctcac

SEQ ID NO: 1638 - DNA, 644 bp, Zea mays
cgtcatctccgcagtgcaaagcgtcaacgcaaacagaccaagatccagaagcaagaaagtgtttatagcctagccggtgcgcgcgcgagagggatagccgattatcatcaagctctgagctagcagagaagatgagcgcatcgtcgtccatgaccaagaaggcgtcgtcgttcgtggtggcggcgagcatgagcgcggtggaggcgctcaaggaccaggcggggctgtgccggtgggactacgcgctccgctccctctacaaccgcgcggccgccgccaataaggtcgtcgccggccgcgccgtcccgttgtcgttgtcgtcgtcccaaaccgcgggtggcagtggcagcgccgcggccgccggtagggccgccaggcccaggcgatcggaggaggagaagatgcacaaggcgtaccacctcgtctgctggggccctaactaattgttaggggcattctcttattaattactcctttatacacgctgtccgattcctccacttcttgttcgtacacatacagagatgtatctgcaaattttgtatgtgtaatccgtcctctggtggtttatgccacgagaattgcttattattgttgggtgataaacaaatggaaatgagaaattttgtgatgtgattagtgat

SEQ ID NO: 1639 - DNA, 1614 bp, Brachypodium distachyon
atgaacaaatccaggtttcggacagctgaagctgtcaaccatggtggaaaacaagcttcaagtgaggctggaaatctggtggatctcaaaagtgtaagagatccagtttctggatggcattccagtatcaagtatcaacggcactttacactgaggttagtgacacatggccacatgatgttgaaatttgggagtaccagaccccacctgggtaaaggaagagaagtatgcccgcgtcagctccttagcattcagctcattacctcctacataaagtgcccaccatcagccccagcccccttcaactcacaccagaatatacacaagcacatcacatcattcagacataatcagcatcatgttggataccaagcataccttgcaagtccttccatggatcctcttgtttgcacagcaggctgcagccagcggttgcgactgcacagctgcaacagatggggcagacaagcagggcgcaatgaagctgaagctggtcgccattgcatccatcctgacagccggggcggctggtgtgctggtgccagtgcttggccgttcattggccgcgctgcgccctgacggtgacatctttttcgcagtcaaggcgtttgcagctggcgtcattcttgccacaggcatggtgcatattctgccagcggcgttcgacgggctcacatccccatgcctccacaaaggtggcggaggtaggaatggcttcccctttgcaggcctcgtggcgatgtctgcagcaatggccacgatggtgatagattcactggctgctgggtactaccgccggtctaacttcagtaaggcacggccaattgagaatgttgacatacccgggcaggctggagaggaggaagggagaaccgagcatgtacatcatgcaacacacggccattcacatggtgaggcagtggtcgtcagctcaccagaggaggcttcaatagctgacacaatccggcacagggtggtatctcaggttttagagttgggaatcttggtgcattcagtgatcatcggtgtgtccttgggagcatctgtgaggccatccaccattagacctcttgtcggtgccctcagcttccaccagttctttgaaggcataggcttgggcggttgcattgttcaggctaatttcaaggtaagggcaaccatcataatggcaacgtttttctccctgactgcacctgtgggcattgtgctagggattgcaatttcatctagctataatgtgcatagctctactgccttcattattgaaggagttttcaactcagcatcagcagggattttgatctacatgtccctagttgaccttctagcaacagatttcaataacccaaagttacagacaaatacaaagcttcagctgatgacatatcttgcacttttcatgggtgcagggatgatgtccatgcttgccatatgggcatagatttccagggcaatgtcatattcccacttgtcattcccgctaaagttgaagtagtgattgtattcatccaggagttctgcattttcccaaaataatacacccatggtgaagaattgaccatattttctattgcccgaaaacaattgtgtcgtggatatattattcatatttga

SEQ ID NO: 1640 - DNA, 1247 bp, Avena sativa
cacaccagaatagacaagcacacatcacaagacataataatcagcatagttcagcaccatgtcgactaccaagcataccttgcaagtgcttccatggctcctcttgtttgcgcagcaggctgcagctagcagcggctgcgactgcactaccgccacggacggggcggacaagcagggcgcggagaagctgaagctggtcgccatcgcgtccatcctgactgccggggcggctggcgtgctggtgccggtgcttggccgctccatggctgcgctgcgccctgacggcgacatcttcttcgcggtcaaggcgtttgcagctggtgtcatcctcgccactggcatggtgcacattctgccggcggcgttcgacagcctcacgtccccatgcctccacaaaggtggcgggggtaggaacagcttcccttttgcgggtcttgtggccatgtgtgctgcaatggccacaatggtgatagactcactggctgctgggtactaccggcggtctcatgtcagtaaggcacagcctattgacagcatctacgtacctgagcatgttggggacgaggaagggaggacagggcatgcacatggacacgtgtctgcaacacatggccattcacatggtgaggcagtggtcatcagctcaccagaggaggcttcaatagctgacacaattcggcacagggtggtatctcaggttctagaactgggaatcttggtgcattccgtgatcattggggtgtccttaggagcatccgtgaggccatctaccatcaggcctctagtcggtgccctcagcttccatcagttctttgaaggcattggcttgggtggttgcattgttcaggctaatttcaaggtaagggcaaccatcatcatggcaacatttttctccctgacagcgcctgtgggcattgtgctagggattgcggtttcatccagctataatgtacatagccctactgccttcattattgagggagtcttcaactcagcatcagcagggattttgatctacatgtccctagttgaccttctagcaacagatttcaataacccaaagctacagacaaatacaaagcttcagctgatgacatatcttgcactattcctaggtgcagggatgatgtccatgcttgccatatgggcatagatctccatatttccactagcattactacttcctgctaaactagaagtattcaggtgtagttctccatcttatcaagataattatccatttgtgc

SEQ ID NO: 1641 - DNA, 1478 bp, Hordeum vulgare
cacctggacaaaggacaacgactctcctcaccctcaccctcaccccacgcctccttcctatattaaagtagcaagcgctggctccatctccctgcagcaagcacatcgcattcaggcataatcagcgattcagcagactcgccaccatgtgggctaccaagcataccttgcaagcgcttctcccatggctcctcctgttcgtgcagcaggccgcggccagcggcgggtgcgagtgcacgaccgccacggacggggcggacaagcagggcgcgatgaagctcaagctggtcgccatcgcgtccatcctggccgccggggcggctggcgtgctggtgccggtgctcggacgctccatggccgcgctgcgccccgacggcgacatcttcttcgcggtcaaggcgttcgccgctggagtcatccttgccaccggcatggtgcacatcctgccggcggcgttcgacgggctcacctccccgtgcatccacaaaggcggcggggacaggaacggcttcccttttgcaggacttgtggccatgtctgcagccatggccacaatggtgatagactccctggctgctgggtactaccgccgctctcacttcagcaaggcacgcccacttgacaacatcgacatacctggacacaccggagatgaggaagggagggccgatcatccacatgtgcacacgcatggccattcacatggtgaggcgattgctgtcagctcgccggaggaggctgcgatagctgacacaatccggcacagggtggtatctcaggttctagagctgggaatcttggtgcattcagtgataattggcgtgtcattaggagcatctgtgaggccatccaccatcaagcctctggtcggtgccctcagcttccatcaattctttgaaggcataggcttgggtggttgcattgttcaggctaatttcaaggtaagggcaaccatcatcatggcaacgtttttctcccttaccgcaccagtgggcatcgtgctagggattgcggtttcatctagctataatgtgcatagctctactgccttcattattgagggagtcttcaactcagcctcggcagggattctaatctacatgtccctagtggaccttctagcaacagatttcaataacccaaagctacagacaaatacaaagcttcagctgatgacatatcttgcacttttcctaggtgctgggatgatgtccatgcttgccatatgggcatagatcttcaaagcaatgaccattgcaattgtatttcctgctaaagtcgaagtgctaattgtattcatccaggagttctctattttctcaaaataatacacccttggtgaagaattgaccatattcattcaggaattttctatttcccgaaccaatgtactctaggatattctctgtacatcatagtatgagattgtgtgatgagtagatgtcagccctaactactaagcaatataagtaattagt

SEQ ID NO: 1642 - DNA, 1249 bp, Pseudoroegneria spicata
  misc_feature (1026)..(1026): n is a, c, g, or t
  misc_feature (1167)..(1167): n is a, c, g, or t
  misc_feature (1169)..(1169): n is a, c, g, or t
aggcacacataatcagcaattcagcagagtcgccaccatgggcgccaccaatcataccttgcaagcgcttctcccatggctcctcctgttcgtgcagcaggccgcggccagcggcgggtgcgagtgcacgaccgccacagacggggcggacaagcagggggcgacgaagctgaagctggtcgccatcgcgtccatcctgaccgccggcgcggctggcgtgctggtgccggtgctcggccgctctatggccgcactgcgccccgacggtgacatcttcttcgcggtcaaggcgtttgccgctggcgtcatccttgccaccggcatggtgcacatcctgccggcggcgttcgacgggctcacctccccgtgcattcacaaaggcggtggggacaggaacggcttcccttttgcaggacttgtggccatgtctgcagccatggccacaatggtgatagactcactagctgctggatactaccgccggtctcacttcagcaaagcgcgcccacttgacaacatcgacatgcctgaacacgcaggagatgaggaagggagggccaatcatccacatgtgcacgcgcatggccattcacatggtgaggcaattgttgtcagctcaccggaggaggctgcgatagctgacacaatccggcacagggtggtatctcaggttctagagctgggaatcttggtgcattcagtgataattggtgtctcattaggagcatctgtgaggccatccaccattaagcctctggtcggtgccctcagcttccatcaattctttgaaggcataggcttgggtggttgcattgttcaggctaatttcaaggtgagggcaaccatcatcatggcaacgtttttctccctgaccgcacccatgggcatcgtgctagggattgcgatttcatctagctataatgtgcatagccctactgccttcattattgagggagtcttcaactcagcctcggcagggattttgatctacatgtccctagttgaccttctagcaacagatttcantaacccaaagctacagacaaatacaaagcttcagctgatgacatatcttgcacttttcctaggtgcagggatgatgtccatgcttgccatatgggcatagagatcttcaaagcaattgccatatttgcacttgtatttcgngntaaagttgaaatatgcattgtattcgtccaggagttctccatttccccaaaataatacacccttggagaaaaattgacca

SEQ ID NO: 1643 - DNA, 1867 bp, Triticum aestivum
cacctggacaaaggacagcagccctcctcaccccgacgcctcctatattaaagtacccagcgttggctcttgctctatctccctgcagtagacatcgcattcaggcacacataatcagcaattcagcagagtcaccaccatgggcgccaccaatcataccttgcaagcgcttctcccatggctcctcctgttcgtgcaccaggccgcggcggccagcggcgggtgcgagtgcacgaccgccacggacggggcggacaagcagggcgcgacgaagctgaagctggtcgccatcgcgtccatcctcaccgccggggcggctggcgtgctggtgccggtgctcggccgctccatggccgcgctgcgccccgacggcgacatcttcttcgcggtcaaggcgttcgccgctggcgtcatccttgccaccggcatggtgcacatcctgccggcggcgttcgacgggctcacctccccgtgcatccacaaaggcggcggggacaggaacggcttcccttttgcgggacttgtggccatgtctgcagccatggccacaatggtgatagactcgctggctgctgggtactaccgccggtctcacttcagcaaggcacgcccacttgacaacatcgacatacccggagatgaggaagggagggccgatcatccacatgtgcacgcgcatggccattcacatggtgacgcaattgttgtcagctcaccggaggaggcggccatagctgacacaatccggcacagggtggtatctcaggttctagagctgggaatcttggtgcattcagtgataattggtgtgtcattaggagcatctgtgaggccatccaccatcaagcctctggtcggtgccctcagcttccatcaattctttgaaggcataggcttgggtggttgcattgtacaggctaatttcaaggtgagggcaaccatcatcatggcaacgtttttctccctgaccgcacccgtgggcatcgtgctagggattgcgatttcatctagctataatgtgcatagctctactgccttcattattgagggagtcttcaactcagcctcggcagggattttgatctacatgtccctggtggaccttctagcaacagatttcaataacccaaagctacagacaaatacaaagcttcagctgatgacatatcttgcacttttcctaggtgcagggatgatgtccatgcttgccatatgggcatagagatcttcaaagcaattgccaaatttgcacttgtatttcctgctaaagttgaagtatgcattgtattcatccaggagttctccatttccccaaaataatacacccttggtgaaaaattaaccatattcatccattaattttctatctctcaaaacaacatactcttggatattctctttgcatgtcatagtatgagactgtgtgatgagttgatgtcagacctaactttgaagccgtataagtgatcagttatacagtaggtttcggactttctaaatttagatcagctgagtctctcacactaacaacgaatctgtatgcatatttttccaatagccaaaaggaacaaaaaagaactagtttgtttagatcgatagttcaaaacccttaaaaagacggacaggagagattcaacgcttcagaaaagatgtaaattttcaaaaattaggagggctacgtgattaatccacagttatatatgctactgtgagaaaaccacatgtaacacacttacacacaagactgctacttctttgagttctttcactcatatatgcttctgcgagaaagcttcccaaaagaattcacgtccttcatgatgaagtcaaagacagcatataaagaacctattctgtttcatgacac

SEQ ID NO: 1644 - DNA, 7720 bp, Oryza sativa
gcatgggtgacaagatgatcacaagaaaattatcattcaatcaaaaggacatggatgtcacagagattgatttgcaggattacaaggatgtggatagcattgcgttctaccaggttccgacaaacgtgggatctggaatgtccatggaaagcgagagattggtaagagttcatgcatgtacagatcacaatggtgtcagttttttgcacaagttgcttcatcgtcttttggagcacaaggagatgtatagcaatgtggtgaacctcctatttcatggtattgaatggcaaactgagggggtgcaactcctgtgttcatttttaggccctggttcaagtgtgaagcaggtagaattccaaaagaatgtctttggcacaaaatcatcagctgctttagtcccactatcagaaatgatccaaaggaataacaccatcaaggcaattgttttttctgagtgtagaattggagcatctggagtcaaactgctagcttcagctttggcatacaacaggagcgtggaagaggtccagctattggatgattccataggtgctaagggagccgaagaattctcaaagatgattgaggtaaattgtgtgttgaagctgttggtcatccttgacaatagctccattgcagcagccccgattttctctgctgtgcttgcacgcagccgcagggtggaggtgcatgtatggggacactgtcgtgatactagaggtggcatgaacagttgtaaaattgctgaatttcaggctggaactggaagcttgaggatttacaacaatattaattccacaggtctacaaaggattgcttgtgctatggcatggaacaccacagtgacaacattggacatgtcaggtgtaccattgaagtccaagtggaccaaagagctcagaggagtccttgagcggaataggatgctgaaaactgtcaagctcaccaagtgttgcctcagggacaaagctgttgtgtatatagctgcaggcctcttcaagaacagctatttggagagcttgagtttggatggaaatcgctttggtggagttggtttggagcatttactgtgcccactgagtacattttcaccacttcagagacaagccaatctcactttgaaggttttgagttttggtggacggcaaacaaatataggaagatatggcataacagcaatcttgcagatgttggagacgaaccagagcctacttcagttggccatatgcgatgatgtaagcttgaggccaaatgatgttgtcagaatctttacaagcttagaaaggaatactactctccgaaacctatcattgaaaggttgcaggggagtcgagggggaactagtcttgcagaccattatgggcatgttgcaggtcaatccttggattgaagaaattgacctgcatgaaacgcctctgcatgttgctggtaagaccagagaaatttatgagaaacttggtcagaatgggagttcggttgtaccaaatgatttgctcgatttgccactaagtgcacctacttgttgccaagtttttctctgtggtcaagaattatcaggtaaaagcactttgtgtagctccataaagcactgcatgaattcaatgaaattgcctcgcatggatgaaataagaacttcaaagactccaattgagcaaatgtcacacaccaatgagtatgggatgaatataattttcgatggcaacacaaaattgactatgtgtaatattggtggacctgaggaaagtattcccttgcatgatttcatgtttgttgtgcatggtggtccaaggattttcatgattgtatctagtttgattggaaagcctgctgataaatatccaaaaagcatagatgtgattgaacaggagctgatatactggttgaagtttgttgcttcaaattctaggagaagagtgtcgcactcatttataccctgtgttacgatagttctcacacattatgataaggtatctcatctagcagaagggctacaattgatcgttgcagctgtacaaagactcagagaagacttctgttcatatgctgaaatttaccccaccgtttttgtggtagactcaagatcacaggtttcagtaagtaagctcacccatcacttgcgaaatacaacaaagacagttctccaacaagctcctcaagtttatgaagtatgcaatgatttgattaggtatttgcataattggagattgaagaatgataaatcagtggtcaaatggtctgagttctgcgagatatgtcagctcagcattccagtgctaaggttgagatcaaggcatgataatgccgagaaattagacacaagaagacatgctgttgcaaagtcactgcatgatttaggtgaaataatattttttgaggagcttggagtgctgataatgaactgcgaatggttctgtcaagatatactcagccaactaggtgcattgaaatccatcaagatagaaaatagtggttttgtccgcaaacaagatctggagaagattctgcaagagaagctgtgtaatcaaattcaaagatcaaactggagagctggtgcatccttgcaatctggtgatatcattaatatgttgttgaaacttgaactgtgctatgaacaagaccctgggaacccaaacacattacttctagtaccagctatgcttgaggaaagcaaagaagggattcaacggtggcagttaaccatgccagagtgcagatatgctggaaggcatatggaatgtgaagatacacacatgtttctgacaaatgacttctttccaaggctacaggtacgtctgcacaataaaatcatgtgccctggaaatcagcaaggagcagtctacaacttggagaaaaaccttatttatacggtgatcgatggtgtccatgtaagggttgagctgggtatgaagttgggctcatccatagatgtacttgcatgctccactagaaatgttacagacatggtgaggcttctgcacaagtcagtaatcacaacaatactaaatatgtctcccagtatgacattcaaggaaagcattatcagacctgactgtgtgaaatatctcataccacaaaggttccgtacaactcagctgctacctgtcaaaaaaattaagcacattctgctgtcattgccggcagaaagtttttacgattatcaacatacctggagtgcagttgaaaacaataaaagggtcatcttaatgtcaggattagatcatgctagagatcttctatcagacgatgacttccatgatgttttgcatcgtaggtactatgatctacagcatcttgcaactgaacttgcagtgaccccagacaatctgcaacaatccgaaactattgctgaatcggatgcagttgatccctccatactaggcattgccaaaggtgttgagatggttctccaaagactgaagagaatagaacaaggaatccaggacttgaaggaggaaattgcaaggctgaggtactacgagtatcaccttgtgactgaactccacaggaaaatggactatgtaatgaactacagcattcagctggaggatagaaaggttcctcagctgttctatcttgtaagcttggacagccgttccaagaagcttgtcacaagaatactgcctggcatgcggtccctacgggtacacatgctgtgcgagttccgacaagaaatgcatgtgttggaggatcaagtcgggtgcgatctgattcaggtagataaccgggcagtgcaatccttgctgccttacatgagcaagttcatgaaactgttgacttttgctctgaagatcggggcgcatttcattgtcgggatgggggagatgatacctgacctgagcagggaggtagtgcacttgctggactcgtcagtcatgtatggtgcaaccacatcagccttatcattgggggcattaggcgcagcggcaatgtatggaaaagcgaggaataacggcagccagagtggcacaaatgacatggaggatgatatgaaaacggccagacagtggcttgttgatttcttgaaaggtcaagggattttgacagggatggacatagcacagagatttggtctgtggcgcgttaggtacagagatgacggccacattgcatggatctgcaggaagcacattgttgcgagagcagacgagatctttgaactgccactctgaaccatccagggtgcagttggtttcacggccacaaggtgcctatctgatgtccctgtccttctgtactgatgatgacaactgacgagcttgcaattgtaagggatggtgccattgctgattacaaggatcgcatatggtaggtacctatcatatgctctgttccagtttctatcactctgcttctgtcaatggtgtgtttttacatttttcctctttacttcgttgttgtggattcacgctagtagaaatattaagtttctgacggcatattgtttcctgttcaattgctgatttgaggagttcgtttatctttcttcaattataatactacagtactgcttcatctctgatgattaactactagcagaattctgtttcagcatattcagattgacatgatcttatataaactacctatagtatttccttgcagaaaaaaaatgccacattattacactaaagacacaggaggtgacactataatgactgtatcagttatctgatgccagtatgaattcatggtttttcccaaccctaacccaaatgcttgctacctgagtgcaacttcagtttctatcactctgcttctgtcaatggtgtgcttttacatttttcatctttgctccgtaattgcggattctctgatgattaactaccatcacatctctgtttcagcatattccagaatggcatgatcttatatgaactactagctactatatcatttccttgcaggaagccaatttgttacactcatcacacgggaggtaacagctgacaactattaggactgtatcagttaactgacaccaggctgaattcatggtttttccccaatccaaacccaaattcttgctacctacatacaccaccgtgtgcagctccggccggcgagctcagaacaccgggcatcccttgacggcgatccccggcgcggtggggcaggaggcgagcgggcagtggtcgaccgccgtgccccaccacttgagctcatggtgggcgttctgcagggcgaagaagatgagcacccccatgaaggccgtgccggcgtcgagcgccgccgacagcacgtagttgtacttctgccaccaccccttgcggtacttgaacacgaagtagttgaagatggtgcccgtgacgagccagctcgcgatgttggtcggcgtcgccggcggcatcccggcgaacccgtaggagatgacggggacgttgatgagcgcgatccacttcttctccgggaacgccctgctgagcagccacaccggcacgggcagcacggcgccggcgaggaacagccacaccaggttgcggtacaggccgtggcggccgaacagccgggcggggccgatgagcccccagatcaccgacgcgtcgaacgtgacccggtacttggggcacgtccacgggctgtccgggtgcagcgcctccacgtcgcagatgttgtcgatgctgcccagcatccaccacgccaccgccaggttcaccacgccggcgaccaccgtgcccaccagctgcgccgtgtacatgcaccgcggcgggatcttcatgtagtgccccagcttgaggtccgcgaggaacgacagcgcgtgcaccgtgctgatcctcccgtagatcttgaacagcaggttcgcgatcggcttccccggcagcgcgtacccgatcatgaactgcgcgatgatgtcgtaccccggttgctggttggtggtggcctggatgacgccgatggggagggtgacgacgaaggcgagggcgaaggcgaagagcatcccccaccacggcagctgcacctcctccctgtacacgaacgacatgaccagcgacacggcgacgctgccgacgagcagcacgaggaaccaccactgcggcacctgcttgtaccgccgcatcagcttcgcgtgcacgtccatcttcgccgccgcggagctcatcgccgacctgctctgcctccagatgtccccgccgtggaacagcgccacgtgcacgatcgtcgccgtgaacctcaggaacccggacccgatggagatggcgaacagcgggctcaggtacagcttcccgtagctctcgtacgccgccacgttgaggtcgaactccctcgtgagcaccttggtggtgtcgtacttctgcccggacgccgtgaacagctggttggagaagattgggaacttcctcgcgtcgaacgtgtcgaacttccagtagcagagcggcacgatgaggtagatgaacatgacgaagcccgcggcggtgttggcgatggacgaccacggcgccaccagcgggctcccgtggtacgccgagatgccggcccagtccagtgtgaaggcgccgacgccgaggccgtggtagccggagcccacctgctgcgccgtgatgctgtgcggccacgcccagcacgcccacgagaagaaggtcaggatggggagcaggtagcccggcagcgcgtagtaggcgaagctcgcgaagaagaagatgaggaagaagcgcatccgtgtaggccccctcgacgacgaccccttcccgccatcgccgccctccttctcgtgcaacgcccttcatgtactcacagagatcattagttagcctgcatagttaactggctgatcttgcttaattgagagatttacgacgtgattaattaattacctgaagagtgagacctgggctaaattcgatggccaccacatgtcagccgggtcaaccaggtacctcctcagcatcccggcccaaccatagcccagtatctgtgtggtgaggacgatgaggagggcgcagaggaagctgagggactgcttgtagtaggccttcatgacggtgatggcgccgatggagtaggcgtcgccgccgccataggagacgccgcagttggcgaagatggtgatgatgacgtgctccttgatgttgaagggccccgggttgaggttgaagctgccgaggcggccgccgaggaggcgcacctcgcggctgggcagcacggcggccatgaactgccccgcggggagcaccaggatctgggccaggatccccgagatggtgagcggctgcgtgcggtaggtgaagaaggtgttgaggaagatgagcacgacgcaggacgcgagccccagcgtccacgcccggaatgtcatcaccggcgtcgtcgggtcgtcggtctccggcaccaccagcgccacctcctccaccgggcacctctccccttcccccttcgccgccgccgccgccgccgccgtcgccgcctgctcctccgccgccaccggcgacttcaacgacgccatctccctagcctcgatctccttcctcctccgcctcacaagtcgccactacaagcaaagcgagctaagctagctgcgaatgatttgtaaagaaaataatttgccagtatctggagaggaaggtagtaacgctttcggggattcgatttggatggtagcacttgaccgcggcgcgcctctatttatattccaattcgcgtctccattttttttcccacctcgtacttatagttattagctggggttttagtggcttgattactcggtacatctcggctaggggaatcg

SEQ ID NO: 1645 - DNA, 3397 bp, Zea mays
gccgagaatctctaaaaggcgccgctcccgtccacggcgcggcgggcagcagcgaagcgtcggtttcagaggccggcgggccggtcgagtcggtggagggagggtgggtagatagatagctagctactagcgggtagcggagagggtccagtcagtgggcgggaggagcgaggggccgggaccgggacgatggcgtcgcggaagtcgccggtggcggcggaggagcgggcggggacggggacgggggaggggaagggggagcggtgcgcggtggaggaggtggcgctggtggtgccggagacggacgacccgtcgatgcccgtgatgacattccgggcgtgggcgctggggctcggctcctgcgtcgtcctcatcttcctcaacaccttcttcacgtaccgcacccagccgctcaccatctcggggatcctggcgcagatcctcgtgctccccgccggccgcttcctggccgccgtgctgcccgaccgcgaggtcaggatcctcggcggcaggctcggcagcttcaacctcaacccggggcccttcaacgtcaaggagcacgtcatcatcaccatcttcgccaactgcggcgtctcctacggcggcggcgacgcttactccatcggcgccatcaccgtcatgaaggcctactacaagcagacgctcagcttcgcatgcgccctcctcatcgtcctcaccacacagatactggggtacggctgggctgggttgctgaggaggtacctggtcgaccctgccgagatgtggtggccttctaaccttgcccaggtctcactcttcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcgggccagaagtacgacaccaccaaggtgctcaccaaggacttcgacctcaacgtcgccgcctacgacagctacgggaagctctacctcagcccgctcttcgccatctccatcggctccggcttcctgcggttcacggccaccattgtccacgtcctgctcttccatggcagcgacatgtggaagcagagcaagtcggccatgaacgcggtgaagctggacgtgcacgccaagctgatgcagaggtacaggcaggtgccgcagtggtggttcctcatgctgctgctgggcagcgtggtggtgtccctgctcatgtccttcgtctggaaggaggagatgcagctgccgtggtgggggatgctcttcgccttcgcgctcgccttcgtcgtcaccctccccatcggcgtcatccaggccaccactaaccagcaaccggggtacgacatcatcgcgcagttcatgatcggctacgcgctgcccggcaagcccatcgccaacctgctcttcaagatctacggccggatcagcaccgtgcacgcgctatcgttcctcgcagacctcaagctcggccactacatgaagatccccccacggtgcatgtacacggcccagctggtcgggacggtggtcgccggcgtggtgaacctggcggtggcgtggtggatgctggacaacatcgagaacatctgcgacgtggaggcgctgcacccggacagcccgtggacgtgccccaagtaccgcgtcacgttcgacgcgtcggtgatctggggcctgatcggcccggggcggctcttcggccagcacgggctgtaccgcaacctggtgtggctgttcctggtcggcgcggtgctccccgtgccggtgtggctgctgagcagggcgttcccggagaagaagtggatcgcactcatcaacgtgcccgtcatctcgtacgggttcgccgggatgccgccggccacgcccaccaacatcgccacctggctggtgacgggcaccatcttcaactacttcgtcttcaggtaccgcaaggggtggtggcagaagtacaactacgtgctatcggcggcgctcgacgccggcaccgccttcatgggtgtgctcatcttcttcgccctccagaacgcgcaccacgagctcaagtggtggggcacggaggtggatcactgcccactcgcctcctgccccaccgcgccgggcatcgccgtcaagggctgcccggtgttctgaatcttccgacgtgagcgtagtaagcagtgtgtgtaacagtgtaaggaaatgtttgctacgggagccatggattcaaccaagcatcgattaaccgatgcagtgctttgtcactcgtgaatgtaacgccatagcgccagtggtggattcagatttcagagggagaaaaaaacacaggcccagtgtctttggaacgcccgaatttggagtcatctggaaccgacggctcaggtttactgcaaccaacaacttagcacttgcgatctagcgtgtgtaataaaagtctgcacaattcgaagctcggcgtgtcaagaacaagaagcatatgtgcggagaataccggagcggcgaaaactgcatggtttttatttagaacaagaagcatatgacgatacagtttttactccatgtcatagcttcaagaatccacaaaacacaaaggaatatacagactgatatttgataaaagcgagagtatgatcaagcgatctcatgtggtgaaagttggctaataaaagttgctctacgaatacctggttctggagtgccgtcgtccatcctcctcatcctcacagattgtacacttatcacctgaaagcagaaagtccttggctacttgcatgtcttctttgaactctggacgccgggcctctggatgctcaaagtggcagctcgaagatttcctcttcccttgctgcgatgtgtttcctgcagatccatgcaatgtggccgtcatctctgtatcgaacacgccacaggccaaatctctgtgctatgtccatccccgtcagaaccccttgccctttcaagaaatccacaagccattgcctggctgctgtcatatcctctcccatgtcgctcgtgctaccattccttgacttgccatacagtgctgccgcgcccagagcccccacggacatggcagatgcagttgtgccgtacaaggccgaggagtccagcaggc

SEQ ID NO: 1646 - DNA, 3372 bp, Sorghum bicolor
cagagagaggctactttccaaagcacgatggatttggcgccaatcaccgggtaaagcggctggccgcgcgcgattagactaaactcgtgtgccccggcgcgccgcgcgcgtgcccccgcgcgccgggggtgcagccggcgcgtgccccgcggggtgctgggtgcccaggtggccgctgcctcgcccgtccgatcccacccgcggacggccacgatgcggtcctctcccaagccctcctcgtcacgtacgtcgcccggagttccacgggaatgaaccgggctcgtacgaggtggagccgtggaggggagcaccgcaccgggaacggatgagctgcggaagtgccagccaagccaacggaatataaataggggcgagcaggggtcaagcgctaccatccaggagccgagaatctctaaaaggcgccgctgcctggccgctcccgtccacgccgcggcgggcagctagcagcgaagcgtcggcttccagaggccggccgcccggtcgtcgagagccagccagtggtggaggtggagggaggctaggtatatagctaccggagagccggtgggcgcgggagaaaggatcggagagccaagggggagatagcttagagatggcgccgtcgcggaagtcgccggtggtggcggaggagcgggcggggatggaggaggggaagggggagcggtgcgcggtggaggaggtggcgctggtggtgccggagacggacgacccgtcgctgccggtgatgacattccgggcgtggacgctggggctcggctcctgcgtcgtcctcatcttcctcaacaccttcttcacgtaccgcacccagccgctcaccatctccgggatcctcgcacagatcctcgtgctccccgccggccgcttcatggccgccgtgctgcccaaccgcgaggtcaggctcctcggcggcaggctcggcagcttcaacctcaacccggggccattcaacgtcaaggagcacgtcatcatcaccatcttcgccaactgcggcgtctcctacggcggcggcgacgcctactccatcggcgccatcaccgtcatgaaggcctactacaagcagacgctcagcttcgcctgcgccctactcatcgtcctcacgacacagatactggggtacggctgggctgggatgctgaggaggtacctggtcgaccctgccgagatgtggtggccttctaatcttgcccaggtctcactcttcagggcgctgcacgagaaagaagaggagggcggcaagtcccgtggcccgtcgcggatgcgcttcttcctgatcgtcttcttcgcgagcttcgcgtactacgcgctgccgggctacctgctgccgatcctgaccttcttctcgtgggcgtgctgggtgtggccgcacagcatcacggcgcagcaggtcgggtccgggtaccacggcctcggcgtgggcgccttcacgctggactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcggggcagaagtacgacaccaccaaggtgctcaccaaggacttcgacctcaacgtcgccgcctacgacagctacggcaagctctacctcagcccgctcttcgccatctccatcggctccgggttcctgcggttcacggccaccatcgtccacgtcctgctcttccatggcagcgacatgtggaagcagagcaagtcggccatgaacgccgtgaagatggacgtgcacgccaagctgatgcagaggtacaggcaggtgccacagtggtggttcctcatgctgctgctgggcagcgtggttgtgtcgctgctcatgtccttcgtctggaaggaggaggtgcagctgccgtggtgggggatgctcttcgccttcgcgctcgccttcgtcgtcacactccccatcggcgtcatccaggccaccaccaaccagcaaccggggtacgacatcatcgcgcagttcatgatcggctacgcgctgcccggcaagcccatcgccaacctgctcttcaagatttacggccggatcagcaccgtgcacgcgctgtcgttcctcgccgacctcaagctcggccactacatgaagatccccccacggtgcatgtacacggcccagctgatcgggacggtggtcgccggcgttgtgaacctggcggtggcgtggtggatgctggacaacatcgacaacatctgcgacgtggaggcgctgcacccggacagcccgtggacgtgccccaagtaccgcgtcacgttcgacgcgtcggtgatctggggcctgatcggccccgggcggctcttcggccggcacggtctctaccgcaacctggtgtggctgttcctggtcggcgcggtgctccccgtgccggtgtggctgctgagcagggcgttcccggagaagaagtggatcgcgctcatcaacgtgcccgtcatctcgtacggcttcgccgggatgccgccggccacgcccaccaacatcgccacatggctggtgacgggcaccatcttcaacttcttcgtcttcaggtaccgcaaggcgtggtggcagaagtacaactacgtgctctcggcggcgctcgacgccggcaccgccttcatgggggtgctcatcttcttcgcgctccagaacgcgcaccacgacctcaagtggtggggcacggaggtggatcactgcccgctcgcctcctgccccactgcgccgggcatcgccgtcaagggatgcccggtcttctgaatgttccaagctaagcggcgtagtaagcagtgtgtgtaacagtgtaaggaaatgtttgctacgggagccatggattcagccgggcatcgtttaaccgatgcagtgctttaccactcgtgaatgtaacaaagtttttcaccgcaaagacaccattgcaggggtggattcagagggagaaaaacagaggcgagacagcctatggagcaacagcccagtgtctgtggttggaacaccagaattttgagtcatctggaaccgacggctcaggtttattgcaacctcttaacacttgcgatctggcgtgtgtaataaactgaaagtctgcacaggttgaagctcggcgtgccaagaagcattatgtggggaatgggaagtgactgagcggtgaacttattcagtcctttataaagaacatatttttcattgaaaggaaaataaatagttatacagacttctaactggaaatgatttaaatatgagaaagacgatgaacttattcaaagtcctttctaaac

SEQ ID NO: 1647 - DNA, 2987 bp, Panicum virgatum
cggcgcgtgccccgcgggcgcccactgcccaggtggccgctccccacgccgcccgatcccgccagcggacggccgcgatccctcggcagtcgccgcaggatgagttccacgggaaaatgaaccgggcccgtacgaggaggaagagtgcgggcgcaccaggacgggggcgcgcggggtggggatcggaagataaatacggggcgggcaggggtcgagcgctaccatccaagagctcggaatcttgaagccaaggctggcgcgcagcggcgaggcatcggttgcggaggccgccggctggttgggacttgggagggagctagtggagcagagggagtgaggtgggggcgggtggatgatggcgtcgcggaagccggcgccggtggcggcggagcaggcggggaagcagggggaggagggggagcggtgcccggtggaggaggtggcgctggtggtgccggagacggacgacccgtcgctgccggtgatgacattccgggcgtggacgctggggctgggctcctgcgtcgtcctcatcttcctcaacaccttcttcacgtaccgcacgcagccgctcaccatctcggggatcctcgcccagatcctcgtgctccccgccggccgcttcatggccgccgtgctgcccgaccgcgaggtcagggtcctcgggggccgcttcggcagcttcaacctcaacccggggcccttcaacgtcaaggagcacgtcatcatcaccatcttcgccaactgcggcgtctcctacggaggcggcgacgcctactccatcggcgccatcaccgtcatgaaggcctactacaagcagacgctcagcttcgtcctcgccctgctcatcgtcctcacaacgcagatactggggtacggctgggccggcatgctgaggaggtacctggtcgaccctgccgagatgtggtggccttctaaccttgcccaggtctcactcttcagggcgctgcacgagaaggaggaaggggacgacaagtcccggggcccgtcgcggatgcgcttcttcctcatcgtcttcttcgcgagcttcgcctactacgcgctgccggggtacctgctgccgatcctgaccttcttctcgtgggcgtgctgggtgtggccgctcagcatcacggcgcagcaggtcgggtccgggtaccacggcctcggcgtcggcgccttcacgctggactgggcgggcatctcggcgtaccacgggagcccgctggtggcgccgtgggcgtccatcgccaacacggccgtcggcttcgtcatgttcatctacgtcatcgtgccgctctgctactggcagttcaacacgttcgacgcccgcaggttccccatcttctccaaccagctcttcacggcggcggggcagaagtacgacaccaccaaggtgctcaccaaggacctggacctcaacgtcgccgcctacgacagctacgggaagctctacctcagcccgctcttcgccatctccatcggctccggcttcctgcgcttcaccgccaccatcgtccacgtcctgctcttccacggcagcgacatgtggaagcagagcaggtcggccatgaacgcggtgaagctggacgtgcacgccaagctgatgcagaggtacaagcaggtgccgcagtggtggttcctcgtgctgctgctgggcagcgtggtggtgtcgctgctcatgtccttggtctggaaggaggaggtgcagctgccgtggtgggggatgctcttcgccttcgcgctcgcgttcgtcgtcacgctccccatcggtgtcatccaggccaccaccaaccagcaacccgggtacgacatcatcgcgcagttcatgatcggctacgtgctgcccggcaaacccatcgccaacctgctcttcaagatctacggccggatcagcaccgtgcacgcgctctcgttcctcgccgacctcaagctcggccactacatgaagatccccccacggtgcatgtacaccgcccagctggtcggcacggtggtcgccggcgtggtgaacctggcggtggcgtggtggatgctggacaacatcgagaacatctgcgacgtggaggcgctgcacccggacagcccgtggacgtgccccaagtaccgcgtcaccttcgacgcgtccgtgatctggggcctcatcggcccgggccggctcttcggccgccacgggctgtaccgcaacctggtgtggctgttcctcgccggcgccgtgctcccggtgccggtgtggctgctgagcagggcgttcccggagaagaagtggatcgcgctcatcaacatccccgtcatctcgtacgggttcgccggcatgccgccggcgacgcccaccaacatcgccacctggctcgtgaccggcaccatcttcaactacttcgtcttccggtaccgcaaggggtggtggcagaagtacaactacgtgctctcggcggcgctcgacgccggcaccgccttcatgggggtgctcatcttcttcgcgctgcagaacgcgcaccacgacctcaagtggtggggcacggaggtggatcactgcccgctcgcctcctgccccaccgcgccgggcatcgccgtcaagggctgcccggtgttctagctaggtgccttctttctaagctggccgtcgtcgtagtacgtggtgatcggggtatgtcacactgtgccagggcgcggcgtaacgctgcaccttgcttttgagaagcgtggatttcagacgagcatcgattaagcgatgcagcgttctgtcactcgtgaatgtaacaatttcttcatcacaaaggtgcccttatagtgtacggtggattcaggggaggaacaaagagaagcgaaattctactgtatgcagcagtctcgtttatgcattatggatatttaaaagcaatacaaacaccatccaggttacagggtgataaaagtaggcatatgatccggtgaagttgccaattacatgtacaagttgctctaggaacacctggtttcggggtatc

SEQ ID NO: 1648 - DNA, 5449 bp, Triticum aestivum
gggcagccacagccagcgaagcagagcgcgtggtcgcagagcgcgagagagatgccgtccgcgaagccgccggcgccggcggccgacgcggcgggagggaaggcggcggcgcagggggagggggagggggagcggtacccggtggaggaggtggcgctggtggtgccggagacggacgacccggcgacgccggtgatgacattccgggcgtggacgctggggctggcctcctgcgtggtgctcatcttcctcaacaccttcttcacgtaccgcacgcagccgctcaccatctcgggcatcctggcccagatcctggtgctccccgtcggccgcttcatggcgtccgtgctgcccgaccgcgaggtccggctgctgggcggccgcctcgggagcttcaacctcaacccggggcccttcaacatcaaggagcacgtcatcatcaccatcttcgccaactgcggcgtctcctacggcggcggcgacgcctactccatcggcgccatcaccgtcatgaaggcctactacaagcagtcgctcagcttcctctgcgccctcctcatcgtcctctccacgcagattctgggctatggctgggctggcatgctgaggaggttcctggttgaccctgccgagatgtggtggccttctaatctcgcccaggtctccctcttcagggcactgcacgagacgaaggagggcgggaagccatcgacgggcccgtcgcggatgcgcttcttcctcatcttcttcttcgcgagcttcgcctactacgcgctccccggctacctgcttcccatcctgaccttcttctcgtgggcgtgctgggtgtggccgcgcagcatcacggcgcagcaggtcgggtccggctaccacgggcttggcgtcggcgccttcacgctggactgggcgggcatctcggcgtaccacggcagcccgctggtggcgccgtgggcgtccatcgccaacacggccgtcggcttcgtcatgttcatctacgtcatcgtgccgctctgctactggcgcttcaacaccttcgacgcccgccgcttccccatcttctccaaccagctcttcacggcgacgggccagaagtacgacaccaccaaggtgctcaccagcgacttcgacctcaacgtggccgcctacgacagctacggcaagctctacctcagcccgctcttcgccatctccatcggctccgggttcctccgcttctccgccaccatcgtgcacgtgctgctcttccacggcgccgacatgtggcggcagagccggagggccatcggcgccgcggccaagctcgacgtgcacgccaggctcatgcagaggtacaagcaggtgccgcagtggtggttcctggtgctgctggcggggagcatcgccgtgtccctgctcatgtgcttcgtgtggaaggagcaggtgcagctgccatggtgggggatgctctttgccttcgcgctcgcgttcgtggtcaccctccccatcggcgtcatccaggccaccaccaaccagcaaccggggtacgacatcatagcgcagttcatgatcggctacgcgctgcccggcaagcccatcgccaacctgctcttcaagatctacggccggatcagcaccgtgcacgcgctgtccttcctcgccgacctcaagctcggccactacatgaagatccctccacgctgcatgtacaccgcccagctggtgggcacggtggtggccggcgtggtgaacctggcggtggcgtggtggatgctggacagcatcgacaacatctgcgacgtggaggcgctgcacccggacagcccctggacgtgcccaaagtaccgggtcaccttcgacgcgtcggtgatctggggcctcatcgggccggggcgcctcttcggccagcacgggctgtaccggaacctggtgtggctgttcgtggttggcgccgtgctgccggtgccggtgtggctgctgagccgggcgttcccggagaagaagtggatcgcgctcgtcaacgtgcccgtcatctcctacggcttcgccgggatgccgccggccacgcccaccaacatcgccagctggctcgtcaccggcaccgtcttcaacttcttcgtcttcaggtaccgcaaggggtggtggcagaagtacaactacgtgctgtcggcggcgctcgacgccggcacggccttcatgggggtgctcatcttcttcgcgctccagaacgcgcaccacgacctcaagtggtggggcaccgaggtcgaccactgcccgctcgccacctgccccaccgcgcccggcatcgtcgtcaagggctgcccggtcttctgagcactgagctcgccggagcatcatcggacactgcccgccatgtatgtagctagcagcgaccatcgtctggattggcagaggaagccatgaattcaacctctctgcatcaattacccgatgcagccacccccccgtcctgagtcacattgtaaacatttgtgtgttttgtttttctccaaggaaatcaaatgcctagcttatataaaatcatcactctgaatatatatactcataggcaaatcacacccttcactattagtgtgatgaatccacagagaaatggtcaatgcaaagtagcaagcaaatcaatcccaaagaacacaggaatacacacaatttgacagaagagaatgataagaacagagcatatttatgcatcacacaactgcactattctcaactgtcacctatcaggctatcagcagagtgacatgagagggaggcacctgtggtcgtcgtgggccgtcgggcacgccggagtggataggttcagagcggcagctcgaagacctcgtctcctctcgcggtgatgtgcttcctgcagacccacccaatgtggccgtcgtctctgtaccgaacgcgccacaggccaaacctctgcgcaatgtccatccctgtcagaaccccttgccctctcaggaaatccacgagccactgcctggccgctttcatatcctcccccatgtcgttggcgccgctgttcctcgccctcccgtacatcactgccgcgcctagagcccccaccgacgcggcggatgcgctgtacatggccgaggagtcaagcaggtgcaccacctccctgctcaggtcaggaatcatctcccccatcccaacgatgaaatgtgcgccgatcttcagggcgaacgttaagagcttcatgaacttgctcatgtagggcagcagggactgcaccgcttggttgtccacctggatcagatcgcagccgatctgatcctccaccacatgcatctctcttcggaactcgcacagcatgtgcacccgcagggatcgcatgccaggcaggatccttgtgaccagcttcctggagcggttgtctaggctgacaaggtagaacatctgaggcacctttctgtcttccagttgaatgctgtagttcatcacgtagtccatcttcctgtggagctcggtcacaaggtgatactcgtagtacctcaagctagcaatctcttccttcaggtcccttattccttgctctattatcttcagtctttggagaaccatctcgacacctctcgcgatgcccaggatggagggatcgaccacgtctgcttctgggatggtttcaggctgctgcagattgtctggggtgacggcgagttcagtcgcgagaaactgtaaatcatagtacctacggtgcaaaacttcatggaagtcatcatctgatagcagatctctggcatggtcggatcctgatcttaagatgagccttttattgctttcaactgcactccaggtatgctgataatcgtagatgctttctgccggcagtgacagtagaatttgctttatttttttcagagggagctgctgagttgcacggaaccttcgtggtatgagatatttcacacagtcaggcctgagaatgctttccttgaacgtcatattgggagacaaattcagtatcgctgggatgacaaacttgtggagtagcctcaccatgtctgtaatatttctaccggagcatgcaagcacatctatggatgagccaaacttcattcccagctccacctttacatggacaccattgatcactgtataaataaggtttttctccaggttataaactgcttcctgctgtccaagacacatgattttgttatgcagacgaacctgcagtcttggaaagaagtcacttgtcaggagcatgtgtatatcttcacattcgagacgccttccaacaaatctgcattccggcatagttaactgccatttctcagcccctcctttgttttcctcaagaatggctggtagtaagagtaatgtatgtgggttcccagggtcctgttcatagcataattcgagttccagcaatatatttatgatgtcactggcctgtaaggatgcaccagttctccagtttgaccttggaatttggttgcgcagcttctcttgcagaatcttctccagctcctctttatggacaaaaccaccactactctctatcttgattgacttcaatgtagctagttggctgaggacatctcggcagaaccattcacaattcatgaccagaagtccaagttcctcaaaaaatactatttcacccaaggtatgcagtgatctggcaacagcacgtctccgtgtgtccactttctccacattatcacgcctcgatctcaatcttagcactggaatgttgagctggcatatctcgcagaactcagcccacctgatcacggctctgttattcttcaacctccagtcatgcaaaatcttgatcaaatcattacatacttcataaacttgaggaacttgttgggttattgtctttgttgtctttcgcaagtggtgagtgagcttgcttactgaaaccaacgatcttgagtcaacagcgaaaacagtggggtaaatttctgcatgtgattggaagtcttctctgagcctttgtacaacggaagcaattggctgtagcccttctggtaaatgagataccttgtcataatgggtgagaactatagttacacagggtcgaaacgagtgtgatactctccgcctataatttgaaatcaagaacctcagccaatatatgagttcccattcaatctcgtctatgccttttggatatttagtagcaggctttccaaccaaactagacacaatcatgaaaaagcttggaccaccaagcaccacgaacatgaaatcatgcaacgcagaacttccttcatttccaccaagattacacattgtcaattttgtgttgccatcaaagattgagttcatcttattctcatcggtgaatggcatctgctcaactggagtcttcagagtttttcttgcatccatgcgaggcaaattcattgaattcatgcactgattcatggagctacatagcgtgcttttacctgctaattcttggccacacagaacaactcggcagcatgtaggagcacttagtggc

SEQ ID NO: 1649 - DNA, 3037 bp, Secale cereale
agggggagggggagaggtacccggtggaggaggtggcgctggtggtgccggagacggacgacccggcgacgccggtgatgacattccgggcgtggacgctggggctcacctcctgcgtggtgctcatcttcctcaacaccttcttcacgtaccgcacgcagccgctcaccatctcgggcatcctggcccagatcctggtgctccccgtcggccgcttcatggcgtcggtgctgcccgaccgcgaggtccggctcctcggcggccgcctcgggagcttcaacctcaacccggggccttcaacatcaaggagcacgtcatcatcaccatcttcgccaactgcggcgtctcctacggcggcggcgacgcctactccatcgcgccatcaccgtcatgaaggcctactacaagcagtcgctcagcttcctctgcgccctcctcatcgtcctctccacgcagattctgggctatggctgggctggcatgctgaggaggttcctggttgaccctgccgagatgtggtggccttccaatctcgcccaggtctccctcttcagggcgctgcacgagacgaaggagggagggaagccgtccaagggcccgtcgcggatgcgcttcttcctcatcttctcttcgcgagcttcgcctactacgcgctgccgggctacctgcttcccatcctgaccttcttctcgtgggcgtgctgggtgtggccgcgcagcatcacggcgcagcagatcgggtccggctaccacggcctcggcgtcggcgccttcacgctggactgggcgggcatctcggcgtaccacggcagcccgctggtggcgccgtgggcgtccatcgccaacacggccgtcggcttcgtcatgttcatctacgtcatcgtgccgctctgctactggcgcttcaacaccttcgacgcccgccgcttccccatcttctccaaccagctcttcacctccacgggccagaagtacgacaccaccaaggtgctcaccgccgacttcgacctcaacgtggccgcctacgacagctacggcaagctctacctcagcccgctcttcgccatctccatcggctccgggttcctccgcttctcggccaccatcgtgcacgtgctgctcttccacggcgccgacatgtggcggcagagccggagggccatcggcgcggcggccaagctcgacgtgcacgccaggctcatgcagaggtacaagcaggtgccgcagtggtggttcctggtgctgctggcggggagcatcgccgtgtcgctgctcatgtgcttcgtgtggaaggagcaggtgcagctgccctggtggggcatgctcttcgccttcgcgctcgcgttcgtggtcaccctccccatcggcgtcatccaggccaccaccaaccagcaacctgggtacgacatcatcgcgcagttcatgataggctacgcgctgcccggcaagcccatcgccaacctgctcttcaagatctacggccggatcagcaccgtccacgctctgtccttcctcgccgacctcaagctcggccactacatgaagatcccgccacgctgcatgtacaccgcccagctggtggggacggtggtggccggcgtggtgaacctggcggtggcgtggtggatgctggacagcatcgacaacatctgcgacgtggaggcgctgcacccggacagcccctggacgtgcccaaagtaccgggtcaccttcgacgcgtcggtgatctggggcctcatcgggccggggcggctcttcggccagcacgggctgtaccggaacctggtgtggctgttcgtggtgggcgccgtgctgccggtgccggtgtggctgctgagcagggcgttcccggagaagaagtggatcgcgctcgtcaacgtgcccgtcatctcctacggcttcgccgggatgccgccggccacgcccaccaacatcgccagctggctcgtcaccggcaccgtcttcaacttcttcgtcttcaggtaccgcaaggggtggtggcagaagtacaactacgtgctgtcggcggcgctcgacgccggcaccgccttcatgggggtgctcatcttcttcgcgctccagaacgcgcaccacgacctcaagtggtggggcaccgaggtcgaccactgcccgctcgccacctgccccaccgcgcccggcatcgtcgtcaagggctgcccggtcttctgagcaccgagctcgccagagcatcatcggacactgcccaccatgtatgtagctagcagcgaccatcgtcatctggatcggcagaggaagccatgaactcgacctctctgcatcaattaagcgatgcagccgcccgtcctgagtcacattgtaaacatttgtgtgttttgctttcctccaaggaaatcaaatgcctagcttatataaaatcatcactctgaatacactcataggcaaatcacacccttcactattagtgtgatgaatccatagagaaatggtcaatgcaaagtaggagtagcaagcaaatcaatcccaacgaatacaggaatgcacacaatttgacagaagagaatgataagaacagagcatatttgctaatcactcaattgcactattctcagctgtcacctatcaggctatcagcagagagtgacatgagagggaggcacctgtggtcgtgggtcgtcgggcacgctggagtggatggttcagagtggcagctcgaacacctcgtctcctctcgcggcgatgtgcttcctgcagacccacccaatgtggccgtcgtctctgtaccgaacgcgccacaggccaaacctctgcgcaatgtccatccctgtcagaaccccctgtcctctcaagaaatccacgagccactgcctggccgctttcatatcctcccccatgtcattggtgccactgttcctcgcccttccgtacatcgctgccgcgcctagagcccccaccgacgcggcgccgtacatggccgaggagtccagccaggtgcaccacctccctgctcaggtcagggatcatctcccccatcccgacaatgaaatgcgcgccgatct

SEQ ID NO: 1650 - DNA, 2471 bp, Panicum virgatum
gtggcgctggtggtgccggagacggacgacccgtcgctgccggtgatgacattccgggcgtggacgctggggctgggctcctgcgtcgtcctcatcttcctcaacaccttcttcacgtaccgcacgcagccgctcaccatctcggggatcctcgcccagatcctcgtgctccccgccggccgcttcatggccgccgtgctgcccgaccgcgaggtcagggtcctcgggggccgcctcggcagcttcaacctcaacccggggcccttcaacgtcaaggagcacgtcatcatcaccatcttcgccaactgcggcgtctcctacggaggcggcgacgcctactccatcggcgccatcaccgtcatgaaggcctactacaagcagacgctcagcttcgtcctcgccctgctcatcgtcctcacaacgcagatactggggtacggctgggccggcatgctgaggaggtacctggtcgaccctgccgagatgtggtggccttctaaccttgcccaggtctcactcttcagggcgctgcacgagaaggaggaaggggacgacaagtcccggggcccgtcgcggatgcgcttcttcctcatcgtcttcttcgcgagcttcgcctactacgcgctgccggggtacctgctgccgatcctgaccttcttctcgtgggcgtgctgggtgtggccgcacagcatcacggcgcagcaggtcgggtccgggtaccacggcctcggcgtcggcgccttcacgctggactgggcgggcatctcggcgtaccacgggagcccgctggtggcgccgtgggcgtccatcgccaacacggccgtcggcttcgtcatgttcatctacgtcatcgtgccgctctgctactggcagttcaacacgttcgacgcccgcaggttccccatcttctccaaccagctcttcacggcggcggggcagaagtacgacaccaccaaggtgctcaccaaggacctggacctcaacgtcgccgcctacgacagctacgggaagctctacctcagcccgctcttcgccatctccatcggctcccgcttcctgcgcttcaccgccaccatcgtccacgtcctgctcttccacggcagcgacatgtggaagcagagcaggtcggccatgaacgcggtgaagctggacgtgcacgccaagctgatgcagaggtacaagcaggtgccgcagtggtggttcctcgtgctgctgctgggcagcgtggtggtgtcgctgctcatgtccttggtctggaaggaggaggtgcagctgccgtggtgggggatgctcttcgccttcgcgctcgcgttcgtcgtcacgctccccatcggtgtcatccaggccaccaccaaccagcaacccgggtacgacatcatcgcgcagttcatgatcggctacgtgctgcccggcaaacccatcgccaacctgctcttcaagatctacggccggatcagcaccgtgcacgcgctctcgttcctcgccgacctcaagctcggccactacatgaagatccccccacggtgcatgtacaccgcccagctggtcggcacggtggtcgccggcgtggtgaacctggcggtggcgtggtggatgctggacaacatcgagaacatctgcgacgtggaggcgctgcacccggacagcccgtggacgtgccccaagtaccgcgtcacgttcgacgcgtccgtgatctggggcctcatcggcccgggccggctcttcggccgccacgggctgtaccgcaacctggtgtggctgttcctcgccggcgccgtgctcccggtgccggtgtggctgctgagcagggcgttcccggagaagaagtggatcgcgctcatcaacatccccgtcatctcgtacgggttcgccggcatgccgccggcgacgcccaccaacatcgccacctggctcgtgaccggcaccatcttcaactacttcgtcttccggtaccgcaaggggtggtggcagaagtacaactacgtgctctcggcggcgctcgacgccggcaccgccttcatgggggtgctcatcttcttcgcgctgcagaacgcgcaccacgacctcaagtggtggggcacggaggtggatcactgcccgctcgcctcctgccccaccgcgccgggcatcgccgtcaagggctgcccggtgttctagctaggtgccttctttctaagctgaccgtcgtcgtagtacgtggtgatcggggtatgtcacactgtgccagggcgcggcgtaacgctgcaccttgcttttgagaagcgtggatttcagacgagcatcgattaagcgatgcagcgttctgtcactcgtgaatgtaacaatttcttcatcacaaaggtgcccttatagtgtacggtggattcaggggaggaacaaagagaagcgaaattctactgtatacagcagtctcgtttatgcaatatggatatttaaaagcaatacaaacaccatccaagttacagggtgat

SEQ ID NO: 1651 - DNA, 3831 bp, Setaria italica
gcgatcggaatataaatagaggcgagcaggggtctggcgctaccatccaagacccgagaatctctaaaggctaggctcccgtccacggcgggcagcggcgaagcatcggccgcggttgggacttgggagctagcggagcagagggagtgagcgagggaggtgggtgatggcgtcgcggaagtcgccggtggcggcggaggagcgggtggggaagcaggggagggggagggggagggggggtgggagcggtgcccggtggaggaggtggcgctggtggtgccggagacggacgacccgtcgctgccggtgatgacattccgggcgtggacgctggggctggcctcctgcgtcgtcctcatcttcctcaacaccttcttcacctaccgcacgcagcccctcaccatctcggggatcctcgcccagatcctcgtgctccccgcggggcgcttcatggccgccgtcctgcccgaccgcgaggtcaggctcctcgggggacggctcgggagcttcaacctcaacccggggccattcaacgtcaaggagcacgtcatcatcaccatcttcgccaactgcggcgtctcctacggcggcggcgacgcatactccatcggcgccatcaccgtcatgaaggcctactacaagcagacgctcagcttcgtcctcgccctcctcatcgtcctcacgacccagatactggggtacggctgggccggcatgctgaggaggtacctggtcgaccctgccgagatgtggtggccttctaatcttgcccaggtctcactcttcagggcgttgcacgagaaggaggacggggagaagtcccggggcccgtcgcggatgcgcttcttcctcatcgtcttcttcgcgagcttcgcctactacgcgctgccggggtacctgctaccgatcctgaccttcttctcgtgggcgtgctgggtgtggccgcacagcatcacggcgcagcaggtcgggtccgggtaccacggcctcggcatcggcgccttcacgctcgactgggcgggcatctcggcgtaccacgggagcccgctggtggcgccgtgggcgtccatcgccaacacggccgtcggctttgtcatgttcatctacatcatcgtgccgctctgctactggcagttcaacacgttcgacgcccgaaggttccccatcttctccaaccagctcttcacggccgccgggcagaagtacgacaccaccaaggtgctcaccaaggacttcgacctcaacgtggccgcctacgacagctatggcaagctgtacctcagcccgctcttcgccatctccatcggctccggcttcctgcgattcacctccaccatcgtccacgtcctgctcttccacggcagtgacatgtggaagcagagcaggtcggccatgaacgcggtgaagctggacgtgcacgcgaagctgatgcagaggtacaagcaggtgccgcagtggtggttcctcgtgctgctgctaggcagcgtggttgtgtcgctgctcatggccttcgtctggaaggaggaggtgcagctgccgtggtgggggatgctcttcgccttcgcgctcgccttcgtcgtcacgctccccatcggcgtcatccaggccaccaccaaccagcaaccagggtacgacatcatcgcgcagttcatgatcggctacgcgctgcccggcaagcctatcgccaacctgctcttcaagatttacggccggatcagcaccgtgcacgcgctgtcgtttctcgctgacctcaagctcggacactacatgaagatccccccacggtgcatgtacacggcccagctggtcgggacggtggtcgccggggtggtgaacctggcggtggcgtggtggatgctggacaacatcgagaacatctgcgacgtggaggcgctgcacccggacagcccgtggacgtgccccaagtaccgtgtcacgttcgacgcgtcggtgatctggggcctgatcgggccggggcgtctcttcggccggcacgggctgtaccgcaacctggtgtggctgttcgtcgtcggcgccgtgctcccggtgccggtgtggctgctgagccgggcgttcccggagaagaagtggatcgcgctcatcaacatccccgtcatctcgtacgggttcgccgggatgccgccggccacgcccaccaacatcgccacctggctcgtgacgggcaccatcttcaactacttcgtgttccggtaccgcaaggggtggtggcagaagtacaactacgtgctctcggcggcgctcgacgccgggacggcattcatgggggtgctcatcttcttcgcgctccagaacgcgcaccacgagctcaagtggtgggggacggaggtggatcattgcccgctcgcctcctgccccaccgcgccgggcatcgtcgtcaagggctgcccggtgttctgaatgttcagagagctgaccatggtaaccggtgcatgtaagggcgtggcgtaacgcaacacctgctttgagaaaccttggattcagccgagcatcgattgaccgatgcagtgtctgtcactcgtgaatgtaacacgtactttcttcatcacaaaggtgcacttatggcagtggtggattgagggggaggaaaacaggagcaaaaagtccacacaacagcgctcggtgttctgaggtttagtacaccctaattttgagtcataatgcaaaaaggcggctcggatttcatgtaaccaataatttattcaaaggactttcttaagagaaaattgtacttgattgttggcggctgggtcatattctgagactgatccgctgatggttatacatgcactatttgatctaaatgggcttatctgtgtgctaaatacatggttgatctaaatacattggctcgatataatcatgcagaaataactagcatttaaaagaaattgaagctagcaaaagcttcatctatctctgggtcaccagactgattcctagcccactggccactgagacactgagtagtttgtggttagcacaacatatttgttctagcacatggatcttatcggctctggatgtggctcaaagtggcagctcgaagatctcatcttcccttgcggcgatgtgcttcctgcagatccatgcaatgtggccatcatctctgtaccgaaccctccacaggccaaatctctgcgctatgtccatccctgtcaaaaccccttgccctttcaagaaatccacaagccactgtctggctgccttcatatcctctcccatgtcgctcgcgccaccttggttgctgttgttcctccctcttccatacagtgctgcagcacctaaagcccccactgacgcggcggatgcagccgctccatacatggctgaggagtctagcaggtgcaccacttccctgctcaggtcaggtatcatctcccccatcccgacaatgaaatgggcaccgatcttcagagcaaaggtcagcagcttcatgaacttgctcatgtaaggcagcaaggatttcaccgtctggttgtccacttgaatcaggtcacagccgagttggtcttctactacatgcatctctcttcggaactcacacagcatgtgcacccgtagggaccgcatcccaggcagtattcttgtgaccagctgtttggaccggttgtccaggcttacaagatagaacatctgaggtactttcctttcctccaactggatgttataattcatcacgtagtccattttcctgtggagttcagtcacaaggtgatactcgtaatacctcaagcttgctatttcctccttgaggtcccttattccttgttccactctcttcagtctttggagaaccatctcaacacctct

SEQ ID NO: 1652 - DNA, 2594 bp, Musa acuminata
tgaagctcgagagcaatggcatccaataaaagctccgtacctcaagagtcggcgccggaggtggcagcggcggcgggggaggaggagggggaggagaaggagtaccgcccggtggaggaggtggcgctggtggtgccggagaccgacgacccttcgctcccggtgatgacattccgggcctggttcatcggcctcgcctcctgcaccatcctcatcttcctcaacaccttcttcacctaccgcacgcagccgctcaccatctccgccatcctggcgcagatcacggcgctccctgtcggtcgcttcatggcgtcggtgctgcccaaccgggagatcagggtgttccggaactgggggttcaacctcaacccgggccccttcaacatcaaagagcatgttatcatcaccatcttcgccaactgcggggtgtccatcggcggcggagatgcctactccatcggcgccatcaccgtcatgaaggcgtactataagcagagcttgagcttcctctgcgggctcatcattgtgctcaccactcagatacttggttatggatgggcagggatgctgaggagatacctcgtagatcctgctgaaatgtggtggccttctaacctcgcccaagtttcactcttcagagcacttcatgagaaggattcgagatcgaaagggctaaccaggatgcagttcttcgtgctgttcttcgttgcaagctttgcatactacacactgcctggctatctcttgcccatactgaccttcttctcgtggatctgctggtcatggcctcgcagtataactgctcagcagattgggtcagcttaccacggccttggtgtcggtgccttcacgctggactgggcagggatctctgcgtatcatggcagtcctctggtcactccatggttctccattctgaacacagcagttggtttcatcatgttcatctacatcatagtaccgttgtgttactggaaattcaacacctttgatgcccggaagtttcccatcttctcgaatcagctcttcactaccagagggcagaagtatgatactaccaagatattgacgcccaactatgatctcaatgtagctgcgtatgagagctatggaaagctctacttgagtccactttttgcgctctccatcggatcaggttttgcaagattttcagccaccatcgtccatgttctcctgttccatggcagcgacatttggaggcagagcaagtcggcaatgaactctgccaaggtggacatccatgctaagctaatgaagaagtacaaacaagttcctcactggtggttcctcattctactagcagcaagtgtcatcttgtcattgatgatgtcgtttgtttggaaagaggaggtgcagcttccttggtgggggatgatatttgccttcgggttagcttgcctcgtcactcttcccattggggtcattcaggcaaccacaaaccagcaacctggatacgatattatagcccaattcatcatcggttacgtacttccagggaagcctattgccaatctgctgttcaagatatatggcagaatcagcaccatccatgcactctccttccttgctgacctcaaactcggtcactacatgaagatcccacccaggtgcatgtacaccgctcagctcgttggaactgtggtttccggtgtcgtcaaccttgcagtggcgtggtggatgttgggaagcatcgagaacatctgtgacgttgatgcactgcaccctgagagcccatggacttgccccaagtaccgagttaccttcgacgcttctgtcatatggggcctcgtaggacctggccgcctcttcgggcatggaggactgtaccggaacctggtgtggctgttcctcgtcggagcagcgttacccgttcccgtgtgggcactgagcaaaatctttccggagaagaagtggattcctttgatcaacataccagtcatctcctacggcttcgccggaatgcctcctgcaaccccaaccaacatagcgagctggctcatcaccggaaccatcttcaattactttgttttcagatacagaaagggatggtggcagaagtacaactacgttctctccgccgcactggatgcagggacagcgttcatgggtgtgctgctgttcttcgccctccagaatgcgaatcacaatctgcgatggtggggcacagagctcgatcactgtccgttggcatcatgccccactgaacctgggatatcagtaaaaggatgtccggtgttttagccacgagctctggatcgtcttaccgcagatgaacccttgacgatgtaaaaggacagaacaaagattgcaagcttagtgtgcgtctgcgtttaggagcacgaataaactatatggaaaggagtcattctcacgaataaactatacatgttgatgtttccccaaggatatctgttcatctttctgcaaacgccttgttcaacgtgaacgtaggagagatggccatggcgtatgctgcatgggaaacaacgtatgccacaacaggagaggagcgcagacgaggggaattgacctgttaacatcctgtcattattacttcatatcgaaatcaagac

SEQ ID NO: 1653 - DNA, 2782 bp, Musa acuminata
cggctcgtacattacccatcccttcccttctctccagagttgcgctccccgatggcctccaagggcgagaacaagggtggttcttccacggcggaggagggggaggaggtggagaggtgccccgtggaggaggtggcgctggtggtgccggagaccgacgacccatcgctcccggtgatgacgttccgggcctggttcctcggcctcacctcctgctccctcctcatcttcctgaacaccttcttcacgtaccgcacgcagccgctcaccatctccgccatcctcatgcagatcgcggttctgcccgccggccgtttcatggcctccgtgttgcccgacagggaggtcaaggtgttccggaactgggggttccacctcaaccccgggcccttcaacatcaaagagcacgtcatcatcaccatcttcgccaactgcggcgtgtccatcggcggaggggatgcctactccatcggcgccatcacggtgatgaaggcctactacaagcagagcttgagcttcctctgtgcgctcattattgtgctcaccacgcagatactgggttatggatgggctgggatgatgagaaggtatttggtggatcccgctgagatgtggtggccttccaatcttgctcaggtctccctcttcagagctttgcatgagaaggactcgagatccaaagggccaagcaggatgcagttcttcctcgtgttcttcgtagcaagctttgcctactacacattgccgggctatctcctgcccatactgaccttcttctcatgggtgtgctggacatggcctcgaagtattactgcgcagcagatcggatcagcttatcatggacttggagttggtgcattcacgcttgattgggcggggatctctgcgtaccatgggagtcctctggtgacgccatggttctccatcctcaatgtggccgtcggtttcctcatgttcatctacatcatcgtcccattgtgttactggaagttcaacacatttgacgcgcgcaagttccccatcttctccaatcagctattcactacgacagggcacaagtacgacaccaccaagatactgacgccagagtttgagctcaacgtcgctgcatacgagagttatgggaagctctatctcagtcctctttttgcgttgtcgatagggtcagggttcgcaaggttcacagcgaccatcatccatgttctcctcttccatggaagtgacatctggaggcaaagcaagtctgccatgaagtctgtgaagttggacatccatgccaaactgatgaggagatacaatcaagttcctcagtggtggttccttgttctactggtaggaagcattgctttgtcacttatgatgtcgtttatatggaaagaggaggtgcagctgccttggtggggtatgatatttgcttttggtttggcttggattgtcacacttcccattggtgtcattcaagcaaccacaaatcagcaacctggatatgatatcatagcgcagttcatgattggatatgtccttccgggcaaacctatcgcaaacctgctgttcaagatatatggtagaatcagcaccatccatgccctttccttcctttcagatttaaagcttggccattacatgaagattccacctaggtgcatgtacacagctcagcttgttggaactgttgttgctggagtcgtgaaccttggggtggcttggtggatgcttgaaagcattgagaatatctgtgatgttgaatcactgcaccctgatagcccctggacctgccccaagtatagagttacttttgatgcttctgtcatatggggccttatcggcccgggacgcctatttggccatggcgggctgtataggaacctggtgtggttattcctcgttggagctgtcttacctgttccggtgtgggtattgagcaaaatctttccagagaagaagtggatccctctcatcaatatacctgtcatctcttatggctttgctggaatgccacctgcaaccccaaccaacatagctagctggctcatcacagggaccatcttcaattactttgttttccggtatcgaaagggctggtggcaaaagtacaactatgtcttatctgcagctttggatgcagggacagcgttcatgggtgtgctgctgttctttgctcttcagaatcaggatcacaatctgaagtggtggggcacagagctcgatcactgccctttggcatcatgtccaaccgcacctgggatatcggttgaaggatgtccggtcttctaactacgagctcgagtatcggttcactcctgtgagggagttcactgttagacaaactcaatcaaggtccttggatgtgcattgtccttttagacttctaaagatgcttcacaaagtttagcaatgtcaaaaacaagctccaagaaatgtgagtttgaaaggtattgaatcaagccatatcaaggttgtcttctgacctttcatcagcttgtgagtgactataccagtgtttggcatcgcaaatgaaacccagatcagtacaccttattctatactgtaatgcttggtttgatcccttgactgctgttctctatttggtacagatgtttggcttttgacagtgaaatgtgcttggcttttgacaatgaaaagtgcctacggcagcaaagattaaagtcctcaagtccatgattgtaatgtgctcaggttttgcatgtcaaatttgtcctaagactccctcctcagttcctaaccatccaatagtgcataaaccaagcaaaggtgtgtaaat

SEQ ID NO: 1654 - DNA, 2541 bp, Musa acuminata
ctccgtctaagggaaaagctggttctccccaatggcctccaagggtgataggaaaggtgaacctccggtttcggaggagggggtggagagatgccccgtcgaggaggtgaagctggtggtcccggagaccgacgacccgtcgctcccggtgatgacattccgggcgtggttcctcggcctcacctcctgctccctcctcatcttcctcaacaccttcttcacctaccgcacgcagccgctcaccatctccgccatcctgatgcagatagccgtgctgcccatcggtcgcctaatggcctccgtgcttcccgacagggaggtcaatctgctccccgggtggggtttcaacctcaaccccggccccttcaacatcaaggagcacgtcatcatcaccatcttcgccagctgcggcgtgtcctacggcggaggcgacgcctactccatcggcgccatcacggtgatgaaggcctactataagcagaacttgagcttcctctgcgctctccttattgttctcagcacgcagatcttgggttatgggtgggctggaatgatgagaaggtatttggtggagccacctgagatgtggtggccttctaaccttgctcaggtctccctcttcagagctttacacgagaaggactcgagatcgcaagggctaagcaggatgcggttctttctcatcttcttcgtcgcgagctttgcctactacacgttgcccggctacctcttgcccatactgaccttcttctcctggatgtgctgggcatggcctcgtagcattaccgcacagcaaatcgggtcggcttaccatggcctcggagtcggcgcatttactctcgactgggcgggcatctccgcgtaccacggcagtcctctggtgacgccctggttctccatcctcaacgtggccatcggcttcatcatgttcatctacatcatcgtccccgtgtgctactggaagttcaacaccttcgacgcccgcaagttccccgtcttctccaatcagctcttcactgcgacagggcacaagtacgacaccaccaagattctgacgccggattttgacctcaacgtagccgcatacgacagctacggcaagctctacctcagccctcttttcgcactctcgatcgggtcaggattcgcgagattcacggcaaccatttcccatgtcctcctcttccatggaagcgatatatggaggcaaagcaagtcagcgatgaactccctgaagctggacatccatggcaaactgatgcggagatacaagcaagttcctcagtggtggttcgtcgttctactggcgggaagcatcgtcttgtcgctgatgctgtcgtttgtttggaaagaggaggtgcagctgccttggtgggggatgatatttgccttcggtttggcttggcttgtcacacttcccatcggagtcattcaagcaaccacgaatcagcaacctggatatgacattatagccgagttcatgattgggtatgtccttccgggcaaacctatcgcaaatctgctgttcaagatctacggaagaatcagcaccatccatgccctttccttcctcgcagatctgaagcttggccattacatgaagatcccacctaggtgcatgtacactgcccagctggcaggaactgttgtcgccggagtcttgaacctatctgtggcttggtggatgctcgaaaacatcgagaacatctgcgacgtcgattcactgcatcccgatagcccgtggacatgccccaagtacagagtcacctttgatgcgtctgtcatctgggggcttatagcccccgggcgactcttcgggcacggcgggttgtacaggaacctggtgtggttgttcctcgtcggcgccgtcttgcccgttcccgtgtgggtgttgagcaaggtcttcccggaaaagaagtggatatctctcatcaacgtacctgtcatcacctacggcttcgccggaatgccacccgcgaccccaaccaacatagccagctggctcatcaccggcaccatcttcaactacttcgtcttccgataccgaaaggtgtggtggcagcggtacaactacgtcttgtccgcagcgctggatgcaggtacagcattcatgggcgtgctgctcttcttcgctctccagaaccagcatcacaacttgcactggtggggctcggagctcgaccactgccccttggcgtcatgtccaaccgcgcctgggatatcagttaaaggatgcccagtcttctaaccacgagcttggctgttactgcattgccgtagagagttcgatcgcaggaggacaaggacaagctccgagagatgtgggttggttcttgagatcatcttcttcttcttcttcttcgctgtgttgactgcagttctccgtgtttggattttgagactgcaaaatgcttgtctatcatccgttttgttctaatttcccttctttaccttctccatctcctcccatgtatccccagagcatgatcatactgtgtgcaaggaccactacataaggctggcttagctgccatttacgac

SEQ ID NO: 1655 - DNA, 2668 bp, Quercus alba
tttgtttgtttcagacattattatgtaacatacatagtctctctttctctcagtccataagtacagcccccacttttttcttttttttttctttcggataagagtgtgacacagaaacaaaaactgagtctttattagccactgatgctcttgctagctattatcaatggcatccaagaatcaaagtgagtaccaaacagacacagagaaatcaaacggtggtggtgctaatggggcttcagaggaaaggtgtcccattgaggaagtggcactggttgtgccagagactgatgacccatcaatcccagtgatgactttcagggcatggttcttgggcataacttcatgcactctgctcatcttcctcaacactttcttcacctaccgtacacagccactggctatctcagccattctcatgcaaattgctgttttgcccattgggaagttcatggccgccacgcttccaaggaacgagtacagcctttttgggtggagatttagtttgaatcctggacctttcaacatgaaggagcatgtgatcatcaccatctttgccaactgtggtatctcttatggtggtggtgatgcttactcgattggtgctattactgtcatgagggcttattataagcaaggcgtgagcttcctttgtagcctcctcatcgttttgtccactcagattttgggatatggatgggctggaatgcttaggagataccttgttgatcctgttgagatgtggtggcctgcaaatcttgctcaagtttctctgtttagagcactacatgaaagggagcctaaaaatagtggaatgacccggatgcgatttttctacattgccatggcagcaagctttgcctattatgcactcccaggatatttatttccaatcttgacattcttttcgtgggtctgctgggcatggccacatagtatcacggctcagcaaattgggtctggttaccatggacttggagttggtgccttcactattgattgggcagggatatctgcttatcatggcagcccacttgtggcacccttctcttccattctcaatgttggggttggatttattatgttcatctacataattgtccctttgtgttactggaagtttgacacctttgatgctcggaaattccctatattttctaatcagctcttcactcacagtgggacaaaatatgataccactaagatcttgactccacaatacgatcttaatattgctgcttatgatagttatgggaagctctatcttagtcctctatttgccctatctattggatcaggatttgcaaggtttacagcaaccctcactcatgtggcactctttcatggcagtgatatttggaagcagagcagatcagcaattaagaatgcaaagttggacatccatgcaaaattaatgaaaaattacaagcaagtgcctgaatggtggttccttgttttgttaatagggagcattgttgtttctcttttattatgttttgtgtggaaagaagacgtgcagcttccatggtgggggatgctttttgcctttgccttggcttttattgttactctcccaattgggatcattcaagcaactaccaaccagcaacctggatatgacataatagcacagttcatgatcggttatgttctgcctggaaagcccatagcaaacttgcttttcaagatatatggaagaatcagcactgtccatgctctctccttcttgtctgacctcaaacttgggcactacatgaaaattccacctcggtgcatgtacacagctcagctggtgggaactctagtttctggtgtagtgaaccttgcagttgcatggtggatgctggagagcattgagaacatctgcgacgttgaagcacttcatcctgacagcccttggacctgccctaaattccgagtgacctttgatgcttctgtgatatggggtctgattggaccaaagcggctctttggacctggggggatgtaccgtaacttggtatggttgtacctcgttggagctttcttgccagttcctgtttgggtattgagcaaaatctatccagacaagaaatggattccattgataaacataccagttatatcttatggtttcgctggaatgccaccagcaactcccaccaatattgcaagctggcttatcacgggaaccatctttaactactttgtgttcaaataccataaaggctggtggcagaaatataactatgttctatctgctgcattggatgctgggacagctttcatgggtgtcctattgttctttgctttgcaaaacgaaggcaaaaatttgaaatggtggggtactaaacttgaccattgtcctttggcatcatgcccaactgcaccaggcattgtcgttgaaggatgtccagttttttaaatagtcctgcttgtttgaaggtccaaagacaaggtgggaatggtgtagtttgagaagaggagccaattttatatgttaaaagctggacgtatagattacattgaataaccaatggctttgcatttttgtacatgcttgttatctctagggtaggtgaatgagggttttcccctttgtgcctgatagtaggaattgatattcccttgaaatgttgttgtcagtagtttgatagtttcacatccttaattaagatgtttgcatttg

SEQ ID NO: 1656 - DNA, 2437 bp, Arabidopsis lyrata
agaagagaaagaaaatggacgccgagaaggctagtgatagaaacaatgtccatctttcttcggaccacgagcgttgtccggtggaggaagttgctcttgtggtgcctgagacggacgatccaagcataccggtgatgacattcagagcttggttcttgggtctgacctcttgtgttctgctcatctttctcaacactttcttcacctaccgcacgcagccacttaccatctcagccatcctcatgcagatcgctgttttgcccatcggcaagttcatggctcgtactcttcccaccacttctcacaaccttcttgggtggaattttagcctcaatcctggtccttttaatatcaaggagcatgtcattatcaccatctttgctaattgtggcgtttcttacggtggtggtgatgcttactctattggggctatcactgttatgaaagcttactataaacagagccttagcttcatctgtggtctcttcatcgtcttgaccactcagattttgggttatggttgggctggaattttgaggaggtaccttgttgatcctgttgacatgtggtggccttccaatcttgctcaagtttctctattcagagcgttgcacgagaaggaaaacaagtctaaaggcttaacgaggatgcagttctttctagtggctcttggtgctagctttctttactatgcacttccaggctatctattcccaatcttgaccttcttctcatgggtttgctgggcttggccaaacagcatcacggctcagcaagttggctcagggtaccatggccttggggttggagccttcactcttgactgggctggtatctctgcttaccatggtagtcccttggtggctccatggtcctctatcctcaacgttggtgttggtttcatcatgtttatatacatcgtcgtccctgtttgttattggaagttcaacactttcgacgccagaaagttccccattttctccaatcagctcttcactaccagtggccagaagtatgacacaaccaagatcttgacaccgcagtttgatctggatattggtgcttataacagctacgggaagctctacctcagccctcttttcgcactctctatcggatccgggtttgcgagattcactgcaacactaacccatgtggcattattcaacggcagggacatatggaggcagacttggtctgcagtgaatactacgaagctggacatccatgggaaattgatgcaaagctacaaaaaagtgcctgagtggtggttttatgtgttgctggcaggaagcgtagccatgtctcttctcatgtcttttgtgtggaaagagtcagtgcagcttccatggtggggaatgctctttgcttttgcattggcctttattgtcacactccctatcggtgtcattcaagcaactacaaatcagcaaccggggtatgatataatagggcagttcattatcggttatattctgcctggaaaacccattgcaaacctgattttcaagatttacgggcggatcagcacagtccacgctctctcattcttggcagaccttaagcttggccattacatgaaaatcccaccgcgctgcatgtacacggctcagctggtggggactgtggtagctggtgtagtgaatctgggagtggcctggtggatgctggagagcattcaagacatatgcgacattgaaggagaccaccctaatagcccgtggacttgccccaagtacagagtgacgttcgatgcttcagttatttggggtttgataggaccaagacggctgtttggaccaggaggcatgtaccgtaaccttgtctggctcttcctcatcggagctgtcctgcctgttcccgtgtgggcgctgagcaaaatcttcccaaacaagaagtggatacctctcataaacattccagttatctcctacggctttgcagggatgcctccagccactccaaccaacattgccagctggctggtcacaggaaccatcttcaactactttgtgttcaattaccacaagagatggtggcagaagtataactacgtactctctgcagcgctcgatgcaggaaccgcattcatgggggtgctcttgttctttgccctgcagaacgctggacacgacctcaaatggtggggcactgaagtagaccactgccctcttgcctcctgtcccacggcccctggaatcaaagccaaaggctgtcccgttttctaaattcagcaacttgattagactcaaacatataaaatcacatgttttgccctttctattgcttctttctgtacagccttctactgttagatagtggccatcagaatgcaataaactctattttagattcatttgagaatgataatgagctaataagacatccgtcatcttttgcttttcaccgatatagttgatctccagatgcttttgtt

SEQ ID NO: 1657 - DNA, 2411 bp, Brassica juncea
atggacgcagaaaaagctagcaacgataacaatggccacgtcgagcacgagcgctgtccggtggaggaagtggcactcgtggtccctgagaccgacgacccaactctaccggtgatgacattcagagcttggttcttgggtctgtcctcttgcgtcctcctcatcttcctcaacactttcttcacgtaccgcacgcagccgctcaccatctccgcgattcttatgcaaatcgccgtcttgcccatcggcaagttcatggctcggactctccccaccacttctcacaggcttatggggtgggagtggagcctcaaccctggtcctttcaacatcaaggagcatgttattatcaccatctttgctaattgtggtgttgcttacggtggtggtgatgcttactccattggagccatcactgtcatgaaggcttattacaagcagagtcttagcttcatctgtggtctcttcattgtcttaaccactcagattttgggttatggatgggctggaatcttgaggaggtatcttgttgatcctgttgacatgtggtggccatccaaccttgctcaagtctctcttttcagggcgttgcacgagaaggagcacaagtcaaaaggcttgacgaggatgcagttctttcttgtggcgcttggtgctagcttcctctactatgcacttccaggctacctattcccaatcttgactttcttctcatgggtgtgttgggcttggcctaatagcatcacggctcagcaagttgggtcagggtaccatggccttggagttggagccttcactcttgactgggctggtatctctgcttaccacggcagccccttggtggctccttggtcctctatcctcaacgttggtgttggtttcatcatgttcatttacatcatagttcctgtttgttactggaagttcgacactttcgatgctagaaagttccccattttctccaaccagctcttcacttccgctggccagaagtatgacacaaccaagatcttgacaccgcggttcgatcttgacatcaatgcttataacaactacgggaagctttacctcagccctcttttcgcgctctctattgggtctggttttgcgaggttcactgcaacgctaactcatgtagcattgttcaacggcagggacatctggaggcagacttggtctgcagtgaagacggtgaagctggacatacatgggaaactgatgcaaagatacaaacaagtgccagagtggtggttttatgtgttgctggttggaagtgtagcattgtctctcctcatgtcttttgtgtggaaggagtcagtgcagcttccgtggtggggaatgctctttgcttttgctatggcctttattgtcactctccctattggtgtcattcaagcaactactaatcagcaaccagggtatgatataattgggcagtttataattggttatatcctacctggaaagcctattgcaaaccttattttcaagatttacggaagaatcagcacagtccatgctctctccttcttggcagaccttaagcttggccattacatgaagatcccaccgcggtgcatgtacacggctcagcttgttggcactgtggttgctggtgtggtgaacttgggagtggcctggtggatgcttgagagcattcaagacatatgcgacattgaaggagatcaccccaatagcccctggacttgccccaagtacagagtcacctttgatgcttcggttatttggggattgataggaccaaaacggctgtttggagcaggaggcatgtaccgtaaccttgtctggctcttcctcatcggagctgtcttgcctgttcctgtgtgggccatgagcaagatcttccctgacaagaagtggattcctctcatcaacattcctgtaatctcctacgggtttgcagggatgcctccagcaactccaaccaacatcgctagctggctggtcacaggaaccatcttcaactactttgtgttcaattaccacaagagatggtggcagaagtataactacgtgctctctgcagcgctggacgcagggactgcattcatgggagtgctgttgttctttgcattgcagaatgctggacatgacctcaaatggtggggtactgaagtagaccactgccctcttgcctcctgcccaacggctcctggaatcatagccaaaggatgtcctgttttctaaattcaacaacgaacttttgagtattagattcaacacatgttatgcaaacatgttctattattgcttctttctgtacagccttttctactgctagatagtggccatcagaatgcaataaactctactttttagatctgaagatttgatataatgttaaaagtactaattgcgttgatctttgcttgtgtcatctctttttgtta

SEQ ID NO: 1658 - DNA, 3884 bp, Brassica rapa
aaagagcacacgtggataaactaacgtaaagaaagaaggggcaagaccgtaatttcgacttctcacttattaccagtcgttccatgtctctgtcctttggttatataaacaagacagacgcaactttgtctggtacctctctgtaaaagacatggacgcagaaaaagctagcaacgataacaatggccacgtcgagcacgagcgctgtccggtggaggaagtggcactcgtggtccctgagaccgacgacccaactctaccggtgatgacattcagagcttggttcttgggtctgtcctcttgcgtcctcctcatcttcctcaacacgttcttcacttaccgcacgcagccgctcaccatctccgcgattcttatgcaaatcgccgtcttgcccatcggcaagttcatggctcggactctccccaccacttctcacaggcttatggggtgggagtggagcctcaaccctggtcctttcaacatcaaggagcatgttattatcaccatctttgctaattgtggtgttgcttacggtggtggtgatgcttactccattggagccatcactgtcatgaaggcttattacaagcagagtcttagcttcatctgtggtctcttcattgtcttaaccactcagattttgggttatggatgggctggaatcttgaggaggtatcttgttgatcctgttgacatgtggtggccatccaaccttgctcaagtctctcttttcagggcgttgcacgagaaggagcacaagtcaaaaggcttgacgaggatgcagttctttcttgtggcgcttggtgctagcttcctctactatgcacttccaggctacctattcccaatcttgactttcttctcatgggtgtgttgggcttggcctaatagcatcacggctcagcaagttgggtcagggtaccatggccttggagttggagccttcactcttgactgggctggtatctctgcttaccacggcagccccttggtggctccttggtcctctatcctcaacgttggtgttggtttcatcatgttcatttacatcatagttcctgtttgttactggaagttcgacactttcgatgctagaaagttccccattttctccaaccagctcttcacttccgctggccagaagtatgacacaaccaagatcttgacaccgcggttcgatcttgacatcaatgcttataacaactacgggaagctttacctcagccctcttttcgcgctctctattgggtctggttttgcgaggttcactgcaacgctaactcatgtagcattgttcaacggcagggacatatggaggcagacttggtctgcagtgaagacggtgaagctggacatacatgggaaactgatgcaaagatacaaacaagtgccagagtggtggttttatgtgttgctggttggaagtgtagcattgtctctcctcatgtcttttgtgtggaaggagtcagtgcagcttccgtggtggggaatgctctttgcttttgcaatggcttttattgtcactctccctattggtgtcattcaagctactacaaaccagcaaccagggtatgatataatagggcagtttattattggttacatcctgcctggaaagcctattgcaaacttgattttcaagatttatggaagaatcagcacagtccatgctctctccttcttggcagaccttaagcttggccattacatgaagatcccaccgcggtgcatgtacacggctcagcttgttggcactgtggttgctggtgtggtgaacttgggagtggcctggtggatgcttgagagcattcaagacatatgcgacattgaaggagatcaccccaatagcccctggacttgccccaagtacagagtcacctttgatgcttcggttatttggggattgataggaccaaaacggctgtttggagcaggaggcatgtaccgtaaccttgtctggctcttcctcatcggagctgtcttgcctgttcctgtgtgggccatgagcaagatcttccctgacaagaagtggattcctctcatcaacattcctgtaatctcctacgggtttgcagggatgcctccagcgacaccaaccaacattgctagctggctggtcacaggaaccatcttcaactactttgtgttcaattaccacaagagatggtggcagaagtataactacgtgctctctgcagcgctggacgcagggactgcattcatgggagtgctcttgttctttgcactgcagaatgctggacatgacctcaaatggtggggcactgaagtagaccactgccctcttgcctcctgcccaacggctcctggaatcatagccaaaggctgtcctgttttctaaattgagtattagattcaaaacatgttatgcaaacatgttcctattattgcttctttctgtacagccttttctactgctagatagtggccatcagaatgcaataaactctgctttttggatttataatatgagattacaaagtactagttccattgatacttgctagtattttgctttttgagacgcatatgatcatttataaatttgaaagccaaacaataataatttgatccttgcttgtatcatcttttgcttttttgaaagccaaacaataataatttgtgaaaacttgaaagccacaatacaaaaccgaaaaaagagatttgctggttttacaagtttcatttttttttgttgttctaaattaatctaagaaaggagaagagatgataaaaagtcttgaaatcaaaagatacacatgactgaataatgcatctttcattatgttgcttaaaaccttattgacaactttaaaagacaacaaaattcgagcttattgagagggaaaaacacttttgcctgtgatgataatctcttcttcttcttctcatatcctatagcctcacacacccattctccatgagttagatactaagcatgtctgagtttccacatgctaatgggaactgggcactatatcatcatcttctcacctctggagggacttgtagagcaccacagttacatacttagccagaaagcggtgagtggaaccaagggcgaccacagatggaccgcttttgcctttctgcatgtaaagatggttgagaatgacgtgctgaggtctcggcaaaggagatggaatgtcagggctggctggaggcaagttcagcagtgtcatctgcaggtgcggcggaaccagagggggttctttggagtagtcctcagcgcctagaagcaagctgctgtaactagcctctggtgattgcggcggctcaaaaccagatatgctttcaatgtcttctggtacatagtcctgcacacaacgaacacacaaacaaaaccatatctctcctatcaacatagatgatatctccattgcattccctaaacacctcaaatagcctctctctctcacaccctaaaggtttcgaagtgaggttacctggaggtccaaaaggttgaaagtgttgccagcgtcgtcacgagctagagggagctcaggggcgtgcctccactgtccatcaacaatgaacctgtactcatacacacctgaaggcaagactttcattatagtgaagtctttcccagatctctgaagccgacttctgatacaaacaaacagaaacaacaatgagagatttgaaaaaagacaaataaaaactctaaaaaaaaaggggtaaggaccttgtcttccaattatcccaagacccttcaacagcaatctccttgcctccgtggcaccaagtgatcatggtggggatgccttgctcgttacaagcctcttcgtaggaaggggcctgcatccacgaagggtttgggatgtggatttcatctggtctttgaagaggaagcaccggtacct

SEQ ID NO: 1659 - DNA, 2444 bp, Brassica napus
ggacctctctcatgtaaaagacatggacgcagaaaaagctagcaacgataacaatggccacgtcgagcacgagcgctgtccggtggaggaagtggcactcgtggtccctgagaccgacgacccaactctaccggtgatgacattcagagcttggttcttgggtctgtcctcttgcgtcctcctcatcttcctcaacacgttcttcacttaccgcacgcagccgctcaccatctccgcgattcttatgcaaatcgccgtcttgcccatcggcaagttcatggctcggactctccccaccacttctcacaggcttatggggtgggagtggagcctcaaccctggtcctttcaacatcaaggagcatgttattatcaccatctttgctaattgtggtgttgcttacggtggtggtgatgcttactccattggagccatcactgtcatgaaggcttattacaagcagagtcttagcttcatctgtggtctcttcattgtcttaaccactcagattttgggttatggatgggctggaatcttgaggaggtatcttgttgatcctgttgacatgtggtggccatccaaccttgctcaagtctctcttttcagggcgttgcacgagaaggagcacaagtcaaaaggcttgacgaggatgcagttctttcttgtggcgcttggtgctagcttcctctactatgcacttccaggctacctattcccaatcttgactttcttctcatgggtgtgttgggcttggcctaatagcatcacggctcagcaagttgggtcagggtaccatggccttggagttggagccttcactcttgactgggctggtatctctgcttaccacggcagccccttggtggctccttggtcctctatcctcaacgttggtgttggtttcatcatgttcatttacatcatagttcctgtttgttactggaagttcgacactttcgatgctagaaagttccccattttctccaaccagctcttcacttccgctggccagaagtatgacacaaccaagatcttgacaccgcggttcgatcttgacatcaatgcttataacaactacgggaagctttacctcagccctcttttcgcgctctctattgggtctggttttgcgaggttcactgcaacgctaactcatgtagcattgttcaacggcagggacatatggaggcagacttggtctgcagtgaagacggtgaagctggacatacatgggaaactgatgcaaagatacaaacaagtgccagagtggtggttttatgtgttgctggttggaagtgtagcattgtctctcctcatgtcttttgtgtggaaggagtcagtgcagcttccgtggtggggaatgctctttgcttttgcaatggcttttattgtcactctccctattggtgtcattcaagctactacaaaccagcaaccagggtatgatataatagggcagtttattattggttacatcctgcctggaaagcctattgcaaacttgattttcaagatttatggaagaatcagcacagtccatgctctctccttcttggcagaccttaagcttggccattacatgaagatcccaccgcggtgcatgtacacggctcagcttgttggcactgtggttgctggtgtggtgaacttgggagtggcctggtggatgcttgagagcattcaagacatatgcgacattgaaggagatcaccccaatagcccctggacttgccccaagtacagagtcacctttgatgcttcggttatttggggattgataggaccaaaacggctgtttggagcaggaggcatgtaccgtaaccttgtctggctcttcctcatcggagctgtcttgcctgttcctgtgtgggccatgagcaagatcttccctgacaagaagtggattcctctcatcaacattcctgtaatctcctacgggtttgcagggatgcctccagcgacaccaaccaacattgctagctggctggtcacaggaaccatcttcaactactttgtgttcaattaccacaagagatggtggcagaagtataactacgtgctctctgcagcgctggacgcagggactgcattcatgggagtgctcttgttctttgcactgcagaatgctggacatgacctcaaatggtggggcactgaagtagaccactgccctcttgcctcctgcccaacggctcctggaatcatagccaaaggctgtcctgttttctaaattgagtattagattcaaaacatgttatgcaaacatgttcctattattgcttctttctgtacagccttttctactgctagatagtggccatcagaatgcaataaactctgctttttggatttataatatgagattacaaagtactagttccattgatacttgctagtattttgctttttgagacgcatatgatcatttataaatttgaaagcca

SEQ ID NO: 1660 - DNA, 2423 bp, Eucalyptus grandis
ccatcaatggccaccaaagaccaaacgcaagacccggaaaagccgaagaaagacctctcagaagaagctgaagaagaagtagaaagatgcccggtagaagaagtggccctggtcgtgccggaaacagacgacccgtcactcccggtgatgacattccgagtctggactcttgggttggcctcctgcatcatcctcatcttcctcaacaccttcttcaccttccggacgcagcccctcaccatctcggccatcctgatgcagatcgcggtgttgcccatcggcaggtttatggccaagactctgcccagcagagagtacaaggtgcttgggtatggctttagcttgaacccggggcctttcaacatgaaggagcatgtgatcatcaccattttcgccaactgcggggtgtccatcggtgggggcgatgcttactccattggagccatcactgtcatgaaggcctattacaagcagaacctgagctttctctgtggcctcgtcattgtcttgaccacacagatactgggatatggctgggctggattactcaggaagtaccttgtggatcctgtcgaaatgtggtggcctgcaaatcttgctcaggtttctctgttcagagcactccatgaaagggaacataaaacaagaggatttacccgaatgcagttctttctcatggcgatgggggcaagctttgtctattacgcccttcccggctatctgttcccgatcctgacgttcttctcttgggtctgctgggcctggccacacagtatcactgcccaacaagtaggatcagggtaccacggactcggggtcggtgccttcacactcgattgggccggaatctcggcttatcacggaagccccctcgtgtccccatggcattcgattgccaatgttgcgatcggcttcatcatgttcatatacataatagtgcctgtgtgttactggaagtacaacactttcgatgctcggaagttcccaatattttcaaatcagctgttcaagtctgatgggctcaagtacgataccaccaagatactgacccctgagtttgatctcaatgtttctgcttatgaaagttatgggaagctatacttgagccctctatttgccctctcaatagcatcaggtttcgcgcggttcacggctacgctcactcatgtggcattgttccatggcagcgagatcatgaagcaaagcagagctgccatcaagaatgcaaaactggacatccacgcaaagctaatgcaaagttacaaacaagtgcctcaatggtggttcctcattctactactaggaagcgccgtcgtgtccctcatgatgtctttcgtgtggaaagatgaagttcagctgccatggtgggggatgctattcgccttcggcttggcttttatcgttaccctcccaatcggggtcattcaagcgaccaccaaccagcaacccggatacgacatcatagcgcagttccttatagggtatgtgctaccaggaaaacccattgcgaatctgcttttcaagatctatggacggatcagcaccattcatgctctctcattcttatccgatctcaaactcgggcactacatgaagattccgccccgctgcatgtacacagctcagcttgttggtactttagtttctggagtagtcaacctcgcagttgcgtggtggatgctagatggcatcgagaacatttgcgacgtcgaagcgctccaccctgattctccatggacatgccctaagtaccgcgttaccttcgatgcttctgttatatggggattgattggaccaagaaggctgttcggaccaggaggattatacaggaacctgatttggttgttcctcatcggagctgtcctgcctgtgccaatttgggcattgagcaaaatgttcccggaaaagaaatggattgccttgataaacattccagttatatcctatggattcgccggaatgccgccagccactccaaccaacatagcgagctggctcatcactggaacgatcttcaactatttcgtcttcagataccggaaacgctggtggcagaagtataattacatcttatccgcggcattggatgctgggacggcttttatgggtgttctgttgttcttcgccctgcagaacgagaacaaaaacttgaaatggtggggaaccgatatcgatcactgccctctagcgtcgtgcccgactgcgccaggaattagtgtcccaaattgcccagttttcaattagctgtgtctatgtgagcttgctatttagtcgtttgcctttgcaaatttggagataagctgaatatgtattgagtgtgagcagaggaagatagatttgtatgatttgaatagatagggacctgctttgtatttcgtacatgattgcacgcccattctcagaggaattccagttatggttta

SEQ ID NO: 1661 - DNA, 2539 bp, Brassica juncea
caagatgcaactttgtctggtacctcatcaagaaatggacgcagagaaggctagcaacgataacaatggtcacgtcgagcacgagcgttgtccggtggaggaagtggctctggtagtccctgagaccgacgacccgactctaccggtgatgacattcagagcttggttcttgggcctatcctcttgcgtcctcctcatcttcctcaacactttcttcacgtaccgcacgcagccgctcaccatctccgcgattctaatgcaaatcgccgtcttgcccatcggcaagttcatggctcggactctccccaccacttctcacaggcttatggggtgggagtggagcctcaaccctggtcctttcaacatcaaggagcatattattatcaccatctttgctaattgtggtgttgcttacggtggtggtgatgcttactccattggagccatcactgtcatgaaagcctactacaagcagagccttagcttcatctgtggtctcttcatcgtcttgaccactcagatattgggctatggctgggctggaatcttgaggaggtatctagttgatccggttgacatgtggtggccatcaaaccttgctcaagtctctctattcagagccttgcacgagaaggagcacaagtcgaaaggcttgacgaggatgcagttctttcttgtggctcttggtgctagctttctctactatgcgcttccaggctacctattcccaatcttgactttcttctcatgggtgtgttgggcttggcctaatagcatcacggctcagcaagttgggtcaggataccatggtctcggtgttggagccttcacccttgactgggctggtatctctgcttaccatggcagccctttggtggctccttggtcttctatcctcaacgttggtgttggtttcatcatgtttatctacatcatagttcctgtttgttactggaagttcgacacgttcgacgccagaaagtttcccattttctccaaccagctgttcacttccgctggccagaagtatgacacaaccaagatcttgactcctcggtttgatcttgatattaatgcttataacaactacggaaagctttacctcagccctcttttcgcgctctccataggatccggttttgcgaggttcactgcaacgctaactcatgtagcattgttcaacggcagggacatatggaggcagacttggtctgcggtgaagacggtgaagcttgacatacatgggaaactgatgcaaagatacaaacaagtgcctgagtggtggttttatgtgttgctggttggaagtgtagcattgtctctcctcatgtcttttgtgtggaaggagtcagtgcagcttccatggtggggaatgctctttgcttttgctatggcctttattgtcactctccctattggtgtcattcaagcaactactaatcagcaaccagggtatgatataattgggcagtttataattggttatatcctacctggaaagcctattgcaaaccttattttcaagatttacggaagaatcagcacagtccatgctctctccttcttggcagaccttaagcttggccattacatgaaaatcccaccgcggtgcatgtacacggctcagcttgttggcactgtggttgctggtgtggtgaacttgggagtggcttggtggatgcttgagagcattcaagacatatgtgacattgaaggagatcaccctaatagcccctggacctgccccaagtacagagtgacctttgatgcttcggttatttggggactgataggaccaaaacggctgtttggagcagggggaatgtaccgcaaccttgtctggctcttcctcattggagctgtcttgcctgttcctgtgtgggccatgagcaagatcttccctgacaagaagtggattcctctcatcaacattcctgtaatctcctacgggtttgcagggatgcctccagcgacaccaaccaacattgctagctggctggtcacaggaaccatcttcaactactttgtgttcaattaccacaagagatggtggcagaagtataactacgtgctctctgcagcgctggacgcagggactgcattcatgggagtgctattgttctttgcactgcagaatgctggacatgacctcaaatggtggggcactgaagtagaccactgccctcttgcctcctgcccaacggctcctggaatcatagccaaaggctgtcctgttttctaaattgagtattagattcaaaacatgttatgcaaacatgttcctattattgcttctttctgtacagccttttctactgctagatagtggccatcagaatgcaataaactctgctttttggatttataatatgagattacaaagtactagttccattgatacttgctagtattttgctttttgagacgcatatgatcatttataaatttgaaagccaaacaataataatttgtgaaaacttgaaagccacaatacaaaaccgaaaaaagagatttgctggttttacaagtttagtctgcg

SEQ ID NO: 1662 - DNA, 2664 bp, Phalaenopsis aphrodite
gtacgaaaggataatagaacaaaattgctcattctctcacccaactctggctgcaaagagcgaccccatggtccgaaatgagtcgctgacgccccccgtggcttcggaggaggatggggcagagcgttgtgccgtagaggaggtggccctggttgtgccagagaccgatgatccgtcgatgccagtgatgacattccgggcgtggttcctcggcttaacttgctgcgtcctgctcatctttctcaataccttcttcacttttcgcacgcagccgcttacaatctcggcgatcttgatgcagattgcagcacttcccctcggtcggttcatggccggggtgctgccaagaaaagaggtgagggtctttaggggctggagttttaatctgaatcctggaccgtttaacatcaaggagcacgtaatcattaccatatttgccaactgcggggtctccattggtggaggagacgcctattccattggggctgtcgcagtgatgaaggtctactacaagcagactttgagtttcttatgcggcctcattattgtgctaactacacagatactaggttatggttgggctggaatgctaaggaggtatttagtagatccagcagaaatgtggtggccttcaaatcttgctcaagtttcccttttcagagctctccacgagaggaatttatcatctaaagggttgacaaggatgcagttcttcttcatattcttaacggcaagttttgcctacttcactctacctggataccttttccctatcctgacattcttctcttggatctgttggatctggcctcacagcatcacagctcaacagatagggtcaggctatcatggacttggtgttggagcatttactcttgattgggctggtatctctgcataccatggtagccctttggtcaccccatggttttctattctaaatacagctgttggtttcatcatgttcatctacataataatgcctctttgttactggagtttcaacaccttcgatgcaaggaagtttcccatattctcaaaccagctatttacttccaagggacagaagtatgacacaaccaagattctgacgccctcatttgagctcaatgaagccgcttacaatgactacgggaaactctatctcagtcctctttttgcaatctctataggttcaggttttcttcggtttactgcaacattaacccacgtgctcttattcaatggcagagatatctggaggcagagcaagtctgcagtgaattcagcgaagctggacatacatgcgaagctgatgaataactataaacaggttcctcagtggtggttccttgttcttctagcaggaagcatagggctatctctgttagtgtcatttgtatggaaggaggaggtacagctgccttggtggggcatgctctttgctttcggattggcatgggttgtcactctaccagttggagttatccaagcaaccacaaatcagcaacctgggtatgatatcatagcacagttcatgattgggtatgtcctcccgggaaagcccattgcaaacttgctctttaagatatatggtagaatcagcacgatccatgccctttctttcctgtctgacctcaagctcgggcattacatgaaaatcccaccaaggtgcatgtacactgcacagcttgttggaactgttgttgctggaatcgtcaacattgcagtagcgtggtggatgattaaaagcatcgagaacatatgcgatgttgatgccttgcatcccagcagcccatggacatgccccaaatatcgtgtcacatttgacgcttcagtcatctggggcctgataggccctgctcgactcttcggccacaatggaatgtaccgcaacttggtgtggctgttcctagttggtgcgctgctaccagtgccggtgtggttattcagcaagatgtttccagaaaagaagtggatacctttgataaatataccagtcatctcttatggatttgctggaatgcctccggccacacccacaaacatagctagctggctcgtcactggaacaatattcaattattttgtcttccgttacaggaagaattggtggcaaaaatacaactacgtgctatcagcagccttggatgcgggcacggccttcatgggtgtgcttctcttctttgctcttcaaaatgaaaatagaaatctgaaatggtggggaacggagattgaccattgtccattggcatcctgccctaccgaacctggaattgttgttaagggatgtcctgttttctaattctcatgattcaactacatgcatgcctttgagattatattttcaaagacttttgatgataagaggagaagaatggtgtcctttcttcgtcatgtgataggattttggagcttgaagcaatgtcttcaaactaagtcaatgtacacaaataactccttattttacccaaccacgttaattggcttgtgattaaagatactactatttgaaagaacttccgttaggggtaaatgcggtatacgaaaggtgtgctcttggaacttagagaatatgtctttaccaaacatatataagctttgctatggccaatatctttggtgtttgcttatttaacgaactggtgttcattagtatttaaaggctagcataatgaagattac

SEQ ID NO: 1663 - DNA, 2451 bp, Arabidopsis thaliana
ggtacttcagaagaagaaagaaaatggacgcggagaaggctactgataagactaatgtccatctctcctcggaccatgagcgttgtccggtggaggaagtggctcttgttgtgcctgagacggatgatccaagcctaccggtgatgacattcagagcttggttcttgggtctgacctcttgtgttctgctcatctttctcaacacgttcttcacataccgtacgcagccactcaccatctcagccatcctcatgcagatcgctgttttgcccatcggcaagttcatggctcggactcttcccaccacttctcacaaccttcttgggtggagttttagcctcaatcctggtccttttaacatcaaggagcatgtcattatcaccatctttgctaattgtggcgttgcttacggtggtggtgatgcttactctattggggctatcactgttatgaaagcttactataaacagagccttagcttcatctgtggtctcttcatcgtcttgaccactcagattttgggttatggttgggctgggattctgaggaggtaccttgttgatcctgttgacatgtggtggccttcaaatctcgctcaagtttctctcttcagagcgttgcacgagaaggaaaacaagtctaaaggcttgacgaggatgaagttctttctagtagctcttggtgctagctttatttactatgcacttccaggctatctattcccaatcttgactttcttctcatgggtttgttgggcttggccaaacagcatcacggctcagcaggttggttcagggtaccatggccttggggttggagccttcactcttgactgggctggcatctctgcttaccatggtagtccattggtggctccatggtcctctatcctcaacgttggtgttggtttcatcatgtttatatacatcatcgtccctgtttgttactggaagttcaacactttcgatgccagaaagttccccattttctccaaccagctattcactactagtggccagaagtatgacacaaccaagatcttgacaccgcagtttgatctggatattggtgcttataacaactacgggaaactttacctcagccctcttttcgcactctctatcggatccgggtttgcgagattcactgcaacactaactcatgtggcattgttcaacggcagggacatatggaagcagacttggtctgcagtgaacaccacgaagctggacatccatggaaaattgatgcaaagctacaaaaaagtgcctgagtggtggttttatatattgctggcaggaagtgtagccatgtctctcctaatgtcttttgtgtggaaggagtcagtgcagcttccatggtggggaatgctctttgcttttgcattggccttcattgtcacactccctatcggtgtcattcaagcaactacaaatcagcaaccaggatatgatataatagggcagttcattatcggttatatcctgcctggaaaacccattgcaaacctgattttcaagatttacgggagaatcagcacagtccatgctctctcatttttggcagaccttaagcttggccattacatgaaaatcccaccgcgctgcatgtacacggctcagctggtgggcactgtggtagctggtgtggtgaatctgggagtggcctggtggatgttggagagcattcaagacatatgcgacatcgaaggagaccaccctaatagcccctggacttgccccaagtatagagtgacgttcgatgcttcagttatttgggggttgataggaccaagacggctctttggaccaggaggcatgtaccgtaaccttgtctggctcttcctcattggagctgtcctgcctgttcccgtgtgggcgctgagcaagatcttcccaaacaagaagtggatccctctcatcaacattccagttatctcctacggctttgcagggatgcctccagccactccaaccaacattgccagctggttggtcacaggaaccatcttcaactactttgtgttcaattaccacaagagatggtggcagaagtacaattacgtactctctgcagcgctcgatgcagggaccgcgttcatgggggtgctcttgttcttcgccctgcagaatgctggacacgacctcaaatggtggggcactgaagtagaccactgccctcttgcctcctgtcccacggctcctggaatcaaagccaaaggctgtcccgttttctaagctcagcagaattgattagattcaaacataaaaattcacatgttttgccctttctattgcttctttctgtacagccttctactgttagatagtggccatcagaatgcaataaactctaccttagattcatttgagaatgataatgagctattgagacatctgtcatcttttgctttttcaccgatatatagttgatctgcagatgctttgttac

SEQ ID NO: 1664 - DNA, 2417 bp, Solanum phureja
ccaatgtccttaaaaaactccgtccaaccaccaccgctctccgccgcggacggtggcggtaagcttaacggagacacactctcctccgacgatgacagatgtccagtggaggaggtagctttagtagtcccggaaaccgatgacccaactttaccggtaatgacattccgggcatggtttctggggctctcgtcttgcactatcttgattttcctaaacactttcttcatttacagaactcagccattaacaatttcagctattttaatgcaaattgctgttcttccaattgggaaattcatggctgctacacttccgaagaagaattttgctttatttgggagatggggttcgtttagtttgaatcctggaccctttaatattaaagagcatgttgttattactgttatggcgaattgtggagtttccattggaggtggtgatgcttattcaattggagctattactgttatgagggcttattataaccagagtgtcagtttcctctgttctcttattattgtcttgactactcagatattggggtatggatgggcaggaatgttgaggagatacctcgttgaccctgtggatatgtggtggccatcaaaccttgctcaagtttctctattcagggcacttcacgaaaaggaaccaaaaacaagaagcttgacaaggatgaagtttttccttgtatttatggctgcaagctttgcatactacgctctcccaggctatctattcccaattttgaccttcttctcgtgggtctgttgggcgtacccacatagtatcacagctcaacaaattggctcgggatatcatggccttggtgtgggtgcttttacccttgattgggctggcatatcagcttatcatggcagtccactagtgacaccgtggtcctcaattctaaatgttgccgttggatttatcatgttcatatacatcattattcctctatgttactggaagtacaacacttttgatgctcaaaagtttcctatcttttcaaatcagttgttcacagctagtgggcacaaatacgataccactaaaatcttgactccacaatttgatctcaacattgctgcttatgaaaagtacagcaagctctacctcagtcctttgtttgccctctcaatcggatcgggatttgcaaggtttacagcaaccctcacacatgttgcactatttcatggaagtgatatttggaagcaaagtagatcagctgtaaagaatgtcaaaatggatattcatgcaaaattgatgaagagttacaagcaagtccctcagtggtggttccttgcattattggtaggtagcatagccctatcacttctgatgtgttttgtgtggaaagaagacgtgcagctgccgtggtggggcttgttgtttgcatttggtcttgcttttgttgttactctccctataggagtcattcaagcgactaccaatcagcaacccggatatgacataattgcacagttcataattggttatatcctcccaggaaaaccaattgcgaatttgcttttcaaaatctatggccggacaagtactgttcatgctctctcctttttagccgatctcaaacttggtcactacatgaaaattccgccacgatgcatgtacacagctcagctcgtgggaacactggttgctggtacaatcaaccttgctgtagcatggtggatgctaggaagcatcgataacatttgtgacgttgaggctcttcatccggacagcccatggacctgtcctaaattccgagtgacatttgatgcatctgtcatatggggtctaattggaccagaacggttatttggtccgggaggattatataggaatttggtatggttattcctcataggtgcattgctaccggtgcctatttgggtgctaagcaaaatgttcccggaaaagaaatggatcccattgatcaacatacctgttatatcatatggtttcgcgggaatgccaccagccacaccaacaaatatcgctagctggcttataacaggtatgatattcaactatttcgtgttcaaatacagaaaagagtggtggaagaaatacaactacgttctgtcagctgcgttggatgctggaacagcttttatgggtgttttactgtttttcgcgttgcaaaacgaggggaaaaacttgaaatggtggggaacagagttggatcattgtcccttagcaacttgtccaacagctcctgggattatagtacaaggatgtcctgttttcaaataggcataacaacaacaagaatgaatgaatgaattagttttagtgtttcgaggttcaaacaagtccgcgcattacattattattaatgtaattttgaatcaactgatgatagctttttgtgttgtgtaaatgatttgattataatgcagtcactactt

SEQ ID NO: 1665 - DNA, 2510 bp, Eutrema parvulum
atataaacaagacagatgcaactttgtctggtacctcagaaaggaagaagaagaaatggactccgagaaggctaataacgaaaagaatgggcatctcgagcacgagcgttgtccggtggaggaagtggctctcgtggtccctgagacagacgacccaactttaccggtgatgacattcagggcttggttcttgggtctgacctcttgcgtcctcctcatctttctcaacactttcttcacctaccgcacgcagccactcaccatctccgccattcttatgcaaatcgccgtcttgcccatcggcaagttcatggctcgggcccttcccaccacttcccacaagcttatgggatgggagtttagcctcaaccctggccctttcaacatcaaggagcacgtcattattaccatcttcgccaactgtggcgtcgcatacggtggtggtgacgcttactccattggagccatcaccgtcatgaaggcttactataaacagagccttagcttcatctgtggtctcttcatcgtcttgaccactcagattttgggttatggctgggctggaattctgaggaggtaccttgttgatcctgtcgacatgtggtggccatccaatcttgctcaagtttctctattcagagcgttgcacgagaaggaacacaagtcgaaaggcttgacgaggatgcagttttttcttatgattcttggtgctagctttctttactacgcgcttccaggctatctattcccaatcttgactttcttctcctgggtgtgttgggcttggccacaaagcatcacggctcaacaagttggctcaggctaccatggccttggggttggagcctttactcttgactgggctggtatctctgcttaccatggcagtcccttggtggctccttggtcctctatcctcaacgttggtgttggtttcatcatgttcatttacatcatcgtcccggtttgttactggaagttcaacactttcgacgccagaaagttcccaattttctccaatcagctattcacttccaccggtcaaaagtatgacacaaccaagatcttgaccccacggtttgatctggatattaatgcctataacaattacgggaagctttacctcagccctcttttcgcgctctctattggatccggttttgcgagattcactgcaacactaactcatgtggcattgttcaacggcagggacatttggaagcagacatggtctgcagtcaagaccgcgaagctggacatccatgggaaattgatgcaaagctacaaacaagtgcctgagtggtggttttatgtgttgctggtaggaagtgtagccatgtctctcctcatgtcttttgtgtggaaggagtcagtgcagcttccatggtggggaatgctctttgcttttgcaatggcttttattgtcactcttcctataggtgtcattcaagcaactacaaatcagcaaccggggtatgatataatagggcagttcattatcggttatatcatgcctggaaaacccattgcaaaccttattttcaagatttacgggcgaatcagcacagtccatgctctctcattcttggcagaccttaagcttggccattacatgaaaattccaccgcgctgcatgtacacggctcagctggtgggcactgtggtagctggtgtggtgaatctgggagtggcctggtggatgcttgagagcattcaagacatatgcgacatcgaaggagagcaccctaatagcccctggacttgccccaagtacagagtgacgttcgatgcttcagttatttgggggttgataggaccaaaacggctatttggagcaggaggcatgtaccgtaaccttgtctggctcttcctcatcggagctgtcctacctgttcctgtgtgggcgatgagcaagatcttcccaaacaagaagtggatccctctcatcaacattcctgttatctcctacggctttgcaggaatgcctccagccactccaaccaacatcgccagctggctggtcacgggaaccatcttcaactactttgtgttcaactaccacaagagatggtggcagaagtacaactacgtactctctgcagcgctcgatgcagggactgccttcatgggggtgctcttgttcttcgccctgcagaatgcaggacatgacctcaaatggtggggcacggaagtagaccactgccctcttgcttcctgccccacggctcctggaatcagagccaaaggctgtcccgttttctaaattcaggaagtctattagattcaaacatataaaaaaacatgttttgctctttgtattgttgcttcttctgtacagccttttctactgctagatagtggccatcagaatgcaataaactctgctttagatttgaaaattgagataatgaagtactaattggataagggctttgcgttgatgcttattaagacatctgtcatcttttgcttttcaccaatatattcgtgatctgcagatgctttgttac

SEQ ID NO: 1666 - DNA, 2095 bp, Panicum virgatum
gggaaaaaaaagaaaaggaaaggaaattccaaaccctcttcccccaaaatcgcagcggcggcttatccaccttgatcgagtcgaagcctctctccgacaaggcgtcgccgtcggacctctcgtagagccgccgaccttctccgcgcctcgcgccggtgaggtgatccgggcgatctgatccagtggtggtgcggtgcgattctgttgcggaaatttttgttgagggggaattttctgcgggcggcgccggcgccggcgccggaggcgaagcgaagatgatccgtcttcagacgtacgcggcgttcagcctgctggcgaccgcgtcggcggtgtactacgccttcagcagccgggatcagttttacccggcgatggtctacctctccacctccaagatctgcttcgtgctgctcctcaacacgggcctcgtcgccatgtgcgtcgcctggcagctcgtcaagcgcctcttcctgggctccctccgggaggccgaggtcgagcgcctcaatgagcagtcctggcgggaggtcgtcgagatcctcttcgcggtcaccatatttcgtcaggacttctccgtctccttcctcgccatggtcgctgcgctgctcctcgtcaaggcgctgcactggctggcacagaagagggtcgagtacatcgagaccacgccctccgtgcccatgctctcgcacataaggatcgtctccttcatggcgttcctgctcatcgtcgactgcctcttcctgtcgaactcgctcaggtcgctcatagacaagcgggaggcgtcagttgccatattcttctcctttgagtatatgatactggcaacatccacagtatcaacatttgtgaagtatatattctatgtcagtgacatgctaatggaaggtcaatgggagaaaaaggcagtgtatacatttctatttggaactcatcagtgaccttgtgcacttatcattatacatgctcttcttcatagctatcttcctgaactacggtgtcccgctgcacttgattcgtgagctatatgagaccttccgcaacttcaaaattcgtgttgcagattatgtacgctacagaaaaatcacttccaacatgaatgaacgttttccagatgctacagcagaggagctcaatgcgagtgacgctacatgtattatttgccgtgaggagatgactacagcaaagaagctgctttgtgggcatctgttccatgtgcattgtctaaggtcatggctagagcgccagcacacttgccccacgtgcagagctccaatcatccccccagataatggacgtgctgcatcagccggacaacatggagctcaacctggagttcagccaggtactggtactccagcctcagaaggagcagtgggtgacaacatgagcagacgccaagcaaagcttgaagctgcagcagcagcagcttctttatatggaagatcttttgcttatcctccagcaaacatcctaaataggtcaggtccttcacagtctacatcaagtacaccacaatttgaagcaagtagctccaatcaatcacagaaagaccaagaactgcagttccagaacaccagcgatggtttcgcacctctgccttttaatgcacatggtgccatgggttcaggaacaatcaccagggatcttgaaaattcactgcagagggcacaagaaaactttataaagagtcagatagagatgttacaaatccagttgcaaatggttcagcgtggtgctgctgtgccggccactaacaatgagaatgccgagcacacaaagaatgattgaaactgtaaatactaaataggcagagatgagaacgggataaacaaaacaaagatttggctgtacctgaggggaaactgttgcatgatgccttgccttgattttggtaggtttgttcatttacacttccctgttagtgccctcttagcaacaccagatgtttcatctttttatgtggtggttgcgcagtttggatctctgtcaagcccgtataataccattgatagaggctgtcgtgttgtaacaatggctagttgagagactaaacaaaatccatttatccaggaaaagaaatagaatggttcttttt

SEQ ID NO: 1667 - DNA, 2236 bp, Zea mays
ggaccaatgggcctagagcccctagacaggcagtttccatgcctgctccaggcccaggcaaaacagcaccggactgcggctccaccattgccgttcctgtttcttcgaattcttctcccgttcaggcgtccatccctcttttctctcgtggcgacgaagacgaccgacgccgacgctgacgccctacgccaggtgccaggttccgtcgggtccttcgccggcgaagagcatccaccaggcgacccagtgctgttctggtgcggtttcattgcggaagttttgttgtgggattttccggtggcgaagatgatccgactacccatgtacgcggcgttcagcctgctggcgacggcttcggcggcgtactacgcgttcagcagccgggagcagttctacccggcgatggtgtacctctccacctccaagatctgcttcgtgctgctcctcaacacgggcctggttgccatgtgcgtcgcctggcagctcgccaggcgtctcttcctcggctccctccgggaggccgaggtcgagcgcctcaacgagcagtcctggcgggaggtcatcgagattctcttcgccgtcaccatcttccggcaggacttctcggtgtccttccttgccatggtcgctgcactgcttcttgttaaggcactgcactggctcgcgcagaagagggtcgagtacatcgagaccacaccctccgtgcccttgctctcgcacatcaggattgtatccttcatggttttcctgctcacggtcgattgcctcttcctgtcaaactcactcaggtcactcatacagaagcgggaggcgtctgttgccatcttcttctcctttgaatatacgatactagcaacatccactttatcaacatttgtgaagtacatattctatgtcagtgacatgctaatggaaggtcaatgggagagaaaggcagtttatacattttacttggagctcatcagtgaccttgtgcacttgtcattatacatgctcttcttcatagctatcttcttgaactatggtgtcccgctgcacttgattcgtgagctatatgagaccttccgcagcttcagaattcgcattgcagattacatacgttacagaaagatcacttccaacatgaatgaacgctttccagaagctacatcagaagagctcgatgcgagtgatgctacatgtattatttgccgtgaggagatgactacagcaaagaaactgctctgtgggcatctgttccatgtgcattgtctgaggtcatggctagagcgccaacacacttgccccacgtgcagagctccaatcgttcctgcagataatggacgtgctgcatcatcacgacaacatggagcccaggctggggttcaacctggtactgccactccatcctcagaaggagcaccaggtgagaacatgagcaggcgccaagcaaaacttgaagctgctgctgcagcagcttctttatatggaagatcttttgtttatcctccagcaaacaccctaaacagcaggtctggttctccccagcctacatcaagtgcaccacaatctgaagccagtagctccaatcatcagtcacaaaaagaccaagaaacacagctccaaaacagcagcgatggtttagtgcctctgccttttagtgcagatggtgttgttggttcaggaacaagcacaagagatcttgaaaattcactgcagaaggcacaagaaaactttattaagagccagattgagatgttacaaatccaactgcaaatggtgcagcgtggcgctgctgggttgagcagtagcgagaacactgagcacacagaagactgactgaatctgtaaacaggcactcctgcatcgtggagtaataatgagaatactgagcacacgcagctgaatctgtaaataggcggagatgaggatggggataaaagaaagcaatcaaagaattggctatacctgggggaaactgatgttttgcctggattttggtaggcttgttgactatgctttcctgttactgtgttagtgccttcttgccagcgttagatgtttctctacgtgtggtggtttctgtaggttgggtacatctaattgctagtttaattatacgattacacaaaattcttgtaccgagggaaaatagaaaggataattgtacaaatgacttttttgtgtgcatatccatgatatcgggattgtctgtagattttgtgtttactggagtaaaacagaaaatttggctgct

SEQ ID NO: 1668 - DNA, 2759 bp, Setaria italica
agtttgtggctctcgctccctagtcctggcgagtccaaacaaaaaggaagttcacaacacaaggacgcaaaaacaaaacgcgaccggcagctgagctgagcaagcagcacagagcggagccagctcgcctcgcctcccctcccctcctcagtcgcctccacttctatatcacttccctctgcccccgccccgtgcgccatcgcgcacatccacgcgcgcgcgcgcccacacgtgcggctccccggattcgcgccgccgcggcagagccagccaggcaaagccaggccagcagcttcggatcgaggaagaggaagggcaagaggaagacgaggaggaggaggcgaggagtcaacccagcttgccagccatggacggatcggccgcggagctggaggcggcggagcgggtggtgatgcggtgggactcggcctcggcgggcgccggcgccgacgagccgatgctgttcgacggcgccggggaccgggccgaggcggaccgcttcctccgcgccgtcgacgacctgcgccgcctcgcgccgccgtcgcccgcggccgtcgggagcccgcgccgcctctcgtcgtcctcggtctcctccgccgccgccgggagcggcgccgtgcaagtcgccatggcgcggctcgaggacgagttccgccacgtgctctcgtcccgcgcactcgacctcgagatcgaggcgctcgccgacctcagctcgctctccatcaacagcgaccgctccaactcggcatcctccgccgacctccccgccgccgacgaggacgactccgtctccgcctccatcggccgccgcagcagcgcctaccgctcgctacggagcatccgcgagatcgacctcctgcccgacgacgccgtcgccgacctccgcgccatcgcgtcccgaatggccgccgctggctacggccgcgagtgcgcgcaggtctacgcctccgtccgcaagcccgccgtcgacgcctccctgcgccggctcggcgtcgagcgcctcagcatcggcgacgtccagcgcctcgagtgggacgcgctcgaggccaagatccgacgctggatccgcgccgcccgcgccgccgtccgcggcgtcttcgccagcgagcgacgcctctgcttccacatcttccacgacctccccatctccagcagcaccatctccgccgccgccgcgcccgccactcacgacacccccttcgccgaggccgtcaagggcgccgcgctgcagctgttcggcttcgccgaggccatcagcatcggccgccgctcccctgagaagctcttcaagatcatagacctccacgacgcgctctcggacctcctccctgacgtctccgatattttcgccgcctccaaggcagcggagtcgatatacgtgcaggccgttgagatccggtcgcgtctcgccgacgccgtgagagggatactctcggagttcgagaacgccgtgctccgcgatccgcccaagaccgcagtgcccggcggcaccatccacccgctcacccggtatgtgatgaactatagcagcctcatttgcgactacaaggtcacgctctccgagctgatcgtgtcacgtccatcggctagtgcgcgtcttgctgctgagggcaatgagctcgtgccgtccttggcggaccttgagcttcctgagcttgagaaccagttgccgcttgcctcccacattgtctggatcattgttgttcttgaacacaacctggagggcaaggcggcactctacaaggatctggctctttcacatttgttcatgatgaacaatgtacactacattgtgcacaaggtgaaagattcgccagacctctggggcatgattggtgatgactacttgaaacgtctcaccggcaagttcacaatggcagccacaaactaccagcggacctcgtggttgaagatcttgaattgtttgcgtgatgaggggctccatgtaagtggtggattttcgtcaggaatatccaaatcggcgctgagggagcggttcaagtccttcaatgctgcgtttgaggacgcgcatagggtgcagtctgggtggtgtgtgccagacaaccagctaagggaagagctaaggatctcaattgcagagaagctgctgccagcataccggtcgttccttggcaggtttcgacatcatatagagaatgggaagcatccagaactttacatcaagtactctgttgaggaccttgagatagcagtgggtgatttctttgaaggtgttcctccttccccgcataataggaggagatcacatggatgaagaacttgtacctcaggcattcaactggactgctgttgctatttattcttttattcttcacacggaagctggtgctggcatttggggctctgtttaactgttctgatactatattgctgatcttcaaccagagatggcaaaatatgaatacattttgggatcttgttgaagctgtcaatcgccccagtggttcctgctctgtaagagaacttgttcatttgttacactattattatataaattttgcaaagtagcatgtccatataggaaattctttcagtaatgtttgatagttggaactcatggcatttctgcccctgttttgcatcagcctttgttgcccttttcattgttaacaattatccaaagggtctatgctttgtggattagatgtaaaaagatttacatgactctcatgtaccacatgattttgtaatatgataatatcatggtgttacaaatttgaaagaaaatttcgagtctt

SEQ ID NO: 1669 - DNA, 2524 bp, Zea mays
ccctctgtcccagcagccctgtgcgccatcgcgcggcccacacgagcggcttgccggattcgcgccgacgcggcagacccagacaggtcagcttcggatcgaggaagaggaggcggtggaggcgaggagtcaactaaacttgccagccatggacggatcggccgcggagctggaggcggcggagcgggtggtgatgcggtgggactcgtccttggcgtgcggtggcacggacgagccgatgctgttcgacggcggcggaaaccgtgccgaggccgaccggttcctccgcgccgtcgacgacctgcgccggctcgcgccgccatcgcccgcggtcgtgggcagcccgcgccgcctctcgtcgtcttcggcggcgaggagcggcgccgtgctggtcgctatgacacggctcgaggacgagttccgccacgtgctgtcgtcgcgcgccctcgaccacgagatcgaggcgctcgcggaccttagctcgctctccatcaacggcgaccggtccaactcggcctcctccgccgacctctccgccgccgacgaggacgactccgtgtcctcctccattggccgccgcagcaccgcctaccgctcgctccggagcatccgcgagatcgacctgctgcccgacgacgccgttgcggacctccgcgccatcgcgtcccgcatggccgccgccgagcacggccgcgagtgcgcgcaggtgtacgcgtccgtccgcaagccctctgtcgacgcctccctgcgccggctcggcgtcgagcgcctcagcatcggtgacgtccagcgcctcgagtgggacgcgctcgaggccaagatccgccggtggatccgcgccgcccgcgccgccgtccgcggcgtcttcgccagcgagcgccgcctctgcttccacatcttccacgaccttcccatctccgccgcctcagcgcccgccacgcacgacacccccttcgccgaggccgtcaagggcgccgcgctgcagctcttcggcttcgccgaggccatcagcatcgatcgccgctcccccgagaagctcttcaagatcatagacctccacgacgcgctctcggacctcctacccgacgtctccgacatcttcgccgcctccaaggtcgcggagtccatatacgtgcaggccgttgagatccggtcgcgcctcgccgatgccgtgagagggatattctcggagttcgagaacgccgtgctccacgacccgcccaagaccgcagtgcctggcggtaccgtccacccgctcactcggtatgtgatgaactatagcagcctcatttgcgactacaaggccacgctatccgagctgatcgtatcgcgtccatcagctagcgctcgtcttgctgctgagggcaatgagctcgtgccgtccttagctgacctcgagctccccgagcttgagaaccagttaccacttgcctctcacattgtctggatcattgttattcttgaacacaacctggagggcaaggcaacactctacaaggatccagctctctcgcatctgttcatgatgaacaatgtgcactacatcgttcacaaggtgaaagattcgccagatctctggggcatgatagctgatgattacctgaaacggcttactggcaagttcacaatggcggccacaaactaccagcaggcctcatggttgaagatcctgaattgtttgcgtgatgaggggctccatgtaagtggtggcttttcgtcagggatatccaagtcggcactgcgggagcggttcaagtccttcaacgctgcatttgaggacgcgcatagggtgcagtcagggtggtgcgtgccagacaaccagctgagggaggagctcaggatctcgattgctgagaagctgctgccagcataccagtcattccttggcaggtttcggcatcatatagagaatgggaagcatccagagctgtacattaagtactctgttgaggaccttgagatagctgtgggtgatttctttgagggcgttcctccttccccgcatcacaggaggagatcacatgggtgaaggtcctgtacatcaggtattcaactagctgttgttgctatttattcttttattcttcacgaggaagctggtgctggtatttgggctcgatttcttctgtcctgatagatgtgagtataaatttggtgatcttcaatcaaagatggcaaatatgaatatattttgggggtctttctgaagctgtcaatcggcacagtggttcctactccgtaagagaagttgttcatttggcttcaatcaaagatgttatatagatcttgcaagtagcatgtccatataggaaattttttcagtaacgtggatagttggaacaacccatggcatttctgcccctgttttgcaccagcttttgttatccttttcaatgttaacaattatccaaagggtctatgctttgtgggttagatgtaaaaagatttatgtaactctcatgtaccacatgattttgtaatatgataatatcatgcttttacaaattcaaaaactccatggcac

SEQ ID NO: 1670 - DNA, 2318 bp, Oryza sativa
caatggacggatcggcggagctggaggcggccgagcgggtcgtcatgcgctgggactccacctccgcctccgacgagccgatgctgttcgacggcgcccgcgccgaggccgagcgcttcctccgcgccgtcgacgacctgcgccgcctcgcgccgccgtccccggccgccgtcgggagcccgcgccggctgtcgtccgggtcgtcgtcggtctcggccgggggtggtggcggcgcggcgaccgccgtgcaggtcgcgatggcgcggctcgaggatgagttcaggcatgtgctgtcgtcccgcgcgctcgaccttgagatcgaggcgctcgctgacctcggcggctcgctctccatctccagtgaccggtcgaactcggcctcgtctgctgagctccaggtggtggatgaggatgactccgtgtcgtcgttggttgggcggcggagcagctaccgctcgctccccagcatccgcgagatcgacctcctccccgacgacgccgtctccgacctccgcgccatcgcctcccgcatggctgcggccgggtacggccgcgagtgcgcgcaggtgtacgcctccgtccgcaagccggcggtcgacgcctccctccgccggctcggcgtcgagcggcttagcatcggcgacgtccagcgcctcgagtggaaggccctcgaggccaagatccgccgctggatccgcgcggcccgcgccgccgtccgcggcgtcttcgccagcgagcgccgcctgtgcttcctcatcttccacgacctccccatctcgaacatcaccgtcaccgccgccgcccccgccacgcacgacacccccttcgccgaggccgtcaagggcgccgcgctgcagctgttcggcttcgccgaggccatcagcatcggccgccgctcccccgagaagctcttcaagatcatcgacctccacgacgcgctctccgacctcctcccggacgtctccgacatcttcgccgcctccaaggtcgccgagtcgatatacgtccaggccgccgagatccggtcgcggctcgccgacgccgtgcgcggcatactctccgagttcgagaacgccgtgctccgtgacccgcccaagacggcggtgcccggcggcaccgtgcacccgctcacccggtacgtgatgaactacagcagcctcatctccgattacaaggtgacgctctccgagctgatcgtgtcgcggccatcggcgagcgcgcgcctcgccgccgagggcaatgagctcgcgccgtccttggccgagctcgacctccccgagcctgacaaccagacgccacttgctgctcatatcatctggatcattgttgtcctggaacacaacctcgagggcaaggcctcactctacagggacacggctctctcgcatttgttcttgatgaacaatgtgtactacatcgtgcacaaggtgaaggattcgccggatctatggaatctgattggtgatgattacttgaagcggcttacgggtaaattcacaatggcagccacgaactaccagcgcagcgcatggttgaagatcttgaattgcttgcgagacgaggggctccatgtaagtggtggcttctcgtcagggatatccaagtcagcgctgcgggagcggttcaggtccttcaatgccgcattcgaggaggcgcatagggtgcaatcaggatggtgtgtgccggacacacagctgagggaggagctaaggatctcaatttcagagaagctggtgccggcataccggtcattccttggcaggtttcgacatcatattgagaatgggaagcacccagagttgtacatcaaatactcagcagaggaccttgagattgctgtgaacgatttctttgagggggttcctccttccccacatatcaggaggagatcacatagctgaagttgttgtacatcaagcattcaacaggggtgctgttgttatgtattctttgattcttcagaggaaaccaatgccagcatttgctgccctggttttactctttggtacttataagggtataggtggcgatattttcaatcagagatgacatctgaaatcatttatgggttctcgttcaagctgtcagtcccctccattgttcctctgtaagagaactcgtttcatttgttacacaattactgttatatataattttgcaagtagcaagttcatatagaactattcttcggtaattttggctagttgggactgagcttttgttaacaattatctggagagaatacttgtggattagatgtaaaaatgatttataccactctcttagtctcttctaccacaattttataatgtgatact

SEQ ID NO: 1671 - DNA, 2668 bp, Oryza sativa
ctatctcccccccccccccccccccccccccccccccaaggcagcccggtcgtcgctgagtccaaacaaaaaagaagcagaagaactccacatccacaaggcggcagtccacacgccataaacaaaagggcagcagcgacgcctcgctcacctgtctcgcgcgaccgggcgctgcacagagcggtgccagctcgcctcccccccgtgcgccatcgcgccaacccaggcgcggccgcgcgccccacacgtgcggctccccggattcgcgccgccgcggtacaaagcgcgccccagctcgcgtcgcgcgggggcacggcaccacgacgacgacgagtcaatggacggatcggcggagctggaggcggccgagcgggtcgtcatgcgctgggactccacctccgcctccgacgagccgatgctgttcgacggcgcccgcgccgaggccgagcgcttcctccgcgccgtcgacgacctgcgccgcctcgcgccgccgtccccggccgccgtcgggagcccgcgccggctgtcgtccgggtcgtcgtcggtctcggccgggggtggtggcggcgcggcgaccgccgtgcaggtcgcgatggcgcggctcgaggatgagttcaggcatgtgctgtcgtcccgcgcgctcgaccttgagatcgaggcgctcgctgacctcggcggctcgctctccatctccagtgaccggtcgaactcggcctcgtctgctgagctccaggtggtggatgaggatgactccgtgtcgtcgttggttgggcggcggagcagctaccgctcgctccccagcatccgcgagatcgacctcctccccgacgacgccgtctccgacctccgcgccatcgcctcccgcatggctgcggccgggtacggccgcgagtgcgcgcaggtgtacgcctccgtccgcaagccggcggtcgacgcctccctccgccggctcggcgtcgagcggcttagcatcggcgacgtccagcgcctcgagtggaaggccctcgaggccaagatccgccgctggatccgcgcggcccgcgccgccgtccgcggcgtcttcgccagcgagcgccgcctgtgcttcctcatcttccacgacctccccatctcgaacatcaccgtcaccgccgccgcccccgccacgcacgacacccccttcgccgaggccgtcaagggcgccgcgctgcagctgttcggcttcgccgaggccatcagcatcggccgccgctcccccgagaagctcttcaagatcatcgacctccacgacgcgctctccgacctcctcccggacgtctccgacatcttcgccgcctccaaggtcgccgagtcgatatacgtccaggccgccgagatccggtcgcggctcgccgacgccgtgcgcggcatactctccgagttcgagaacgccgtgctccgtgacccgcccaagacggcggtgcccggcggcaccgtgcacccgctcacccggtacgtgatgaactacagcagcctcatctccgattacaaggtgacgctctccgagctgatcgtgtcgcggccatcggcgagcgcgcgcctcgccgccgagggcaatgagctcgcgccgtccttggccgagctcgacctccccgagcctgacaaccagacgccacttgctgctcatatcatctggatcattgttgtcctggaacacaacctcgagggcaaggcctcactctacagggacacggctctctcgcatttgttcttgatgaacaatgtgtactacatcgtgcacaaggtgaaggattcgccggatctatggaatctgattggtgatgattacttgaagcggcttacgggtaaattcacaatggcagccacgaactaccagcgcagcgcatggttgaagatcttgaattgcttgcgagacgaggggctccatgtaagtggtggcttctcgtcagggatatccaagtcagcgctgcgggagcggttcaggtccttcaatgccgcattcgaggaggcgcatagggtgcaatcaggatggtgtgtgccggacacacagctgagggaggagctaaggatctcaatttcagagaagctggtgccggcataccggtcattccttggcaggtttcgacatcatattgagaatgggaagcacccagagttgtacatcaaatactcagcagaggaccttgagattgctgtgaacgatttctttgagggggttcctccttccccacatatcaggaggagatcacatagctgaagttgttgtacatcaagcattcaacaggggtgctgttgttatgtattctttgattcttcagaggaaaccaatgccagcatttgctgccctggttttactctttggtacttataagggtataggtggcgatattttcaatcagagatgacatctgaaatcatttatgggttctcgttcaagctgtcagtcccctccattgttcctctgtaagagaactcgtttcatttgttacacaattactgttatatataattttgcaagtagcaagttcatatagaactattcttcggtaattttggctagttgggactgagcttttgttaacaattatctggagagaatacttgtggattagatgtaaaaatgatttataccactctcttagtctcttctaccacaattttataatgtgatactgttatctattgggtc

SEQ ID NO: 1672 - DNA, 2724 bp, Brachypodium distachyon
gtcttccgcgacaggggcgcagcgcagcacctcccccgagcggagcggagcggagccagcttggctctcctcctcctcctcctatatcactcgctcccgcctccacccccgtgcgcccatcggcgcagaccccacacgtgcggctccccggattcgcgccgccgcgggtaccaaaggccagctcggagccgacgaggagtcaactcggccatggacggatcggcggagctggaggcggcggagcgggtggtcatgcgctgggactcctcctcggcctccgcgtccgcggcggcggcggcggcggcggcggacgagccgatgctgttcgacggcgcgggggaccgggccgaggcggagcggttcctccgcgcggtggacgacatccgccgcctcgcgccgccgtcgcccgcgtccgtcggcagcccgcgccggctgtcgtccgggtcctcggcgctggggggtgccgggtgcagcgccgcgcaggtcgcgatggcgcggctcgaggacgagttccgccacgtgctgtcgtcacgcgccttcgacctcgagatcgaggcgctcgccgacctcacctccctctcctccatctccaccgaccgctccaactcggtctcctccatcgacctccccgtcgtggaggaggacgaccccgtttcctacgccgtcggccgccgcagcagctaccgctcgctccggagcatccgcgagatcgacctcctccccgacgacgccgtcgccgacctccgcgccatcgcgtcccggatggccgccgctggctacggccgcgagtgcgcccaggtgtacgcctccgtccgcaagccggccgtcgacgcctccctccgccggctcggcgtcgaacggctcagcatcggcgacgtccagcgcctcgagtgggaagccctcgaggccaagatccgccggtggatccgcgccgcccgcgccgccgtccgcggcgtcttcgccagcgagcgccgcctctccttccacatcttccacgacctcccaatctccaacgtcgccgttgccgccgccgtccccgcggctgccgccacgcacgacacccccttcgccgaggccgtcaagggcgcggcgctgcagctgtttggcttcgccgaggccatcagcatcggccgccgctcccctgagaagctcttcaagatcatcgacctccacgacgctctctctgacctgctccctgatgtctccgacatttttgcggcctccaaggccgccgaatcgatatacgtacaggccgtcgagatccgatcccgactcgccgatgccgtgcgagggatactttcggagtttgagaacgccgttctacgcgacccgcccaagactgccgttcctggcggcaatgtccacccgctcactcggtatgtgatgaactatagcagcctcatttccgagtacaaggccacgctctctgagctgatcgtttcgcgtccatcagctagtgcacggcttgctgctgaagggaatgagctcgcgccgtccttggccgagctcgagctccctgagcttgataaccagtcacccctttcagctcatatcatttggatcattgttgtccttgaacacaacctggagggcaaggcgtcgctgtacaaggacacggctctctcgcatttgttcttgatgaacaatgtgcactatattgtgcacaaggtgaaggactcaccagaactctggagcatgattggtgatgattacttgaagcggcttaccggaaagttcacagtggcggccacacattaccagcggacatcatggctgaagatcttgaattgtttgcgagatgaggggcttcatgtaagtggtggcttctcatcaggaatatccaagtcagctctccgggagcggttcaagtccttcaatgctgcgtttgaggatgcgcatagggtgcaatccgggtggtctgtgccggacactcagctgagggaggagctaaggatctcaatatcagagaagctgttgccagcatatcggtcattccttggcaggttccggcatcatatagagaatgggaagcatccagagctgtacatcaagcactcagcggaggacctagagattgcagtgaatgatttctttgaaggggttactccttccccacacaacaggaggagatcacatggatagaagtctggtacatcacacattcaactggtgtgctgttgctttgcattctttgattcttcaggggggggaagacaatactggctgttggagcctctgtctttactctgtgatacttgaggctgtagttggtcataaactcatgatcaatcacgaaatatagatgacatcatcccatatcattttgggatcttgttgaagctgtcaatctcctacatgaatcttcacctgtaagagaacttgttcatttgttacactattattattattttttgcaattagcatgtccatatagtattattctttcagcaaggtagatggaaaagcaactcatgcaatctcatgccatgcctcgcatgtgctttcgttgtcctttgtgttgttagcaatcatcttgagggtccatgctttgtggattagatgtagaaagacttttgtcactctgttgtgccacatgattttgtaaaatgatgttatcactttgaatggcaatcctgatcctaccacacagctttttaaaggtgttacaagttcaaactactactaatgtataacacattctttcatatgtgatatatgagtatt

SEQ ID NO: 1673 - DNA, 2105 bp, Secale cereale
cggcggctggtggaggcgggtgcagcgccgtgcaggtcacgatggcgcggctcgaggacgagttccgccacttgctctcgtcccgcgccttcgacctcgagatcgaggcgctcgccgacctgacatctctctctatctccagcgaccgaacgaactcggtctcatccatggacctcccagctgtggaggaagatgattccatctcctactgcggcggccggcgaagcagctaccgctcgctccggagcatccgtgagatcgacctcctccccgacgatgccgttgccgacctccgcgccatcgcctcccgaatggctgcggctgggtacggccgcgagtgtgtccaggtgtacgcctccgttcgcaagccggccgtggacgcttcctccgccggctcggcgtcgaacggctcagcatcggtgatgtccagcgcctcgagtgggacgctctcgaggccaagatccgccgatggatccgagctgcccgtgccgccgtccgcggcgtttttgccagcgagcgccgcctctccttccacgtcttccatgacctcccaatctccaatgtcaccgttgtcagcgtcgtcaccgcggctccagccacgcatgacacccccttcgtcgaagctgtcaagggtgcggcacttcagctgtttggcttcgctgaggccatcagcatcggtcgccgctctcccgagaagctcttcaagatcatcgatctccacgacgcgctatctgacctgctccctgacgtctccgacattttcgctgcatccaaggcagccgaatcgatatacgtgcaggccgtagagatccgatcgcgcctcgcagatgcagtgcgtggaatactctcggagtttgagaacgcagttctccgcgacccgcccaagactgcagtacctggtggcaccgtccacccgctcacacggtacgtgatgaactatagcagcctcatttccgactacatggccacgctcaccgagctgattgtatcacgtccgtcggcaagtgcacggcttgctgctgaaggcaatgagcttgcgccatccttgtcctacctcgaactacccgagcacgagaatcagtcaccgcttgctgcccatatcatctggatcattgttgtccttgaacacaaccttgaaagcaaggcgtcactctacaaggacacggctctctcacatttgttcttgatgaacaatgtacactatattgtgcacaaggtcaaggattcacctgacctctggagcatgattggtgacgattacttgaagcggcttacaggaaagttcacagtggccgccacaaattaccagcggacgtcatggctaaagatcctgaattgtttgcgagatgagggtctacatgtaagtggtgggttctcgtcaggaatatccaagtcagcgttgcgagagcgattcaagtccttcaatgctgcatttgaggatgcgcatagggtgcaatctgggtggttcgtgccggacacgcagctgagggaggagctgaggatctcaatatcagagaagctcttgccagcatacaggtcgttccttggcaggttccggcatcatatagagaatgggaagcatccagagttgtacatcaagcactcagctgaggaccttgagaatgccgtgaatgatttctttgaaggggctcctccttccccgcataataggaggagatcgcatggatgaaattcctgtgcttttagcattcgactggtgtgtcgtggctttgtattctttgattcttcaggggggatcaagtgctgacagttggatctgtctactctctgatatttgacaatatagttggcaagaactcttggtggataaacagacatgctaattctcatgtcattttgagatctggtgaagctgtcaatctccatgggtcttcatctgtaagccaacttgttcatttgttacactatcattatatattattggcaagtagcatgttgatatatcattttcattccagttaaaaatacatatgatgttattattctttcagctatgctgggtacatggaaatgtactgcatgcaatttcatgccaatgccatgaatgcgcttttgatgtctttatgttattagcaatcatctgg

SEQ ID NO: 1674 - DNA, 2278 bp, Hordeum vulgare
gaggagggtgaggtggagagtcggcaggcgaggagtcaactggatactatggatggatcggcggagctggaggcggcggagcaagtggtgatacggtggaattcgtcgttggcttcgacggcggcagcggcggcagcggcggcggcggcggcggttgagtacgagccgatgctgttcgacggagcaggggatcggaccgaggcggagcggttcctccgtgctgtggataacatccgccgcctcgctccgtcgtccccctcggtggtcgggagcccgcggcggctgtcgtccgggtcgggggcggcggctggtggaggcgggtgcagcgccgtgcaggtcacgatggcgcggctcgaggacgagttccgccacttgctctcgtcccgcgcttttgacctcgagatcgaggtgctcgccgacctgacatccctctctatctccagcgaccgaacgaactcggtctcatccatggacctcccagctgttgaggaagatgactccgtctcctactgcggcggccggcggagcatctaccgctcgctccggagcatccgtgagatcgacctcctccccgacgacgccgttgccgacctccgcgccatcgcctcccgaatggctgcggctgggtacggccgcgagtgtgcccaggtgtacgcctccgttcgcaagccggccgtggacgcctccctccgccggctgggcgtcgaacggctcagcatcggtgatgtccagcgcctcgggtgggacgctctcgaggccaagatccgccgatggatccgagctgcccgtgccgccgtccgcggcgtttttgccagcgagcgccgcctctccttccacgtcttccatgacctcccaatctccaatgtcaccgttgtcaccgcagctccagccacgcgtgacacccccttcgtcgaagccgtcaagggtgcggcgcttcagctgtttggcttcgccgaggccatcagcatcggacgccgctctcccgagaagctcttcaagatcatcgatctccacgacgcgctatctgacctgctccctgacgtctccgacattttcggtgcctccaaggcagccgaatcgatatatgtgcaggccgtagagatccgatcgcgcctcgcagatgcagttcgtggaatactatcggagtttgagaacgcagttctccgcgacccgcccaagactgcagttcctggtggcaccatccacccgctcactcggtacgtgatgaactatagcagcctcatttccgaatacaaggccacgctcaccgagctgattgtatcacgtccgtcggcaagtacacggcttgctgctgaaggcaatgagcttgtgccatccttgtgctacctcgaactacccgagcatgagaatcagtcaccgcttgcagcccatatcatttggatcattgttgtccttgaacacaaccttgagagcaaggcgtcactctacaaggacacggctctctcacatttgttcttgatgaacaatatacactatattgtgcacaaggtgaaggattcacctgacctctggagcatgattggtgatgattacttgaagcggcttacaggaaagttcacagtggccgccacaaattaccagcggacgtcatggttaaaaatcctgaattgtttgcgagatgagggtcttcatgtaagtggtggcttctcgtcaggaatatccaagtcagctctacgggagcgattcaagtccttcaatgctgcatttgaggatgcacatagggtgcaatctgggtggttcgtgccggacacgcagctgagggaggagctgaggatctcaatatcagagaagctcttgccagcatacaggtcgttccttggcaggtttcggcatcatatagagaatgggaagcatccagagttgtacatcaagcactcagctgaggaccttgagaatgccgtgaatgatttctttgaaggggctcctccttccccgcataataggaggaaatctcatggatgaaattcatgtacatttattcgactggtgtgttgtggctttgtattctttgattcttcagggggatcaactgctggcagttggagctctgtctactctctgatatttgacaatatggttggtgatgaacccatggtcgataaacagacatgccagttcttacgtcattttgtgatctggtgaagctgtcaatctccatgggtcttcctctgtaagccaacttgtccatttgttacacgattattattacatattactggccagtagcatgtcgataaagtattttcattccagataa

SEQ ID NO: 1675 - DNA, 2781 bp, Oryza sativa
ggataattagtggtgcgaggaagcccaaaggagcaaagcaacaaggggaaaatacccgagacaaaaagcgaattcgataaaacgagcggccgctcgaagcggccactgcacagcgccctctcgcctcctcgcctcgccgccgccgccggcttaaggctctcctccccgcgccgtaccggcgggagtgtggaggtgttgtgctgcggcgtgggtgtgttgggagttggggggtgaagcatgatggatggatccaccgctgcggcggcggagctggaggcggcggagagggtggtgatgaggtgggactccacggcgtcggcgtcctacgggggcgggggcggggacgagcagatgctgttcgatggcggcggtgaccgggtggaggcggagcggttcctccgggctgtggatgacctacggcggctggcgccgccgtccccggccacggtcgggagcccgcgccgcacctcgtcggctagcggcggcggaggggcggcgtccaacgccgtccaggtcgcgatggcgcggctggaggacgagttccgccacgtgctgtcgtcgcgcgccctcgacctggagatcgaggcgctcgccgacctcacctcgctctccatgtgcagcgaccggaccaactccgcggacgtcgccgaggaagcggcggctgcggacgaagacgactccgtgtcgtcctccgtcggccgccgcagcagctaccgctcgctgcgcagcatccgagaaatcgatctcctccccgcggacgccatctccgacctccacgccatcgcctcccgcatggccgtcgccggctacggccgcgagtgcgtccaggtgtacgcctccgtccgcaagccggccgtcgactccgcgctccgccgcctcggcgttgagaagctcagcatcggcgacgtgcagcggctcgagtgggaagtcctcgaggccaagatccgccgctggatccgtgctgcccgcgccgccgtccgcggcgtcttcgccagcgagcgtcgactctgcttcctcatcttccacgaccttcccctctccagctctaccatcaccactgccacccacgacgctcccttcgcggaagccgtcaagggcgccgccctgcagctcttcggcttcgccgaggcgatcagcatcggccgccgctcaccggagaagctgttcaagatcattgacctgcacgacgcgatcgccgatctgttgcctgacgtctccgacatctttgctgcatccaaggccggggaatccatatacgtgcaggctgccgagatcaggtcgcgtctcgctgatgccgtgcgtggtatactgtcggaatttgagaacgctgtgcttcgtgacccgtcgaagactccggtgcctggtggtaccatccatcctctcactcgctatgtcatgaattacagtagcctcatttctgactacaaaaccacactgtctgagctgattgtgtcgcggccattggcttgctcccgaattgctcctgagggcaatgagaatgccccatccttccctgatcttgaccttgccgaccctgacagtcagttaccccttgctgctcatcttatctggattattgtggttcttgagcacaatcttgagagcaaagcatcactctacaaggatgcggcactctctcatttgttcgtcatgaacaatgtacactatattgcacacaagataaaggattcaccggagctccgggggcttattggtgatgagtatttgaagcagctgacaggtaagttccggctcgcagccactcgctatcaacggacagcatggttgaagatcctgaattgtctgagagatgaaggtctgcatgtcagtgggggcttttcatcaggggtatccaaatcagcactccgggagcgtttcaagtctttcaatgctgcattcgaggaggcacatagggttcaatctgcttggtatgtgccagacacgcagctgagagaagagcttaggatatcaatagcagagaaacttcttccagcatatcgatccttccttggtcggttccggcatcacatagagaatggaaggcacccagagttgtacatcaaatactcagttgaggaccttgagacgtccgtcacaaatttctttgagggttgtccaccttcgctacataacaggagaagatcccatggatgagaggtggcttgaagactcaaaagatctctattgttgactgatgagtgtggttgcctagtattctacaatgcttcgggaaaagcaagacttaagggtatagttggtgatgatttcttctactagaggtaatctgaaacaggatcaggatcttattgaaactgtcaaattccttagtggttcttccttttatagccaaccttgttcgtttgttacactatcatcatatcttttatgattagattgttcatataggtctgttctttcagaatgtttcgcagttgtaagttgtaacatcatggtgtttgtttgacacttaactgagtgtcttgtcacctttttggttgttcagatatatattaagattgcacttcatagattagatgtaaaaacaaatctgtgttactgggttttacctatgcaagaccatgttctgccttaaagtatcagttttgacttttgaggttaccacatcaggtctcttttaaagtgcttgtatagttcccaattttttcttcaaacttctaactttttcatcacatcaaaacttttctacacacataaacttccgactttttttttaaacttccaattttagtcaaacttccaattttggcgtggaattaaaca

SEQ ID NO: 1676 - DNA, 2330 bp, Oryza sativa
atggatggatccaccgctgcggcggcggagctggaggcggcggagagggtggtgatgaggtgggactccacggcgtcggcgtcctacgggggcgggggcggggacgagcagatgctgttcgatggcggcggtgaccgggtggaggcggagcggttcctccgggctgtggatgacctacggcggctggcgccgccgtccccggccacggtcgggagcccgcgccgcacgccgtccaggtcgcgatggcgcggctggaggacgagttccgccacgtgctgtcgtcgcgcgccctcgacctggagatcgaggcgctcgccgacctcacctcgctctccatgtgcagcgaccggaccaactccgcggacgtcgccgaggaagcggcggctgcggacgaagacgactccgtgtcgtcctccgtcggccgccgcagcagctaccgctcgctgcgcagcatccgagaaatcgatctcctccccgcggacgccatctccgacctccacgccatcgcctcccgcatggccgtcgccggctacggccgcgagtgcgtccaggtgtacgcctccgtccgcaagccggccgtcgactccgcgctccgccgcctcggcgttgagaagctcagcatcggcgacgtgcagcggctcgagtgggaagtcctcgaggccaagatccgccgctggatccgtgctgcccgcgccgccgtccgcggcgtcttcgccagcgagcgtcgactctgcttcctcatcttccacgaccttcccctctccagctctaccatcaccactgccacccacgacgctcccttcgcggaagccgtcaagggcgccgccctgcagctcttcggcttcgccgaggcgatcagcatcggccgccgctcaccggagaagctgttcaagatcattgacctgcacgacgcgatcgccgatctgttgcctgacgtctccgacatctttgctgcatccaaggccggggaatccatatacgtgcaggctgccgagatcaggtcgcgtctcgctgatgccgtgcgtggtatactgtcggaatttgagaacgctgtgcttcgtgacccgtcgaagactccggtgcctggtggtaccatccatcctctcactcgctatgtcatgaattacagtagcctcatttctgactacaaaaccacactgtctgagctgattgtgtcgcggccattggcttgctcccgaattgctcctgagggcaatgagaatgccccatccttccctgatcttgaccttgccgaccctgacagtcagttaccccttgctgctcatcttatctggattattgtggttcttgagcacaatcttgagagcaaagcatcactctacaaggatgcggcactctctcatttgttcgtcatgaacaatgtacactatattgcacacaagataaaggattcaccggagctccgggggcttattggtgatgagtatttgaagcagctgacaggtaagttccggctcgcagccactcgctatcaacggacagcatggttgaagatcctgaattgtctgagagatgaaggtctgcatgtcagtgggggcttttcatcaggggtatccaaatcagcactccgggagcgtttcaagtctttcaatgctgcattcgaggaggcacatagggttcaatctgcttggtatgtgccagacacgcagctgagagaagagcttaggatatcaatagcagagaaacttcttccagcatatcgatccttccttggtcggttccggcatcacatagagaatggaaggcacccagagttgtacatcaaatactcagttgaggaccttgagacgtccgtcacaaatttctttgagggttgtccaccttcgctacataacaggagaagatcccatggatgagaggtggcttgaagactcaaaagatctctattgttgactgatgagtgtggttgcctagtattctacaatgcttcgggaaaagcaagacttaagggtatagttggtgatgatttcttctactagaggtaatctgaaacaggatcaggatcttattgaaactgtcaaattccttagtggttcttccttttatagccaaccttgttcgtttgttacactatcatcatatcttttatgattagattgttcatataggtctgttctttcagaatgtttcgcagttgtaagttgtaacatcatggtgtttgtttgacacttaactgagtgtcttgtcacctttttggttgttcagatatatattaagattgcacttcatagattagatgtaaaaacaaatctgtgttactgggttttacctatgcaagaccatgttctgccttaaagtatcagttttga

SEQ ID NO: 1677 - DNA, 2427 bp, Setaria italica
gcgcgcgccgtagcgtgaactgggagaagggggaagcggggggtggtgaggcgggaggcgccatggaagcgtccgccgcggcgaagctggaggccgcggagagggtggtgatgcggtgggactccacggcgtcggcggcgtcctcggccgccggggacgagcaggcgatgctgttcgacggcgccggcgaccgcgcggaggcggagcggttcctgcgggcggtggacgatatccgccgcctggcgccgccgcagtcggcgggctgcgcctgcgccgccgtgcaggtcgcgatggcgcgcctcgaggacgagctccgccacgtactcgcggcgcgcgcgctcgacctcgaaatcgaggcgctcgccggccttacctcgctctccatgtccggcgaccggaggaactccgacgccacggaggtggcggcggcggcgggggacgacgacgacggtggcggcggttccgtgtcgtcctccgtcggccgccgcagcagctaccgctccctgccgagcatccgcgagatcgacctgttccccgcggacgccatctccgacctccacgccatcgcctcccgcatggccgaggcggggttcggccgcgagtgcgtccaggtgtacgcctccgtccgcaagccggccgtcgactccgccctccgccgcctcggcgttgagaagctcagcatcggagacgtccagcggctcgagtgggacgcgctcgaggccaagatccgccgctggatccgcgccgcctgcgccgccgtccgcggcgtcttcgccagcgagcgccgcctctgcttccacatcttccacgacctcccgctctgcagttccaccgccacctccgcgggtacagccacccacgacgcgcctttcgccgaggccgtcaaaggcgcggcgctgcagctcttcggcttcgccgaggccatcagcatcgggcgccgctcccccgagaagctgttcaagatcatcgacctgcacgacgctctctccgacctgttgcctgacatctctgacatctttgcagcctccaaggccgcggaatcgatatacgtgcaggctgctgagatcaggtcgcggctggcagacgccgtgcgcggtatactctcggagtttgagaacgcggtgctccgcgacccgtccaagactccggtgccaggcggtaccatccacccgctcactcgctatgttatgaattacagcagcctcatttcggactacaagaccacgctctctgagctgatcatctcgcggccatcagctagctccaggattgctactgagggcaatgaggcagcaccggccttccctgatcttgacctgcctgatcctgacagccagttgccccttgctgctcatcttatctggattattgttgttcttgaacacaaccttgagagcaaggcatcactctacaaggatgccgcactgtctcatttgttcctcatgaacaatgtgcactatatcgtgcacaaggtaaaggattcagctgagcttcgggggctaattggggatgagtatttgaggcgactcacagggaagttccggcaggcagccacaagctaccagcgaactgcatggttgaagatcctgaattgtctcagggatgagggcctccatgttagtggtggcttttcgtctgggatatccaaatcggcactaagggagcgattcaaagcattcaatgctgcatttgaggaagcacacaggatccagtccacctggtatgtgccagacacacagctgagagaagagcttaggatctcaatttcagagaagctgctcccagcatatcgatccttccttggaaggtttcgccatcacatagagaacggcaggcacccagagttgtacatcaagtactcagttgaggatcttgagatagcaatggcagatttctttgagggagctccaccatcgccacataacaggaggagatctcacggatgaaagatggcttcaaaaagctgagcgttcataccatgtattctttaattcttttggggggaaggccagccaagtgcagttggatcttttgttttgttctcctgagactcagggctatagttggtgatgatttcttcgactagaggtaatctgaaacaggatcaggatcttgacaaagctgtcaaaagctccttttcttattctcctgtaagcgagcttgttcatttgttacactatgtttatattttttgcatgtagtgtgttcatataggaatgcttagtcatgtaacatagttgtaacctgtaacttaattgcttgacatgtagttgagtgcttattatatttttggtggttcacttgtatctaaaaatgatgcttgataaatgagatgcaaaaagaaattgttgtgttggggttacgcatacacgattatgtaatgccatctttaatgggcttgaaatatatgtttggaggaccttcttc

SEQ ID NO: 1678 - DNA, 1960 bp, Triticum aestivum
atggctgcggctgggtacggccgcgagtgtgcccaggtgtacgcctccattcgcaagccggccgtggacgcctccctccgccggctcggcgtcgaacggctcagcatcggtgatgtccagcgcctcgagtgggacgctctcgaggccaagatccgccgatggatccgagctgcccgtgccgccgtccgcggcgtttttgccagcgagcgccgcctctccttccacgtcttccatgacctcccaatctccaatgtcaccgttgtcagcgtcgtcaccgcggctccagccacgcatgacacccccttcgtcgaagctgtcaagggtgcggcgcttcagctgtttggcttcgctgaggccatcagcatcggtcgccgctctcccgagaagctcttcaagattatcgatctccacgacgcgctatctgacctgctccctgacgtctccgacattttcgctgcatccaaggcagccgaatcgatatacgtgcaggccgtagagatccgatcgcgcctcgcagatgcagtgcgtggaatactctcggagtttgagaacgcagttctccgcgacccgcccaagactgcagttcctggcggcaccgtccacccgctcacacggtacgtgatgaactatagcagcctcatttccgactacaaggccacgctcaccgagctgattgtatcacgtccgtcggcaagtgcccggcttgctgctgaaggcaatgagcttgcgccatccttgtcctgcctcgaactacccgagcatgagaatcagtcaccgcttgctgcccatatcatctggatcattgttgtccttgaacacaaccttgagagcaaggtgtcactctacaaggacacggctctctcacatttgttcttgatgaacaatgtacactatattgtgcacaaggtcaaggattcacctgacctctggagcatgattggtgatgattacttgaagcggcttacaggaaagttcacagtggccgccacaaattaccagcggacgtcatggctaaagatcctgaattgtttgcgagatgagggtcttcatgtaagtggtggcttctcgtcaggaatatccaagtcagctctgcgggagcgattcaagtccttcaatgctgcatttgaggatgcgcatagggtgcaatctgggtggttcgtgccggacacgcagctgagggaggagctgaggatctcaatatcagagaagctgttgccagcatacaggtcgttccttggcaggttccggcatcatatagagaatgggaagcatccagagttgtacatcaagcactcagctgaggaccttgagaatgccgtgaatgatttctttgaaggggctcctccttccccgcataataggaggagatctcatggatgaaattcctgtgcatttagcattcgactggtgtgttgtggctttgtattctttgattcttcaggggggatcaagtgctgacagttggagctctgtttactctctgatatttgacaatatagttggtcaagaactcttggtcgataaacagacatgccaattcttatgtcattttgagatctggtgaagctgtcaatctccatgggtcttcctctgtgagccaacttgttcatttgttacactattattttatattattggcaagtagcatgttgatatagcattttcattccagttaaaaatatatataatgttattattctttcagctatgttgggtacatggaagtgtaatccatgcaatttcatgccaatgccttgaatgtgcttttgatgtcctttatgttattagcaatcatctggatagtccatgctttgtgggttagagatagaaagattctttttgtactcttttgtaccatatgattttgtaaaattatgttgttactttgaatgccaatcttgagtttctctagtgcatatcttctttcgggtgttagaaattgacagattttaatcactct

SEQ ID NO: 1679 - DNA, 2555 bp, Hordeum vulgare
gcccgaacgaccaaagcaaaccaaaccaaagccgggagagaagagaaatcggccggtctcccctcgctggactaaccagagagcagagagcatcagagcacagcgcagagccaagacagcagcttcatcgccgccggtggttggcttcctgccgctccctccctgctattggtgttggtttgtcgcgcggctggccgggggtgaggagggtcggagggggcgaagcatggacggatccgccgcggcggagctggagagggcggagagggtggtgatgcggtgggactccacggcgtccgcgcccgcggggggcggggaggaccagatgctgttcgacggcggcggggaccgggcggaggcggagcggttcctgcaggcggtggacgacctgcgccgcctcgcgccgccgtcccccggcagcccgcgccgcacctcctcgtcgggggcctccggcgccgtccaggtcgccatggcgcggctcgaggacgagttccgccacgtcctggcgtcgcgcgcggtcgacctcgagatcgaggtgctggccgacctcagctccctctccatgtgcagcgaccgctccagcttctccgacgtcggcgacgcgccgccggtggacgacgactccgtcgagttctccgtcggccgccgcagcagctaccgctccatgcgcagcatccgcgagatcgacctcctcccgcccgacgccgtcgccgacctcaacgccatcgcctcccgcatggccgccgccggctacgaccgcgagtgcgtccaggtctacgcctccgtccgcaagccggccgtcgactccgccctgcgccgcctcggcgtcgagaagctcaccatcggcgacgtccagcgcctcgagtgggacgccctcgaggtcaagatccgccgctggatccgcgcggcccgcgcagccgtccgcggcgttttcgccagcgaacgccgcctttgcttcctcatcttccacgacctccccctctccaaccccaccatcgccacccccgcacccaccacgacgcccgccgcccccttcgtcgaaactgtcaagggcgccgcgctgcagctctttggctttgccgaggccataagcatcggccgccgctcgccagagaagctcttcaagatcattgatctgcacgatgcactggccgatctgctgcctgatgtctcggatatctttgctgtctccaaggccggggaatcaatatatgtgcagagtaccgagatcagggcgcgtctggctgatgctgtccgtgggatactctcggagttcgagaacgccgttctccgtgacccctccaagactccagtacccggcggcaccatccatcccctcactcgctatgtgatgaattacattgtcctcatttccgactacaaggcgacactttctgagctgatcgtgtcacggccatcagctagctcgcgtgtttctgccgacggcaatgagctcacaccgtcatttcctgatctggaccttgctgatcctgacagccagttgcccctttctgctcatctcatctggactattgtggttcttgaacacaaccttgaaggcaaggcatcactctacaaggacccggcactctctcacttgttcctcatgaacaatgtgcactatattgttcacaaggtaaaggactcgcctgagctccggggacttattggcaatgagtacttaaagcgactcacaggtaagttccggttggcagccacagcttaccagcgtagttcatggcttaagatcctgaattgtctaagagacgagggtctccatgtcagcggcggcttttcatcagggatatcaaagtcagcacttcgggagcgcttcaagtctttcaatgccgcgttcgaggaggcgcatagggcccagtctgggtggtatgtgcctgacacacagctgagagaagagcttaggatctcaatatcagagaagctgcttccagcatacagatccttccttggtcgattccggcaccatattgagaatgggaggcatccagagttgtacatcaaatacacagttgaggaccttgagatatccgtgacagatttcttcgaggggtctccacctccgccgcataataggaggaggtcccatggatgagagatggcttgaaggcttgcaatagttgtatcacttgattgggtgttgttgccgagcattctttaattcttcggtgaagccagtgcaggcggtcgggtatgtattttgtttcactctcctgagacttaagggtgtagttggtgatgatttcttctactagaggtaatctgaaacagaatcaggatcacatttgacgcttgtcaaaagtcttggtgtttcttcctcagttggcgagcttgctcatttgttctagtgttgttgtaattttgtctagcaacatgttcatataggaatgttcttttttttttagtaatgttgcatagttgtaagttgtaatttcatggtgtttatttgatctttagccgattgctctgccatctttcggttgatcaaatatgaatatgaagattacactgggtagattacatagaaaatcaactctgct

SEQ ID NO: 1680 - DNA, 2804 bp, Zea mays
gcgggctccgcctcctcgcgcgcgagcggggtgggagtggggggacggcgacaagtcggttagggttgcgcggccacgtaactgggaggtgaaaggaggcgaggcagcagccagcatggagggcttcgccgcggcggagctggaggccgcggagcggttggtcaagcggtgggactccacggcgtcggcggcttcctcggctggtaggggcggggacaaccagatgctgttcgacggcgccgccgaccgcgccgaggcggagcggttcctccgggcggtggacgacctccgccgcctggcgccgccgtcgccggcctctgtcggcagcccgcgccgcgcctcgtccgcgggcggcgtctgcaccgcagtggaggttgccatgactcggctcgaggacgagttccgccacgtgctgtcggcgcgcgcgctcgacctcgagatcgaggcgctcgccggcctcagctcgctttcgatggccagcggccggagtaactctgacgccacagaagcggccgctggggaggaagacgacggctccgtgtcgtcctccgtcggcaggcgcagcagctaccgctccctgcagagcatccgcgagattgacctcttccccgcggacgcaatctccgacctgcatgccatcgcctcccgcatggccgccgcggggtacggccgcgagtgcgtccaggtgtacgcctccgtccgcaagccggccgtcgactccgccctgcgccggctcggcgtcgagaagctcagcatcggcgacgtccagcggctcgagtgggacgctctcgaggccaagatccgccgctggatccgcgcggcccgcgccgccgtccgcggcgtcttcgccagcgagcgctgcctctgcctccacatcttcaacgacctcccgctgcgcacttccaccgctaccgccgccgccgccgcggctcccaccaaccacgacgcgcccttcgctgaggccgtcaagggcgcggcgctgcagctctttggcttcgctgaggccatcagcatcgggcgccgctccccggagaagctgttcaagatcattgacctccacgacgcgctctccgatatgttgcctgatatctccgacatcttcgccgactccaaggccgcggagtcgatatacgtgcaggccgccgagatcaagtcgcggttggtcgacgccgttcgtggaatactctcggagtttgagaacgccgtgctccgcgacccgtccaagactccagtgcccggcggcaccatccacccgctcactcgctatgttatgaattacagcaccctcatttcggactacaaggccaccctctccgagcttatcatctcgcggccatcagctagcccccaaactgctgctgaggaaaatgaggctacaccggccttccctgatctcgacccgcccgatcctgacagccagttgccccttgctactcatcttgtctggattattgttgttcttgaacacaaccttgagagcaaggcgtcactctacaaggatgcaccactgtctcatttgttccttatgaacaacgtgcactatattgtgcacaaagtaaaggattcagctgaacttagggggctaattggggatgagtatttgaggcgtctcacagggaaattccggcaggcagctacaagctaccagcgaactgcatggttgaagatcctgaattgtctcagagatgagggtctccatgttagtggtggtttttcatccggggtatccaaatcggcactacgggagcgattcaaggctttcaatgctgtatttgaggaggcacacagggtccagtctgcgtggtatgtgccagacacacaactgcgagaagagcttaggatatcagttttggagaagctgctcccagcatatcgatccttccttggaaggttcaggcatcacatagagaacagcaggcaccctgagttgtacatcaagtactcagttgatgatcttgagatagcaatggcagatttctttgagggatctccaccatcactgcataacaggaggagatctcatggatgaaagatggcttgaaaaatctcagtcttcttgtaatgtattctttaattctttggggacaggccaacaaatgcagttgggtcttttgttttgtcctcctgagacatatggttaggctggtgccaatgcaggctatagtgagggcgatagcgcccagcaggaggcgagagcgaggccggaggcgggcgagagcgacccggcgggcgctactgccaccgcccggcgataggcaggcgagagcggggcgacgcattggcgatgcgtcttcgcgggcgagagcgaggggcgacagtgaggtggcggcttctgattggtccacgtgtgctatagcctgaggctgtagcctgctgcagcctgtgcactggagcagcaggggcgagagtggaggcgagagctgacgtggcaggggcgagagggaggctgtgcattggactcagccttatagttggtgatgatttcttcgactagaggcaatctgaaacgggatcaggatcctgataacgctgtcaaaagccccatttcttcttccactgtaagcgatcttttttttttttcatttgttacacttgtttatattcttgtgagtagcgtgtttatataggaatgatcttttagacatgtaacatatatataagttgtaacttctgtatctgtttgacatttagctgagtgttgtatcatcgttttggtggttcacatgtatctgaagaatgctgcttgattgatgaggtgtaaaaaaagtaatgttaaggctatgcacatatgatgcaatgccatt

SEQ ID NO: 1681 - DNA, 2772 bp, Brachypodium distachyon
tagtctgcccaataattatcgcaaatacgaagcccaaacgagcaaagagaagggaaatcggccggtcttgccttacgcgaccccggctggctgtggactagagagagcagagcggcgcgcgccttcctcttcctctccccacatcgccgctgctggtgatttgctgctgctcgtcgtcgggctccgcctcccctcccccgcgtgccttcgaggtccaggtgccggctcgagcccgcgcgaggtcggagctgctcgcgccgcacgtgcgccttccctgttattggtttctcgcgctgctggttggagtattgtactgggaaggaaggaagggggaagagggtcggaggcggggtgaagcatggacagatccgccgcggtggagctggagagggccgagagggtggtgatgcggtgggactccacggcgtccgcatccacgggtggcgggagcggcggggaggagcagatgctgttcgacggcggcggggaccgggcggaggcggagcggttcctcctggcggtggacgacctccggcgcctggcacccgcgtcccccggcgcggtcggcagcccgcgccgcacctcgtcggcgggcggaggctccaacgccgtccaggtcgccatggcgcggctcgaggacgagttccggcacgtgctgacgtcacgcgcgctggacctcgagatcgaggtgctcgccgacctcagctccctctccatgtgcagcgaccggaccagcttctccgacttccctgagccggtggcggcggccggggacgacgatgactccgtgtcgtcctccgttggccgccgcagcagctaccgctccatgcgcagcatccgcgagattgacatcttccctgccgacgccatctccgacctcaacgccatcgcttgtcgcatggctgccgccgggtacgaccgcgagtgcgtccaggtttacgcctctgtccgcaagccagctgttgactccgccctccgccgcctgggcgtcgagaagctcaccatcggcgacgtccagcggctcgagtgggatgccctcgaggccaagatccgccgctggatccgcgcagcccgtgccgccgtgcgtggcgttttctccagcgagcgccgcctttgcttccttatcttccatgacctccccctctccaaccccaactcccccatcaccagccccaaccccaccacccctttcgccgaaactgtcaagggcgccacgttgcagctcttcggctttgctgaggccatcagtatcgggcgccgctcacctgagaagctgttcaagatcattgacctgcacgatgcgctctctgatctgctgcctgatgtctctgacatcttcgctgcttccaaggccggggaatcaatatatgtgcaggttgcggagatcaggtcacggctggctgatgccgtgcgtgggatactctctgagtttgagaatgccgttctacgggatccatccaaaactccggtaccgggtggcaccatccatcctctcactcgctatgtgatgaattacattagcctcatttctgactacaaggctacactctccgagctgatcttgtcacgaccatcatctagctcgcgtaatgctgctgaaggcaatgacctcacaccctcatttcctgatcttgaccttcctgatcctgacagccagtcacctcttgctgctcatcttatctggattattgtggttcttgaacacaaccttgaaggcaaagcatcgctctacaaggatgtgtcactctctcacttgttcctaatgaacaatgtgcactatatcgtgcacaaggtaaaggactcacctgagctccgggggcttattggcgatacttacttaaagcgactcacaggtaagtttcggttggcagccacaagttaccagcggactgcatggcttaagatccttaattgtctaagagatgaaggtctccatgtcggtggtggtttttcatcagggatatccaaaacagcacttcgggagcgcttcaaggctttcaatgctgtgtttgaggaggcacatcgggtgcagtccgggtggtatgtgcctgacacgcagctgagagaagagcttaggatctcaatatcagagaagctgctcccagcataccgctccttccttggtcgcttccggcatcatatagagaatggaaggcacccagaattgtacatcaagtattcggttgatgacctggagatatccgtgacagatttctttgaggggtccccacctccgccacataacaggaggagatcccatggatgagaaatggcttgaaggattccatgagttgtatcacttggctgggtgttgttgccagtattctttcattcttcgtggggaatcagtgcaggcagtcgggtattttgttttacactcccgagccttacgggtgtagttggtgatgatttcttctactagaggtaatctgaaacagaatcagggcacaagggtcggattgaagctgtcaaaagcctcggtagttcttcctcagttcacgagcttgttcatttgttacactactatattttttagtagcatgttcatataggaatgttcttttagtaatgttgcacagttgtaagctgtaacttctggagcttatttgacctttagatgagtgcccttccatgcttttggttgatcacatatatatgaagaatgtactagatatattagatgtaaaatctttttttctgagttaaattagatgtaaaatctactatgttactgtgttgcactttgattatctaggaccaagttcttgtctt

SEQ ID NO: 1682 - DNA, 3430 bp, Sorghum bicolor
aaagcggacggccggtctttagcggggccagcagacagcgccctcctctgtcctctcctcgcttcgccgccgcgaatcaatcgctgggactaggcgactagcgtgcgtactgcctgccactcactcggctcaggctcatcgcgggctgacgggctccgcctccgcgcgcgcgcgcgcgagcggggtgggtgtgggccgtgcgggggactgcgacaagtcgggtgagggttgtgctgcggccgcgtaactgaggggagggggaaagagggggaggcggcggccgggccagccagcatggagggatccgccgcggaggagctcgaggccgcggagagggtggtcatgcggtgggactccacggcgtcctcagccggcggggacgaccagatgctgttcgacggcgccgccgaccgcgccgaggcggagcggttcctccgggcggtggacgacctccgccgcctggcgccgccggccaccgtcggcaccccgcgccgcgccgcccttcaggtcgccatggcgcggctcgaggacgagttccgccacgtgctgtcggcgcgcgcgctcgacctcgagatcgaggcgctcgcgggcctcagctcgctctccatatccagcagcgacccgaggaactccgacgccaccgaggcggcggccacggggggcgacgatgacgacacctcctccgcgtcgtcctccgtcggcaggcgcagcagctaccgctccctgcagagcatccgcgagatcgacctcttccccgtggacgcaatctccgacctccaggccatcgcctcccgcatggccgccgccgggtacggccgcgagtgcgtccaggtgtacgcctccgtccgcaagccggccgtcgacgccgccctgcgccggctcggcgtcgagaagcttagtatcggcgacgttcagcggctcgagtgggacgccctcgaggctaagatccgccgctggatccgcgcggcccgcgccgccgtccggggcgtcttcgccagcgagcgccgcctctgcttccacatcttccacgacctcccgctgtgcacttccaccgccaccgccaccgccgcggacgacgcgcccttcgctgaggccgtcaagggcgcggcgctgcagctcttcggcttcgctgaggccatcagcatcgggcgccgctccccggagaagctgttcaagatcattgacctccacgacgcgctcgccgatatgttgcctgacatctccgacatctttgcggcctccaaggccgccgagtcgatatacgtgcaggccgccgagatcaggtcgcggttggccgatgccgtgcgtggaatactctcggagtttgagaatgccgtgctccgcgacccatccaagactccagtgcccggcggcaccatccacccgctcactcgctatgttatgaattacagcaccctcatttcggactacaaggccaccctctctgagcttatcatctcgcggccatcagctaactctcgaactgctgctgggggcaatgaggctacaccggccttccctgatcttgacccgcctgatcctgacagccagttgccccttgctactcatcttgtctggattattgttgttcttgaacacaaccttgagagcaaggcatcactctacaaggatgcagcactgtctcatttgttctttatgaacaatgtgcactatatggtgcacaaagtgaaggattcagctgaacttcgggggctaattggggatgggtatttgaagcggctcacaggtaaattcctgcaggcagctacaagctaccagcgaactgcatggttgaagatcctgaattgtctcagagatgagggtctccatgttagtggtagcttttcgtctggtatatccaaatcggcactacgggagcgattcaaggctttcaatgctgcatttgaggaggcacacagggtccagtctgtgtggtatgtgccagacacacaactgcgagaagagcttaggatcttaatttcggataagctgctcccagcgtatagatccttccttggcaggttccggcatcacatagagaacagcaggcaccctgagctgtacatcaagtacacagttgaggatcttgagatagcaatggcagatttctttgagggatctccaccatcatcaccgcataacaggaggagatctcatggatgaaagatgtcttgaaaaagcttagtcttcttgcaatctattctttaattctttggggacaggccaacaaatgctgttgggtcttttgttttgtcctcctgagggttatagttggtgatgatatcttcgactagaggtaatctgaaacgggataaggatcttgataaaaagctgccgaaagtcccatttcttcttccactgtaagcgatcttttttcatttgttgcacttgtttatattcttgtgagtagtgtttatataggactgttcttttagccatgtaacatagttgtaagttgtaacttctgtatctgtttgacatttagctgagttgttgtatcatcgttttgatggttcacatgtatctcaagaatgttgcttgatagatgaggtgcaaaaagaaattgtaatgttaaggttatgcacatatgatgcaattgcgcaatgccatttttctggccttgaagtatatgtttggaggatttttctgctttatatgtctttgcaatcataacagtgaataagggtgcaatataacattagtcacgatacaactacaatgtctataattaaagttacagtcagattttccatcaaacattctacctgactgtaaaataagaaagatgcttgcccatttatctacaataatgagaaaaaaaagttggcatttactcttttgtatcattagtttttcttactattttggggactactgccgcacctcagaccccaatgacacacacacaaatgtgtgtaggattctactgttatgcagcgaaatggtaagttcaagtttcctgcagcacactaataggttttctaactagctggaaccccatgcagttgtgcgggcaagcaaacatataaatgtagcatgagaaggcacaacaatacatagtaaggagagcgcgaagcggcagcatggcggggtcggcggcgttgtggcaagcagcggcagcgtcccaacctccggaccgctaggcaacgcgggctggcagggatggcgctggaggagtgggggtagcggcgggggactgacgctgcgggggggagactgtcgcagctggagagaggacgggacgttgaaggctctggcggagttccagaatcgaacggataagagaagctggtgacatggcttccagggagcagtaattggtgaaaaaataagggtaaggatagatgtcaatgggcctattttaattagggctagtataaaaccttatgctttaaacctgataaactgtttaatttctcgaaacacttac

SEQ ID NO: 1683 - DNA, 2733 bp, Zea mays
agtgccgcccgcggcccgccgtcagccagtaatccgcctgccggttggttaattaacacaaggaagcccaaacgaacgaagccaaatcgccgagatgaacgaggggattagataaagcggggccagccgagcagacagcgcccctcgtctcctctcctcgcttcgcttcgcgccgccgccgcgaatcgctgggagcagcgtactgccactcatagcgggactgcaaagtccgtgagggttgcgcggccacgtaactgggaggggaaaaggagggaggggaggcgaggcggcggccagcatggaggcatccgcggcggaggagctggcggccgcgaagagggtgatcatgcggtgggattccactgcgtcggcggcgtgctcagccggcggggacgaccagatgctgttcgacggcgccgccaaccgcgccgaggcggagcggttcctccgggcggtggacgacctccgccgcctggcgccgccgtcgccggcctccgtcggcagcccgcgccgtgcctcggcggcgggcggcgtctgcgacgccgtgcaggtcgccatggcgcggctcgaggacgagttccgccacgtgctgtcggcgcgcgcgctcgacctcgagatcgaggcgctcgccggcctcagctcgctctcgatggccagcgaccgtaggaactccgacgccaccgaggaggcggccgcgggggacgacgacggaagcggcggcggcggcggcagctccgtgtcgtcctccgtcggcaggcgcagcagctaccgctccctgcagagcatccgcgagatcgacctcttccccgcggacgcaatctccgacctccacgccatcgcctaccgcatggccgccgcggggtacggccgcgagtgcgtccaggtgtacgcctccgtccgcaagccggccgtcgactccgccatgcgccggctcggcgtcgagaagctcagcatcggcgacgtccagcggctcgagtgggactccctcgaggccaagatccgccgctggatctgcgcggcccgcgccgccgtccgcggcgtcttcgccagcgagcgccgcctctgcttccacatcttccacgacctcccgctgcgcacttccaccgccaccgccgcgtatgccaccaaccaagacgcgcccttcgctgaggccgtcaagggcgcggcgctgcagctcttcggatttgccgaggccatcagcatcggccgccgctccacggagaagctgttcaagatcattgacctccacgacgcgctctccgatatgctgcctgacatctccgacatcttcgccgcctccaaggccacggagtcgatatacgtgcaggccgccgagatcaggtcgcggttggccgatgccgtgcgtgggatactctcggagttcgagaacgccgtgctccgcgacccatccaagactccagtgcccggcggcaccatccacccgctcactcgctatgttatgaattacatcagcctcatttcggactacaaggccaccctctctgagctggtcatctcgcggccatcagctagctcccggactgctgctgagggcaatgaggctacaccgtcctttcctgatcttgacccgcccgatcctgacagccagttgccccttgccgcccatcttatctggattattgttgttcttgagcacaaccttgagagcaaggcgtcactctacaaggatgccgcactgtctcatttgttccttatgaacaatgtgcactatatcgtgcacaaagtaaaggattcagctgaacttcgggggctaattgggaacgagtatttgaagcgactcacagggaagttccgccaggaagctacaagataccagagaactgcgtggttgaagatcctgaattgtctcagagacgagggcctccatgttagtggtggtttctcgtctgggatatccaaatctgcactacgggagcgattcaaggctttcaatgctgcgtttgaggaggcacacagggtccagtctgcgtggtatgtgccagacacacagctgagggaagagcttaggatctcgatttcggagaaactgctaccagcatatcgatccttccttggcaggttccgtcatcacatagagaacagcaggcaccctgagttgtacatcaaatactcagttgaggatcttgagataacaatggcagatttctttgagggatctccaccaccgcataataggaggagatctcatggatgaaatatatcttgaaaaaacttatcttttttgcaatgaataatacgtattctttagttctttggggacaggccaaccgacgcggttgggtcttgtgttttgtcctcctgatgctgagggttgtagttggtgatgatttcttcgactagaggtaatctgaaacaggatcaggatcttgataaaaagctgtcagaagtcccatttcttcttccactgcaagcgatcttttttttttcatttgttacacttgtttatattcttgcgaatagcgtgtttataataggaatgttcttttagccatataacatagttgtaagttctaacttctgcatctgtttaacatagtgttgtatcatcgttttggtggttcacatgtatctgaaaaatgctgtttgatagatgaggtgcaaaaagaaactgtaatgttaaggttatgcacatatgatgcaattgtgaatgccatttttttttctggccttgaaatatgtttgtagaatttttttcttctttatatgtctttg

SEQ ID NO: 1684 - DNA, 2357 bp, Sorghum bicolor
agagaatcctgaacccgccccgtcgaacaccagaggaatccgagggcaaaaatcgaaaaagtcactccggcaccgccgccctgcccgccccggcgcgccagtctcccgccgcctctctagcctccacccaccctcgagcggcgcgtctcccaccgtcgctcggtttcccaccggcacagcccggctttgcctccgccactccgcttcccgccgcggcgccgtccgacgccgccgactccgtctgctcccttgcctccgctcgttcccatcttacgccgccgtagctactgtgagcagggatacagaagagagggagagaagatgtcgtccaagaagaactactataaggagaagatgatgcggcggaaagaggagaaaaaagaagaaccagagacacctaggtatcgtgatcgtgctaaggagcgtcgcgaagatcagaacccagattatgaacctacagaacttggttcatttcatgcagtggcacctcctgggactgatttgaggttggcagatgcccacaagatttcaattgagaaaagcaaatatctcggaggtgatttggagcatacacatctggtcaagggcttggactatgctctacttcacaaagtacggagtgaaattgaaaagaaacctgatgcagaggatgggaaggatgcaaagtcaagggcaacaaaagaagatcaggcaatctccttccgcactgcaactgcaaagtctgtctaccaatggatcataaagcctcaaagcataattaaggagaatgaattgtttcttcctggtcggatgtcatttatttacaacatggaggagggagtaacaaatgatattccaacaactcttcataggagcaaagctgattgcccaattccagaggagatggttactgttagcgtggatggttctgtacttgacaggattgctaaaattatgacataccttcggcttggatcatcagggaaggtcttgaagaaaaagaaaaaggagagagatataaaagggaagagcaatttggcaagtggtgactatgatgagtctgtaaaaccttcccaaattaatggttctactctgaaacatcaatcagatatgccaccaccaccagctccaccccctcggaacaataatttcaatggaaaggagaaacaaccagtccctgtttcaagagcagatgatgatgacatttttgttggagatggagttgactattcagttcctaacaaggaaatgagtcagagccctgtttctgatatggatgaatccccacataaccatcagaagcagtccaatttcactgaacccatgtatggcccagtaccaccatctgaacctgctcaagcttggcaacagcagaacgggtatgatgctgttcaagcccagatggcagctgctggatatcaaggtgactggtcaagctatgtgtatgcagaacagcagttgggttatccagaacagtatgtgcagcaaagcacccaggaatacgatgtgttagctgaccctagtctatcccaggatccgaggttcatgactcaagcagacaaggatcggggtttaggttctgttttcaaacgtgatgatcaaaggcttaatcagctgagggaaaaagatgcacgggagagagatccaaattttatttcagatagttactcagagtgttatcctggttaccaggagtataataatgagattgcaggaagcgatgatgaagatgatttatcgaagatggatatgggtggacgggcgaagggccgtcttcacaggtgggactttgagactgaagaggagtgggccaagtacaacgatcagaaagaagccatgccaaaggctgccttccagtttggggtgaagatgcaggacggcaggaagaccaggaagcagaataaggaccagaagctcacgaacgacctccacaagatcaacaagatcctggctaggaagaagggcgagaaagatggggcggaagatggcggtcactatgatgatgatttacctagctcgaagaaacagcgtggctgaagctgtcaccttttgtttctcctgccaatacagtaggcaggcgaacattgtatgaagagttacagtgccatgtttagctggcagctgtatcctgcgtttgtttaaggtggccggtaggaaattatgttgatgctattgagctgaaaccatggaagaagtatgcctgtatacgtaattttataagaaaagaaaaggcagagctttattattacaatgagttcgatttgtcaaagaagtcatattgggaggcctttgtgatctggtgagaatcgagaatagtcaagactttgtcccaggtcttgtttacttccactccaaaactcaaaaattttcaagatttt

SEQ ID NO: 1685 - DNA, 2324 bp, Setaria italica
attttttccgtccgttttcatccttaaagagagagcgaaatcgagtcactccggcaccggtgcgccgccgccgtccgccgtccgccgtccgcaggccctctagcctcctcccatctccaagcggcgccgctgtatcccccacctctcgcgtttaccaccggatttctccgcccttcctccgccagctcccttcccgccgcgctgcactccgccgccgccggcttctgtccccgcctccgtcgtctcgctcccgccatctgctgctgtaggctgtagctcctcgagcgtgaaccactaggccgtctcgccgagttggaaccctgagattgtgagctggatttgtaacaatctcgtcttcaagtctctaatcccccctgacctgggtttgtagggatacagtctagacagacaagatgtcgtcgaagaagaactactataaggagaagatgatgcggcggaaagaggagaaaaaagaagaaccagagacacccaggtatcgtgatcgtgctaaggagcgtcgtgaagatcaaaacccagactatgaacccacggagcttggttcatttcatgctgtggcacctcctgggacggatttgaggctggcagatgcacacaagatttcaattgagaaaagcaaatatctcggaggtgatttggagcatacacatttggttaaaggcttggactatgctctacttcacaaagtacgaagtgaaattgaaaagaagcctgatgcagaggatgggaaggatgcaaagtcaagggcgacaaaagaagatcaggcagtctccttccgcactgcagctgcaaaatctgtctaccaatggatcataaagccacaaagcataataaaagagaatgaattgtttctccctggtcggatgtcatttatttacaatatggaggagggactcaccaatgatattcctacaactcttcataggagcaaagctgattgccctgttccagaggagatggtaactgtcagtgtggatggctctgtacttgacaggattgctaaaattatgacataccttcgacttggatcatcagggaaggtcttaaagaaaaagaaaaaggaaagagactcaaaagggaagaacaatttggcaagtggtgattatgatgaggcagtaaaaccctcacaaactaacggttctgctctgaagcaccaatcagaaaagaatatgccgccgccgccgccaccacccgctcggaatgataatttcaatggaaaggagaaacaacctgttcctatttctagagctgatgatgatgacattttcattggagatggagttgactatactgttcctaataaggaaatgagccagagccctgtttctgaggatatggatgaatccccacataaccatcagaagcagtcctatttcacagaacccatgtatggcccagtaccaccatctgaacctgctcaagcttggcaacagccgagtgggtatgatgctgttcaagcccaaatggtagcagctggatatcaaggcgattggtcaggctatgcgtatgcagaacagcagatgggttatccagaacagttcgtgcaacaaagcactcaggaatatgatgtgttagctgatcctagtatagcccaggatcctaggttcatgactcaagcagacaaggatcggggtctaggttctgttttcaaacgtgacgaccaaaggcttaatcagctgagggaaaaagatgcccgggagaaagatccaaattttatttcagatagctactcagagtgttatcctggttaccaggagtatcataatgagattgcagggagcgatgatgaagatgatttatcaaagatggatatgggtggacgggccaaggggcgtctacataggtgggactttgagacggaagaggagtgggcgacatacaatgatcagaaagaagccatgccgaaggccgccttccagtttggggtgaagatgcaggacggcaggaagacgaggaagcagaacaaggaccagaagctcactaatgatctccacaagatcaacaagatccttgctaggaagaagggcgagaaagatggaacggatgatggcggccattacgatgatgatttacctagcgcgaagaagcaacgcggctgatgtagttcatttctcggtcctcgtggcagaaagtgtaaaatgcgccaatagttacagtgccatgtttagctgccagctgagttgctgagcttttgtttaaggtggctggtatgaaatatatgtccttgactcttgctgatgctatggaagaaatctgtttgtatatgttttaaggataaggaggtgctgccgaatactgtttgattt

SEQ ID NO: 1686 - DNA, 2166 bp, Panicum virgatum
agcgaatccgagggccacatcgaaaaaggccggcccgccgcgccgccgtcctccagcctcctcccatctccgagctgtaccgcacccccccccttcccccctctatcgtttcccgacggccggacctctctgctcccgcctgtccacctcccgccgcggcgccgtcggcaccgtctgtcaagccccgttgtctcgctcttatcatccgctgccgtagctaactctgggcagtgatacagaaaaaggagagaagatgtcgtcgaagaagaactactacaaggagaagatgatgcggcggaaagaggagaaaaaggaagaaccagagacacccaggtatcgcgaccgtgctaaggaacgtcgtgaagatcaaaacccagattatgagcctacagagcttggttcgtttcatgctgtggcacctcctgggacagatttgaggctggcagatgcgcacaagatttcaattgagaaaagcaaatatctaggaggtgatttggagcatacacatttggtcaaaggcttggactatgctctacttcacaaagtacggagtgaaattgaaaagaaacctgaagcagaggatgggaaggatgcaaaatcaaggtcaacaaaagaagatcaggcagtctccttccgcactgcaactgcaaagtctgtctaccaatggatcataaagccacaaagcataataaaagagaatgagttgtttctgcctggtcggatgtcatttatttacaatatggaggaaggagtaaccaatgatattccaacaactcttcataggagcaaagctgattgcccaattccagaggagatggtaactgtcagtgtggatggttctgtacttgacaggattgctaaaattatgacatacctccgacttggatcttcagggaaggtcttaaagaaaaagaaaaaggagagagatttaaaagcagggaagaacaatttggtgagcgctgactatgacaaggcagtaaaaccttcccaaactaatggttctgctctgaaacatcaatcacagaaggatatgccgccgccaccagcacccccttggaacaataattttaatggaaatgagaaacaatttgcccctgttgctagagcagatgacgatgacatttttgtcggagatggggttgactattctgtccctaacaaggaaatgagccagagtcctgtttctgaggatatggatgaatccccacataaccatcagaagcagacttatttcactgaacccatgtatggtccaataccaccatctgaacctgctcaagcttggcaacagccgaatgggtatgatgctgttcgagcccagatggcagctgccgggtatcaaggcgactggtcaggctatgtgtatgcagaacagcagttggcttatccagtacagtatttgcaacaaagcacccaggaatatgatgtgttagctgaccctagtatatcccaggatccaaggttcatgactcaagcagacaaggatcgaggcctaggttctgttttcaaacgtgatgatcaaaggcttaatcagctgagagaaaaagatgcgcgggagagagatccaaattttatttcagatagttactccgagtgctatcctggttaccaggagtataataatgagattgcagggagtgacgatgaagacgatttatcaaagatggatatgggtggacgggcgaagggtcgtcttcacaggtgggactttgagacggaagaggagtgggcaaaatacaatgatcagaaagaagccatgccgaaggccgccttccagtttggtgtgaagatgcaggatggtaggaagacgaggaagcagaacaaggaccaaaagctcacgaatgacctcaacaagataaacaagatcctggctcggaagaagggtgaaaaggatggggctgatgatggtggccattatgatgatgatttacctagctcaaagaaacagcgtggctgaagctgttggtggttttcgtttctcctgccaatatagtgtaaacttagaatgttaccagttataccatgcttacctggtagctgtgttctgcagtgtttgtttgaggtgcagtgtgaaatatattgagctaagacattggaagaaatacatatgcctgtatttttaaccttttttatgtgaagaaaagaggcaaaactcaatttatcatt

SEQ ID NO: 1687 - DNA, 2212 bp, Panicum virgatum
ccccccccccgccgtcgcctctatcgtttcccgacctccgtaccgctctgccccccccgcctgtccgcctcccgccgcggcgccgtccgacgccaccaccgcctgacgccgtctgtcaagccccgttgtctcgttcgcatcatccgctgccgtagctaactctgagcagggatacagaaaagggagagaagatgtcgtcgaagaagaactactacaaggagaagatgatgcggcggaaagaggagaaaaaggaagaaccagagacacccaggtatcgcgatcgtgctaaggaacgtcgtgaagatcaaaacccagattatgagcctacagagcttggttcatttcatgctgtggcacctcctgggacagatttgagtctggcagatgcgcacaagatttcaattgagaagagcaaatttctaggaggtgatttggagcatacacatttggtcaaaggcttggactatgctctacttcacaaaatacggagtgaaattgaaaagaaacctgatgcagaggatgggaaggatgcaaagtcaaggtcaacaaaagaagatcaggtagtctccttccggactgcaactgcaaagtctgtctaccaatggatcataaagccacaaagcataataaaagagaatgagttgtttctgcctggtcggatgtcatttatttacaatatggaggaaggagtaaccaatgatattccaacaactcttcataggagcaaagctgattgcccaattccagaggagatggtaactgtcagtgtggatggttctgtacttgacaggattgctaaaattatgacatacctccgacttggatcttcagggaaggtcttaaagaaaaagaaaaaggagagagatttaaaagggaagaacaatttggtgaccggtgactatgacgaggcagtaaaaccttcccaaactaatggttctgctctgaaacatcaatcacagaaggatatgccgccaccaccaccaccaccccgtcgggacaataattttaatgggaatgagaagcaatctgcccctgttgctagagcagatgacgatgacatttttgtcggagatggggttgactattctgtccctaacaaggaaatgagccagagccctgtttctgaggatatggatgaatccccacataaccatcagaagcagacttatttcactgaacccatgtatggcccaataccaccatctgaacctgctcaagcttggcaacagccgattgggtatgatgctgttcaagcccaggtggcatctgccgggtatcaaggcgactggtcaggctatgtgtatgcagaacagcagttggcttatccggaacagtatgtgcaacaaagcaccctggaatacgatgtgttagctgaccctagtatatcccaggatccaaggttcatgactcaagcagacaaggatcggggccttggttctgttttcaaacgtgatgatcaaaggcttaatcagctgagagagaaagatgcacgggagagagatccaaattttatttcagatagttactctgagtgttatcctggttaccaggagtataataatgagattgccgggagcgacgatgaagatgatttatcaaaaatggatatgggtggacgggcgaagggtcgtcttcacaggtgggactttgagacggaagaggagtgggcaaaatacaatgatcagaaagaagccatgccgaaggccgccttccagtttggtgtgaagatgcaggatggtaggaagacaaggaagcagaacaaggaccaaaagctcacgaatgacctccacaagataaacaagatcctggctcggaagaagggtgaaaaggatggggctgatgatggtggccattatgatgatgatttacctagctcaaagaaacagcgtggctgaagctgttgatggtttttgtttctcctgccaatagtgcttatgtgctaaatttaccatgtttacctggtagctgtgtgctgtagtgtttgactacttgttcgaggtgtcactttgaaatatattgagctcctgagctgaaacattagaggaaatatgcctgtatttgtaacctttttcatgtgaagaaaagaggcaatactctatttatcattatcctgttctttcaatttgtcgaaggtgctaactgtgcgggcagctatctgtgaaaaataatcactgcttaaccataaattgtataaaaataatttccatgtctt

SEQ ID NO: 1688 - DNA, 2384 bp, Setaria italica
ctcgtgtgtgcgtctgcagaaagcagcaaaggcaagagggcgaaatcgagtcactccggcaccggtgcgccgccgccgccgtccgccggcactctagcctcctcccgtctcggaacggcgccgctgtatcccccgcctctcgcgtttcccaccggatttccccgcccttcctccgccagctcccttcccgccgcgctgcactccaccgccgccgccttctgtccccgcctccgtcgtcttgctcccgccatcagctccggtaggctgtagctcctcgagcagggaccactgggacgacgctccgagcaggagccctgaggctgcgagctggagttgtaacaatctcgtcttcaggattctaatccccactgacctgggtttttagggatagagcagacagacaagatgtcgtcgaagaagaactactataaggagaagatgatgcggcggaaagaggagaaaaaagaagaaccagagacacccaggtatcgtgatcgtgctaaggagcgtcgtgaagatcaaaacccagactatgaacctacggagcttggttcatttcatgctgtggcacctcctgggacagacttgagattggcagatgcacacaagatttcaattgagaaaagcaaatacctcggaggtgatttggagcatacacatctggtcaaaggcttggactatgctctacttcacaaagtacggagtgaaattgacaagaaacctgatgcagaggatgggaaggatgcaaagtcaagggcaacaaaagaagaccaggcagtctccttccgcactgcaactgcaaagtctgtctaccaatggatcataaagccacaaagcataataaaagagaatgaattgtttctcccaggtcggatgtcattcatttacaatatggaggagggattcaccaatgatattccaacaactcttcataggagcaaagctgattgccctgttccagaggagatggtaactgtcagtgtggatggttctgtacttgacaggattgctaaaattatgacataccttcgacttggatcttcaggaaaggtcttaaagaaaaagaaaaaggaaagagacacaaaagggaagaacaatttggcaagtggcgattatgatgaggcagtaaaacctacccagactaacggttctgatctgaaacaccaatcagaaaagaatatgccaccgccgcctccaccaccccctctgaacaataattccaatggaaaggagaaacaatccgttcctcttgctagagctgacaacgatgacattttcgtcggtgatggagttgactattctgttcctaacaaggaaatgagccagagtcctgtttctgaggatatggatgaatccccacataaccatcagaagcagtcctatttcacagaacccatgtatggtccagtaccaccatctgaacctgctcaagcttggcaacagccgaatgggtatgatgctgttcaagcccaaatggtagcagctggatatcaaggcgattggtcaggctatgcgtatgcagaacagcagttgggttatccagaacagtatgtgcaacaaagcattcaggaatatgatgtgttagctgatcctagtatagcccaggatcctagtatagcccaggatcctaggttcatgactcaagcagacaaggatcggggtctaggttctgttttcaaacgtgatgatcaaaggcttaatcagctgagggaaaaagatgcacgggagaaagatccaaattttatttcagatagctactcggagtgttaccctggttatcaggagtatcataatgaagttgcagggagcgatgatgaagatgatttatcaaagatggatatgggtggacgggccaaggggcgtttacataggtgggattttgagacggaagaggagtgggcaaaatacaacgatcagaaagaagccatgccgaaggccgccttccagtttggggtgaagatgcaggatggcaggaagacgaggaagcagaacaaggaccagaagctcaataatgacctgcacaagatcaacaagatccttgctaggaagaagggcgagaaggatggaacggatgatggaggccattacgatgatgatttacctagtgcgaagaaacatcgcggctgatgtagttcatttcttgggcctcgtggcagaaagtgtaaaatgcgccaatagttacagacttacagtgccatgtttagctggatgctgagttgcttagcctttgtttaaggtggctggtatgaaatatatgcccttgactcctgctgaagaaatggaagaaatgtgtttgtatatgtttgaggaggcgctgccgaatactgtttgattttaacgccctgctcttgttgattctgggctgccccttcaaccggtggtta

SEQ ID NO: 1689 - DNA, 1918 bp, Pennisetum glaucum
agcgggaacaaattgtctgacgcgccgagccggagccctgctagctcggtttgtaacaatctcgtcttcgagattctataatcccctaaacctgggtttctagggatagagtcagacagacaagatgtcgtcgaagaagaactactacaaggagaagatgatgcggcggaaagaggagaaaaaagaagaaccagagacacccaggtatcgtgatcgtgctaaggagcgtcgtgaagatcaaaacccagactatgaaccgacggagcttggttcatttcatgctgtggcacctcctgggacggacttgaggctggaagatgcacacaagatttcaattgagaaaagcaaataccttggaggcgatttggagcatacacatctggtcaaaggcttggactatgctctacttcacaaagtacggagtgaaattgataagaaacctgatccagaggatgggaaggatgcaaagtcaagggtaacaaaagaagatcaggcagtctccttccgcactgcaactgcaaagtctgtctaccaatggatcataaagccacaaagcataataaaagaaaatgaattgtttctccctggtcggatgtcattcatttacaatatggaggagggactcaccagtgatattccaacaactcttcataggagcaaagctgattgccctgttccagaggagatggtgactgtcagtgtggatggttccgtacttgataggattgctaaaattatgacataccttcgacttggatcttcagggaaggtgttaaagaaaaagaagaaggaaagagacacaaaagggaagaacaatttggcaagtggtgattatgatgaggcggtaaaacctacccagacaaatggttctggtctgaagcacaaatcagaaaagaatatgccactgccgcctccaccaccccctcggagcaataattccaatggaaaggagaaacaatctgttcctcttgctagagctgacgatgatgacattttcgtcggtgatggagttgactattttgttcctaacaaggaaatgagccagagtcctgtttctgaggatatggatgaatccccacatgaccatcagaagcagtcctattttgcagaacccatgtatggtccggtaccaccatctgaacctgctcaagcttggcagcagccgaatgggtatgatgctgttcaagcccaaatggtagcagctggatatcaaggcgattggtcaggctatgcatatgcagaacagcagttgggttatccagaacagtatgtgcaacaaagcattcaggaatatgatgtgttagctgatcctagtatagcccaggatcctagggtcatgactcaagcagacaaagatcggggtctaggttctgttttcaaacgtgatgatcaaaggcttaatcagctgagggaaaaagatgcacgggagaaagatccaaattttatttccgatagctactccgagtgttaccctggttatcaggagtatcatagtgaagttgcagggagcgacgatgaagatgatttatcaaagatggatatgggcggacgggccaaggggcgtctacataggtgggactttgagacggaagaggagtgggcaaaatacaacgatgagaaagaagccatgccaaaggccgccttccagtttggggtgaagatgcaggatggcaggaagacgaggaaacagaacaaggaccagaagctcagtaatgacctgcacaagatcaacaagatccttgctaggaagaagggcgagaaggatgggacggatgacggaggccattacgatgatgacttacctagtgcgaagaaacatcgcggctgatgtagttcattcttttgagtcttgtggcagagtgtaaaatgtgccatgtttagctggatgcggagttccttagcctttgtttaaggtggc

SEQ ID NO: 1690 - DNA, 1804 bp, Pennisetum glaucum
cggaagaaagaggagaaaaagaagaaccagagacacccaggtatcgtgaccgtgctaaggagcgtcgtgaagatcaaaacccagactatgaaccgacagagcttggttcatttcatgctgtggcacctcctgggacagatttgaggctggcagatgcgcacaagatttcaattgagaaaagcaaatatctcggaggtgatttggagcatacacatttggtcaaaggcttagactatgctctacttcataaagtacggagtgaaattgaaaagaagcctgatgctgaggatgggaaggatgcaaaatccagggcaacaaaagaagatcaggcagtctccttccgcactgcaactgcaaaatctgtctaccaatggatcataaagccacaaagcataataaaagagaatgaactgtttctccctggtcggatgtcatttatttacaatatggaggagggactcaccaatgatattccgacaactcttcatcggagcaaagctgattgccctgttccagaggagatggtaactgtcagtgtggatggttctgtacttgacaggattgctaaaattatgacataccttcgacttggatcttcagggaaggtgttaaagaaaaagaaaaaggaaagagacacaaaagggaagaacagtttggcaagtggtgattacgatgaggcagtaaaaccctcacaaactaacggttcttctttgaaacaaaaatcagaaaagaatatgccaccgccgccattaccacctgctcggaatgataatttcaatggaaaggagaaacaacctgttcctacttctagagctgatgatgatgacatttttgtcggagatggagttgattatgttgttcctaataaggaaatgagtcagagccctgtttctgaggatatggacgaatctccacataatcatcagaagcagtcctatttcacagaacccatgtatggcccagtaccaccatctgaacctgctcaagcttggcagcagccgaatgggtatgatgctgttcaagcccaaatggtagcagctggatatcaaggcgattggtcaggttatgcgtatgcagaacagcagctgggttatccagagcagtatgtgcaacaaagcactcaggaatatgatgtgttagctgatcctagtatagcccaggatcctatgttcatgactcaagcagacaaggatcggggtctaggttctgttttcaaacgtgacgaccaaaggcttaatcagctgagggaaaaagatgcacgggagaaggatcctaattttatttcagatagctactcagagtgttatcctggttaccaggagtatcataatgagattgcagggagtgatgatgaagatgatttatcaaagatggatatgggtggacgggccaaggggcgtctgcataggtgggactttgagacggaagaggagtgggctaaatacaacgatgagaaagaagccatgccgaaggccgccttccagtttggggtgaagatgcaggacggcaggaagacgaggaagcagaacaaggaccagaagctcagtaatgatctccacaagatcaacaagatccttgctaggaagaagggcgagaaagatggagcggatgatggcggccattacgatgatgacttacctagcgcgaagaagcaacgcggctgatgtagttcatttatgggtcctcgtggtggaaagtgcagaatgcagcaatacttgcagttccatgtttagctgtcagctgagttgcacagccattgtttaagttgtctggtatgaaatatatgtcattgactcttgctgat

SEQ ID NO: 1691 - DNA, 2059 bp, Zea mays
aaagtcactccggcaccgccagtcccccgcctcctccaaatccccgaccggcgcctccgtcccggcttccctccgctccctgccgcggcgccgtcgacgccaccgctgttgcctcgctccttcccatcttccgctgccatagctattgtaagcaaggattctatggagagagagagagagagagagagagagagagagagagagagagagagagagatcgccgaggagaagaaaaaagaagaaccagagacacccaggtatcgtgatcgtgctaaggagcggcgtgaagatcaaaaccctgattatgaacctacagaacttggttcgtttcatgcagtggcacctcctgggagtgatttgaggttggcggatgcccacaagatttcaattgagaaaagcaaatatcttggaggtgatttggagcatacacatctggtcaagggcctgggctatgctctacttcacaaagtacggagtgaaattgaaaagaaacctgaggcagaggatgggaaggatgcaaagtcaagggcaacaaaagaagatcaggcagtctccttccgcactgcaactgcaaagtctgtctaccagtggatcataaagcctcaaagcataattaaagagaatgaattgtttcttcctggtcggatgtcatttatttacaacttggaggaggtagtaaccaatgacattccaacaactcttcataggagcaaagctgattgcccagttcaagaggagatggtaactgtaagtgtggatggttctgtacttgacaggattgctaaaattatgacgtaccttcggcttggatcatcagggaaggttttgaagaaaaagaaaaaggagagagatataaaagggaagaacaatttggcaagtggcgactgtgatgagtcagtaaaaccttccaaaattaatggttctactcagaaacatcaatcagatatgccaccaccaccagctcgaccccctcagaacaataatttcactggaaaggagaaacaaccagtccctgttgcaagagcagacgatgatgacatttttgttggagatggagttgactatacagttcctaacgaggaaatgagtcagagccctgtttctgatatggatgaatccccacataaccatcagaagcagtccaatttcattgaacccatgtatggccctgtaccaccatctgaacctgctcaagcttggcaacagccgaatgggtatgatgctgttcaagcccagatggcagctgctggatatcaaggtgactggtcaagctatgtgtatgcagaacagcagttgggttatccagagcagtacgtgcagcaaagcacacaggaatatgatgtgttagctgaccccagtatatcacaggatccgaggttcatgactcaggcagacaaggatcggggtttaggttctgttttcaaacgtgacgatcaaaggcttaatcagctgagggaaaaggacgaacgggagagagatccaaattttatttcagatagttactcagagtgttatcctggttaccaggagtataataatgagatcgcaggaagcgatgatgaagatgatttatcgaagatggatatgggtggacgggcgaagggccgtcttcacaggtgggacttcgagactgaagaggagtgggccaagtacaacgatcagaaagaagccatgccgaaggctgccttccagttcggggtgaagatgcaggacggcaggaaaaccaggaagcagaacaaggaccagaagctgacgaatgacctccacaagatcaacaagattctggctaggaagaagggcgagaaagatggggcggaagatggcggtcactacgatgatgatttacctagctcaaagaaacagcgtggctgaagcagtcatttttttgtttttgtttctcctgctcgtactgtaggcaggcgaacattctatgaagagtcacagtgtcatgtttagctggcagctgtatcctgctgcgtttgtttaaggtgtcctggtaggaaatatgttgatgctattgagccgaaaccatggaaggaatgtggctatatatatatat

SEQ ID NO: 1692 - DNA, 2571 bp, Oryza sativa
ccgaattttttggatcagtatgggccgtgcgccacgaagcccaataatagcccatgtgatcctaccctcgcggccgcggcccagcgcaaatcagacggactcccctacctcctcctccgacgagaaatttcccatcggaggccgtcgtctccgtctccccgtttgctactccggcgccggcgaggccacctcggtcgtttccctccctcctccacccactcgccttcccggccgccgcggagctctgcccccccccactctccctacgtctagctgcgctacttgttgtctcccccacctctcttcctctgccgccgcacagcttgccttcctcgtcgtctcgtctccttcagcgccggcgagaagccccccggccgccgagcttgccccgtctccggcggctaggcgctgccgcctcctgaccacgcgggttttctgcccctgccgctgaccccacccaccgccggcttgctagggcttattggataagatgtcgtccaagaagaactactacaaggagaagatgatgcggcggaaagaggagaaaaaagaagaaccagagacaccaaggtatcgagatcgtgctaaggagcgtcgtgaagatcaaaaccctgattatgaacctacagagcttggttcatttcatgctgtggcacctcctggagcagatttaaggctagcagatgcacacaagatatctattgagaaaagcaaatatctcggaggtgatctggaacatacacatttggtcaaaggcttggactatgctctacttcacaaagtacgaagtgaaatagaaaagaagcctgaagcagaagatggaaaggatacacagtcaaggtctacaaaagaagatcaagcagtctcattccgcactgcagctgcaaagtctgtctatcaatggatcataaagccacaaagcatcataaagtcgaatgaaatgtttcttcctggtcggatggcatttatttacaacatggaggatggacttaccaatgatattccgacaacacttcacaggagcaaagctgattgctctgttccagaggagatggtaactgtcagtgtggatggttctgtacttgataggattgctaaaatcatgtcataccttcgacttggatcatctgggaaagtcttgaagaaaaagaaaaaggagagggacacaaaagggaagaacagtttagcaagtggtgactacgatgaggtagctagacctggccaaactaatgggtctgctctgaaacatcaatttgaaaaggatatgccaccgccgccaccccctcgaaataataatttaagcaaaaatgagaaaccgtctgctccagttgctagagcagatgaagatgacatttttgttggagatggggtttactattctgttcctaacaaggaaatgagccagagccctgtctctgaagatatggatgagtccccacataaccatcagaagcagtcctatttcactgaagagaaacctatctatgggcccatcccaccatctgaccctgctcaagcttggccacaaccgaatgcgtacgatgctattcaagctcaaatggtagctgctggatatcaaggggagtggtcaggctatcagtatggcgaacaacagatggcttatccagaacagtacatgcaacaaagcgctcaggactgtgatgtactagctgatccaaatataacccaggatccaaggttgatgactcaagcagataaagacagaggtcttggttctgttttcaaacgcgatgatgaaaggcttaaacagctgagggagaaagatgcacgggagaaagatcctaattttatctcggatagttactccgagtgctatcctggttatcaggagtataatcatgagattgcaggcagcgatgaagaagatgatttatcgaagatggacatgggtggccgggctaagggccgtcttcacaggtgggactttgagacagaagaggagtgggccacatacaacgaccagaaggaagccatgccgaaggctgcattccagtttggggtgaagatgcaggatggcaggaagacgaggaagcagaacaaggaccagaagctcacgaatgacctccacaaaatcaacaagatacttgcgagaaagaaaggtgacaaagatggagggcatgatggcgggcattacgatgatgatatgccaagtgggaagaagcaacgtgcctgatgctattagacacttatagtttatcctgcgagaggtaaaactgtatttgtactaggaattacagtgccatgaacacctgacagttgtaatgttctgcgttttggccggtgcagaagggaaaaagaacgggatggccatgctttcgagctgaaacagtgataatatgtagctcatccatttttataacagaacagcccgtaatttgctttgttttactacgaaaagaaaaaaacatcgaaagtccaattttccatgacaatgtacgcgttaagtcatctggtgagcaaatgacgtactccgttacgttttggaagaacagtatatgaactgttatggaaggacagtaatgtgaacaggtcaaaagacattttaacttc

SEQ ID NO: 1693 - DNA, 2281 bp, Oryza sativa
ggacttccttccccacctccctccgacccgcctcggctcccatccactaccgtttgctactccggcgccgccgcggccaacctcgcgcgtttccctctccctcctccacgcactcgccttccaagccgccgcggcgctgcgctcccccacctctcttctctgccgccgcaccgctttcccccgtcgtcgtcgtcgtctcgtctacttcagcgccagcgagaagcccccttgcccatgagcttgcctcgtctccggcggctacgcgctgccgcctcctaaccacgtcggtttcattgccctgtcgctgaccctgcgcaccgccggcttcctagggcttattggacaagatgtcgtccaagaagaactactacaaggagaagctgatgcggcggaaagaggagaaaaaggaagaaccagagacacctaggtatcgagatcgtgctaaggagtgccgtgaagatcaaaaccttgactatgaacctacagagcttggttcatttcatgctgtggcacctcccggagcagatttaaggctagcagatgtacacaagatatctattgagaaaagcaaatatcttggaggtgatttggaacatacacatttggtcaaaggtttggactatgctctacttcacaaagtacgaagtgaaatagaaaagaagcctgatgcagaggatgggaaggatacacagacaaggtcaacaaaagaagatcaggcagtctcattccgcactgcaactgcaaagtctgtctataaatggatcataaagccacaaagcatcataaagtagaatgaaatgtttcttcctggtcggatggcatttatttacaacatggaggatggacttaccaatgatatcccaacaactcttcacaggagcaaagctgattgcgctgttccagaggagatggtaactgtcagtgtggatggttctgtacttgataggattgctaaaatcatgtcataccttcgacttggatcatctgggaaagtcttgaagaaaaagaaaaaggagagggacacaaaagggaataacagtttagcaagtggtgactatgatgaggtagccagacctggccaaacaggttcttctctgaaacatcaatttcaaaaggacatgccgccgccgccaccccctcgaaataataacttaagcaagaatgaggaacagtctattcctgttgctagagcagatgaagatgacatttttgttggagatggagttgactattctgttcctaacaaggaaatgagccatagccctgtctctgaagatatggatgagtccccacataaccatcaaaagcagtcctatttcactgaagagaaacctgtctatgggcccatcccaccatcggaccctgctcaagcttggccacaaacgaatggatacgatgctattcaagctcaaatggtagctgctggatatcaaggggagtggtcaggctatcagtatggtgaacaacagatgccttatccagaacagtacatgcaacaaagcactcaggactatgatgtattagctgatccaaatatagcccaggatccaaggttgatgactcaagcagataaagatagaggtcttggttctgttttcaaacgtgatgatgaaaggcttaagcagctgagggaaaaagattcacgggagaaagatcctaattttatctcagatagttactccgagtgttatcctggttatcaggagtataatcatgagattgcaggcagcgatgaagaagatgatttgtcgaagatggacatgggtggccgggctaaggggcgtcttcataggtgggactttgagacggaagaggagtgggccaaatacaacgaccagaaggaagcgatgccgaaagctgcattccagtttggagtgaagatgcaggatggcaggaagacgaggaagcagaacaaggaccagaagctcacgaatgacctacacaagattaacaagatacttgcgaggaagaaaggtgacaaagatggaggggatgatggtgggcattatgatgatgatctacctagtggcaagaagcagcgcgcctgatgcaagccactaatagtttatcctgcgagaggtgtaaaaatgtatttgtactaggaattacagcgccatgaacaaacgacagttgtaatgttcagcgttttggccggtgcagaagggaataagaatggggagctggaacggtgaaaatatgtagtttgtccatttttataacagaacaatcggtaatttgctttgttctactatgaaaagagaaaacatcaacgaatgcccaa

SEQ ID NO: 1694 - DNA, 2291 bp, Triticum aestivum
ggcccgaggagctccaagtctccacccatcccggccactctcgtacggacccgaccatctacgccgccgacgccgccgaagctccagtccgccgcccgctaacccagcgcaaactccagtatcattacaaacccgagagagcaggcgccaaccaccacctcgcatcccgtgccccctccccctcgcggaaaccccctgccccccgtcgcctgtgctagggttgcagccgtattcctccggcttttgtttcccgggacacagggaagatgtcgtcgacgcagaagaagaagagcaactataaggagaagatggcgcggcggaaagaggagaacaaaaaagaagaaccagagacaccaaggtaccgagatcgtgcgaaggagcgtcgtgaagatcaaaaccctgactatgaacctacagagcttggttcgtttcatgccgtggcacctcctggagcagatttgaggctagaagatgcccaaaagatttcaattgagaaaagcaaataccttggaggcgatctggagcatactcatttggtcaaagggttggattttgctctactaaacaaagtacggagtgaaattgacaagaagcctgatgcagaggatgggaaggatgccaaggcgagggaaacaaaagaagaccgggcagtctcattccgcactgcaattgcaaagtctgtctaccagtggactgtaaagcaacaacaaagcatgataaaggcgaatgacatgtttcttcctggccggatggcatttatttacaatatggaggatggacttaacagtgatattccaacaactcttcacaggagcaaagctgattgccctgtcccagaggaaatggtcactgtcagcgtggatggctctgtacttgacaggattgccaaaatcatgtcataccttagacttggatcatcagggaaggtcttgaagaagaagaaaaaggagagggatacaaaagggaagaataatttggcaggcggtgtctacaatgaggtagtaagacctgcccaaagtgatggttctgttcagaaacaccagtcagaaaaggatatgccaccaccacccccacccccacgaaagagtaacttcagtgaaaaggagaaacattctgtccctgttgctagagcagatgacgatgacatattcattggagatggagttgactatactgttcctaacaaggaaatgagccagagccccatctccgaagatatggatgaatccccacgtatccatcagaatcagtccaatttgaatgaacctgtgtatggtcctattcaaccatctgaacctgctcaagcttggcaacagccaatggatggttatgatgctatgcaagcccaaatggcagctgctggataccaaggcgagtggtcaggctatcagtatgctgaacagcagctggcttatccagaacagtacatgcaacagggtactgtgggatacgatgtattagttgacccaaatatatctcaggatccaaggttgatgactcaagcagacaaggataagggtctaggttctgtcttcaagcgtgatgatgacaggcttaagcagctgagggaaaaagatgcgcgggagaaagacccaaattttatttcagatagttactctgagtgttatcctggttatcagggttataatcaagagattgcagggagtgacgatgaagatgatttgtcaaagatggatatgggtggacgggcgaagggccgtcttcaccggtgggactttgagacggaagaagagtgggcgaaatacaacgatcagaaggaagccatgccaaaggcggcattccagtttggtgtgaagatgcaggatggcaggaagaccaggaagcagaacaaggatcagaagctcagcaacgacctcaacaagatcaacaagatcctggcgaggaagaagggcgataaagatggaggcgaagggcattatgacgacgatctacccagcgggaagaaacagcgagcttgatctaactggtcatccattgtttttcttttcgtctgtcttgttggaactgtgaaacggccatgcttttgtgagctgaaaccattaagtctgtagcctgtagtttcatttttgatggacattagtcttgcatggcattcgttgtagaatatgtaaaccagatggtcccacctactcaggtcaggcaaaagtaccagacatgacatgagaagccatgtaaaattgtgggagacgattctgatctggtggctgatccgcgggaaatatccgtctcttgtctcggaaaaaagatgtttctcttcacctgattccttt

SEQ ID NO: 1695 - DNA, 2288 bp, Brachypodium distachyon
tcttgattccctccatagtctccagctccagccccgacccggccgaccgccgccgccgccgccggagctccagtccgccgtctaacgccccccctagcgcagcataaactccagtggcacaaacccctgggtacccaaccaccaacctcgctaaaccccatcccgcttttttctttccgccggcgctagggttccggccgtgattcgccggctttggttggttctcccttccaggggcgcaagcctcctgaccgggcaagatgtcgacgacggccacgaagaagaagagcaactacaaggagaagatggcgcgccggaaagaggagaacaaaaaggaagaaccagagacgcccaggtaccgagatcgtgctaaggagcgccgtgaagatcagaacccagactatgaacctacagagcttggttcgtttcatgctgtggcacctcctggagctcctggagcagatttgaggctagcggatgcccagaagatctcaatcgagaaaagcaaatatcttggaggtgatttggagcatactcatttggtcaaagggttggattttgctctactaaacaaagtgcgaagtgaaattgacaagaagcctgatgcagaggacgggaaggatgcaaaggctagggaaacaaaagaggaccgggcaatctcattccgcactgcaattgcaaagtctgtctaccaatccatcgtaaagtcacagagcacgccgaaggcaaatgagatgtttcttcctggtcggatggcatttatttacaatatggaggatggacttattaccaatgatattccaacaactcttcacaggagcaaagctgattgccctgttccagaggaaatggttactgtcagcgtggatggttctgtacttgacaggattgcgaaaattatgtcataccttagacttggatcatcagggaaggtcttgaagaagaagaaaaaagagagggatgcaaaaggaaagaataatttggcaggcagcgactacaatgagggagtaagacctccccaaactaatggttctgctcctaaacaccatttagacaaggaaatgctaccacctccacccccacgaaagagtaacttcaaagaaaaggagaaacagcctgcccctattgctagggcagatgatgacgacatatttgttggagatggagttgactacactattcctaacaaggaactgagtcatagccccatctctgaagatatggatgagtccccacataaccatcagaatcagtcacatttgactgaacctgtgtatggtcctattcaaccatctgaacctgctcaagcttggcaacaagtgggtggttatgatgctattcaagcccaaatggctgctgctggatatcaaggcgagtggccaggctatcagtatgctgaacagcagctggcttatccggaacagtacatgcaacagggtgctctgggatatgatgtattagctgacccagacataccccaggatccaaggttgatgactcaagcagacaaggataagggtctaggttctgttttcaaacgtgacgatgacaggcttaagcagctaagggaaaaagatgcacgggagaaggaccctaattttatttcagatagttactccgagtgttatcctggttatcagggttataatcaagagattgcagggagtgatgatgaagatgatttgtcgaagatggacatgggtggacgggcgaagggccgtcttcaccggtgggactttgagacggaagaggagtgggcgaaatacaacgaccagaaggaagccatgccgaaggcggcgttccagttcggggtgaagatgcaggacggcaggaagacgaggaagcagaacaaggaccagaagctcaacaacgacctccacaagatcaacaagatcctggcgaggaagaagggggacaaggacgggggcgaaggacactatgacgatgatctgcctagcgtgaagaaacaacgcgcttgatcttcaccagttgctgcccccttagttttcggtctatcctgtcagaattgtaaaatggccatgccttttcttttgagctgaaacactggtgatcgatttgtaagctagctcaatgttgtttatgaatgcattggtaatttatctctgttattgaagctgtcttccatctcatttgttgtagagcctgaactacaagtgatgaaaaaagtataccgtaggattacctggaaggaagaaaaatattcaatcacaaatacttactcgcactatttttcatagagggtcaaatattttattactcatggctgt

SEQ ID NO: 1696 - DNA, 2047 bp, Secale cereale
tgcgtcagcgcaaactccagtatcattacaaacccgagggagcaggcaccaaccgccacctcgcatcccgtgccccctccccctgcggaaaccccctcgccccccgtccgcctgtgctagggttgcagccgtattcctccggcttttgtttcccgggacacagggaagatgtcgtcgacgcagaagaagaagagcaactataaggagaagatggcgcggcggaaagaggagagcaaaaaagaagaaccagagacaccaaggtaccgagatcgtgcgaaggagcgtcgtgaagatcaaaaccctgactatgaacctacagagcttggttcgtttcatgccgtggcacctcccggagcagatttgaggttagaagatgcccaaaagatttcaattgagaaaagcaaataccttggaggcgatctggagcatactcatttggtcaaaggattggattttgctctactaaacaaagtacggagcgaaattgacaagaagcctgatgcagaggatgggaaggatgccaagacgagggaaacaaaagaagaccgagcagtctcattccgcactgcaattgcaaagtctgtctaccagtggactgtaaagcaacaacaaagcatgatgaaggcgaatgacatgtttcttcctggccggatggcatttatttacaatatggaggatggacttaacagtgatattccaacgactcttcacaggagcaaagctgattgccctgtcccagaggaaatggtcactgtcagcgtggatggctctgtacttgacaggattgccaaaatcatgtcataccttagacttggatcatcagggaaggtattgaagaagaagaaaaaagagagggatacaaaagggaagaataatttggcaggcggtgtgtacaatgaggtagtaagacctgcccaaagcgatggttctgttcagaaacaccagtcagaaaaggatatgccaccacctccaccaccacccccacgaaagagtaacttcagtgaaaaggagaaacactctgtccctgttgctagaacagatgacgatgacatattcattggagatggagttgactatactgttcctaacaaggaaatgagccagagccccatctccgaagatatggatgaatccccacgtatccatcagaatcagtccaatttgaatgaacctgtgtatggtcctattcaaccatctgaacctgctcaagcttggcaacagccaatggatggttatgatgctattcaagcccaaatggcagctgctggataccaaggcgagtggtcaggctatcagtatgctgaacagcagctgccttatccagaacagtacatgcaacagggtactctgggatacgatgtattagtggacccaaatatatctcaggatccaaggttgatgactcaagcggacaaggataagggtctaggttctgttttcaagcgtgatgatgacaggcttaagcagctgagggaaaaagatgcgcgggagaaagacccgaattttatttcagatagttactccgagtgttatcctggttatcagggttataatcaagagattgcagggagtgacgatgaagatgatttgtcaaagatggatatgggtggacgggcgaagggccgtcttcaccggtgggactttgagacggaagaagagtgggcgaaatacaacgatcagaaggaagccatgccaaaggcggcattccagtttggggtgaagatgcaggatggcaggaagaccaggaagcagaacaaggatcagaagctcagcaacgacctcaacaagatcaacaagatcctggcgaggaagaagggcgataaagatggaggcgaagggcattacgacgacgatatacccagcgggaagaaacagcgagcttgacctcactggtcacacatttttttccgtccgtcttgttggaactgcgaaaggccatgcttttttgagctgaaacgattagatctgtagttcagtgctgttttatgtatgcacctgtagtttcatttttgatggaaattagtcctgcataacattcgttgtacaa

SEQ ID NO: 1697 - DNA, 502 bp, Saccharum officinarum
  misc_feature (310)..(310): n is a, c, g, or t
ctaaacatggccacacttaaactgcgatggcaccagtgtcggaggccgctagctacctcgagctcctccaaggcggcagcattgcctcctccttgggtgccgtttacaacgcgccttgggacgggtaccgcagcgcgcggggaagggtgtcggagaccgacagcgacgacgatgacgacgactacgactgcgctcctgctgcctgatcgacaacccgccgcgttcgggtgaaattgatctgtgtttctgagataatgagatatgctgcgcgtacgtaggcggtaggcgcgaaccgccaaagaccatgtantagtactagctacgtacagattatagtacgtgccagtgcttctatcaggctaatacctgatctttgctgcatcgtccaaaagacctttagcctcggagattccggcgacccggactaaatatcttttagtttcggcgggaggaaccaaccggaactaaagggcccttcttacggtttttttttaagcctctt

SEQ ID NO: 1698 - DNA, 661 bp, Zea mays
ccacagtagcagcttcttcttcctagcaagagcttagcttgcttcccactgttacaacttcggcagcttgcatttcgttcgatcgcacacgcttaaactgcgatggcaccagtgtcgtcggaggcggctagctacctggtgctcatcaaaggcggcagcattgccgcctcttcgcgtgccgtttacccttgggatggctgcagcgcgcggggaaggatgacagagaccgacagcgacgacgacgacgacgactacgactgcgctcctgctgcctgatcgagaagccgccgcgttctggtgaaattgatctgcgtgtgttctctgagatgatgagatatgctgccccgtacgtaggcggtaggcgaaccggcgaagagcatgtagtatgtagtagtactacgtattgttaatcgcagaatagagtacgtacatacgtgccgctgcttaaagctaataatttggtcgtttaatttccactcctaggtaatgggtatacatgtatttcgggtagctgatttatgagccagtgtggttttcgtcccgggactaagctagagatcatgcaggctagctagattgattatgtaagcaataaacactgggatagatcttcctgtacttcgtatctgataacgcaataaactgaatctagttttttgta

SEQ ID NO: 1699 - DNA, 696 bp, Zea mays
accaagcgagagctttgcttcttcccgctgtcagcttgcaattcgctcgcacacttaaagtcttaaactaactaggatggcaccagcagtagtgtcggtggcggcggctagctactacctcgtccaaggcggcagcattacctcctcctcgggtgcggtttacgccgcgccttgcgatgggtgctgcagcgcacggggaaggatggcagagaccgacggcgacgatgacgacgacgactacgactgcgctcctgctgcctgatcgagaacccgccgcgttctggtgaacttgacctgtgttctgagttctgattgagatatgctgcgagagtacgtataggccaatatataggcaaaccggcgaagagcatgacgtagtagtgctacctacatacgtactattactccagaatagagtacgtgccgctgcttcaagctaataatttggttgttcaatttctactcctgcatgggtaagtagatatatatatatatatatatatatatatatatatatatgtatttcgggtagcttaattattatgagccagagtgtggttgtcgtccccggattgtcgtccccggagatcatgcaggctagattatgtaagcaataaacactgggttagatctatctgtacttcggatctgaactgatgattgcctgaacaatatatatgctttgtacttccctta

SEQ ID NO: 1700 - DNA, 722 bp, Panicum virgatum
cgggggctctccgtgcaaaatcccagacaccagcagacaccagcagctagccagcactcactagcacgccgccgcatccacagctcccatcagccacagtactagcagcttctcctacctcgagcaggcagcaagagcttgctgcgcggcgtgaactaatttgacactagcagcttgcaattcgcttgcaccgacacgcacaccgtacccaacgctgccatggcaccagtactgtcggcggaggcggccagctacctcgtgctaggcggcagcattgcgtcctcctggggcgccgtttacgccgcgccttgcagcgcgcgaggaaggatggcggagacggacagcgacgacgacgacgacgactatgactgcgctccggctgcctgatgaggagccaccgttctgatgaaactggtgtgtgacatgacatactgcgcgctgtggccaagaacttctaggcttgcattgtacgactactactgcccgaatagagcgccatcgccgctgcatgctaataataatccgatcggtttaggtgtttacggcttcttacatatgtattctcgtttagcttacgatcgaggcagttaaatgtggtttttgtcccaagactaagctagagttcatgcaggctagcttgtgcaataatcaataaaagatcgagttagattagatctgtacttctgatctgatgatgaaataaactgaaatttccctgatga

SEQ ID NO: 1701 - DNA, 977 bp, Panicum virgatum
cggggccagcgggcgccgcgcggccgccgagtgctgactgtgcccgcccggagcccgtgccgcgggggcgccgtgcacgcagcggcgcagccgttccacgctccccgccggcaaccccacgctcccggcctcgccgcgccgcgtgccaccacactgccctccgccggccgcgccgctataaatcccacgccacgcgcggccactccctctccgtgcaaaatcccagacaccagcagcaccacagctagccagcactcactagcacgccgccgcatccacagctcccatcagccacagtactagcagcttctcctacctcgagcaggcagcaagagcttgctgcgcggcgtgagctaatttgacactagcagcttgcaattcgcttgcaccgacacgcacaccgtacccaacgctgccatggcaccagtactgtcggcggaggcggccagctacctcgtgctaggcggcagcattgcgtcctcctggggcgccgtttacgccgcgccttgcagcgcgcgaggaaggatggcggagacggacagcgacgacgacgacgacgactatgactgcgctccggctgcctgatgaggagccaccgttctgatgaaactggtgtgtgacatgacatactgcgcgctgtggccaagaacttctaggcttgcattgtacgactactactgcccgaatagagcgccatcgccgctgcatgctaataataatccgatcggtttaggtgtttacggcttcttacatatgtattctcgtttagcttacgatcgaggcagttaaatgtggtttttgtcccaggactaagctagagttcatgcaggctagcttgtgcaataatcaataaaagatcgagttagattagatctgtacttctgatctgatgatgaaataaactgaaatttccctgatgaagtactgcttaacctgctgcacttttgtttgctgatcagtagacagtagtgatgatg

SEQ ID NO: 1702 - DNA, 662 bp, Setaria italica
atcacagacaccagcaacaccacagctaagcaagcactagcagacccaccgcatccacagctcccatcagccacagtagcagcttcttctacctcgagcaagcaagagcttgctgcgcgcggcatcaattaatttggtagtaacttgcagctcgcttgcacgcacacttaaaaactgccatggtaccagtgtcggcggaggcggtaagcttcctcgtccaaggcggcagcattgcgtcctcctcgggcgccgtttacgccgcgccttgcgatgggtggcgcagcacgcgaggaaggatgccggagacagacgacgacgacgatgacgactatgactgcgctcctgctgcctgataaagagacaccgtctgatgaaactggtgtatgttatgcgatctggtgcgcgtggtggctcactattactgatatcacaccggaattggagtgccgccgctgctgcttgctaataattcgatcggttttaggtagctaggcttcctatattatgatgtattctcgtgtagcttatgaggcagttaagtatggtttttgtcccaggactaagctagagttcatgcaggctagcctatgcaagcagtaaaagacatcgagttaggtctgtacttcggatctcatgatgcaataaactgaaactaatttttc

SEQ ID NO: 1703 - DNA, 668 bp, Setaria italica
aaatcacagacactacccagtactcacatcactgctaagatagcactagcacaacacatccacagtagaagcttcttcttctaccccgaggcttgaggaagcaagagcttgctgctcggcgtcaattaatttggtagtagcttgtaattcgcgcgcgcacacactttaaactgccatggcaccagtgtcagcggaggccgccagctacctcgtccaaggcggcagcattgcgtcctcctcgggcgccctttgcgatgggtgtctgagcgcgcgacgaaggatggcggagacagacagtgacgacgatgacgacgactatgactgcgctcctgctgcctgaggagccaccttctgatgaaactggtgtgtgttatgcgatctgctgcgggtggtggctcacttgtcactatatatacataggcgaagtggcgaagagcctgtagctttactacttactggtattactccggagtagatttccgccgccgccactgcatggtaataattcgatcggttttaggtaggcttcatatatcatgctgtattctcgtgtagcttatgaggcagttcagtacgtggtgtttttgtccgaggactaagctagagttcatgcaggctaacctatgtaaggaataaaacgagttaggtctgtactgatctgatggtgc

SEQ ID NO: 1704 - DNA, 3034 bp, Panicum virgatum
ctgggactaattttgctttgctttccaggtgcaggtacacatgatgctactgctgcagaggcccccaggtcttggtcttttccttggccggaatcgccgccatttcggactcaccaaagctccggcttgcttttccacttggacgccacaatgcctcctccaacattataaattgcctaatcgcatgcgcggctgaactggactggacgatgctctggccaagattcagatgcccatccacgagccattcttccctcatcgccatgcgccggctcctgctcctggtgctcgccgccgcgcccgccgccgccgctggtggcgagatggggtacacgcattgcgcctgcgacggagagggcggcggcggcggcttctggagcctggacaacatcttcaagtggcagaaagtcagcgacctgctcatcgccgcggcttacttctccatccccctcgagctcctctacttcgtcgccggcctccgccacctgctcccgttccgctgggtgctggtccagttcggcgccttcatcgtgctgtgcggcctcacccaccttctggcggccttcacctacgagccccaccccttcatggtcgtgctgctcctcaccgccgccaagttcctcacagcgctcgtgtccttcctcaccgccatcacgctgctcacgctcatcccgcagctgctgcgcgtcaaggtccgcgagagcctgctctggatcaaggcccgcgagctcgaccgcgaggttgtgctgatgaagcggcaggaggaggcgagttggcacgtccgcatgctcacccaggagattcgccgctcccttgaccgccacactgtgctctataccacgctcattgagctctccagggtgctcgcactcaacaactgcgccgtgtggatgccctcagaggacaagtccggaatgtgcctcacccacgagctccgccggggcagcgacggcgaagccgtcgtcagcgccgacgacaaggacgtcctcgaggtcaagagcagtgacggcgtcaagctgctgccgccggagtcggtccttgggtcggccagcggcggcggcaaggaggggaccggcacggtggctgcaattcggatgccaatgctcaaggtcgcggacttcaagggtggaacgccggaggtgatccagacgagctatgctgtgctagttttggtgccgcccagtgacaggaactgggcaccacacgagctggagatcgtcgaggtggtcgctgatcaggtggccgtcgcgctctctcatgcctcactgcttgaggagtcacaagcaatgcgtgacaggctggccgagcagaaccgtgagctgctgcaggcaaggcgggatgccctcatggccaatgaggccagggacgcgttccagcgtgtcatgagccagggaatgaggaggcccatccactccatcctagggctggtatctgtggtgcaggaggagggcctgacacctgagcagaagctcgtcatcgacactatggcgcggacagcaaccgttgtctcgacgctcatcaaggatgtcatggagatgtctgctgtcaaccaggagcgcttcccattggagacacggccattccacctgcagtccatgatcagggatgccgcttgtgtggcgcggtgtctttgtgacttcagggggtttggtttcgcggtgcacattgagaatgcgctgccagaccttgtcattggtgatgagcggcggattttccatgtcttgttgcacatggttggcaatctgattggccggatcgatgcggggaatgtcacgttccgggtgcgtgctgatgatgagacgatggaggatcagaggtgggatccatggaggccaagctactctggtgggcactcgtcagttaaatttgtgattggggtgaagcagcagcagagtgctgactcatcaagctcgcttgcacagttcttgcggaagccaagcgctgaggggtttgatctcaggctcagcttcagcatgtgtaggaagctcgtgcagatgatgcaaggaaacatctgggccattcttgatggccaaggactcccggagagcatgaccctagtcctgagattccagctgcaaccatcgctgtcgggctccagccttggaggatcatttgatctgcagtacccatcgccatcaaaccaaatcgcgggcctgaaggttctgctgatcgatgatgatgaaatcaacctagtcgtggctcgaaagctcctggagaagataggctgcactgtgtcctcactcccctcgggttcagggttcatgaactccgtggggcccacctctacctcattccagcttgtcgtggtcaacctggagatggcacgagtgaatcccttggatgttgcctccaggatcaggcaatacaggagcgcgcactggcccttggtcatggcgatgacatcagagcaaaacgtgtgggagaagtgcgctcagtcagggatcaacggcgtcctgaagaagccgcttgttctgcaggaagtaaaagatgagctgacacgaatccttcagaacacatgatgtttgctggtgttttttggctgctcgccaggagttttgtactctggagctgagaaatttagctttgccgtgaccgtgaccctgaccctgacagcaccaccatcgaccagcatagcacaaggaagaattggacagatgtttgctgagacactgaagccgataaggcattggctattgagggtttctggtgtattgcacacttggtggagaatgtatggcagtggcaatgtgccatgggtgagtctagtctttgagacgggaagtaccgagacctgaagagatagtttgtgatacagttcttgatagaaacttaggtgatatgtaatgatggcccctccaggcaataataagagtgaagttttgtaacatgggtagcctggttgtcaggatgtgatggagagaaggggtgaaacgatgcagaattgtatttaggccctatttagttctttacatgtaaacgcaaaaaagccgtaaacgcattaaagtgaaaaggaattttgctaatttgaagtact

SEQ ID NO: 1705 - DNA, 3062 bp, Panicum virgatum
acgggctcagatcgacctcggttcgggatcctaaagctctttagtgggaggctcgctcccggtcaggggtcagccggtcagggcctcggggctgagggcctctgcctcatctctgtttccttcccccttccccttctttccgactctctcctcccttgctcttccttccctggcggcgacgactgggcttcatcacgtcttcgcccagccctttgccggcgacgagcgcatcctccagcgcggctgaactggaccggacgatgctctggccaagattcagatgtccatccagaagccattcctcccccatcgccatgcgccggctcctgctcctggtgctcgccgccgcgcccgccgccgctggtggcgaaatggggtacactcattgcgcctgcgacggagagggcggcggcggcggcttctggagcctagacaacatcttcaagtggcagaaggtcagcgacctgctcatcgctgcggcctacttctccatccccctcgagctcctctacttcgtcgccggcctccgccacctgctcccgttccgctgggtgctggtccagttcggtgccttcatcgtgctgtgcggcctcacccacctgctggcggcgttcacctacgagccccacccgttcatggtcgtgctgctcctcaccgccgccaagttcctcacggcactcgtgtccttcctcactgccatcacgctgctcactctcatcccacagctgctgcgcgtcaaggtccgtgaaagcctgctctggatcaaggcccgcgagctcgaccgcgaggtggtgctgatgaagcggcaggaggaggcgagctggcatgtccgcatgctaacccaggagattcgccgctccctcgaccgccacactgtgctctacaccacgctcattgagctctccagggtgctcgcactcaacaactgcgccgtctggatgccctccgaggacaagactggaatgtgcctcacccacgagctccgccaaggcagcgacggagaaggcgtcgtcagcgccgacgacaaggacatcctggaggtcaagagcagtgatggcgtcaagctgctgccgccggagtcggtccttgggtcggccagcggcggtggcaaggaggggaccggcacggtggctgcgattcggatgccaatgctcaaggtcgcggacttcaagggtggaacgccggaggtgatccagacgagctatgctgtgctagttttggtgccgcccagtgaccggaactgggcaccgcatgagctggagatcgtcgaggtggtcgctgatcaggtggccgtcgcgctctctcatgcctcactgcttgaggagtcccaagcaatgcgcgacaggctggccgagcagaaccgtgagctgctgcaggcaaggcgggacgccctcatggcgaacgaggccagggacgcgttccagcgtgtcatgagccagggaatgaggaggcccatccactccatcctaggactggtgtccgtagtgcaggaggagggcctaacacccgagcagaagctcgtcgttgacactatggcgcggacagctaccgttgtctcgacgctcatcaaggatgtcatggagatgtccgctgtcaaccaggagcgcttcccattggagacacggccattccatctgcactccatgatcagggatgccgcttgtgtgtcgaggtgtctctgtgactttagggggtttggtttcgcggtgcacattgagaatgcgctgccagaccttgtcattggcgacgagcggcggattttccatgtcttgctgcacatggttggcaatctgattggtcggatcgatgcggggactgtcacgttccgggtgcgtgctgatgatgagacgatggaggatcagaggtgggatccatggaggccaagctactctggtgggcattcgtcagttaagtttgtgattggggtgaagcagcagcagagtgctgactcatcaaagtcgcttgcacagttcttgcggaagccaagcactgaggggtttgatctcaggctcagcttcagcatgtgcaggaagcttgtgcagatgatgcaaggaaacatctgggccattcttgatggccaaggactcccggagagcatgaccctagtcctgagattccagctgcaaccatcgctgtcgggctccagccttggaggatcatttgatctgcagtacccatcgccatcaaaccaaatcgcgggtctgaaggttctgctgatcgatgatgatgaaatcaacctagtcgtggcacgaaagctcctggagaagctaggctgcactgtgtcctcacttccctcgggttcagggttcatgaactctgttgggcccacctctacctcgttccagctcgtcgtggtgaacctcgagatggcaagagtgaatcccttggatgttgcctcgaggatcaggcagtacaggagcgcgcactggcccttggtcatggcgatgacatcagagcaaaacgtgtgggagaagtgcgctcagtcagggatcaacggcgtcctgaagaggcctcttgttctgcaggaagtaaaagatgagctgacaagaatccttcagaacacatgatgtttgcaggtttctttgctgctggccaagagctctgaactctggagctgtgaaatgtagcattgccgtgaccctgacagcaccaccatcaaggaagaattggacagatgtttgctcagactgaaaccgagaaggcgttggctattgaggggttctggtgtattgcgcacttgctggagaatgtatggcaagggcaatgtgccatggtgatacagttctttgagatgggaagtactgggacctgaagaaatagtttctgatacagttcttgatagaaacttaggtgatatgtaatgatgaccgctccaggcaataatgagagtgaagttttgtaacttagctagcctggttgtcaggacgtgatggagagagttgtatttattaggaaatgaatctagaatcattgaaaatgcattggtggggagcaggaactctgcaagagtgatgtatttattagtatccctatgatgagcaggttacaggttattgatctca

SEQ ID NO: 1706 - DNA, 3082 bp, Setaria italica
gattaatccaccccaacctgctgtcctgtttgtaattctcttctaaggcaattgctttggaactctgcaggtacggatgatgctagtgctggagaggtccccaagtcttggtcttttcgtcggccggaatcgccgccatctcggactcaccaaagctccggctcgctttctccacttggacgccacaatgccgccgacattataaattgcctaatcatatggtacaatccgtctcaatttatacgaaagttgcagccttttttccatttctcctcggcaacttgccaatttggtcacccatttgcgtgtccttgcaatcgcgtcagcagcgcagctgaactggaccggacgatgctctggccaagattcagatgcccatccagacgccattttccccccatctccatgcgccgcctcctgctcctggtgctcgccgccgcgcccgccgccgccaccgccggcgaaatggggtacacgcattgcgcctgcgacggcggaggcggcggcggcggcggcggattctggagcctggacaacatcttcaagtggcagaaggtcagcgacctgctcatcgccgcggcctacttctccatccccctcgagctcctctacttcgtcgccggcctccgccacctgctcccgttccggtgggtgctggtccagttcggcgccttcatcgtgctctgcggcctcacccacctgctggcggccttcacctacgagccccacccgttcatggtcgtgctgctcctcactgccgccaagttcctcacggcgctcgtctccttcctcaccgccatcacgctgctcacgctcatcccgcagctgctgcgcgtcaaggtccgcgagagcctgctctggatcaaggcccacgagctcgaccgcgaggtggtgcttatgaagcgccaggaggaggcgagctggcacgttcgcatgctcacccaggagatccgccgctccctcgaccgccacaccgtgctctacaccacgcttatcgagctctcgagggtgctcgccctcaacaactgtgccgtctggatgccctccgaggacaagtccggaatgtgcctcacccacgagctccgccggggcagcgacggcgaagccatcgtcagcgccgacgacgcggacgtcctcaaggtcaagggaagcgatggcgtcaagttgctgccgccggagtcggtccttgggtcggccagcggcggcggcaaggaggggaccggcacggtggctgcgattcggatgccgatgctcaaggttgctgacttcaagggtggaacgccggaggtgatccagacgagctatgccgtgttagttttggtgccgcccagtgacaggaactgggcaccgcacgagctggagatcgtcgaggtggtcgccgatcaggtggccgtcgcgctctcgcacgcctcgctgctcgaggagtcgcaagcaatgcgcgacaggctggccgagcagaaccgcgagctgctgcaggcgaggcgggacaccctcatggcgaatgaggccagggacgcgttccagcgcgtcatgagccaggggatgaggaagcccatccactccatcctgggactggtgtccgtggtgcaggaggagggcctaacgtccgagcagaagctcgtcattgacactatggcgcggacagctaccgttgtctcgacgctcatcaacgatgtcatggagatgtccgctgtcaaccaggagcgcttcccgctggagacacggccattccacctgcactccatgatcagggatgccgcctgcgtggcgaggtgtctctgtgacttcagggggtttggtttcacggtgcacgtcgagaatacgctgccagaccttgtcattggcgacgagcgacggattttccatgtcttgctgcacatggttggcaatttgattggtcggatcaatgctgggaatgtcacgttccgggtgcgtgctgatgatgaggcgatggaggaccagaggtgggatccatggaggccaagctactccggtgggcactcgtcggttaagtttgtgattggggtgaagaggcaggagagtgctgactcatcaagctcgcttgcacagttcttgcggaagccaagcactgaggggtttgatctcaggctcagcttcagcatgtgcaggaagcttgtgcagatgatgcaaggaaacatctgggcaattcttgacggccaaggtctcccagagagcatgaccctggtcctgagattccagctgcaaccatcgctctcgggctccagcctcagaggatcatttgatcttcagtacccatcgccatcaagccaaatcgcaggcctgaaggttctgctcatcgatgatgacgacatcaacctagtcgtggctcgtaagcttctggagaagcttggctgcactgtgtcctcactcccctcaggttcagggttcatgaactccgtcgggcccacctctaccttgttccagctcgttgtggtcaacctggagataacagcagtaaatcccttggatgttgcctcgaggatcaggcagtacaggagcacgcagtggcctttggtcatgacgatgacatcagagcataacgtgtgggagaagtgcgcccagtcagggatcaacggcgtcctgaagaagccacttgttctgcaggaaataaaagatgagctgacacgaatccttcagaacacatgaggtttcttttgctgtgcgccaagagatctgatctgtgttgccgtgaccgacaatgccaccatccagcatagcaggggtaagaactcgacagatgtttgctcagaatggccacgatgacgccgagaaggcattggctgttgagggtttctggtgtatggtgtccttgctggagaatgtgtggaagagtaaatactagtgcaatggcaatgtgccatgatgagtcttcgagatgggggaagtattggcacctgaagaaagagtgtgtgatactgaaaagtgtccttcatagaaaattaggtgatactaatgacgatcagcacaggcaataataaggctgaatgttttgggggaaaacgaagcagaattgtaatttaggaagtgaagaatcatccgaaaatgaaacattggtgctggg

SEQ ID NO: 1707 - DNA, 3449 bp, Zea mays
cttgattcctcttgccggggttccttggcctgcctatccttgctaatcgggcgggccagtccgccgcctgcagatctgaacgctgccctcccctgctccccgagcgcggcgaggatcgccgctccacggacgcaagaacaagtgcccttgatcttttccccccatttgattgattcatccagtgctgctggtactggtacccagcaacagttttcggtaggaaactactatggcaacttctccaggtacatacagatggtgctagtgagggagaggtccgcgagccgtcgccgccatttcggaccaaccaaggcggcgctagtatgcttctgcttgctttccttctacctggacactactgcaatgccgtcaacgtcattgtaaaccgtcagtgctagccacatggtaacgctagactgcgaaagttgcgatctttttctcgcatctcctcggcaacttgccaatttggtcagcatcgtcatcaccaccaccatcagcggcgcagctgaactgacgatgctttgcccgagatccggatgctcatccagatcgagacgccattcatctccccccccccccccccccccccgccgtgcggatgcggtggctcctcctcttggcgttcgccgccgcccccgccgccggcgagatggggtacgcgcattgcggctgcgacggcagcggcggcgctggcggtggaagcgggttctggagcctggacaacatcttcaagtggcagaaggtgagcgacctgctcatcgcggcggcctacttctccatcccgcttgagatcctctacttcgtcgcggggctccgccacctgctcccgttccggtgggtgctggtccagttcggcgccttcatcgtgctgtgcggcctcacccacctgctggcggccttcacctacgagccccacccgttcatggtcgtgctgctcctcactgccgccaagttcctcacggcgctcgtctccttcctcaccgccatcacgctgctcacgctcatcccgcaactgctgcgcgtcaaggtccgcgagagcctgctgtggatcaaggcccgcgagctggaccgcgaggtggttctcatgaagcggcaggaggaggcgagctggcacgtccgcatgctcacccaggagatccgccgctcgctggaccgccacaccgtgctctacaccacgctcatcgagctctccagggtgctcgcgctcgacaactgcgccgtctggatgccatccgaggacaagtccggaatgtgcctcacacacgagctccggcggggcagcgacgacggcgaggccgtagtgggcgctgacgacgcggacgtcctcgaggtcaagggcgccgacggggtcaagctgctgccgccgggctcggtacttggctccgccagcggcggcggcaaggaggggaccggcacggtggcggcgatccgaatgccgatgctcagggtcgccgacttcaagggtgggacgccccaggtgatcaaggcaagctacgccgtgctggttctggtgccgcccagcggcaggaagtgggcgccgcacgagctggagatcgtggaggtggtcgccgaccaggtggccgtggcgctctcgcacgcctcgctgctggaggagtcgcaggcgatgcgtgacaggctggccgagcagaaccgcgagctgctgcaggcgaggcgggacgctctcatggcgaacgaggccagggacgcgttccagcgcgtcatgagccagggaatgcggaggcccatccactccgtccagggactggtgtccgtggtgcaggaggaggagggactggcgtccgagcagaggctcgtcgtcgacgctgtggcgcggaccgcaaccgtcgtctcgacgctcatcaacgacgtcatggagatgtccgcggccaccagccaggagcgcttcccgctggagacgcggccgttccgcctgcgctccatggtgagggacgccgcctgcgtggccaggtgtctctgtgacctgagcgggcggtttggtttcgcggtgcacgtggagaacgtgctgccggaccttgtcatcggcgatgagcggaggatcttccacgtcctgctgcacatggtaggcaatctgatcggtcgggtcgacgagggggacgtcacgttccgggtgcgcgccgatgatgaggcgacggaggaccagaggtgggatccgtggaggccgagctactccggtgggcactcgtcggtcaggtttgtggtcggggtgaagaggcagcagaacgcaggcgactcgcttccgcggttcttgcggcggccaaggacccatgacgggttggatctcaggctcagcttcagcatgtgcaggaagcttgtgcagacgatgcaagggaacatctgggcagttctcgacggccaaggactcccggagagcatgaccctggtcctgaggttccagctccaaccatcgctggcgagctccaacctcctcggagggtcgtttgatcaggagcactactcatcattgccatctaaccaaatagccgggctgaaggttctgctcatcgatgacgacgagatcaacctggtggtggcccggaagctcctggagaggctaggctgcaccgtttcctcaggctcgggactcatggactcttcctctgcctgtgcctcgttccagctcgtcatggttaacctcgagatgtcagcgatagatcccctggatgctgcctcgaggatcaggcagcagtacaggagctcgcactggcccctggtgatggccatgacgtcggagcagaacgtgtgggagaagtgcgcgcagtccgggatcaacggcgtcctgaagaagccgcttgttctgctggaagtgaaagaagagctcgagcggatccttcagaacacatgatgcctgccatgacccatgagctactaccatgatgaatacgacccccgtccgtccgtctagcatactacatagcagaggggaggggacatggatctcgagttgagaagtggatgcaagtctcctacgctgctgtagttgagtgactgctgtgaggacggaggtggtgacgacgacggatttggcaggcaagcacgagggccgcgttatccgatccatgcccatgccgcgtaaggaggcttcacctcgattcaccaactacataatcacctcgattcacacacgtcaggctttcagtcgataaattcattagtttcatcagaaacggaatgcagttgccagttataatgttggcgtcagtcgcaggggatcttcggccatcgtcgccgcatcagaagcaatgcgcagctccagtggcctcgaccgaacaggacaagaaataggtctagttggatttcttttcgcctttgggtttttgttttaaaagaaagagaacttgattttccttaaactagaattctctgtcttccattatagtgcacccttttttatactcagattcaaaaccaaaatataaaagaattaagta

SEQ ID NO: 1708 - DNA, 3029 bp, Brachypodium distachyon
gctctgctggatggtgcctccgagattcagatgcagcaggagaggccgccgcagttcccccaccgccgccatgagagtcctgctgctgctgctcctcgccgtggcgcccgccgccgtggccgccacgggcgacgacgtggggtacccgcattgcaactgcggcggcggcggcgggttctggagcatggagaacatcttcaagtggcagaaggtgagcgacctgctcatcgcggcggcctacttctccatcccgctcgagatcctctacttcgtcgccggcctccgccacctgctcccgttccggtgggtgctcgtccagttcggcgccttcatcgtgctctgcggcctcagccacctgctcacggccttcacctacgagccccacccgttcatggtcgtgctgctcctcaccaccgccaagttcctcaccgcgctcgtctccttcctcaccgccattactctgctcacgctcataccgcagctgctccgcgtcaaggtcagggagagcctgctctggatcaaggcccgcgagctcgaccgcgaggtggacctcatgaagcagcaggaggaggccagctggcatgtccggatgctcacccaggagatccgcaagtcgctcgaccgccacaccgtgctctacaccacgctcatcgagctctccagggtgctcgagctcaagaattgtgccgtgtggatgccggccgaggacaaggctgcgatgcacctcacccacgagctcaggcgtggcggcagcgacggcctcgttgtcggggtggatgatgccgacgtcgtcgaggtcaggaggagcgacggcgtgaagctgcttggccctgactcggtgctcgcgtcggcgagcggcggtggtagggaggacactggcccagtggcagcaatacggatgccgatgctcaaggtgtcggactttaagggtggcacgccggaggtgatccaggcgagctatgctgtgctggtgcttgtgcctcctagtgacaagaattggggagctcatgagctggagatcgttgaggtggttgctgaccaggtggctgtcgcgctctcgcacgcgtcattgcttgaggagtcgcaggcaatgcgagaccggctggccgaacagaaccgtgagctgctgcaggcgaggcgggacacactaatggccaacgaggccagggacgccttccagctcgttatgagccagggaatgcggaagccgatccactccatcctcggccttgtgtccgtggtgcaggaggacaacctgatgcccgagcagaagcttgttgtcaacacaatggcacggacagcaactgtcgtctcgacgctcatcaacgacgtgatggagatgtctgccaccaaccgggagcgcttccccctggagacgcggccgttccacctgcactccatgatcagggatgccgcttgcgttgctaggtgtctctgtgacttcagggggtttggctttgcggtgcacgtcgagaatacactgccggaccttgttattggtgatgagaggaggatcttccatgtcatcctccatatggttggcaatctcattagtcggatcaactccgggcatgtcacattccgggtccgtgctgatgacgaggtgatggagggcagccttggacagaggtgggacccatggaggccaagctactccagtggatactcatcggtgaagttcgtcatcggttggaagagcaccgaatcggtctcatccgcaggtcaattcttacggaaaccaaatggagagggctttgatctcaggcttagcttcagcatgtgcagaaagcttgtgcagatgatgcgggggaacatatgggcagttcttgacgggcaaggactcccagagagcatgaccctggtcctgagattccagctgcaaccatcgctcacatcatccagcaccggagggtcattcgagcggcaatatacatcgccgtcatgccaactaacaggactgaaagtcctgctcatcgacgatgatgacatcaacatggtcgttgctcggaagctcctggagaagctcggctgtgtggtttcctcgctcccctctgggtcagggttcctgaactccgttggcccctcatcaggcgcattccaggtggtcatggtgaaccttgagatgacaagggtaaatgccttggatgttgctgcgagggtcaggcagtacaggagtggccgctggccctttgtgatggccatgacgtccgagcaaaacgcgtgggagaagtgcgcgcagtccgggatcaatggcattatcaggaagccggttgttctgcgggaaatgaaggaagagctcacgcggattcttcagagcacatgatgtctgcagtttcaaatttgtttgccttcttgtcaagagctctgaaaatggtgaaaactgctattgctcaccagtcggcatcgatcaccgaagagagatcttcaggaaatattttgatcagagaggctacatgcacggcgagatagcttgttggtcagcgattgatgatctcgttgtgatgttcagcagtgttgctaggaacatccatatcagtagcaatggcattgtgcaatataccaccattagatgggaagtagacctgagaaaggatcctgatacttttgattcttgatagaaatctaggtgatatgtaatgatcataaccactagtgccaataagattttagcatctcgattgacctggatgtagtggtatctgaaagacagatttgtctgacagaagaagagagattcagaagtgtatttaggaagtgaagaagggcaagtggaggaagcataagtttccttctttttttttatcattggattgtaggtatgagatgtaacaaaaacatgctggatttagacatgttcaatgagaaaggattgaacaagtacctgttccttttcttttacaagtgccagcaattaggtatgatttgatgatgtttcctccctgcacatttttcagataatatgttctttcatatagagagaaaagatgattgctactgtaaaaaaagaagaaagaaaagatggttgcctg

SEQ ID NO: 1709 - DNA, 2783 bp, Zea mays
gcacgcgccggagctcatctcccagtcccagaccgcacctcctacctactcgaacccagccacccacccaactgcccgagcctgcgactgctcggcttccgcgcggcgcgcacagaaacggacgctacaggggggcagcagcgcaggcggcagtccggctgcagagcgagaaacccgcaagaggcgatcgctagccgcgagcgcgggcggccaccatggcggcgagcgcgagggggagcgtgtgggagatccagccgcgcgacgtggaggccgcggggctcgccgcagccgacgcggccgcgttccacgccgcgctccgctccgccgcgggctcggcagccgcctccggggacgccgtgtgggcggccgtggccgcggcgggggtgctgcggccggagcacccgcacgcgctccaccagctcgtctactactccgcctacgccgggtgggaccgcgccgcccggggcccgccgccgtactggttcccgtcaccaactgactgtaagcaaacgaacctggggagattgatggaagtaaatggaccaaagctgttaggatcatcatacagggatcctatatcaagttttaaccacttttacaggttttccgtagagaaccaagaggtctactggtcaatggtgctaaagcaactcgcagtcaagtttaaacaagaaccaatgtcaattctaagtacgtcagatagatcaaagaaaggggggacatggcttcaaggtgcagtgctcaacatcgctgagtgctgtctgttgccttgtccttccctgaagaggacagatgacagtacagctatcatttggagggatgaaggccttgatgattatccagtgaaccgaatgtcactgaaggagcttcgcagtcaagtgataactgtcgcacatgccttagatgccatatttgagaagggggacccgattgcaatagacacgcctatgacatgcaatgcagtcatcatatatttggcgatcatccttggtggttttgttgttgtatctatagcagatagttttgcacctcaggagattggtagtcgtatgggtgtctccaaagcaaaggcaatttttacccaggatttcattgttagaggagggaagaaagttccattgtacagccgtgtcatacaagggacttcatctaaagctgttgtgattcctgcaattggagattctcttggaattatgctaagggatggtgatatgtcctggaaagattttctttctcacgctgctggaaggtcatcttcatattctccagtttatcaatctgtggatgcactaactaatatactattttcttcaggaacaaccggggagccaaaagcaataccgtggacacaactttctcccataagatgtgcatccgatacctgggcacatttggatgttcgtccgtgtgacataggttgctggcctactaatctgggctgggttatgggaccaataatcatctactcatgctttctgactggggcaactttggctttataccatggatctccacttggacgcgatttctgcaaatttgtacaggatgctggtgtgactgtattaggaagtgtgcctagcttggtgaagtcatggaaagctgggaactgcgctgaagggcttgactggaccaaaatcagagtactaggcacaacgggggaggcttctgatattgatgacaacctgtggctaacttcgcgtgcctcatacaagcccattgttgagtgctgtggaggcacagagttggcatcctcatacattcaagggagtcttctgcgaccgcaggcctttggagcttttagtggcgcatcaatgtccactgggtttgtcatacttgatgaacagggaactccgtatcctgatgatataccttgctctggagaagtgggtctcttccctttgtattttggtgctactgatcggcttctcaacgctgatcatgacaaggtttacttcgatggaatgcccatttataaaggaaggcaactcagacgacatggagatataatccagaggacagtaggcgggtactatattgtacagggaagggcggatgacaccatgaacctcggtggaattaagaccagttcagtagagatagaacgggtgtgcaacagagctgacgagtgtctgctagaaacagcagcagttagcatcaaaccttccggtgggggaccagaacatctagccatcttggcggtgctaaaagatagatcggcccagtacgacgtgaatcttctcaagaggaagttccagactgccattcagaagaacctcaatcctctcttcaaggtgagctatgtcaaagtcgtcgctgagttcccgagaacggcttcgaacaagctgctgagaagggttctgagggatcagctcgcgcaggaactctcaaatcgcagcaagctatgacctttgagactgttctgcctttgtttcagcatcaaagctatcgattttcttgttccatttcaataaagcactgcttcaatgaaggaagcataccaagatgatcctacaaattccccccgcccctgtaaaacttcaaatctggttgtccttttgaaaagggaaccgtagtccagagaacgtttgtaaaggtcagtacattttatctgatcgttacagtgctgatgaacaaactgggcgcatgcatagttgtgtcacatagtatgtaccaatcggtggtaattgcatcgaatcatttgctgcgatttttttttatcttgcgagacaagtgggagtcagtgcttcgttgtatcgtactgtttgaacgtctatcacctagtt

SEQ ID NO: 1710 - DNA, 2513 bp, Setaria italica
ggcgaggcgcggccatcatatggcagcgagcgcgagggggagcgtgtgggagatccagcccggcgacgtgggggccgcggggctcggggccgccgacgggggcgcgttcctcgcggcgctccgctccgctgcggccgcggccggcccgggagccgccggggacgccgtgtgggcggcggtggcggcggcgggggtgctgctgccggagcacccgcacgcgctccaccagctcgtctactactccgtctacgccgggtgggaccgcgccgcccggggcccgccgccgtactggttcccgtcaccgattgacagtaagcaaacgaacctggggagattgatggaagcaaatggaccgaagctgttaaaatcatcatacaaggaccctatatcaagttttagccacttttacaggttttcagtagaaaaccaagaggtctactggtcaatggtgctaaagcagctcgcactcaagtttcaacaagaaccaaaggcaattctaagtacgtcagatagatcaaagaaagggggaacttggcttcaaggagcggtgctcaacattgccgaatgctgtctgctaccttgcccttccttgaagaggacagatgacagtactgctattgtttggagggatgaaggtcttgatgatcatccagtgaaccgtatgtcactgaaggagcttcgtagtcaagtgatagctgttgcaaatgcactagataccatgttccagaaaggggatcggattgcaatagacatgcctatgacatgcaatgcagtcatcatatatttggcaatcgtccttggtggctttgttgttgtgtcaatagcagatagttttgcgccacaggagattggtactcgcatgggtgtttcaaaagcaaaggcaatttttactcaggatttcattattaggggaggcaagaaagttccactttacagccgcgtcgtgcaaggaacttcatctaaagctgttgtgattcctgcaaatggagactaccttggagttacactgaggaatggtgatatgtcctggaaagactttctttctcgtgctgctggaaggtcatctatctattctccagcttatcagtctgtagatgcgataactaatatactattttcttcaggaacaactggggagccaaaagctataccatgggcacaactttctcccataagatgtgcagctgatacatgggcccatatggatgttcgtccagaggacattggttgctggcctactaatctgggctgggttatgggacctataatcctgtactcatgctttcttaatggtgcgactttggctttatatcatggatctccacttggacgtgatttttgcaaatttgtacaggatgctggtgtgactgtattaggaactgtgcctagcttggtgaagtcatggaaagctgcgaactgtgctaaagggcttgactggaccaaaatcagggtactaggcacgacgggggaggcatctgatattgatgataatctgtggctaacttcccgcacatcatacaagcctattgttgaatgctgtgggggcacggagctggcatcctcatacattcaaggtagtcttttgcaaccgcaagtcttcggcgcttttagtggtgcgtcaatgtccactggatttgtcatacttgatgaacaggggactccatatcctgatgatgtaccttgtgctggagaagtgggtctcttccctttgtattttggtgctacaaattggcttctcaatgctgaccacaacaaggtttactttgatggcatgcccatttacaaaggaaggcaactccgacggcatggagatataatccagaggacagtaggtgggtactatattgtacagggcagagcagatgacaccatgaaccttggaggaattaagacaagttcagtagagatagaaagggtatgcaacagagccgatgagggactgctagaaacagctgcagttagtgtcaagcctgctggtggtggaccggaacatctggctatcttagcagtgctgaaagatagatcggcccaatacgatgtaaacgttctcaagagcaagttccagagagccattcagaagaacctcaatcctcttttcaaggtgagctatgtcaaagttgttcccgagttcccaagaactgcttccaacaagcttctgagaagagtcctgagagatcaactgaagcaggaactctcaaatcacagcaagctctgacctttgagtggtgacaccattctgcgtaccttcagcgaaaaaattgccttttcacatgtcaaaatatcagtatcatattcacccattccatttcaataaagcggcttgaataaagaggcattcgttcactggattgtgcagaagagcgatggtttactattgttgtttctccttttttgggcacaacttcagccctagaaggtcatctcaaagatggctagtccagactccagagaacatttgccaacagcaatgcatctgatcaggtcatctcaaagactgaaaccaaagaatccaa

SEQ ID NO: 1711 - DNA, 3139 bp, Panicum virgatum
cggggactcccactcccacctcgtggctgcgccgctacccgctagctcgccagtcacctcagcgcagcgcccgagctgcgagctctacctcgaccaactaccaactaccaactaccaagcgcgcacgggcacaccacacctcctacctaactgatcgaacagaaaatcagaaccccacctgccgccagctcatcagcttgccgcgggtccgcggatcgctcgcagagacgctagcgctgcttgcccacagagacaccgcgcgagcaagccggccggtcgagagagcgcaagggagagtgggagaccggaagaagacgcgagcttgggcggcggcggccatcacatccgtatcctatggcggcgaccgcgagggggagcgtgtgggagatccagcccggcgacgtgggcgccgcggggctcggcgcggccgacgcgggcgcgttcctcgccgctctccgctccgccgcggccacggcgggcccgggagccgccggggacgccgtgtgggcggcggtcgcggccgcgggggtgctgcggccggagcacccgcacgcgctgcaccagctcgtctactactccgtctacgccgggtgggaccgcgccacacggggcccgccgccgtactggttcccgtcaccgattgacagtagacaaacgaaccttgggaggttgatggaagcaaacgggcccaagctgttagggccagcatacaaggacccgataacaagtttcaatctcttttacaagttctccgtagagaaccaagaggtctactggtcaatggtgctaaagcagctcgcagtcaagttccaaaaagaaccaaaatcgattctaagtacatcagatacatcaaagaaaggggggacatggcttcaaggtgcagtgctcaacattgctgagtgttgtctgctcccttgcccttccctgaacaggacagatgacagtacagctattgtttggagggatgaaggccatgatgattatccagtgaaccgtatgtcactgaaagaacttcgcagtcaagtgataactgctgcaaatgccttggataccatgttccacaaaggggatccgatcgcaatagacatgcctatgacatgcaatgcagtcatcatatatttggctatcatccttggtggctttgttgttgtgtcaatagcagatagttttgcaccactggagatcggtactcgcatgggtgtttcaaaagcaaaagcaatttttactcaggatttcattattagaggagggaagaaagttccactttacagccgtgtcgtgcaagggtcttcatctaaagctgttgtgattcctgcaaccggagactatcttggagttacactgaggaatggtgatatgtcctggaaagattttctttgtcgtgcttctggaaggtcacctatctattctccggtttatcagtctgtagatgcgctaactaatatattattttcttcaggaacaactggggagccaaaggctataccatggtcacaactttctcccataagatgtgcagctgacacgtgggcccatatggatgttcgtccacaggacatattttgttggcctactaatctgggctgggttatgggacctatagccctgtacgcatgccttcttaatggtgcaactttggctttatatcatggatctccacttggacgtgatttctgcaaatttgtacaggatgcaggtgtgactttattaggaagtgtgcctagcttggtgaagtcatggaaagctgggaactgtgttaaagggcttgactggaccaaaatcagggtactaggcaccacaggggagtcttctgatattgatgataatctgtggctaacttcacacacctcatacaagcccattgtcgaatgctgtgggggcacggagttggcatcctcatacattcaaggtagtcttttgcaaccgcaagcctttggtgcttttagtggtgcatcaatgtccactgggtttgtcatacttgatgaacagggtactccatatcctgacgatgtaccttgtgctggagaagtgggtctcttccctctgcattttggcgctacaaattggcttctcaatgcggaccatgacaaggtttactttggtggcatgcccatttacaatggaaggcaactccgacgacatggagatataatccagcggacagtaggtgggtactatattgtacagggcagagcagatgacaccatgaaccttggaggaattaagacaagttcagtggagatagaaagggtatgcaatagagccgatgaaagacttctagaaacagctgcagttagcatcaaacctgctggtgggggaccagaacatctggcaatcttagcagtgctgaaagatagatcggcccaatacgatgtaaatcttctcaagagcaagttccagaaagccatccagaagaacctcaatcctcttttcaaggtgagccatgtcaaagttgttcctgagttcccaagaactgcttcaaacaagcttctgagaagggtcctgcgggaccaactgaagcaggaactctcaaatcacagcaagctctgacctttgagtggtttgactgtcctaccttcggtgaagaataccttttcacatgtcccaatattattatcaaattcactcgttccatttcaataaagcagaatgaataaataggcatcattcactgagctgtgccgaaggctataggatgctcattgtcatttggtactttggaattatgctcagcgcatatcaaaggcttgatagtatagtagatttgtttctccttttttttttggcacaactttagcccttgtacggctactgcttcttttcaaaagggattgtgagaggaaatctagtttagagaagatttgcagagtaatcgtgtcggatcatatcatctcaaatacagaaaccagaagaatccaaatgtgattctgttggcaaaatggcaattgcaacgatcatggtggcgttgtgccgtcatcgatcccgttgatcttgggatctgtcggcggcgcaggcgccgcctctgcagacgaagcagtagtgtggttggcgcccggaggcgggcaccgggcaggcggcccgtggcatcgacggcgaccatacgatgcggcgacccgcgtgcccgcctcgccgccccccc

SEQ ID NO: 1712 - DNA, 2867 bp, Oryza sativa
atcgaagagcatcgccattgtcacgatggcgacccaatcacaaacatggcagaattgcagagagtctagtaaggcagaagctgaggctgagcttaccaaacacaagcacacgcacacgcacaccacacagtctacctatacctactactacctgtcatcttctccttcttaatcccaactaaatgcgcacataaacgaagaagatttgcactgatacccgcgctgatacaagcaagcatccggcgatggcggcggcggcggcggcaagggggagcgtgtgggagatccagcagcgggacgtggaggccgcggggctggccgacgccgacgcgggcgccttcgtcgcggcgcttcgctccgccgccgccgttgcgacgggtgggcctgacgccgcgtgggaggccgtggcggcgggggtgctgcggccggagcacccgcacgcgctccaccagctcgtctactactccgtctacgccggctgggatcgcgccgcccggggcccgccgccgtactggttcccgtcacagattgacactaaacaaacaaatcttggtagactgatggaagcacatggtcctaggttgttaggatcatcatataaggacccagtttcaagttttcacctcttccacaagttctccgtagagcatcaagaggtctactggtcaatggtgctgaaggagatctcaatcaagttccaacaagaaccaaagtcaattctagatacatcagataaatcaaggaaagggggaacatggctccaaggtgctgtgcttaatattgctgaatgttgtctgttaccttggccttcccaaaacaggacagatgacagcacagctattgtttggagggatgagggtcttgacaatcacccagtgaaccgtatgtcactgaaggagcttcacaatcaagtgattacagttgctactgcgcttgataccatgttccaaaagggggatcgaattgcaatagacatgcctatgacatgcaatgcagtcatcatatatttggctattgtccttggtggttttgttgttgtgtcgatagcagacagttttgcacctcaggagattggtacacgcatgagtgtgtcaaaggcgaaagctatttttactcaggatttcataattagaggagggaagaaggttccactatacagccgtgttgtgcaagggacttcatctaaagctgttgtaattcctgcaactggaggctttcttggggtttcactaaggaatggtgatatgtcctggaaagatttcctttcttgtgctgctggaaggtcgtccatttatcccacagtttatcaaccttcagacgctctaactaatatactattttcttcagggacaactggagaaccaaaagctatcccatggtcacaactttctccaataagatgcacatgtgatacatgggcgcatttggatatccagccacaggacatattttgttggcctactaatcttggatgggttatggggcctatactcttgtactcatgctttttaagtggtgcaacgttggctttgtatcatgggtcaccacttggtcgtggtttttgcaagtttgtacaggatgctggtgtcactatattaggaagtgtacctagcttagtgaagtcatggaaagctgggaattttactgaagggcttcactggaccaaaatcagggtactctccacgacaggagaggcttctgatattgatgatgatctatggctatcttcgcgtgcctcttacaagcccattattgaatgttgtgggggtactgagctggcatcgtcatacattcaaggcagtcttctgcgttcgcaagcttttggagcttttagtggtgcatccatgtccactgggtttgtcatacttgatgaacaaggaactccatatcctgatgatgtaccttgtgctggagaagtgggcctcttccctttatattttggcgctacagatcgacttctcaatgctgacaacaataaggtttattttgatggaatgcccatttacaatggaaggcaacttcgacggcatggagatataatccaaaggacagtaggtggttactatattgtgcagggaagagcagatgacactatgaatcttggaggaattaagacaagttccgtggaaatagagcggatatgtaatagagccgatgaggctctactagaaacagcagcggttagcatcaaacctgctggtgggggaccagaacagctggctatcttggctgtgctaaaagatagatcaccaccatgtgatgcaaatgttctcaagagcaaatttcagagagccatccaaaagaacttaaatcctcttttcaaggtgagctatgtcaaaatagttcctgagttcccaagaacagcttcaaacaagctgctaagaagagtactgagggatcagctgagcaaagaactctcgaatcgcagcaagctatgaccgacgtgacatattcaacaaggaccacaacaacaacaacaatagtagactttagtccaaagcaaggtagagatgaagagccatacgaacagtgagggtaattcaaaatcgcttcaaaaatgccctcttgcttgtcaaatggtaatattgaattatgagtgtgtcaaaaaaaaaacagccacttgaataaagagtcatgattcattgggggcgtatagagaacttcaggaaactatttttttccatgttaataaatgttgttgaattgtgagcatgttcaataggcaacggcttgaaaaagtgacatttcccgatgggaatttgtagagaacttcagaatactcatcgctgtactgtattatgttcagctcatgataaagtggtggcatggtgtttggattattttggcacaattcatcccctttgaag

SEQ ID NO: 1713 - DNA, 3419 bp, Brachypodium distachyon
ggccgccacgtccaacgccctcggccgctgccctccgttgcaaggccgccgcgtccaacttcatcggccgcctgctccatggggaagaagaagatgagaggaaaaaaaaaagaaaaagaaatggcaatagacacactgacgtatgagacccactagtcagtgtaattgcaaaactaaataggaccaaagtttaattgcaaaactaaatagggaccgaagtttaggtagcaccactgaagctcaagtttaaatagggcctgaaaattttaggaggaagccctgtacagtatttagggtccttgtttttagggcctatgctctaaagctttatttgacggatagagtataaaatgggaacgtatttcaggcttttaattcgattgattataacttgagaggataaacggatgagacaaaggtcattggtctagtgatcctgagttcctgaccactccgccggtggccaatttcctcccggcgctaatgtgacgctgcttccacaaaacgacactacgctgccgtcggcttcgtgggtgcgtgaagtcttgttcaaatcgggaagaagcggccgacgtcgacggcgacggcgagggatccctgggctaccaaactggagtagcacctaccagctaccactaaccagacgcccccgcaccacacctcataccaacaaaacttcacctacccaacccgagctttcgctcaatcccttcctttcctcctcgtgacgagctcgtgatcaaactagatcagccaaattcccaaatgcgcggataaaatactgtcacaagtgcgaaggctcctgagaaaacaagtacggagtagtatactagtgccaatccacggtgcaagcggcgaggcggaggctgagcactcgagcaggcggccgggcgggggcaatacatggcggcgaccgcgagggggagcgcgcgggagatccgggcggccgacgtggaggtggccgggctcgccgcggccgaggcgggcgccttcctcgcggctctccgctccgccgccgcgtcgtcgccgtcttcggacgcggccgaggtgtgggcggcggtggtggcggcgggtgttctgcggccggagcacccgcacgcgctccaccagctcgtctactactccgtctacgccggctgggaccgcgccgcccggggcccgcctccctactggttcccgtccccgattgactgtaagcgaacaaatctcgggagaatgatggaacagaatgggcctaagctgttaggatcatcgtacaaggatccgatttcgagctttgatctctttcacaaattctcagtagagaatcaggaggtgtactggagaatggtgctaaaggagctctcagtcaagttcctgcgcgaaccaaagtcgattctagatgcatcagataaatcaaagaaaggaggaacatggttccaaggcgctgtgcttaacattgctgaatgttgtctgctaccttggccttcccaaaataggacagatgacagcacagctattgtttggagggatgagggccttgatgattatccggtgaatcgtatgtcgctgaaggagcttcgcactcaagtgatgactgttgcacatgcccttgataccatgtttcaaaagggggaccggattgctatagacatgcctatgacatgcaatgctgtcattatttatttggcaatcatccttgggggctttgttgttgtgtcaatagcagacagtttcgcacctcaggagattggtacacgcatgagagtctcaaacgcaaaggcaatttttactcaggatttcataattagaggagggaagcaatttccactttacagccgtgtcatggaaggaacttcatctaaagctattgtaattcctgcaactggagactgtcttggagttacaccaaggactggcgatatgtcctggaaagattttctttctcgtgctgctggaaggtcatccatctactctccagtttatcaaccatcagatgccctaattaatatactgttctcttcaggaacaactggagagccaaaagctataccatggacgcaactttgtcccataagatgcggagctgatacctgggcacatttggatgttcgtccacaggacataggttgctggcctacaaatctgggttgggttatgggacctatactcttgttctcctgctttctaagtggtgcaactttggctttgtatcatggttctccacttggacatggtttctgcaagtttgtgcaggatgcccgtgttaatatgttaggaactgtacctagcttggtaaaggcatggaaggctgggaatcttactaaagggatagactggactaaaatcagggtacttgccacaacaggggaggcttctgatattgatgataatctatggctatcttcacgtgcctgttacaagcccattgttgagtgctgtggaggcacggagttggcatcctcatatattcaagggagtcttttgcagccacaagcttttggagcttttagtgggaaatccatgtccactgggtttgtcatacttgatgaacaaggacatccatatcctgatgatcaaccttgtgctggagaagtgggcctcttccctttatattttggtgctactgatcggcttctcaatggcgaccacgataaggtttactttgatggaatgcccatttacaaaggaaggcaactccgacggcacggagatataatccagaggacagtaggtggttattatattgtacagggcagagcagatgacactatgaatcttggaggaattaagacaagttcggtggagatcgaacgggtttgtaatagagccgacgagggtctgctagaaaccgcagcagttagcatcaaacctaccggtggggggcctgaacagctggctatcttggcagtactgaaagatagatcagcatcatgcgatgctcatcttctaaagagcaagttccagcgagccatccagaagaacctcaatccccttttcaaggtgagctacgtcaaagtcgttcccgagttcccgagaactgcttcaaacaagctgttgagaagggttctgagggatcagctgaagttggaactcgtgaatcgcagtaagctatgaaagggcctgagtattactgaacactggatgtgttccgtaagcaacatcctgaatccttttatattgtgttcattggaggtgtgtacagaacttcacagtgtattgtatagtgctcatgtcattcgaactaacaaggcgatctcataataaaatgggaaaattggatattttttcgtgtgaattttttccacttttatatccattgttacttttgaaggggagctatgacactgaaagagaaagtaggcagaaagcattagcaaatagcaatatagggaacttgcttcattttataacctacgtacaaaattctaagtcaaaat

SEQ ID NO: 1714 - DNA, 2584 bp, Secale cereale
gaccagcaagtccaaatgaaatgcctgcgccgataacataggcatagcagtgtcaccagcactctcgcgcgaagctgcgaccgcgaggcaggcggagagcgagcgagcagccggcaggcgggccatggcggccaccgcgaggggcggcatgggggagatccgggcggccgacgtggaggcggccgggctcgccgcggccgacgcgggggccttcctcgccgcgctccgctcggcgaccggcaaatacggcggcgacgcggccgccgcgtgggcggcggtcgtggcggcgggggtgctgcggccggaccacccgcacgcgctccaccagctcgtctactactccgtctacgccggctgggaccgcgccaagcgaggcccgccgccctactggttcccctccccgattgactgcaagcagacaaatcttgggagagtgatggaagagaatggacccaagctgttaggagcatcatataaggatccaatttcaagctttggccccttccacaaattctctgttcataatcaggaggcgtactggaaaatagtgctgaaggagctctccatcaagtttgtacgagaaccaatgtcgattctagatgcgtcagataaatcaaagaagggaggatcatggttcccaggtgcagtgctcaacattgccgaatgttgtctgctaccttggccttcccagaacaagacagatgatagcacagctattgtctggagggatgagggctttgacgattacccagtgaaccgtatgtcgttgaaggagcttcgcacccaagtgatgactgttgcaaatgcccttgataccatgttccaaaagggcgaccggattgcaatagacatgccaatgacgtgcaatgcggtcattgtttatttggcaatcatccttggaggctttgttgttgtgggaatagcagacagttttgcacctcaggagattgccactcgcatgagggtcgcaaaagcaaaggcaatttttacccaggatttcataattaggggagggaagaaatttccactttacagccgtgtcatggaagggacttcatctaaagctattgtaattcctgcaactggagactgtcttggagttgcactaagaaagggtgacatgtcctggaaagattttctttctcgtgctgctggaaggtcatccatatactctccagtttatcaatctgcagacgccctaattaatatactgttttcatcaggaacaacaggagagccaaaagctataccatggacacagctttgtcccataagatgtggagctgatacctgggcacatttggatgttcgcccaaaggacattggcctgtggcctacaaatctgggttgggttatgggacctatacaattattctcatgctttctaaatggtgcgacattggctttatatcatggttctccacttggacgtgctttctgcaaatttgtgcaggatgcccgtgtgagtgtattaggatctgtgcctagcttggtgaaatcatggaaggctggtaatcttactgaagggctagactggactaaaatcagggtacttgctacaacaggagaggcttctgatattgatgataatctgtggctatcttcgcgtacctgttacaaacccattgttgagtgctgcgggggcaccgagctggcatcctcatacattcaagggagtcttctgcagccacaagcttttggagctttcagtggtgcatcaatgtccactgggtttgtcatactcgatgaacagggaaatccatatcctgatgatctaccttgttctggagaagtgggtctcttccctttatattttggtgctaccaatcgacttctcaatgctgaccacgataaggtttacttcgatggcatgcccatttacaggggacggcaactccgacgacacggagatataatccagaggacagtaggtggttactatatcgtgcagggcagagcagacgacactatgaatcttggagggatcaagacaagttcggtggagatcgaacgggtttgtaatggagccgatgaaggtctgctagaaacagcagctgttagcatcaaaccttcgggagggggaccggaacaactggctatcttggcagtgctaaaagatagatccacatcatatgatgcaaatattctgaagagcaagttccagagagccatccagaggaacctcaacccccttttcagggtgagctacgttaaagtcgtccccgagtttccaagaactgcttcgaacaagctgctgagaagggtcctgagggatcagctgaagcaagagctcatgaatcgcagcaagctataaggggcccgagggatctctgtctctcttttcaacaggaaaatggatcttcattatccaagtttattgaactcacggcgtgttacataagcaacggttcggttccctttcattcacttcattgggggtgtgtagattcataacacttgttattgtattgtatgtgttgagctcattggaagtaataaggcgatggcttgctaaaatcggatcactctgcatgtttgaaggtttataagccatcattattttcttatgttttctctttacatt

SEQ ID NO: 1715 - DNA, 2339 bp, Panicum virgatum
gaccgcgccgcccggggcccgccgccgtactggttcccgtcaccgactgacagtagacaaacgaaccttgggaggttcatggaagcaaacgggcccaagctgttagggccagcatacaaggacccgataacaagttttaatctcttttacaagttctccgtagagaaccaagaggtctactggtcaatggtgctaaagcagctcgcagtcaagttccaaaaagaaccaaaatcgattctaagtacatcagatagatcaaagaaaggggggacatggcttcaaggtgcagtgctcaacattgccgagtgttgtctgctcccttgcccttccctgaacaggacagatgacagtacagctattgtttggagggatgaaggccatgatgattacccagtgaaccgtatgtcactgaaagaacttcgcagtcaagtgataactgttgcaaatgccttggataccatgttccacaaaggggatccgatcgcaatagacatgcctatgacatgcaatgcagtcatcatatatttggcgatcatccttggtggctttgttgttgtgtcaatagcagatagttttgcaccacaggagattggtactcgcatgggtgtttcaaaagcaaaggcaatttttactcaggatttcattattagaggagggaagaaagttccactttacagccgtgtcgtgcaagggtcttcatctaaagctgttgtgattcctgcaaccggagactatcttggagttacactgaggaatggtgatatgtcctggaaagattttctttgtcgtgcttctggaaggtcatctatctattctccagtttatcagtctgttgatgcgctaactaatatactattttcttcaggaacaactggggatccaaaagctataccatggacacaactttctcccataagatgtgcagctgatacgtgggcccatattgatgttcgtccacaggacatattttgttggcctactaatctgggctgggttatgggacctatagtcctgtactcatgctttcttaatggtgcaactttggctttatatcatggatctccacttggtcgtgatttctgcaaatttgtacaggatgcaggtgtgactttattaggaagtgtgcctagcttggtgaagtcatggaaagctgggaactgtgttaaagggcttgactggaccaaaatcagggtactaggcaccacaggggaggcttctgatattgatgataatctgtggctaacttcacacacgtcatacaagcccattgttgaatgctgtgggggcacggagttggcatcctcatacattcaaggtagtcttttgcaaccgcaatccttcggtgcttttagtggtgcatcaatgtccactgggtttgtcatacttgatgaacagggaactccatatcctgacgatgtaccttgtgctggagaagtgggtctcttccctctgtattttggcgctacaaattggcttctcaatgctgaccatgacaaggtttactttgatggcatgcccatttacaatggaaggcaactccgacgacatggagatataatccagaggacagtaggtgggtactatattgtacagggcagagcagatgacaccatgaaccttggaggaattaagacaagttcagtggagatagaaagggtatgcaatagagccgatgaaagacttctagaaacagctgcagttagcatcaaacctgctggtgggggaccagaacatctggcaatcttagcagtgctgaaagatagatcggcccaatacgatgtaaatcttctcaagagcaagttccagaaagccatccagaagaacctcaatcctcttttcaaggtgagctatgtcaaagttgttcctgagttcccaagaactgcttcaaacaaacttctgagaagggtcctgcgggaccaactgaagcaggaactctcaaatcacagcaagctctgacctttgagtgggttgactgtcctaccttcggtgaagaataccttttcacatgccacaatattaatatcaaattcacccgttccatttcaataaagcagaatgaataaataggtatcgtacactgaattgtgcggaaggctttaggaattaggatgctcattgtcatttggtactttggaactaagctcagcgcatttcaaaggcttgatagtatagtagatctgctctctctctctctctgcacaacttccgccctttacggcaaccgcttcttttcaaaaggaaatcgtgagagcatctcgaagagtatcctatttctcttcctcatccttatttttttagaaaaaataaaaaaaacactctccaatagttttccattctaa

SEQ ID NO: 1716 - DNA, 1068 bp, Saccharum officinarum
aaacgcttgtggcgattggcaaactcgcggcgcgtggcagcgggagcgtacgaggtaaaggagagcgagggcgacgcgcggatcgcatcgcagctttcggcggaggccttgccgcggagatgctggcggtgttcgatccggcggtggcgccgagcccggaggggctgcggcagccgggcgccgccgggggcgacagcgcggcgggcctcgcggatcggttcagagaggcgcgccccgacgccgtcaccgtcaaccttggcgggtccggcgccatggcgtactcctccagcaaccagagcccccttctccccaggttgtttggagcggtggatgacatattctgcatgttccagggtacaattgtgaacgttgctgtcctcaagcagcaatatggattaagcaaaggcgctaatgaggtcaacatcatcattgaggcttacaggaccttgagggacaggggtccttatcctgcagatcaagttgtgagagacattagtggaaaatttgcatttgttctgtatgattgctcgactaagtcggtcttcatggctgctgattccgatggcaacgttccattctactggggcgctgataccgatggccgtcttgtggtctctgatgacgctgagctcgtgaagaaggcctgtggaaaatcctctgccccggtcccaaaggcttcttcttcagacgtccggagggtgaaaagcacgagcaccccatgaacgaggtgaagccggtgccgagggtggacagcaagggcgaggtgtgcggcacgacgtacacggtcgatgcaagcgccaagaaggagaccggcatcccaagggtcggcagcgctgccgattggtcttcacaatactgactttccttttaagctgttgggttggatcggagctcaggtagcaggcgtggctatgttcatatggaagccagtgctagtgtttgtctgaatagactgttctctataaatcgacacggattctataacttcacatgattttcgttgctgctgtgttgtaacacgaagtactgcctttgcctttgttctcgaataaatcaattttctagagt

SEQ ID NO: 1717 - DNA, 1472 bp, Zea mays
ttgataatataatttgtattggattttgtgtagtgtgcaacttttcaaaatctatggagaaccaaaaccacctatgcaagaagacataacttacatgtctacattggggccatttccgaaatgggcctcgacagagaatagaatagcctaatcaattcagttggttatttcttatctagaagcaaaagagaaattgctaatgctatttttacccgttttgtctttatcctttccgcgtccgacgagtgcgcggcggccggtgatgactggtcgcgacaggtgtgccgcgggccccgcggtgccgtgccgtgtggatcagtcccgatccttctcccgccttcggccttccccgcgcgcgcgcgcacgcaccagcaccaccgcgatataaagcccgccaccaatccgctcgtggtcgtcgtcatcatcccgattcccgacacgcttgtgttgtcgcgattggcaagctcggcggctcgtggcagcgggaacttacgaggcgaaggagagcgagggcgaccgcgcggatcgcatcgcagctctgggcggaggtggggccttgcgcggagatgctagcggtgttcgatcgggcggtggcgccgagcccggaggggctgcggcagccgggcgccgcggggggcggctgcgcggcgggcctcgcggaccggttcagagaggcgcggcccgacgcggtcaccgtcaaccttggcgggtccggcgccctggcgtactcctcgagcaaccagaaccccctcctccccaggttgtttggcgcggtggacggcgtattctgcatgttccagggaacaattgcgaacgttgctgtgctgaagcagcagtatgggttgagcaaaggcgctaatgaggtcagcatcatcatcgaggcttacaggaccttgagggacaggggcccttatcctgcagatcaggttgtgagggacataagtgggaaatttgcatttgtcctgtatgattgctccactaagtcggtcttcatggctgctgacaccgatggaaatgttccgttctactggggcgtggacaccgacgggcgtcttgtggtctctgacgacgccgaactcgtgaagagtgcctgtgggaaatcctgtgccccgttccccaaaggcttcttcttcacgacgtccggagggctgaggagctacgagcaccccatgcacgaggtgaagccggtgccgagggtggacagcaagggcgaggtgtgcggcacgacgtacacggtcgacgcaagcgccaggaaggagaccaccatcccaagggtcggcagcgccgccgactggtcttcgcagtactaaaattcgttatctttctctgtgtgtgttgaacgggttcgagcgcaggtagcagggcgtcgcacgggcgtggcccgtgtttgttcgcatggaaaccctagctgtctggtgtttatctgaatgaatagactgttctctatgaatcaacacggatttctctctaag

SEQ ID NO: 1718 - DNA, 1558 bp, Panicum virgatum
ccggccccgacaggtgtgccgcgggtcccgcggcgccatgtggatccgtcccgatccttctgccgccttccccgcccgggcggggcgccggccaccgacggccacgtaccaccgcaatataagcccggcatcgatccgctccccggcaccccgaaatcctcctcccggcggcggttggcaagctcgcgggcgcgtggcagcggaagcgtacgacgaggtgaggagagccagaagccagagcggcgcgcggatcgtgatcacagcttggtgggggcggagatgctggcggtgttcgaccgggcggtggcgccgagcccggaggggctgcggcagccgggcgccgccggggacggcagcgcggcggggctcgcggaccggttcagggaggcgcgccccgaagctgtcaccgtcaacctcagcgggtccggcgccatggcgtactcctcccacggccagagcccccttcttccccggctgtttggcgcagtggatgacatattctgcatgttccaaggcacaattgagaacgttgctgtcctcaagcagcaatacggattaagtaaaggcgctaatgaggtcaacatcatcattgaggcttacaggacgttgagggacaggggtccttatccagctgatcaagttgtgagagacattagtggaaaatttgcatttgttctgtatgattgctccaccaagtcggtcttcatggctgccgatgctgatggcaacgttccattctactggggcgtggactctgatggccgtctcgtggtttctgacgacggtgaaatcgtgaagaaggcctgcggaaaatcctcatccctattccccaaaggcttcttcttcacgacgtccggagggctgaagagctatgagcaccccatgaacgaggtgaagccggtgccgagggtggacagcaagggcgaggtgtgcggcacgacgtacacggtggacgccaaggccaagaaggacgccagcatccccagggtcggcagcgccgcagattggtcctcgcaatactagaaatttactaactggttatctatcttgtgtgtggagcagctcaggtagcaagcaggtgtggagtttgtctgtcctagcccgatgttcctatggaaaccgtcagtcttgttctagcgtttgtctgaataaactgttcgttctctgtcgctgtttataaatcatcccgaggtctctacactgcagagatcagagatgagctgtatgaacttgaaccaagacgagtagctgatccgttgcaaatgtttctggacaatcaatcatcttgcaactgaactccagatgcagagacacggtgagacctgaaacccaatgagattggtgggcactctccacattccgcgctgctgagttggatcatgctcgcgaatgctgaagcactgaagaggacagcagggcaggggacaaagggagtgatgagcaagcacgacacgggcgtcagccactgtgcgcaacagtggcggccgggcgcgcgcaaccgttcgctgtgcgcgcacattcctcttgattgtcaccaataattcgcgcgtatgggccg

SEQ ID NO: 1719 - DNA, 1330 bp, Setaria italica
tccccgtttgtccttatcctctccgcgcccgacgagtgcgcggcggccggtgactggcaacgacaggtgtgccgcgggtcccgcggcgccgtgtggatcagtcccgatccttctcccgccttccccgcgcgcgggcgccggccaccgacggccacgtaccaccggaatataagcccgccatccatcgatcctctcctcgtcatcccggaatcctcctggcgatagattgggcaagctcgcagcggaagcgtacgaggtgtggagagagcgagagcgacgcgcggatcgcagctcggtagaggcgacgggatgctggcggtgttcgaccgggaggtggcgccgagccccgaggggctgcggcagccgggcgccgcgggggacggcagcgcggcggggctcgcgggccggttcagggaggcgcgccccgacgcggtcaccgtcaacctcggcgggtccggcgccatggcgtactcctcccacggccagagcccgctcctccccaggttgtttggtgcagtggatggcatgttctgcatgttccagggcacaattgagaacgttgctgtcctcaagcagcaatatggattaagtaaaggcgctaatgaggtcaacatcgtcattgaggcttacaggacgttgagggacaggggtccttatccggctgatcaagtcgtgagagacataagcggaaaatttgcatttgttctgtatgattgctccaccaagtcggtcttcatggctgccgatgccgatggaaacgtcccattctactggggagtcgactccgatggccgtcttgtggtgtctgacgacgatgaaatggtgaagaaggcctgcggaaaatcctctgccccgttccctaaaggcttcttcttcaccacgtccggtgggctgcagagctacgagcacccgatgaacgaggtgaagccggtgccgagggtggacagcaagggcgaggtgtgcggcacgacgtacacggtggatgccaaggccaagaaggacaccagcatccccagggtcggcagcgctgcagactggtctgcgcaatactgatttggttatctgtgtgttgagcagctcaggtagcatcatatccccggggtgtttgtcgtagtagaccgatgttcatatggaagccatcagtcttgttctagtgtttacctgaataaactgttcgttctctgccgctgtttataattcaagacagaggtttctaatgtttaaatgagcatgactagctgttgctttggtgtaagaacttgaatgaagatgggttgctgtctactactgatcactaataaaggggtgtttggttccttgagcttgacct

SEQ ID NO: 1720 - DNA, 1035 bp, Panicum virgatum
gcaagctcgcgggcgcgtggcagcggaagcgtacgacgaggtgaggagagccagaagccagagcggcgcgcggatcgtgatcacagcttggtgggggcggagatgctggcggtgttcgaccgggcggtggcgccgagcccggaggggctgcggcagccgggcgccgccggggacggcagcgcggcggggctcgcggaccggttcagggaggcgcgccccgaagctgtcaccgtcaacctcagcgggtccggcgccatggcgtactcctcccacggccagagcccccttcttccccggctgtttggcgcagtggatgacatattctgcatgttccaaggcacaattgagaacgttgctgtcctcaagcagcaatacggattaagtaaaggcgctaatgaggtcaacatcatcattgaggcttacaggacgttgagggacaggggtccttatccagctgatcaagttgtgagagacattagtggaaaatttgcatttgttctgtatgattgctccaccaagtcggtcttcatggctgccgatgctgatggcaacgttccattctactggggcgtggactctgatggccgtctcgtggtttctgacgacggtgaaatcgtgaagaaggcctgcggaaaatcctcatccctattccccaaaggcttcttcttcacgacgtccggagggctgaagagctatgagcaccccatgaacgaggtgaagccggtgccgagggtggacagcaagggcgaggtgtgcggcacgacgtacacggtggacgccaaggccaagaaggacgccagcatccccagggtcggcagcgccgcagattggtcctcgcaatactagaaatttactaactggttatctatcttgtgtgtggagcagctcaggtagcaagcaggtgtggagtttgtctgtcctagcccgatgttcctatggaaaccgtcagtcttgttctagcgtttgtctgaataaactgttcgttctctgtcgctgtttataaatcatcccgaggtctctacactgcagagatca

SEQ ID NO: 1721 - DNA, 1275 bp, Cenchrus ciliaris
cgccgcgcgggcgccggccaccgacggccacgtaccaacgcaatataagcgcgccatcgatagatccgctcctcgtcaccctgaaatcttcctcgcggttgggtaagcttgcagcggaagcgtacgaggtgaggagatagggagagaggcagagagcgacgcgcggatcgcagctcggtcggcggcggaaatgctggcggtgttcgatcaggcggtggcgccgagccccgaggggctgcggcagccgggcgccgcgggggaaggcagcgcggcggggctcgcggaccggttcagggaggcgcgtcccgacgcggtcaccgtcaacctcggcggttccggcgccatggcgtactcatcacacggccagagccctctcctccccaggttgtttggtgcagtggatgacatattctgcttattccagggcacaattgagaacgttgctgttctaaagcagcaatacggattaagtaaaggtgctaatgaggtcaacatcataactgaggcttacaggacgttgagggacaggggtccttatccagcagatcaagttgtgagagacataaacggaaaatttgcatttgttctgtatgacagctccaccaagtcggtcttcatggctgctgatgccgatggcaacgtcccgttctactggggagtagactccgatggtcgtcttgtggtgtctgacgacgatgaaatggtgaagaaggcctgcggaaaatcctctgccccgttccctaaaggcttcttcttcaccacgtccggtgggctgcagagctacgagcacccgatgaacgaggtgaagccggtgccgagggtgaacagcaagggcgaggtgtgcggcacgacgtacacggtggatgccgaggccaagaaggacaccagcattccccgggtcggcagcgctgcggactggtcttcgcaatactgatttgcttatcatctgtgtgttgagcagctgaggtagaatcatactcccccagggtgtttgtcgtggtagaccgatgttaatatggaagccatcatcagtcttgtcctagtgtttacctgaatgaataaactgttggttctgtaccactgtctataaaccaacacgaaggtttctactgtgtaaacaggaccatgactttagcagtttagctactattgctttgctgtaagaactagaatgaagatcccttcggctcctctcaagtcaccagttttgggcatgttttcttgtctgcagatgcccaaagattgcactgagaatacaggccgtgttaacttgca

SEQ ID NO: 1722 - DNA, 1199 bp, Panicum virgatum
ggccccgacaggtgcgccacgggtcccgcggcgccgtgtggatcagtcccgatccttctcccgccttccccgcgcgggcggggcgccggccaccgacggccacgtaccaccgcaatataagcccgccatcgatccgctccccgccatcccgaaatcctcccggcggttggcaagctcgcgggcgcgtggcagcggaagcgtacgaggtgaggaaagccagagccggagcgacgcgcggatcgtgatcacagcttggtggggggcggagatgctggcggtgttcgaccaggcggtggcgccgagcccggaggggctgcggcagccgggcgccgccgaggacggcagcgcggcggggctcgcggaccggttcagggaggcgcgccccgaagctgtcaccgtcaacctcggcgggttcggcgccatggcgtactcctcccacggccagagcccccttcttcccaggttgtttggcgcagtggatgacatattctgcatgttccaaggcacaattgagaacgttgctgtcctcaagcagcaatacggattaagtaaaggcgctaatgaggtcaacatcatcattgaggcatacaggacgttgagggacaggggtccttatccagctgatcaagttatgagagacataagtgggaaatttgcatttgttctgtatgattgctccaccaagtcggtcttcatagctgccgatgccgatggcaacgttccattctactggggagtggactctgatggccgtctcgtggtctctgacgacggtgaaatcgtgaagaaggcctgcggaaaatcctcagccccattccctaaaggcttcttcttcacgacgtccggagggctgaagagctacgagcaccccatgaacgaggtgaagccggtgccgagggtggacagcaagggcgaggtgtgcggcacgacgtacacggtggacgccaaggccaagaaggacgccagcatccccagggtcggcagcgccgcagattggtcctcgcaatactagaaatttactactaattggttagctatcttgtgtgtggagcagctcaggtagcaggtgtggagtttgtctgtcctagcccgatgttcatatggaaaccgtcagtcttgctctagtgtttgtctgaataaactgttcgttctgtcactgtttacaaagcatcccgaggtctctactcagcagatgagca

SEQ ID NO: 1723 - DNA, 1365 bp, Panicum virgatum
gtttgtctttatcctctccgcgcccgacgagtgcgcggcggccggtgaccggccccgacaggtgcgccgcgggtcccgcggcgccgtgtggatcagtcccgatccttctcccgccttccccgcgcgggcggggcgccggccaccgacggccacgtaccaccgcaatacaagcccgccatcgatccgctccccgccatcccgaaatcctcccggcggttggcaagctcgcgggcgcgtggcagcggaagcgtacgaggtgaggaaagccagagccggagcgacgcgcggatcgtgatcacagcttggtggggggcggagatgctggcggtgttcgacccgcggtggcgccgagcccggaggggctgcggcagccgggcgccgccgaggacggcagcgcggcggggctcgcggaccggttcagggaggcgcgccccgaagctgtcaccgtcaacctcggcgggttcggcgccatggcgtactcctcccacggccagagcccccttcttcccaggttgtttggcgcagtggatgacatattctgcatgttccaaggcacaattgagaacgttgctgtcctcaagcagcaatacggattaagtaaaggcgctaatgaggtcaacatcatcattgaggcatacaggacgttgagggacaggggtccttatccagctgatcaagttatgagagacataagtgggaaatttgcatttgttctgtatgattgctccaccaagtcggtcttcatagctgccgatgccgatggcaacgttccattctactggggagtggactctgatggccgtctcgtggtctctgacgacggtgaaatcgtgaagaaggcctgcggaaaatcctcagccccattccctaaaggcttcttcttcacgacgtccggagggctgaagagctacgagcaccccatgaacgaggtgaagccggtgccgagggtggacagcaagggcgaggtgtgcggcacgacgtacacggtggacgccaaggccaagaaggacgccagcatccccagggtcggcagcgccgcagattggtcctcgcaatactagaaatttactactaattggttagctatcttgtgtgtggagcagctcaggtagcaggtgtggagtttgtctgtcctagcccgatgttcatatggaaaccgtcagtcttgctctagtgtttgtctgaataaactgttcgttctgtcactgtttacaaagcatcccgaggtctctactcagcagatgagcatgactctctctagcttagggtgtgttttgttggtgaaaaagtttgggtttggctactgtagcacatttcgctgttatttgataattaatgtccaatcatgaattaattagcatcatt

SEQ ID NO: 1724 - DNA, 1088 bp, Pennisetum glaucum
cggaaatgctggcggtgttcgatcaggcggtggcgccgagccccgaggggctgcggcagccgggcgccgcgggggaagtcagcgcggcgaagctggcggaccggttcatggaagcgcgtcccgacgcggtcaccgtcaacctcggcagttccggcgccatggcgtactcctcaaacggccagagccctctcctccccaggttgtttggtgcagtggatgacatattctgcttattccagggcacaattgagaacgttgctgtcctcaagcagcaatacgggttaagtaaaggtgctaatgaggtcaacatcgtaattgaggcttacaggacgttgagggacaggggtccttatccagcagatcaagtcgtgagagacataaatggaaaatttgcatttgttctgtatgattgctccaccaagtcggtcttcatggctgccgatgccgatggaaacatcccgttctactggggagtagactccgatggccgtcttgtggtgtctgacgacgatgaaacggtgaagaaggcctgcggaaaatcctctgccccgttccctaaaggcttcttcttcaccacgtccggtgggctgcggagctacgagcacccgatgaacgaggtgaagccggtgccgagggtgaacagcaagggcgaggtgtgcggcaccacgtacacggtggatgccaaggccaagaaggacgccggcagcatcccccgggtcggcagcgctgcagactggtcttcgcaatactgatttggttagtatttgtctgtctgttttttagcagctcagctcaggtagcatcatcatatatactccccctgcctgcagggtgtttgtcgtagtagcccgatgttcatatggaagccatcgtcagccttgtcctagcgttttacctgaataaaactgttggttctgtcccgctgtttataaaccaacacgaggtttctctactgtataaaggactatatgactttagcagtttagctggttgatttgctgcaagaacttgaacgaagataactaatctatcagttgccagtaacgatctggttcactccctgagatgctgaacccatcggttcctca

SEQ ID NO: 1725 - DNA, 1702 bp, Oryza sativa
tgtatagaggatctcaatcccttgctggttgcaatagcacgagaaatatatataaaattaaggcaaaacggtgggagggcggaggtggttgaggtgaagcgaggcctcgccgcatctaccggagcggcgtagccggcgatcggagatgacgatcccgagaagaaggtcttcaccgtcagtcagtcacctcgttcctcgtcgtgtgcctatccattttcgcgccctacggctacgagtgcggtggtcgtcacagcccacagccacaggcgctttgtagcgacgtgtggatccgtctcgatccttcgcgtcgccaccgtccttaccgccacacgccttccgtatatagctctcccgcggacgaacacctgtcgtgcactgcgcgcggggggtggcggacgatcggatcgggagaggacgcgacgcgaggcgggctgcgttgtgagggagagaagggatgctggcggtgttcgatcgggcggtggcgccgagccctgaggggctccggcatcccggggcggcgggggacggcgcggcggggctcgccgagaggttccgcgacgcgcgccccggcgccgtcaccgtcgccctcggccccggcggcgccaactccctcgcctactcctcccacggccagagccccctcctccccaggttgttcgcggcgacggacgagatattctgcctgttccaaggcacgatcgagaacatcgcggtgctgaagcagcagtacgggttgcacaacaagggctccaccgagatcaacatcatcatcgaggcttacaggacattgagagacaggggaccttaccctgcggatcaagtcgtcagagacatcaacggcaagttcgcgttcgtgctctacgattgctccaacaactccgtcttcatggccaccgatgctgatggtagcgttccattttattggggagttgatcctgacagccgtcttgtggtttctgatgatgacgaaattgtgaataaggcttgtggaaaatcctctgcaccattccctaaaggtttcttcttcaccacatccggaggactgcagagctacgaacaccctatgaatgaggtgaaaccagtgccgaggctcgacagcaagggggaggtatgcggcacaacgtacacggtcgacgcgaaggcgaagaaggatagcagcattcctagagttggcagcgctgcggattggtcctcgcaatactaaaaccgtataaatcgtcagaagcatatggtatgatgacctagaaacctttgctgcaattacatggagagcactaggcttccgggttgtccacggttacaagtgggcatttgccatctgaaatgttcatctggatggtcagccttgtgctgtgctgctgtctgaaatttctgtcctgtccaccattactgaagaatgagagcgtgtgggtcttgaatttccaataaaacgcaatgccttacagatgtgtaaatagatgtttttgcttactacaatattttctgaacaatcagcatatctataactgtggctagaatgaatcatctctaacgatgtgtgttctgttacttctgtatgtgaagtgatcttcccttctgcttgaatgatgctccgtgccataaatcagaccatggcattttcgttatggggtacctgtcatgatgtcgataacctgaacagtaattctccagtcttactaatacagtttatcattgtgattgc

SEQ ID NO: 1726 - DNA, 895 bp, Zea mays
gccaccaatccggctccggctacggccgcgggtcccggatcccttcagtccatcaccacaccaggcaccagcgatgatttaaaaaggaaagcacaggcgctcaccagaatcgataaaccacagagccaccccactaactactttcaccattgtttccagaaaaatctccgcgcataatatttctctagagcaaacgctctgtcatcacacaacactagttcgtccgcacgacactcccgcagttcctcgacaggggagaggtttccattccaggcggttgcggttgcggttggcggcggagatgagccgggggagcaagctccggtggctgtggcgcgcgccggcgcgggcgctggggcgggcgcgggacctgtacgtgcgggggctgacggggtgcgcgcgccacgtcccctccgacgccgcgttcgggtaccccgtgttcgtgccggcgccgctgtccaggagccacagcgccgtcggctggggcgccgggtcgtccgaggccgacgaggacctgcgcgagctggtccgcgccgcgtcgcagcgccgcgtggagcagcgccgcgccgagctgcaggccgtggcccggagccagagcatggccgcctcgctctccatggcgcgcatcgacgaggacgcgccgtgcgacttcggggcgcccggggcgctgtgcccgaggagccagagctgtgtcggcgacgccgcggggaggaggcccccaccgccgcggccacgggaaggtggcggccttgctctgacggagtcggagctgctgtccggccgccgccgtcggtggcacagtgtgtgcgaatagcgatcgtgtcacgccatgtcttctgtgcaaagtttgatcatgtcaatactcgaaatgatggatgtttttgctgtccgccga

SEQ ID NO: 1727 - DNA, 2465 bp, Zea mays
agtgggggtggatgcagagcagttggatcggggacacacacagagagagagagggctttgctttccgttttcctctccaaatggctcatttagctcttgaccggaagagtggagggtggtggtgcgggtagagatagagatagatggcactcgtcggtgtggacagtgctgggttccttggagcttagcgtgacttcatcagaagacgccgtttgcctgcctggctgcttggtcttgggtcgacgaccggagccccctccctcgtgctcgccttcttcctccctgtccctgtccctgctaccgagtttccgggcgctgaccactgggcaactacagctgatctctctctgccgcggcatggaggtggaggctctggagaagaaggggcacgcagcttttgccaaggcgatgaaatctttcggctcttccgagcggtacaagcgatccacgagtggcagatattttgaggatatgtatgctacagacgctttgcgttcttcagacaagacgattgttctacctatgccggaagtggtaaaagctaaggtcaaatgtgatatcactaaggaagctcaacccgggaggggagcacaaagcaccttgagaaaggagattcttcagctcgagaagcacctcaaggatcaacaggctgtgcgtggtgcgctggaaaaggctttagggcctaacgctggccctgtcagcttgtcgccagagaatccaatgccacaggcagctaatgaattgatacgggagattgctacattggagctggaggtcaagaacatggagcagtatctcctgacgctgtaccggaaagcatttgagcagcagcaagcgcctgcgttttccccccctgaccgccgggaagcttcgaagccgtcagtgagctcgcgttctgggcagctccgggaaacgcccatggcaacgaagtcttcttgcaagagtagaggggacgcagcactgcggtccagttacccgccagcgcataagaaactgaacgatccattggcggattgctgcacatctgctcgatttgatagagtggttgattcagacgtcctccgctgccagtctgcgttgtcataccgtggagtttgttcgtccaggatattgccttcggaggacgatagtcttgcaagggctcttcgctcgtgccactcgcagcctttctcattcgtagaggaaggagacaccggtgcatcagggatgataagcttagcagagtatctaggaactaatgtagctgaccacatccctgaaactccaaacaacctgtcagaggagatggtgagatgcatggcggggatatactgcagactcgcagatcctcccttggttcaccacggctcgtcctcttcaccgtcgtcgtcgttctcctcgactagcgcaatctctccgcagtatgtgggggacatgtggagtcccaaatacaggagagaggcgactctggactcccgtctgataaacccgttccatgtcgatggtctgaaggagttcagtggaccttacaacacaatggttgaggttcctatgattagccgggacagtcggaggctgaaagaagccgaggacctgctccagacttacaagttgattttgtatcggttggaagccgttgatctgaggagaatgacagatgaagaaaagatcgcattctgggtcaacatacacaatgctttgctgatgcatgcttatctgaagaatggcgtcccacagaacaatctaaagaaaacatccctacttgttaaggctgcctgcaaaatagccggacgcaacatcaacgccgccgtcatccagagcattgttcttgggtgcaacacacactgccccggacagtggctacggacgctgctttaccccaggatcaaaagcaaggtgagcaaagcggggcatgagtggcgggcctttgccgttgcgcaaccggagcctcttttacgctttgcgctttgttccggcagccattctgatcccgcggtgagggtgtacactccgaagcggctgttccaccagctggagtcggccaaggaggagttcatccgggcgacggccggcgtgtggaaggagcagaagctgctgctccccaagctggtggaggcgtacgccaaggacgtgaagctctcgccgcagggcctcgtggacatggtccagcgctacctcccggagagcatgaggatggccgtgcagcggtgccagcacggcggcaggtcgtcgggcaaggtcgtggagtgggtgtcctacaacccggccttccgctacctgctcgccagggacctcgcgttccctcacctcagctgaccgttcgttaatctttagtagtatatgcgtgtgtgccatagggttagaagtagagaagggatcatgtgcagtttttgtgtggtggttgtcaatggcttttgtagatgatgaacaggaaacaggggaagaaatgagagaaagcacgtttgacaatggactctgtttgtgac

SEQ ID NO: 1728 - DNA, 2667 bp, Panicum virgatum
gatgcagagcagttgtagagagagagaaagggaggactattctctccgtttccctctccaaatgtctgattagttcttgacctgaagagtgaagggtagttgtggtgatagatggatacggaacttggtgtggacagagctgggttccttggagcttagcgtgacttcagaacacgccatttcttcgttcttggatcatttggagtctcttgcttgattttggcggcttctctcctcagttctgagctctgagcagcgacaaatctctgtaagctatttcctcctcacatctcttcttcttcttctttccccattgtggctacaattctacagatgcgcatgctcttcaaggtcttgttgcatagagtggttcggtttgcatttttgcagtcagttcacagttgttggttggttctcgagctgcaccaagcaatggaggtggaggcaccggagacgaaggggcacagagcttttgccaagcctcttaagcctttcagttcttcagagcggcacaagcaatccaagagttattttgaggaaatatatggtgcagatgctttgcgctcttcagacaaaactattgttctgcctaagccgggagctgtaaaagctaaggtgaaaagtgacatcaataaggatgtgcgacctgggaggggagcacaaagcaccttgagaaaagagattctgcagctagaaaagcacctcaaggatcagcaggttgtgcgtggtgccctggaaaaagctttagggcctgacgctgctccagtcagcttgtcacctgagaatccaatgccaaaagccgctaatgaattgatacgggagattgccacattggagctagaggtcaagaacatggagcagtatctgctgatgctgtatcggaaagcgtttgagcagcaagcacctgcattttctcctcctgataaccgtgaagcttcaaagccatcattgagctcacgttccgggcagctctgggaaatgccaatggcgatgaagtctttcaagagtagagaggatacagcactccggtcaagctatccgctgccacataagaaatggaatgatccattgacaacctcagttcgtcctgatagagcagttgattcagatgtcctccgctgccagtctgccttatcataccgtggagtttgttcatccagaatacagccttcagacgatgatagtcttgcaagggctcttcgctcatgccactcgcaacctttttcattcctagaggaaggagagactggtgcgtcaggaatgataagcttagcagagtatctaggaactaatgtagctgaccacatccctgaaactcccaacaatctgtcagaggagatggtgagatgcatggcggggatatactgcagacttgcagaccctccgttggttcaccatggttcctcatcttcgccgacatcgtcgttctcctcaacaagtgcagtctctccacaatatgtgggcgacatgtggagtcccaactacaagagagaaactaccctagactcccgattgataaacccgttccatgtcgagggtttgaaggagttcagtggaccgtacaacacaatggttgaggttcctatgattagccacgacagtcggagactgaaagaagccgaggaccttctccagacgtataagttgatcctataccggttggaaactgttgatatgaggagaatgacaaatgaagaaaagatagcattctgggtcaacatacacaatgctttgctgatgcatgcttatctgaagaatggcgtcccacagaacaatctgaagaagacatccctacttgttaaggctgcctgcaaaatcgccggacgtaacatcaacatagccgttatccagagcatggttcttggatgtaatactcactgtcccggacagtggctacggaccttgctttaccccaggatcaaaagcaaagtgaccaaagccgggcacgagtggcgagcctttgccgttgcacaatcagagcctcttttacgctttgcgctttgttcggggagccattctgatcccgcggtgagggtgtacactccgaagcggctgttccaccagctggaggcggcgaaggaggagttcatccgggcgacggccggcgtgtggagggagcagaagctgctgctcccgaagctggtggaggcgtacgccaaggacgtgaagctgtcgccgcaggggctggtggacatggtgcagcgctacctcccggagagcatgaggatggccgtgcagaggtgccagcagggcggcaggtcgtcgagcaaggtcgtggagtgggtgccctacaacccggccttccgttacctgctcgccagggacctcgcgttcccccacctcagctgaccgtgtctgtctctgcaatagcagattagcagtagggcactgtgatgaactgaagaagtttggttggagtggagtatatgcgcgtgtaccatagggttagagttagacaagggtttgtgcagattgtgtcgtgtgagtagatgatcagatgatcactggcgagtggcgattgcttgtgggtttccgattgtccgctgtaaaaaaaaggggggcaataggttattttgtagatgaacaggagacagaggatgaaatgggaaagcaaaaaatgttagtagtatcccttaaaaaaatgttactagtatgctcacgttctgc

SEQ ID NO: 1729 - DNA, 2594 bp, Panicum virgatum
tgccttgcgctgtatatatacacgatacacacgcagaccgcagtgcgggtggatgcagagcagttgtagagagagaaagggtggactcttcttcccgtttccctctccaaatgtctgattagttctttacctgaagagtgaagggtagtggtggtggtagatggatacggaacttggtggtgtggacagagctgggttccttggagcttagcgtgacttcagaacacgccatttcttcgttctcggatcatttggagtctcctgcttgattttggcggcttctctcctcagttctgagctctgagcagcgacaagtcttttcagttcacagttcttggttggttctcgagccgcaccgagcaatggaggtggaggcgccggagatgaaggggcagagagcttttgccaagggtccctttgccaagcctatgaagtctttcagttcttcagagcggcacaagcgatccaagagttattttgaggaaatatatggtgcagatgttttgcgctcttcagacaaaaccattgttctgcctaagccggaagctgtaaaagctaaggtgaaaagtggtatcaataaggatgtgcgacctgggaggggagcacaaagcaccttgagaaaagagattctgcaactagaaaagcacctcaaggatcagcaggatgtgcgtggtgccctggaaaaagctttagggcctgacgctgctccagtcagcttgtcacctgagaatccaatgccaaaagccgctaatgaattgatacgggagattgccaccttggagctagaggtcaagaacatggagcagtatctgctgacgctgtatcggaaagcgtttgagcagcaagcacctgcattttctcctcctgataaccgggaagcttcaaagccatcattgagctcaaggtccgggcagctctgggaaatgccgatggcaataaagtctttcaagagtagagaggatacagcagtccggtccagctatccgctgccacacaagaaatggaatgatccattgacagattgctgtacatcggttcgtcctgatagagcagttgattcagatgtcctccgctgccagtctgccttatcataccgtggagtttgttcatccagaatactaccttcagacgatgatagtcttgcaagggctcttcgctcatgccactcgcaacctttttcattcctagaggaaggagagactggtgcgtcaggaatgataagcttagcagagtatctaggaactaatgtagctgaccacatccctgaaactcccaacaacctgtcagaggagatggtgagatgcatggccgggatatactgcagacttgcagaccctccgctggttcaccatggttcctcatcttcgccgacatcgtcgttctcctcaacaagtgcagtctctccacagtatgtgggcgatatgtggagtcccaactacaagagagaaactaccctagactcccgattgataaacccgttccatgttgagggtttgaaggagttcagtggaccgtacaacacaatggttgaggttcctatgattagccacgacagtcggagattgaaagaagctgaggacctgctccagacgtataagttgatcctataccggttggaaactgttgatctgaggagaatgacaaatgaagaaaagctagcattctgggtcaacatacacaatgctttgctgatgcatgcttatctgaagaatggcgtcccacagaacaatctgaagaagacatccctacttgttaaggctgactgcaaaatcgccggacgtaacatcaacgtagccgttatccagagcatggttcttggatgcaatactcactgccccggacagtggctacggaccttgctttacccaagaatcaaaagcaaagtgagcaaagccgggcacgagtggcgagcctttgccgttgcacaatcagagcctcttttacgctttgctctttgttcggggagccattctgatcccgcggtgagggtgtacactccgaagcggctgttccaccagctggaggcggcgaaggaggagttcatccgggcgacggccggcgtgtggagggagcagaagctgctgctcccgaagctggtggaggcgtacgccaaggacgtgaagctgtcgccgcaggggctcgtggacacggtgcagcgctacctgccggagagcatgaggatggccgtgcagaggtgccagctgggcggcaggtcgtcgagcaaggtcgtggagtgggtgccctacaaccaggccttccggtacctgctcgccagggacctcgcgttcccgcacctcagctgaccgtgtctgtctctgcaatagcagattagcagtagggcactgtgatgaactgaagaagtttggttggagtggagtatatgcgtgtaccatagggttagagttagacaagggttttgtgcagattttgtgtcgtgtgggtagagaggatcagatgatcactggcgagtggcgactgcttgtgggtttccgattgtccgctgtaaaaaaagctgggaaaaggttattttgtagatgaacaggagacagaggatgaaatgggaaagctaaaatgttagtagtatgttcacgttc

SEQ ID NO: 1730 - DNA, 2350 bp, Zea mays
gcatagagagcagttggattggatcaaagagaggagggctttgctttccgttttccttctccaaatggctcattagctcgtgcttcttccttccttgctaccgagttcggggcgctaaccaatgcgcagcgacaagctgatctctttcctgattgactcttattagtcttagctctgccacgggatggaggtggaggctctagagaaggggtacacagcttttgccaaggcggtgaagtcttttacttcttcagaacggtacaagcgatcagagagctattttgaggacatgtatggtacagatgctttgcgttcttcagacaagacaattgttctacctatgccagaagctgtaaaagctaaggtgaaaggtgatatcagcaaggaagctcaacctggaaggggagcacaaagcaccttgagaaaggagatccttgagcttgagaagcacttcagggaacaacaggttgtgagtggtgcactggaaaacgctttaggacctaacgccggttcagtcaacttttcaccagagaatccaatgccaaaggcagctaatgaactgatacgggagattgccacattggagctcgaggtgaagaacatggagcagtatctcctgacactctaccgcaaagcattcgagcagcaagcgccggcactctctccccctgattgccgggaagcttcgaagccgtcagtgagctcacgctttgggcagctccgagaaacacccgtggcggcgaagtcttgcaagagtggaggaggggatgcggcactccggaccagttacccgccgccggcgcataagaaactgaacgatccgttggcagactgctgcacatctgctcgctcccatagagcggttgattcagatgtcctccgctgccagtcagccctgtcgtaccgcggagtttgctcgtccagggtactgccttcagaagaggatgatgatagcctcgcgagggctcttcgctcgtgccactcacagccattctcattcgcagaggaaggagagggggccggtgcatctggaggagcgataagcttagcagagtatctaggaaccaacgtagccgaccacatcccggaaacccccaacaacctgtcggaggagatggtgagatgcatggcggggatatactgcaggcttgcagaccctcccttggtccaccacggctcgtcgtcctcgccgacattgtccttctcctcgaccaccagcgcagtctctccacagtacgtcggagacgacatgtggagtcccagctaccgcaggagagaagcgacgaccctggactcccgcctgatcaacccgttccacgtcgagggtctgaaggagttcagtgggccttacaacacgatggtcgaggttcctacgatcagccgtgacggtcggaggatgaaagaagccgaggacctgctccagacttacaggctggttttgtaccggctggaagccgttgatctgaggacgatgacgaacgaagaaaagatagcgttctgggtgaacgtacacaatgccttgctgatgcatgcttatctggagaacggcgtcccacagaacaaaacatccctgcttgctaaggccgcctgcaaaatagctggacgcagcatcaacgcggccgttatccagagcgttgttcttggatgtaccacgcactgccccggacagtggctacgacggacgctgctctaccccaggaccaaaagcaaagtgagcaaagcggggcatgagtggcgagcctttgccgtcgcacaaccggagcctcttttgcgctttgcgctttgctccggcagccattctgatcccgcggtgagggtgtacactccgaagcggctgttccaccagctggaggcggccaaggaggagttcatccgggcgacggccggcgtgtggaaggagcagaagctgcttctccccaagctggtggaggcgtacgccaaggacgtgaggctgtcgccgcagggcctcgtggacatggtccagcgccacctcccggagaccatgagggtggccgtgcagcggtgccagcagggcggcagggcgtcgtcgggcaaggtcgtcgtcgactgggtgccccacaacccggccttccggtacctgctcgcaagggacctcgcgttccctcacctcagctgacgctgacactgagcatatatcgatgggcatgggctcaagtagtatatgcatgtgtcaaagggttaggacttaggagtaaagaagggatcgtgtgcagtttttgtgtgggtggttatcaatggcgtggcgtgtaaagatgcttctgtagtctgtagatgatgaacaggaaaggaaacagttgacgaaatgatagaaagcacgtttgacggttga

SEQ ID NO: 1731 - DNA, 2189 bp, Brachypodium distachyon
atgtggctgatgcgtatgagtgtgaaccgcaggaataaaagtccttgggaggttttcaaggggtgccaagaaatggaggtggaggcccttgagaagaagggccacagagcctttgctaaggcaattaagtctttcaattcttcagaaaggcacaagcgttctaagagtgatcttgagaatacatatggtaaagatgccttgtacgctgcagacaaaacatgcgttcgtcctaagcaagatggtgtaaaggctaaggtaaagagcgatttcagtaaggaagtgcagcctgggagaggagcacaaagttccttgagaaaagagattctacaactagaaaagcacctcaaggaccagcagggtgtgcgtggcgccctggagaaagctttggggccaaacgctgtcccggtcaacctgtcacatgagaatccaatgccaaatgctgcaaacgaactgataagggagattgccacactagagctagaggtcaagaatatggagcagtatctcctcactctgtaccggcaagcgtttgagcagcaagcacctgcattttctccccctgatcgccgtggagcaccgaagctgtcggtgagctcgaggtccgggcagctccgggaaacacccgatgcgaaggcttcttgtaagagtagaggggattcaatgctccggtctagctacccaccgccaccgtcccataagaagtggaatgatccattgacagattgctctacatcctcttgctccggtagaccaaatgattctgacgtgctccgctgtcagtctgcgttgtcgtaccgtggaatctgttcatctaggatatcaccagctgaggagagtctcgcgagggctcttcgctcgtgccactctcaacctttctcatttttggaggaaggagatgctactgcagcaggggtgataagcttagcagaatatctaggcactaatgtagctgatcacatccctgaaactccgaataacctttccgaggagatggtgagatgcatggcaggggtatattgcaaacttgcagatccgccattggttcaccatggctcctcgtcttctccgacatcgtcattctcctcaaccagtgcaatttctccacagttcctgggggacatgtggagccccagttacaagcgagaaacaacactagactcccggttgataaatccgttccatgtcgaggggttgaaggagttcagtggaccatacaatacaatggttgaggttccagcgatttgccgtgatagtcggaggctaaaagaagtggaggatctgctccagacttacaagttgattttgtaccggttggaaacggttgatctcaaaagaatgacaaacgaggagaagattgcattctgggttaacatacacaacgcgttgatgatgcatgcttatctcaggtatggcgtcccacagaacaatctgaagaagtcatcactgcttgttaaggctgcctgcaaaattgctggacgcaacatcaatgtagccgtgatccagaacttggttcttggatgcaacacacattgtcccggacagtggctacggactttgctttacccaaggatcaaaagcagagtgagcaaagtagggcatgagtggcaagcctttgccgttgcacaaacagaacctcttttacgctttgcgctttgctcgggcagccattctgatcccgcggtgagggtgtacactccaaagaggctgttccatcagctggaggccgccaaggaagagttcatccgggcaacggtcggcgtctggagggaacagaagatactgctgccgaagctcgtcgaggcatacgcgaaggacgtgaagctctcgtcacagggcctcgtcgacatggtccagcggtacctcccggagagcctgaggatggcgatgcacaagtgccagcagcaggggggcaggtcgagcaagatcatagagtgggtgccctacaacctgaacttccggtatctgctagctcgggacctcgcgtttcctcacctgaactgaccgtgtacacggccctagtgatcaagtatagtgttcatgtgtgataggcttaggtttggggggtcgaagatgtttcagattcaatgatttctgtaggcttagtgtgtgagtagtaaactagtagatggcgcatgcagtgtgtattttggcgctgtaaatcttttgtagatgaagaggaaataggggaa

SEQ ID NO: 1732 - DNA, 4003 bp, Oryza sativa
ttacaatgtcacattgggttctgtataaaacattattttaacttacaactactgcatctgtcccaaaatatttttgaatggaggggagtatctctttttattttacaaacaattatgtatacagcggcatgcagactcgaaaactgtactacattttacggattggcaagtgccaacctttgggtaatataggtgttatggtacatcacgattgcttgagactcaggagtcaggaattcaagatagctgcaccaacccattgcaaatttgcaatgcaaaaggaatatatgagatggttggttgcattagtgatgagttccctttacttccaaatgccaaccaattttagtttgtacaatcaatgtgtggtactatcacgggatagtatatgtagcgtaaacctataaactattgtaggatacacaaatggatgtctggaatttgttcacgtccccctgattaatcttttacttctagattaaagtatgattatttttttattggctaaatctcagatgataatttgtgtatcatataacagttttcaggtttgtattacatacagatggtttgcactatatattttctccgctatcgttgtgtctctatctccaggccatttctagtcttctctacatgagccaatgggaagttggcttgcattgaaatttgcatcattgttgaccatagtggaaggacgagtgagtattaacaagtggactcattagtcattagtcatggtggttagtatgcacgtacgctgattaatttgaaacaaaccaataatgatgcccttctccaaatggcactgcagactacctgctctcggctcatttgctggtctgtcagtatcataaaacaaactcatcgcagggcagaaaaaactattatggtcacaaagatttctgaagagctatgtcaggcacatctggaaacctgcctgttccattaagaaccccaaactccaaagtgcaatttcaacatactactaatattctgatgctgaaatccctcaaccaagtttggtagacaataacctaatttaacaatgctgatgttttgtcggttaggtatgcaagcttggctctattagcagctggatgcagtaatcctgagttaatataatcccacaatcttactgctgctcacaaccccaaaaactgttactcgaggttggttgaggtagaaagcctaagacacatataaccaagctgatgttagaaaaaaaaaagctaaccttttcctagttttgcaagctgcagaatacaaagaagccgggagggattaaaattttcagacctgtggatgcaaaaaaggtacagtgattagtgtatactactactactccatttatccagcaaagaaccaagggaaaagttgtgcgtggcattttcacgagatgtcacagtcaacggcctttttgcaggcgccctaaacactagtgtgcgtcactggttgtggctgtgctgtatataacgcagagtgcggggtttctgcagagctggagtggagaaaggagagacctttccattccctctctgaaaaaacaacaatttagtttttgacctgaagggtggtagtagtgggctagttggcggtagatggcattgacactggttgccaagcacagtgcaggttttgttggagcctagtgtggcttcagagctcagaagcagccacatttctgcattcttggatcatttggagctctccttgtttgttgttgggtctcttctctttcctgcttccgagttctgtgaaccagccaactaatctctttcttgattggttcataccttggtgccaagaaatggaggtggaggcgatggagaagaagggacacagagcctttgctaaggcaattaagtctttcggttcttcagaaaggcacaagcgttctaagagtgatcttgaggatatgtgtgctaaagatgcgctgtatgcttcagataaaacatgcgttcagcctaagccagatgctgtaaaagttaaggtaaaaagtgatatcaacgctgaagtgcaacctgggagaggagcgcagagcttcttgagaaaagagattctccagctagaaaagcacctcaaggatcagcaggtcatgcgtggcgccctggagaaagctctgggaccgaacgctactgctgctccagtcaacgtatcaaacgagaatccaatgccaaaggatgccaaagaacttatcagggagattgctacactagagcttgaggtgaagaacatggagcagtatctccttaccctgtacaggaaggcctttgagcagcaagtgcccacattttcccctcctgaccaccggggagctccgaagccgccggtaccggcgatggcggcagtgagctcgcagcctgtgcagctgcagaaatcacccagtgtcaaggcatctcgcaagaacaacagagctgacgcaatgctgcgatccagctacccgccaccgtcccgtaggacgttgaacgatccagtgatgacggattgctctacgtcgggttgctctagcaggctaggtgaatctgatgttctccggtgccagtctgcggtgtcgtaccgcggcatttgttcgtccaggatttcaccatcggaggacagtcttgcgagagctcttcggtcatgccactctcaacctttctcatttctggaggaaggagagagtactgcagcaggagtgataagcttagcagagtatctaggcactaatgtagctgaccacattcctgaaactcccaacaacctatcggaggagatggtgagatgcatggcaggggtgtactgcaaacttgcagatccccctttggttcaccacggctcgtcgtcttcgccaacgtcatcgttctcctcgacgagtgcgatatccccgcagtatctgggggatatctggagtcccaattacaagagagaatctactctggactctcgtttgataaaccctttccatgttgaggggttgaaggagttcagtggaccatacaatacaatggttgaggttccactgatttgccgcgatagtcggaggctaaaagaagttgaggatctgctccagacttacaagttgattttgtaccggttggaaaccgtcgatctcaggagaatgacgaacgaagaaaagattgcattctgggtcaacatacacaacgcccagctgatgcatgcttatctaaagtatggcgtcccacagaacaatctgaagaagacatcacttcttgttaaggctgcctgcaaaattgctggacggagcatcaatgtagctgttatccagagcatggttcttggatgcaacacatactgtcctggacagtggttacgtactttgcttcacccaaggatcaaaagcaaagtgggcaaagtagggcatgtgtggcaagcctttgccgttgcacaatcagagcctcttttacgctttgcgctttgttcaggaagccattctgatcccgcggtgagagtgtacactccaaagaggctgttccatcaactggaggctgccaaggaggagttcatccgggcaacggtgggcatctggaaggagcagaaaatactgcttccaaagctcgtcgaggcgtatgcgaaagacgtcaagctctcgtcgcagggccttgtcgacatggtgcagcgctacctcccggagagcttgaggatggcaatgcagaagtgccagcagagcagatccagcaagatcatagaatgggtgcctcataacctgaatttccggtatctgctgtccagggacctggcatttcctcacctgaactgactaatcttactgctctctgctcaaataggctgtgaaatgagctgaagtatatgcattgtatcatatagatttagacgtaaggattgtgtagggttgatgtgtgagtagtgtttatctttgcctgtaaaaatttttgtagatgaacagtaaaaggggaagaaatgagaaagaagcatcctttggttatctgacaatttcggtatgttgtgtcattgtgtgccatgttaagcctctttgtgtggg

SEQ ID NO: 1733 - DNA, 2014 bp, Saccharum officinarum
ttccttccccacccgccgcgacgcatagccgccaaacaaactcccacgagcaccatagccaaatcagcccatagcgatcgccagaagctttcacagagctgtctcgtgcacgagtactccagctgacacctattcccggcgtcaatggcgagctccggtgatgaagggcgcgtggtggtggacctccgttccgcggcggagtcggcggctgccgacgacgatgcccacgccacgcctctccacgagatcgagtccctctgcatgcgctgcggcgagaacggcatcacaaggcttctgctgacgctgatcccgcacttccgggaggttgttctgatggccttcgagtgcccacattgtggtgagaggaacaatgagattcagtttgctggacagctccaacccaagggatgctgctatagcttggtggttccgttggggcagagtgagatactgaatcgtcaggtcgtgaagtctgattcagcaactatcaagattccagagctggactttgagattcctccagaagctcaacgtggaacgctttctactgtggaagggattattatgcgagctgtggatgagctgcaggctcttcaagacgaacgaaagaaagtggatcctcagaaggctgaagccatcgatcaattttactgaagttgagatctcttgggtcaggagaggctgcattcacctttattcttgatgaccctgcaggaaacagctttattgagaacccgcatgctccgtcgtcagatcctttactatctgtgagattctacaaaaggacttgtgaacaacaaggagcacttggttttcttgctgaaccaccaacagaacaacctggagaggctgttttgcctgcttcagctgtggaatccaattctgatgggttgcaaagcgtgccccatggctcagttggagctgttgcaggtcgtcgcgctatagctcagggaaaccctgacgaagttgctgcagcattgtgtagatactcagcaccagaagaggttgatactttaccatcaacatgtggagcctgtggagcagaatgtgccacgcgtttctttgctacaaaaatcccatatttccgggaggtgattgttatggcgacaacatgtgacatgtgtggttatcgcaattcagagctgaagcctggaggtgaaattccagctaagggaaagaaaattacactgcgtgttcaaaatgcacgagaccttactcgcgatgtcataaagtcagattcagctagcgtgaaagtacctgaacttgagttggagctttcatgtggaacgttgggtggtatggtcacaactgttgaaggtttaattgtgaaaatatgcgaggctctggagagaatacatggcttccaattgggcgatagcacactggaatggaaaaagaagaaatgggaggatttcaaggagagactatccaagcttttgagtttacaagaagcctggactctaataattgatgatggattggcggcttcatttgtggccccggctactgattccttagaagatgacagccagctaaccatggaggagtatcaaaggagttgggagcagaatgaggaactaggcctgaatgacatggatacgtcctctgcagacgcggcttacaacacgaccagcacatgattttttttaagttttcttgtgctgaatgtatttgttatgctagcttgtatcattatctatttactttgataaactcccagtgtgtatactaatgtaaacaacttatatttcttctgatgataaacatcgagcggtaatgcgtcgaacgatgtttaaacattttaaaagttctgcggagcaccagcttgatgaaatttgagtgatggtcacctactataccccgccaccccggtaaccagttaggccagctaggcagtctcagcgggaattttatgatcttgttaccaatgcaaccatattttagatgtagaagagttttgtctccataaaattctttctactctcatgaaattcttatcatatctctcttcatt

SEQ ID NO: 1734 - DNA, 2035 bp, Zea mays
aacagcaaagcccaggctgcccagcacacgcgacgcgaaccagctggcgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatcgggttgatcgtcgattaatcgtgattagtcggctgatcgcccttctggcgatcagaaacgataaggcaatctgaaaacattggccgccaaacctccagagcgactcccgcgagccgtgaccaccatagctaaatcaacgcaccagaagctttcacggagctgtctcgtccacgagtgttccagctgactcctattccctgcgtcaatggcgagctctggcaatgaagggcgtgtggtggtggaccttggctccgcggcggagtcggtggctgctgacgaggaggcgcacgccacgcctctccacgagattgagtccctttgcatgcgctgcggcgagaacggcatcacgaggcttttgctgacgttgatcccgcacttccgggaggtggttctgatggccttcgagtgcccacattgtggtgagaggaacaacgagattcagtttgctggacaactccaacccaagggatgctgctacagcttggaggttccgttggggcagagtgagatgctgaatcgtcaggtcgtgaagtctgattcagcgactatcaagattccagagctcgactttgagatccctccagaagctcaacgtggaacactttctactgtggaagggattattatgcgagctgtggatgagctgcaggctcttcaagatgaacggaagaaagtggatcctcagaaggccgaagctatcgatcaatttttactgaagttgagatctcttgggtcaggagaggctgcattcacttttattcttgatgatcctgcaggaaacagctttattgagaatccgcatgctccgttattagatcctttactatctgtgagattctacgaaagaactcgtgaacaacaagcagcacttggctttcttgctgaaccaccaaaagaacaacctggagaggctgtattgcctgcttcagcagtggaatccaattctgatgggttgcaaagcgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacagaatgcgtcacacgtttctttgctacaaaaatcccatatttccgggaggtgattgttatggcaacaacatgtgacatgtgtggttatcgcaattcagagctgaagcctgggggtgaaattccagctaagggaaagaaaattacactgcgtgttcaaaatgcacaagaccttactcgtgatgtcataaagtcagattcagctagcgtaaaagtacctgaacttgagttggaactttcatgtggaacgttgggtggtatggtcacaactgttgaaggtttaattgtgaaaatatgtgaggctctggagagaatacatggatttcaattaggcgatagtacactggaatggaaaaagaagaaatgggatgacttcaaggagagactatccaagcttctgagtttacaagaagcctggactctaataattgatgatggattggcggcttcatttgtggccccggctactgattcgttagaagatgacagccaactaaccattgaagagtatcagaggagttgggagcagaacgaggaacttggtctgaatgacatggatacgtcctctgcagacgcggcttacaacacgaccaacacataatttttttagttttgttgtgccgaatgtatttgttacgctatcagtttactttgatgaactttcagtgtgtatactaatatcaacaacttatatttcctctgacgataaacatcgagcgaacgtgcgaggc

SEQ ID NO: 1735 - DNA, 1926 bp, Setaria italica
ttcccttcccctccctcccgccgcgacgcaaagccgcggccgccaaacctgcaaaggcgaactcccagtctccaacgagcaccgcagccaaaacaaagcatagcgatcgcgagaagcttccacagagcttgtctcctccacgagtgctcccgacgacaactgttccacggcgtcaatggcgagctccggcgatgatgggcgcgtggtggtagacctccgctccgcggcggagtcggcggccggggcaggcggcgaggaggcgcacgccacgccgctccacgagattgagtccctatgcatgcgctgcggcgagaacggcaccacgaggctgcttctaacgctgatcccgaacttccgggaggtggttctgatggccttcgagtgcccgcattgtggtgagaggaacaatgagattcagtttgctggacagcttcagccgaagggttgctgctatcgcttggaggttccatctgggcagagcgagatactgaaccgtcaggttgtgaaatctgattcagcaactatcaagatcccagaattggactttgagattcctccagaagctcaacgtgggaagtgttctactgtggaagggattattatgcgagctgtggatgagctgcaggctcttcaagatgaaagaaagaaagtagatcctcaaaaggctgaagccatcgatcaatttttactgaagttgagatcccttgggtctggagaagctgcatttacctttattcttgatgatcctgcaggaaacagctatattgagaacccgcatgctccatcatcagatcctttgctatctgtgagattctacgagaggacacgtgaacagcaagcagcacttggttttcttgctgaaccagaacaacctggagaggctgttttgcctgtttcagcagtgggatccaattctggtgggttgcaagccgagccccatggcgcagttggagcccttgcaggtcgtcgtgctatagcacagggcaaccctgatgaagttgctgcagcactgtgtagatacgcagcaccagaagaggttgatgtgttgccatcatcatgtggggcctgtggagcagaatgtgtcacacgtttctttgctacaaagatcccatatttccgggaggtgattgttatggcaacaacatgtgacatctgtggttaccgcaattcagagctgaagcctgggggtgaaattccagctaaaggaaagaaaactacgctacgtgttcaaaatgtaaaagacctcactcgtgatgtcataaagtcagattcagctagtgtgaaagtacctgaacttgagttggagctcacaagtggaacgttgggtggtatggtcacaacggttgaaggtttgatcgtgaaaatatgcgaggctctggagagaatacatggattccacctgggtgatagcacactggaatggaaaaagaagaaatgggatgatttcaaggatagactatccaagcttctgagtttacaagagccctggactttaatccttgatgatggattggcagcttcatttgtagctccagctacagattcgttagaagatgacaagcagcttaccattgaggaatatcagaggagttgggagcagaatgaggaacttggcttgaatgacatggatacttcctctgcagaccacgcttacaacacaaccagcacatgattcttgttttaatcttgtgctgagagtattgttgtagcttgtaacattatctatttattaactttttcaaacccccgtgtgtacatttcattacttttgtatctaacaataaccttcgagcggtaatgtgttgtctaagtgtctaacggtgttttgaaccctcaaagttttgaacagtgttatctatgattgatggttgacttccactaaacctgcaatagtattttaccccttagggaaagtgcgcgctatat

SEQ ID NO: 1736 - DNA, 1676 bp, Pennisetum glaucum
ccggcgtgaatggcgagctccggcgatgaagggcgcgtggtggtggacctccgctccgcggcggagtcggcggctggggctggcgacgacgaggcgcacgccacgccgatccaagagctcgagtctctatgcatgcgctgcggtgaaaacggcaccacgacgctgcttcttacgttgataccgaacttccgggaggtggttctgatggctttcgagtgcccacattgtggtgagaggaacaatgagattcagtttgctggacagcttcagccgaagggttgctgctatcgcttggaggttccatctgggcagagcgagatactgaaccgtcaggttgtgaagtcagattcagcaactatcaagatcccagaattggactttgagattcctccagaagctcaacgtgggaagtgttctactgtggaagggattattatgcgagctgtggatgagctgcaggctcttcaagacgaaagaaagaaagtagatcctcaaaaggctgaagccattgatcaatttttactgaagttgagatctcttgggtctggagaagctgcatttacctttattcttgatgatcctgcaggaaacagctatattgagaacccgcatgctccgtcatcagatcctctgctgtctgtgaaattctacgagaggacacgtgaacagcaagcagcacttggtttccttgctgaaccagaacaacctgtagaggctgttttacctgcttcagcagtgggatccaattctggtgggttgcaagctgagccccatggcgcagttggagcccttgcaggtcgtcgtgcaatagcacagggaaaccctgacgaagttgctgcagcactgtgtagatatgcagcaccagaagaggttgatgtgttgccatcgtcatgtggggcctgtggagcagaatgtgtcacacgtttctttgttacaaagatcccatatttccgggaggtgattcttatggcgacaacatgtgacttctgtggttaccgcaattcagagctgaagcctgggggtgaaattccagccaaaggaaagaaaattacgttacgtgttcaaaatgcaaaagaccttactcgtgatgtcataaagtcggattcagctagcgtgaaagtaccggagcttgagttggagctcacaagtggaacgttaggtggtatggtcacaacagttgaaggtttgattgtgaaaatatgtgaggctctggagagaatacatggattccagttgggtgatagcacattggaatggaaaaagaagaaatgggaggatttcaaggatagactatctaagcttctgagtttacaagagccatggactttaattcttgatgatggattggccgcttcatttgtagctccagctacagatacattagaagacgacaaacagctaaccactgaggaatatcagaggagttgggaccagaatgaggaacttggcttgaatgacattgatacttcctctgccgaccaggcttacaacacaacaaacgcatgatttttgttttaattttgtgctgagagtactgttgtagcttgtaacattactattatctataaacttttgaaatccctagcgtgtacttatacttattacttttgtatctgaccataaacttcgagcggtaatgttttgtctaacggtgttatgaaccctcaagaagtttt

SEQ ID NO: 1737 - DNA, 5035 bp, Brachypodium distachyon
ttccatccccttcccgttccgtcccttcttcccctcccgccgcgaagcactcgagagtccagagccaaacccagctgaagctaagcaaagagatcgcgagaagcttctgaaagctccgttccttggagagaacgcatccatctcccgcgttcatggcgagctccggcgaggaagggcgcgtggtagtggacctccgctccgcggcggagtcagcgggcgacgaggacgcgcacgccacgccgctccacgagatcgagtccctctgcatgcgctgcggcgagaacggcataactaggatactgctgaccctgattccacacttccgggaggttgttctgatggcttttgagtgccctcattgtagtgaaaggaacaatgaagttcagtttgctggacagctccagccaaagggatgttgctaccgtttggaagtcccgtctgggaagagcgagatactgaaccgtcaggtcgtgaaatctgattcagcgactattaagattccggaactggattttgagatccctccagaagctcaacgtggaacactttcaacagtggaagggtgcattatgcgagctgttgatgagttgcaggcacttcaagatgaaagaaagaaagtggatccccaaaaagctgaagctattgataagttcttagtaaaattgaaatctctcggatcaggagaagtggcttttacctttattcttgatgatccttctggaaacagcttcattgagaatccgcatgcaccttcgtcagatcctttgctatctttgaaattctatgaaaggacatctgaacaacaagcagcacttggttttcttgctgaaccaaccaaagaacctggagagtcttctcgggatgcttcaacagtggaagcaaagtctggtgggctgcaaaggatgccccatgggtcagttggagctattgcgggtcgtcgtgctatagctcagggaaactctgatgaagttactgcagctttgtgtagatattcagcaccagaagaggttgatactttgccatcaacatgtggggcctgtgcaactgagtgtgtcactcgtttctttgctacaaaaatcccatattttcgagaggtgattgttatggcaacaacatgtgacgtatgtggttatcgcaactcagagctgaagcctggtggcgaaatcccagctaaaggaaagaaaactactctacgtgtgcaaaatgcaaaggatcttagtcgtgatgtaataaagtcagattcagctgcggtgcaagtacctgaacttgacttggagctgtcaagtggaacactgggtggcatggtgacaactgttgaaggtttaattgtgaaaatatgcgaggcactggagagagttcatggattccaattgggtgatagcacacatgaatggaagaagaagaaatgggatggtttcacggagagattgtcaaagcttctaagtttacaagagccttggactttaattattgatgatgcattggcggcttcgtttgttgcccctgccacggattcaatagaagatgaccaccagctaacaatcgaggagtacgagaggagctgggagcaaaatgaggagcttggcttgaatgacatggacacatcatccgcggacatggcttacaacacgacgagcacgtaatgataatcattttgtcttgtgctcaatgttttaacctaacagttatctactttgaactttgatactcttgtgttgtaatagctgttacttctatttcttctctgcaaacaatggtgccattaaatggcaaatatcgtttcgactttcctgccttttagtgcaagaaatagtgttggtttttacagcaaatcagtttcaaagatatgagttatgagtgaaccaagttgcgcttgtatatttacttcatccacatgtgtgaagactgggaatatgagaatagaaaaatgagaggtcgaaccaaataattttatatctactttaaatagcagaaatgtgagactacaaagaataagattctgacaaatatgaaccaaaagaatgtaaatacagtcgctctttatcgtacggtagctaaaaggtaaaccaaaagaactggtaaaagagataaatatcaccaagcgtgagtataacaagcagtccctatagacgagtgaaatatttagtggcagttacaaagttatcaaaggataaaatcgctgatattatcaacagcagtaggattgtaggaacatgctcgatgtgccaaataaaataaaaacatgcaaggtttctttatacatcatctcatgatccagacggcgtttggggttaagcacaagagaacactgtgttctagttttttgacgggaaacactgttctagtgacaacccttgcactcggactggaatgccatgcgaagttctgtagtttctaatttataaaagagtcaccaaaggcacctcaaagaccataagcagaaagggatcttattactatatgcgctgagataacagtaaatcaccattcacaagggttgcattccttctgcttctactttatgttgtttccctggcagaattaacaccaaatgaaatgcgagaatatgacccccgttgcagacagaccattggttgaaaacttcgaaggatccagtccgttcgtacttggcgattgtccatagttctgtacaaactcacctctgatttccaccctttagtttcaataataatagtgcctgaaaacagtgcagtctttacgagttaagcacacatagatcaaaggtacatggctataaatcgattaattctgtaagttggtgtgtgtacctcttaagaaatttcaactgtaagagaagaaatacttcagatcactttgtaaagtttggcaagcatttgttgcaattttatgcaggttaagtgcaacaaagagagtaaaagtaccgctaggtctgtatgaaggttcagcccaaaataataaaaatcagatttgctgctaaattctatgatcgctgtttcttgttgttaccagtaaactaacgcatgaagtacaaacagctttagtttacttttggaggtcatgactcatattatgaacttgaagatatgctactccgtatctatgaacaacatatcaagaagataactttgagtaattattgctgccaatcatatgcaatctatcaacaataaattttgaaatcttacttgattatttaactaccgcactagaaagcatggcaagtgaaacatccactcagcgaactcatttggccattcttgctgaggtgtgatgtccttttgacactcctggagatctgctggtcatgatttgcggttgttgtactgcccaccacttgtgttttcctatgagctgacctgaaggtgttgaaaatcctctccagcgagtatgatcgtttcttttcaagtttgatctgaacaaagttgtgtgaaatgataaatatcgaactcactagcagtaatcaagaacgaaccatataaactgtaactctcaaacatagctccactaatgagcagtagaataggatacacagggaaaagtagatacgcgcaggacaggatgcatatggttaaataaactactaaaataatgattaaggaaagccagaagcaaagaaacaagcataccacaagcttctgtattgccgcctctgcttttgctttctgcatattctcccaagcagtcatttttgcttcctccccctcaatccttcagacagacaatatgtaagacatgacaaatctacccaatacccatcagctttccgtaagacaagacaaaaaaaatttcattctcattagctatcaaacacttacattagacaattgacctagataagaatcagttcaagtttacagcacagtaatatatttcataatggtcggtaagttggaagattgccacaatcgtgtttcatctcccagttctaactagtagaagatatagttgtatatcgacaatgatgctgagctggcctgtacagtttttcgctatgctgcggtgtttttgttatttttctctttctttctttggttgtttttgtgcgtatttgtcttttggcctatcgttttttatttgtctgttcgtcctggcgtcgctcgataccctcttctaatacagatatcgcgcacttaggcgtgggttaaagaaaaaaattgatgatgactaaaataggcacaatagctctagaaactatgtgctgacatatccttgcaccactaaaaacagattatccttgtaccttctgctctcttcagtagcattctaaatcttgtaaacaaaattcaggcaccattgaattagttatagaagaacttaacctcattcctttgcttacactagaaagttcttctaggacgatgcaacttgtaatagtgaagtcttagtaatatcatattaaaacatgacaagttaaggcaaactattaggtgcatggcatattagtagaagagaaccgaagtacggagtaattctataaagtaatatctacttaactttttagggggtaatatctacttagttagtcttgtacatgttactccatatgatttagaaagggtcagtgaaatgacaactttatcaaaaaggactaaaataaaaggaatttccttactttgcaatacactttgcagtttctgttaattcccaggttgaagatttagattccattgtctttctcttccactctatgatatttgttgagttcttgtcagagctccgtgaaacatgtttcttggaccacctggtcagagtcactcgatcatccatctctacatctttgatttcaagcttagagaaacagctctccagctccttgacttgttgtactgatagtgaacgagaaaaggagggcctcatgttgggagaagaggatctgctaaggtcagggctagtttgcgttgccacatccttcctcgaaattacaggggtattgctagtggccaagtcttttgtaacttcaacctgttcatctgggaaagcagcagacaatgaaaatgtttcaggagaacagttagtagctccttctgaaatttgcgaaaattaagccactgta

SEQ ID NO: 1738 - DNA, 1958 bp, Panicum virgatum
gggttccccttcgcttcgcttcccttccttccccttcctcccgccgcgacgcgaagccgccaaacctgcaaggcgagctcgcagattcccacgagccccgcagccaaatcaacgcacagcgatcgcgagaaaccttccgcatagcttgtctcctccacgagtgctccagccggcaattgttcccccacggcgtcaatggcgagctccggcgatgaagggcgcgttgtggtggacctccgttccgcggcggagtcggtgggtcgggctggcgacgaggaggcgcacgatgcgccgatccaggagatcgagtccctatgcatgcgctgcgggaagaacggcacaacgagggtgatgcttacgctggtcccgaacttccgagaggtgattctgatgtccttcgagtgcccgcattgtggtgagagaaacaatgagactcagtttggtggtcagcttcagccgaaaggatgctgctatcgtttgaaggttccttctgggcagagagagatactgaaccgccacgttgtcaagtctgattcagcgactatcaagataccagaactggactttgagattcctccagaagctcaacgtgggacatgttctactgtggaagggattattatgcgagctgtggatgggctgcaggctcttcaagatgaaagaaagaaagtagatcctcaaacggctgaagccattgatcaattttgcttgaagttgagatcttttgggtctggagaagctgcatttacctttattcttgatgatcctgcaggaaacagttttgttgagaacccgaatgctccatcatcagatcctttgctatctgtgagattctatgagaggacacgagaacagcaagcagcactcggtttcctcgctgaaccagaacaacctggagagggtgtgctgcctgcttcagcagtgggatccaattctggtgggttgcaaagcgagccccatggctcagttggagctgctgcaggtcgtcgtgctatagctcagggcaaccctgatgaagttgcggcagcactatgtagatactcagcaccagaagaggtcgacgtgttgccatcaacatgtggggcctgcggaaaagaatgtgtcacacgtttctttgctacaaaaatcccatatttccgggaggtgattcttatggcgacaacatgtgacttgtgtggttaccgcaattcagagctgaaggctgggggtgaaattccagctaaaggaaagaaaattactctacgtgttcaaaatgcaaaagacctgactcgtgatgtcataaagtcagattcagctggtgtgcaagtacctgaacttgagttggagctcgcaggtggaacattaggtggtattgtcacaacagttgaaggtttaattgtgaaaatatgtgaggctctggagaggatacgtggattccaatttggtgatagcacccttgaatgggaaaagaagaaatgggatgatttcaggaatcgactatccaagcttctgagtttgcaagagccctggactttgattcttgatgatggactggctgcttcatttgtagctccagctacagactcgttagaagatgataagcagctaactattgaggagtatgagaggagttgggagcagaatgaggaacttggcttgaatgacatggatacttcctcggcagacgctgcttacaacacaaccaagacatgattgtagtagcttgtaacattacattttcacttgtttaccttgaaaaaaaccgtgtgtaatgtgttgcatgtgacaataaacatcgagcattaatgtttggccaagggtgttctgaacacttttaagtttttttaatcgaaggacaaaagaagagaagggagtagagaagactcgtacaaacccctcgcccattcggacgatgctgccttgtataaactatggatatcacataacagttactttacacgctgccactctgattactg

SEQ ID NO: 1739 - DNA, 2034 bp, Panicum virgatum
cggacagtatcgcagcccagtccatctccgcgcagccgtttctagagggtcctaggtcactcgccccagttctcggctgttccccttcgcttcgcttcccttccttccccttcctcccgccgcgacgcgaagccgccaaacctgcaaggcgagctcgcagattcccacgagccccgcagccaaatcaacgcacagcgatcgcgagaaatcttccgcatagcttgtctcctccacgagtgctccagccggcaattgtttccccacggcgtcaatggcgagctccggcgatgaagggcgcgttgtggtggacctccgttccgcggcggagtcggtgggtcgggctggcgacgaggaggcgcacgatgcgccgatccaggagatcgagtccctatgcatgcgctgcgggaagaacggcacaacgagggtgatgcttacgctggtcccgaacttccgagaggtgattctgatgtccttcgagtgcccgcattgtggtgagagaaacaatgagactcagtttggtggtcagcttcagccgaaaggatgctgctatcgtttgaaggttccttctgggcagagagagatactgaaccgccacattgtcaagtctgattcagcgactatcaagataccagaactggactttgagattcctccagaagctcaacgtgggacatgttctactgtggaagggattattatgcgagctgtggatgggctgcaggctcttcaagatgaaagaaagaaagtagatcctcaaacggctgaagccattgatcaattttgcttgaagttgagatcttttgggtctggagaagctgcatttacctttattcttgatgatcctgcaggaaacagttttgttgagaacccgaatgctccatcatcagatcctttgctatctgtgagattctatgagaggacacgagaacagcaagcagcactcggtttcctcgctgaaccagaacaacctggagagggtgtgctgcctgcttcagcagtgggatccaattctggtgggttgcaaagcgagccccatggctcagttggagctgctgcaggtcgtcgtgctatagctcagggcaaccctgatgaagttgcggcagcactatgtagatactcagcaccagaagaggtcgacgtgttgccatcaacatgtggggcctgcggaaaagaatgtgtcacacgtttctttgctacaaaaatcccatatttccgggaggtgattcttatggcgacaacatgtgacttgtgtggttaccgcaattcagagctgaaggctgggggtgaaattccaactaaaggaaagaaaattactctacgtgttcaaaatgcaaaagacctgactcgtgatgtcataaagtcagattcagctggtgtgaaagtacctgaacttgagttggagctcgcaggtggaacattaggtggtattgtcacaacagttgaaggtttaattgtgaaaatatgcgaggctctggagaggatacgtggattccaatttggtgatagcacccttgaatgggaaaagaagaaatgggatgatttcaggaatcgactatccaagcttctgagtttgcaagagccctggactttgattcttgatgatggactggctgcttcatttgtagctccagctacagactcgttagaagatgataagcagctaactattgaggagtatgagaggagttgggagcagaatgaggaacttggcttgaatgacatggatacttcctcggcagacgctgcttacaacacaaccaagacatgattgtagtagcttgtaacattacattttcacttgtttaccttgaaaaaaaccgtgtgtaatgtgttgcatgtgacaataaacatcgagcattaatgtttggccaagggtgttctgaacacttttaagtttttttaatcgaaggacaaaagaagagaagggagtagagaagactcgtacaaacccctcgcccattcggacgatgctgccttgtataaactatggatatcacataacagttactttacacgctgccactctgattactg

SEQ ID NO: 1740 - DNA, 1981 bp, Triticum aestivum
ccacttctttccagaggctactaggttgctctcctttctcccgttcttttctcctacagaggtcccgccgcacttctttgccctcccaccgcgagcacgagcgccaaaccaagcagtgcgaggagaagagaccgcgagagtcttctggagaccactccttcgcgagaagcccaacccgcaccgctatcccgtgaccatggcaaactccggcgacgaggcgcgcgttgtgacggacctccgctccgctgcggagtcggcgggcggcgatgaggcgcttcacgaaatcgagtctctctgcatgcgctgcggcgagaatggcaccacgaggttgctgctgactacgatccccaacttccgggaggttgttctgatggctttcgagtgcccgcattgtaatgaaaggaacaacgaggtccagtttgctggacagctccagcccaagggatgttgctaccgcttggagatccctcaagggcagaacgagatactgaaccgtcaggtcgtcaaatctgattcagcaactatcaagattccggaactggactttgaaattcctccggaagctcaacgtggaacactttcaacagtggaagggattattatgcgagctgtggaggagttgcaggcacttcaagatgaaagaaagaaagcggatcctcaaaaagctgaagctattgatcagtttttaataaaattgagatctcttggatcaggagaagctgcgtttacctttgttcttgatgatcctgctggaaacagcttcatcgagaacccgcatgctccttcatcagatccttcgttatctgtcagtttctatgaaaggacatctgaacaacaagcagcacttggttttcttgttgatccaccaaccggagaatctggagatccttcgcagaatgcttcaacagttgaggcaaattctgtcgagttaccaaaggtgccccatggatcagttggagctgtcgcaggtcgtcgtgctattgctcagggaaaccctgatgaaattgctgcagcgctgtgtaggtatacagctccagaagaggttgatactttgccatcaacatgtggagcctgtggagctgcatgtgtgactcgtttctttgctacaaaaatcccgtatttccgtgaggtaattgttatggcagcttcatgtgacctgtgtggttatcgcaactcagagttgaagcctggcggtgaaattccggctaaaggaaagaaaattatgttacatgtgcaaaatgtaaaagatctttctcgcgatgtcataaagtcagattctgccgctgtgaaagtacctgaacttgagttggagctgtcaatgggtacattgggtggtattgtcacgacagttgaaggtttaattgtgaaaatatgtgaggctctggagcgggttcatggattccaattgggtgatagcacaaatgaatggaagaaaaagaaatgggatgatttccagcaaagattatcaaagctcctgagtttacaagagccctggaccttaattatcgatgatgcgttagcggcttcgtttgtcgccccagccacagatttgatagaagatgacagccagctactcattgaggactatgagaggagttgggagcagaatgaggagcttggcttgaatgacatggacacctcctctgcagacattgcttacaatatgaccagcgcagaataagtttagatctttttgtgctcagtgttgtagcctgtaatattatggatctaaaacttgatcgctcgtattttgaaaaaacttgataaacttcctgttttctgggaacatctactcccttggtcccataacataatataagaaggtttttcacactagttcttatattatgggaaggagagagtatttactttgcttattgcagtaagaatgggtggttttgagatggcaaatagttttttcagttcccacctaaaaagttggaaattttgagttgggaagatactaatgagtatattgtat

SEQ ID NO: 1741 - DNA, 1758 bp, Triticum aestivum
ctcccgcgagcagcccagcccgtaccgacctccccgcgccacgccatggcgagctccggcgaggaacggggcgtggtggtggacatccgctccgcggcggagtcggcgggcgatgacggtgcgcgcgacgcgccgctccacgtcgtcgagtccctctgcatgcgctgcggcgagaacggcacgacgaggatactgctgactctaatcccgcacttccgggaggttgttctgatggctttcgagtgcccgcattgcagcgaaaggaacaacgagattcagtttgcagggcagctccagcccaagggatgctgctacaccttgaaagtccccaaggggcagcctgagatactgaaccgccaagttgtgaaatctgattcagcaactattaagattccagaactagactttgagatccctccagaagctcaacgtggaacactttcaacagtggaagggagcattatgcgagctgttagtgagttgcaagcacttcaggatgaaagaaagaaagtggatcctcaaaaggctgaagctattgaacagttcttagtaaaattgagatctcttggatcaggggaagctgcttttacctttattcttgatgatgcttctggtaacagcttcatcgagaacccgaatgcaccttcatcagatcctttgttatctttgagattctatgagaggacatatgaacaacaagcagcactcggttttcttgctgaaccaaccaaagaatctggagactcttctcaggatgcttcaacagtggaaggaaactctggtgggccgcaaaggattccacatggttcagttggagctgttgcaggtcgccgtgctatagctcagggaaactctgatgaaattactgcagcactgtgtagatattcagcaccagaagaggttgatactttaccatcaacatgtgcggcctgtgctactgagtgtgtcacacgattcttttctacaaaaatcccatattttcgagaggtgattgttatggctacatcatgtgatgcgtgtggctatcgcaactcagagttgaagcctggtggtgaaatcccagctaaaggaaagaaaacaacactgattgtgcgaaatgtaaaagatcttagtcgtgatgtcataaagtcagattcagcagcagttagtgtacctgaacttgagttggagctgtcaagcggaacactgggtggcattgtgacaacagttgaaggtttaattgtgaaaatatgcgaggcactggagcgagttcatggattccagttgggtgacagcacatatgaatggaagaagaagaaatgggatggtttcacagagagattagcaaagcttctaaatctagaagagccatggactttaattcttgatgatgcattggcggcttcgtttattgctccagcgacagattcgctagaagatgacaaacagctaacaattgaggagtatgagaggagctgggagcaaaacgaggagctgggcttgaatgacatggacacgtcctctgcggatatggcttacaacacgacgagcacgtcataatcgatattggtttagtcttctcgttgtgcacaatgttgtaacctgtaatttgaaatttggtactccgtggtgtattcaatttttattttacgaatgaacctaatcaataggtggtatggagatggtttcaactatatagtttatttgttcaccttggcaaagacgttggttcaatcgtgcaacacttgtattcttgaaggctgcaggtcaacttttttt

SEQ ID NO: 1742 - DNA, 1899 bp, Secale cereale
gactcgcaaacctgctcccagggttagggttcgcgccgccgccgccgctcacgccctcctgccgccgctctccgcccaccagcgagcttccgaaagctccgtgctctcgcgagaagcccagcccgccccacgccatggcgagctccggcgaggacaggggcgtggtggtggacattcgctccgcggcggagtcggcgggcgacgagggcgcgcgcgacacgccgctccacgtcgtcgagtccctctgcatgcgctgcggcgagaacggcacgacgaggatactgctcactctgatcccgcacttccgggaggttgttcttatggctttcgagtgcccgcattgcagcgaaaggaacaacgaggttcagttcgctgggcagctccagcccaagggttgctgctacactttgaaagtccccaaggggcagcctgagatactgaaccggcaagttgtagaaatctgattcagcaactattaagattccagaactagactttgagatccctccagaagctcaacgtggaacactttcaacagtggaagggagcattatgcgagctgttactgagttgcaagcacttcaggatgaaagaaagaaagtggatcctcaaaaggctgaagctattgaacagttcttagtaaaattgagatctcttggatcaggggaagctgcttttacctttattcttgatgatgcttctggtaacagcttcatcgagaacccgaatgcaccgtcatcagatcctctgttatctttgagattctatgagaggacatatgaacaacaagcagcactcggttttcttgctgaaccagccaaagaatctggagactcttctcaggatgcttcaacagtggaaggaaactctggtgggccgcaaaggattccacatggttcagttggagctgttgcaggtcgccgtgctatagctcagggaaactctgatgaaattactgcagcgctgtgtagatattcagcaccagaagaggttgatactttaccatcaacatgtgcggcctgtgctactgagtgtgtcacacgattcttttctacaaaaatcccatatttccgggaggtgattgttatggctacatcatgtgatgcgtgcggctatcgcaactcagagttgaaacctggtggtgaaatcccagctaaaggaaagaaaacaacactgattgtgcgaaatgtaaaagatcttagtcgtgatgtcataaagtcggattcggcagcagttagtgtacctgaacttgagttggagctgtcaagcggaacactgggtggcattgtgacaacagttgaaggtttaattgtgaaaatatgcgaggcactggagcgagttcatggattccagttgggtgacagcacatatgaatggaagaagaagaaatgggatggtttcacagagagattagcaaagcttctaaatctagaggagccatggactctaattcttgatgatgcattggcgtcttcgtttattgctccagcgacagattcgctggaagatgacaaacagctaacaattgaggagtatgagaggagctgggagcaaaatgaggagctgggcttgaatgacatggacacatcctctgcggacatggcttacaacaccacgagcgcatcataatcaatttcggtttagtcttattgttgtgcacaatgttgtaacctgtaatttgaaatctggtacttcgtggtgtattcaaattttgttttacgaatgaacctaatcaataggtggtatggagatggtttcaactatatacttgtatttgttcaccttggcaaagacgttggttcaatcatacacgtacaactaacttttacgtaaaaccaaaaaaaaaaaaaactaacaagactagtccaacggacgacctaacgacgggtaggtaaggtg

SEQ ID NO: 1743 - DNA, 998 bp, Saccharum officinarum
tacttctaccccaagacgaactcggtgaactctttccggttcgttcctccccgtgcctatatacgcccgtttctctctcctcgcgcaacatcggagcaccacacaagcgaggaatccagtcaagtcccggcaatggagtgcgttctgggcgtggttggccgcgacttcgcggtggtggcggccgacacctccgccgtgcagagcatcctcgtccacaagaccgacgaggacaaggtgatggtcctcgactcgcacaagctgatgggcgcttcaggggagcctggtgaccgggtgcaatttacggagttcatacagaagaacctccacctgtaccagttccgcaacaccatcccgctctcaaccgccgccgccgccaacttcacacgcggcgagctcgccacagcccttcgcaagaatccatatatggtcaatattattcttggtggttatgacaaggatgttggcgcttccctgtactacatcgactacattgcaaccttgcacaagattgacaagggtgcttttgggtacggatcatatttctgcttgtctctgatggacaagttgtaccacccggacatgactgttgaggaagcagtagatcttgttgacaagtgcattaaggagattcggctgcgactggttgttgcgccccagaactttgtgatcaagattgtcgacaaggacggggcgagggagtacgcgaggcgtgaactcatcggcgacaatgcacctgttgatgctgcaatcacagttgctgcctgaggcatgaacttgttggaagttgaactgtgttaattgttttctcagcgaggctacttatgtaatcacaggatactggtgggggtcccacaactgttttatcaatttttagcccagacgtgtgtaattctgtttctgcactattcatgtctttgctgaacaaaaaaaaaaaaaaaaaaaggcggcccggttttgaaggatcaaggctaccttaccgctgcatgccacgtaataag

SEQ ID NO: 1744 - DNA, 887 bp, Triticum aestivum
caatcaaggattccagtccagtcctgccaatggagtgcgttttgggcttggttggccgcgacttcgcggtggtggcggccgacacctccgccgtgcagagtatcctcgtccacaagactgacgaggacaaagtaatggtcctcgactcgcacaagctgttgggcgcttcaggggagcctggtgaccgggtgcaatttacggagttcatacagaagaacctccacctgtaccagttccgcaacaccatcccgctgtcaaccgccgccgccgccaacttcactcgcggcgagctcgccacagcccttcgcaagaatccatatatggtcaatattattcttggtggttatgataaggatgttggtgcttccctgtactacattgactacattgcaaccttgcacaagattgacaagggcgcttttgggtacggatcatatttctgcttgtctctgatggacaagttgtaccgcccggacatgactgttgaggaagcagtagatcttgttgacaagtgcattaaggagattcggctgcgactggttgtcgcgccccagaacttcgtgatcaaaattgtcgacaaggacggggcgagggagtacgcaaggcgtgaactcgtcggcgacaatgcacctgttgatgctgcaatcacagttgctgcctgaggcatgaacttgttggaagttagactgtgttaattgtgttttctcagcgaggctacttatgtaatcacaggatactggtgggggtcccacaactgttttatcaatttgagcccagacgtgtgtatttctgtttctgcactattcatgtctttgctgagtacaagtttacaactagtgtttaacgcttgacaatgctgcatgtgcaccatttatgataactgaaat

SEQ ID NO: 1745 - DNA, 1079 bp, Zea mays
attcaaacattattgaagccccctgcaaccaacaccgcaaacagagctgccaggagtccaggacatcaggccccagaaaaaagtccgaacgcatctcttctttctactttcttgtaacccaagacgaactcggtgaactctttctcctcgcgcagcaccggagcacaatcaaggattccagtccagtcctgccaatggagtgcgttttgggcttggttggccgcgacttcgcggtggtggcggccgacacctccgccgtgcagagtatcctcgtccacaagactgacgaggacaaagtaatggtcctcgactcgcacaagctgttgggcgcttcaggggagcctggtgaccgggtgcagtttacggagttcatacagaagaacctccacctgtaccagttccgcaacaccatcccgctgtcaaccgccgctgccgccaacttcacacgcggcgagctcgccacagcccttcgtaagaatccatacatggtcaatgttattctcggtggttacgataaggatgttggcgcctcactgtactacatcgactacattgcgaccttgcacaagatcgacaagggcgcttttgggtacggatcgtatttctgcctgtctctgatggacaagctgtaccgcccggacatgaccgttgaggaagcggtagacctcgttgataagtgcattaaggagatccggctgcggctggttgtggcgccccagaacttcgtgatcaagatcgtcgacaaggacggggccagggagtacgcgaggcgtgaactcgtcggcgacagtgcacctgctgaagctgcagctacggttgccgcctgaggcatgaaacttgtttgtgttagttgtttgtttctcagcgaggctactatgtaatcaaatggatactggtgggggtcccacagctgttttttaatcaattttagcccagacatgtaattctgtttctgcactaattcatgtcttcgccgagtacaagttgacacggagtgtgtggcgcttgacattgctgtgcaccatttctgatcactgaaatgaacataaaatctgtgccaacgtccaacggtgcgcagc

SEQ ID NO: 1746 - DNA, 1017 bp, Zea mays
cgtcacactgctgcgaaggacaccaggcccgccgaaaattgtgtgaacgcccctttcttctaccccaagacgaactcggtgaactctttccggttcgttcccctacgcccgtttctctctcgtcgcgcaacatcagagcacaagcgaggaacccagtccagtcccgggaatggagtgcgtattgggcgtggttggccgcgacttcgcgctggtggcggccgacacctccgccgtgcagagtattctcgtccacaagaccgacgaggacaaggtgatggtgctcgactcgcaaaagctgatgggcgcttcaggggagcctggtgatcgggtgcaatttacggagttcatacagaagaacctccacctgtaccagttccggaacaccatcccgctctcaaccgccgccgccgccaacttcacacgcggcgaactcgccacagcccttcgcaagaatccatatatggtcaatattattcttggtggttatgataaggatgttggtgcttccctctactacatcgactacattgcaaccttgcacaaaattgacaaaggtgcttttgggtacggatcatacttctgtttgtctcttatggacaagttgtaccacccggacatgactgttgaggaagcagtagatcttgttgacaagtgcatcaaggagattcggctgcgattggttgtcgcgcctcagaactttgttatcaagattgttgacaaggacggggcgagggagtacgccaggcgtgaactcgtcggtgacaatgcacctgctgaagctgcaaccgcagttgttgctgcctgaggcatgaactcgtttgaggttggaatgtgttagttgtttctcagcgatgctacttatgcgatcacaggatactggtggggggcccacaactgttttatcaattttagcccagtcgtgtaattctgtttctgcactattcatgtctgctgagtacaagtagtgtttcacgcttgaacaaatacaatactgttgctgtgcaccttttctgatca

SEQ ID NO: 1747 - DNA, 967 bp, Panicum virgatum
gccacggtacccgtgtctctcacaccttgcgcggcatcggagcactagcgaagaaaatccagtccagccccagcaatggagtgcgtcctgggcgtggtcggccgcgacttcgcggtggtggcggcggacacctccgccgtgcagagcatcctcgtccacaagacggacgaggacaaggtgatggtcctcgactcgcacaagctgatgggcgcctcgggggagcccggcgaccgggtgcaattcacggagtacatacaaaagaacctccacctgtaccagttccgcaacaccaccccactctccaccgccgccaccgccaacttcacccgcggcgagctcgccacagccctccggaagaatccatacatggtcaacgttatacttggtggttatgataaggatgttggtgcttccttgtactacatcgactacattgcaaccttgcacaagattgacaagggtgcttttgggtacggctcctacttctgtttgtccctaatggacaaactgtaccacccggacatgactgttgaggaagcagtagatcttgttgacaagtgcatcaaggagatccggctgcggttggtcgttgcgcctcagaacttcgtgatcaagattgtggacaaggatggggcgagggagtatgcgaggcgtgagctcgtcggcgacaacgcatcagcatcagcgggagctgcagcaactacagttgccgcctgaggcgtgaactcgttggagcttgcatattgttaattgtttctgagtgctgctactatgtaatcacaagatactttgggatcccagaactgtttttgtcaattctagcccagacgtgtaactctgtttctgcacttttcatgtctttgccgagtacaaggtagtgtttctctcttacaatgctgtgtgcctgtcttgcccgcttgttctgatttctgaacactgaaataaacagaatctgtgccagctccgc

SEQ ID NO: 1748 - DNA, 921 bp, Cenchrus ciliaris
cgaagcacaagcgaggaatccagtccacagcaccagcaatggagtgcgtcttgggcgtggtcggccgcgacttcgcggtggtggcggcggacacctccgccgtgcagagcatcctcgtccacaagacggacgaggacaaggtgatggtcctcgactcgcacaagctgatgggcgcttcgggggagcccggcgaccgggtgcaattcacggaatacatacagaagaatctccatctgtaccagttccggaacaccatccctctctccaccgccgccaccgctaacttcactcgcggcgagcttgccacagccctgcggaagaatccatacatggtcaacattatactcggtggttatgataaggatgttggtgcttccctgtactacatcgactacattgcaaccctgcacaagattgacaaaggtgcctttgggtacggctcctatttctgcttgtcgctgatggacaagttgtaccacccggacatgactgtggaggaggcagtggatcttgttgacaagtgcattaatgagatccgcctgcggctagtggttgcaccccagaacttcgtgatcaagattgtggacaaggacggggcgcgggtgcttgcgaggcgcgagctcgttggagacagcgcatcagcgggagctgcagccgctaccacggttgccgcctgaacgcgttagcttgttggcggttggacattgttcattgtttctcagcgctgctactatgtaaccacaagatacttttggggtcccagaactgtttttatcaattctagccccaggcgtgtaactctgtttctgcactttttcatgtctttgctgaatacaagtagtgctttacgctttacaatgttatgtgcatgcttgttgtgaagtgtgaggcagtgaaattaacagaaaacatctgtgccaa

SEQ ID NO: 1749 - DNA, 987 bp, Pennisetum glaucum
cagcaatggagtgcgtcttgggcctgaactctgcctgttcctctctccctgttcctctatatacgactcgcctcgtcgccacggttacccgtttctctctctcctcgcgcagcatcggagcacaagcgaggaatccagtccagccccagcaatggagtgcgtcttgggcctggtcggccgcgacttcgcggtggtggcggcggacacctccgccgtgcagagcatcctcgtccacaagacggacgaggacaaggtgatggtcctcgactcgcacaagctgatgggcgcttcgggggagcccggcgaccgggtgcaattcacggagtacatacagaagaacctccacctgtaccagttccgcaacaccatcccgctctccaccgccgccaccgccaacttcacccgcggcgagctcgccacagccctgcggaagaatccatacatggtcaacgttatacttggtggttatgataaggatgttggtgcttccctgtactacattgactacattgcaaccctgcacaagattgacaaaggtgcctttgggtacggctcctatttctgcttgtcgctgatggacaagttgtaccacccggacatgactgtggaggaggcagtggatcttgttgacaagtgcattaaggagatccgcctgcggctagtggttgcgccccagaacttcgtgatcaagattgtggacaaggatggggcgagggagtatgcgaggcgtgagctcgttggtgacagtgcatcagcggaagctccagccacaaccacagttgccgcctgatgcgtgagcttgttggtggttggacagttcattgtttctcacagccgctactatgtaaccacaagatacttttggggtccaagaactgtttttatcaatttagcccaggcgtgtaactctgtttctgcacttcatgtctttgttttgtactagtgcttgccgctttacaatgttgtgcgcctgctcttgttctaaaa

SEQ ID NO: 1750 - DNA, 1131 bp, Setaria italica
agaaggcctagcccacaatccaaacttcgtcgagcctttgggctttgtcgtctcggtttccctttcttctttcttctaccccaagacgaactcgttcactcgtcctgaactcttccggttcctcccgtgtcctctatatacgactcgcctcgtcgccccggtacccgttcctctatcctcgcgcagcatcggagcacaagcgaggaatccagtccagccccagcaatggagtgcgtcttgggcttggtcggccgcgacttcgcggtggtggcggcggacacctccgccgtgcagagcatcctcgtccacaagacggacgaggacaaggtgatggtcctcgattcgcacaagctgatgggcgcttcgggggagcctggcgaccgggtgcaattcacggagtacatacagaagaacctccacctgtaccagttccgcaacaccatcccgctatccaccgccgccaccgccaacttcacccgcggcgagcttgccacagccctgcggaagaatccatacatggtcaacgttatactcggtggttatgataaggatgttggtgcttccctgtactacatcgactacattgcaaccctacacaagattgacaaaggtgcctttgggtacggctcctatttctgcttgtcgctgatggacaagctgtaccacccggacatgactcttgaggaggcagtggatcttgttgacaagtgcattaaggagatccgcctgcggctggtcgttgctccccagaacttcgtgatcaaggttgtggacaaggatggggcgagggagctcgcgaggcgtgagctcgtaggcgacagtgcatcagcggaagctgcagcagcaaccacagtggccgcctgaggcgttaacccgttggcagttggacattgttcattgtttctcagcgctgctactatgtaaaccacaagatacttttggggtcccagaactgtttttatcaattctagcccaggcgtgtaactctgtttctgcacttttcatgtctctgctgagtacaagtagtgcttcccgctttacaatgctgtgtgcctctgcctgtgtgcttgttctgaacactgaaattaatcccaaaaaaaattaatctaatgtgctacttgttcaacatcc

SEQ ID NO: 1751 - DNA, 1591 bp, Panicum virgatum
gatagcagaactgatattccatagggttcgtgatgttgcaccaaacaaggctatgttttgtttaagcttcaagctacccatgcagtgtttgaaggaggacaatgaaaatcacattcaatcagttgtctagcagacgccgccatactttgatgcctacgttttaactgttccgcctatggtttttggagctttactaaagaaactggaactgtgctggtaattctggggttagctgctgtagatagatctgaatcaccatttcgtgctgaagacacattaccagattatttctgatgctctgatgatcagctttgatatagccacggaagatgctttggtggctgcaatcaggacgttggtagtagcaccatctaattctgaagcatggtaccattggtttacaggaagtgcacggttatgctgtttttgcaaggatttgtatcttcagctcatctcgactccaaagctttatcagtaatcaagtttagtttagttttttttttttgccatgtaaaaggcgtcgcagaacatccaaagtgtatgccttgtcaaggatttgcagagaataatatggtcagaattcacagaaaaaaaaaaaaaaaacaaaaacaaaaaacaaaaaaaaaaaaaaacgacgccgtcgccctctcctcgtcgccacggtacccgtttctctcacacctcgcgcagcatcggagcactagagaggaatccagtccagcagcccaagcaatggagtgcgtcctgggcgtggtcggccgcgacttcgcggtggtggcggcggacacctccgccgtgcagagcatcctcgtccacaagacggacgaggacaaggtgatggtcctcgactcgcacaagctgatgggcgcctcgggggagcccggcgaccgggtgcaattcacggagtacatacagaagaacctccacctgtaccagttccgcaacaccaccccgctctccaccgccgccaccgccaacttcacccgcggcgagctcgccacagccctccggaagaatccatacatggtcaacgttatacttggtggttatgataaggatgttggcgcttccttgtactacatcgactacattgcaaccttgcacaagattgacaagggtgcttttgggtacggctcctacttctgtttgtcgctaatggacaagctgtaccacccggacatgactgttgaggaagcagtagatcttgttgacaagtgcatcaaggagatccgtctgaggttggtcgttgcgcctcagaactttgtaatcaagatcgtggataaggatggggcgagggagtatgcgaggcgtgagctcgtcggtgacaacacatcagcatcagcatcagcgggagctgcagcaactacagttgccgcctgaggcgtgaactcgttggagctcgcatattgttaattgtttctcagcgctgctactatgtaatcacaagatactttgggggtcccagaactgtttttatcaattctagcccagacgtgtaactctgttgtttctgcacttttcatgtcttcgctgagtacaaggtagtgtttctcccttacaatgctgtgtacctgtctgtgcgcttgttctg

SEQ ID NO: 1752 - DNA, 876 bp, Avena sativa
caaatacctctctcgccgtctgctcccccaaatctctcttccttcccccacacaaaccccagtcgaaccagcgtaggcggaggcgatggagtgcgtcctcggcgtggtcggccgcgacttcgcggtggtggcggcggacacgtccgcggtgcagagcatcctcgtgcacaagacggacgaggacaagatcatggtcctcgactcccacaagctcatgggcgcctccggggagcccggcgaccgcgtgcagttcaccgagttcatccagaagaacctccacctctaccagttccgcaacaacatgccgctcagcaccgccgccacagccaacttcacccgcggcgagctcgccaccgccctgcggaagaatccctactctgtaaacatcctacttgcagggtttgatgaagatgttggtgcatcgttgtattacatcgactacattgcaacactacacaaaattgacaagggtgcattcgggtatggttcgtacttctgcctgtcactgatggacaagctgtaccatcctgacatgactgttgacgaggcggtggaccttgttgacaagtgcatcaaggagatcagactccggttggtggttgcgcctcagaatttcgcaatcaagatcgttgacaagaatggtgccagattccatgcgaggcgtgagatcgtaggcgacagtccagttgaagctgcaaccgcaccaactactgcctgaggtggccctgttggcggtcatttggatggagctgtgttaattgtttccgagtactgtcacaatgtaatcgcaaaacgtttggatttgagaactgtgttgcaatttctcccagacattgactagtctgtttatgccctacaccttatatgtctcagttt

SEQ ID NO: 1753 - DNA, 1193 bp, Secale cereale
gtgggggaccgaagccgggctcgactccagtccccccaaattacaacccctctcgccgtctgctcgcccgtccgtccgtcccccaaatccacctccctccccgccccacgaaccccagcggcgatggagtgcgtcatcggcgtggtcggccgcgacttcgcggtggtggcggcggacacgtccgccgtgcagagcatcctcgtccacaagacggacgaggacaagatcatgctcctcgactcccacaagctcatgggcgcctccggcgagcccggcgaccgcgtgcagttcaccgagttcatccagaagaacctccacctctaccagttccgcaacaacatgccgctcagcaccgccgccaccgccaacttcacccgcggcgagctcgccaccgccctccgcaagaatccctactctgtaaacatcatacttgcagggtttgataaagacgctggtgcatcgatgtactacattgactacatcgctacgctccacaaaatcgacaagggagcgttcggatacgggtcatacttctgtctgtcgctgatggacaagttgtaccgccccgacatgactgttgaggaagcggtggaccttgttgacaagtgcatcaaggagatcaggctccggctggtcgtcgcgcctcagaattttgccatcaagatcgtggacaaggatggcgccagggactatgctaggcgtgagatcggaggtgacagtcctgcagccgcaagcgcaacaatagcagcaactgcctgaggtgattggccctgtcggtggtcatttggctggctggaggctgaacccttcctgttaattgtttccgagtgctgtcacctatgtaatcgcaatacgtttcggttccagagctgtgttgcaaattctcccagacgtggactagtctgtttatgacccctatttcatggttatatgtttcactgttccttgctatcggatgccgtgctccgggtatttcggacttcctgttcatgactgctgctgcttattattgttgtgctgctgtcgatgctgagaattctaaaagtaaaaaaaagtaaaaaaaaaaaaaaaaaaaaaaaacaaaaaaaaaaaaaaaaacaaaaaaaaaaaaaacaaaaaaaaaaacaaaaaaactaaaaagaacgaactaacgaacgaacgaacgaacgaacggaaggaaggtaaggagacat

SEQ ID NO: 1754 - DNA, 1039 bp, Secale cereale
ggctcgactccactccccccccaaattacaacccctctcgccgtctgctcgctcgcccgtccgtcccccaaatccacccctcctcccccacgaaccccagcggcgatggagtgcgtcatcggcgtggtcggccgcgacttcgcggtggtggcggcggacacgtccgccgtgcagagcatcctcgtccacaagacggacgaggacaagatcatgctcctcgactcccacaagctcatgggcgcctccggcgagcccggcgaccgcgtgcagttcaccgagttcatccagaagaacctccacctctaccagttccgcaacaacatgccgctcagcaccgccgccaccgccaacttcacccgcggcgagctcgccaccgccctccgcaagaatccctactctgtaaacatcatacttgcagggtttgataaagacgctggtgcatcgatgtactacattgactacatcgctacgctccacaaaatcgacaagggagcatttgggtacgggtcgtacttctgtttgtcgctgatggacaagttgtaccgccccgacatgactgttgaggaagcggtggaccttgttgacaagtgcatcaaggagatcaggctccggctggtcgtcgcgcctcagaatttcgccatcaagatcgtggacaaggatggcgccagggactatgctaggcgtgagatcggaggtgacagtcctgcagccgcaagcgcaacaatagcagcaactgcctgaggtgattggccctgtcggcggtcatttggctggctggaggctgaacccttcctgttaattgtttccgagtgctgtcactatgtaatcgcaatacgtttcgattccagagctgtgttgcaaattctcccagacgtggactagtctgtttatgacccctatttcatggttatatgtttcactgttccttgctatcggatgccgtgctccgggtatttcggtcttcctgctacaaaataaaaaaaaaaaaacaaaaaaaaaagacgtactgtcgtgtctacacctccgtcttgagactcgt

SEQ ID NO: 1755 - DNA, 898 bp, Cynodon dactylon
gccgggggagaacaaactcctttcgcttctcagccctcggtcgcgacggtactctctctctctctctctctctctctcgtcgacgtgaaatcgaaccaccggcagctcctctctccttaaaggcgcggcggcggcggaggcggcggcgagtccacgatggagtgcgtcataggcgtggtcggccgcgactttgcggtggtggcggcggacacctccgccgtgcagagcatcctcgtgcacaagacggacgaggacaaggtcatggtcctcgactcgcacaagctcatgggcgcgtccggggagccgggggacagggtgcagttcacggagtacatacagaagaacctccacctgtaccagttccgcaacaccatcccgctctccacggccgccaccgccaacttcacccgcggcgagctcgccaccgccctgcgcaggaatccgtatatggtcaatgttatactggctggatatgataaggatgttggcgcttccatgtattacattgactacattgcaacattgcacaagattgagaaaggtgcttttggttacgggtcttacttctgtttatcgttgatggacaagttgtaccacccggacatgactcttgacgaagcagtagatctcgttgacaagtgcatcaaggagatccgactccggttggttgttgcgcctcagaattttgtgatcaaggttgtggacaaggacggggctaaggagtatgcaaggcgtgaatacattagtgacagtcccccagatgctgctgctgctgcaactgaagcataataaggtgtttactcttttgagttgttggaccccttgctgcaggttgaacctttgtgttgaactgttaattgtttcccagactgctatgtaatcgcaagtacttgacctg

SEQ ID NO: 1756 - DNA, 3909 bp, Oryza sativa
ccaaagcaaaaaatttttgccctgtaaaccgggcctaaacacggaccggcccactaaaacccaaactgctcttccgccctcctcaccccgattctttcttgcacccgaagacgaagcgaactcaactcctttatacacctcttctctctcctcccctctcgctcccgtttcttctcacatcggcgagttcgcaacctcctccctccaggctccacttcccagacgaatcggcggcagcggcggcggcggcggtgatggagtgcgttatcggggtcgtcggccgcgacttcgcggtggtggccgccgacacatcggcggtgcagagcatcctggtccacaagaccgacgaggacaaggtgatggtgctcgacagccacaagctgatgggcgcgtccggagagcccggcgaccgggtgcagttcaccgagttcatccagaagaatctccacctgtatcagttccgcaacaacatcccgctcagcaccgccgccaccgccaatttcacccgcggcgagctcgccaccgccctgcggaagaatccgtactatgtcaacgtgttgcttgctggatatgattcggatgttggtgcctctttgtattacattgactacatcgcaacattccataagatcgaaaagggtgcctttgggtatggctcctacttctgtctctcgctgatggacaagttatatcgtccagacatgtcagtcgaggaagctgttgatcttgttgacaagtgcattaaagaaattcggctcaggttggtcgttgctcctcaaaacttcataatcaagattgttgataaagagggtgctagggagtatgccaggcgtgcatacaccgacagtccaccggaagctgcaacatcagaagctgcaactgtagcagcctgagttgtatctgccatatgggtgtgaaccttaggtttccgagtacaattgctatgtaatcacaagtactgggatctgagaactttgttgcaaatttacttcctcttttatttgtgttatttatctgtttaactgtttcatgttcgtgaatgctgtgcaactggattttatagacatctttctagttcctcctgttcccacagttgcaagagctgcggttttctgaatattgctgagatttgtgtgatgcgtaaaatatatggatcgagcaacgcatgtgtctgaactgaaacatcgcaagggttagaaacaaaacatcacgagatcacttgtcttcccacagcagaaaaaaaaaaatgcaacattgcgtgacagattcaagtaccatatccatgaaggcggatgcaccgagcagaattggtattcaactatgtgtcggcattctatttacaaagactgtcaggaaagactaccgtacaattgtgttgcgagaatgatgtaggccaattttttttacgttacctatctttacaacacaacctgagctatagttaataagctgaaatacggcaaaaatgaatctaaaatgcatccttcataggggtcttaaaagcgggtaatcttcgagcagctctcgttctgacaatgtgtcattctcattttgtggagtccatagtacctcaactgcctgcagagaaaaacaagagaataaaaataagaaacgtcaatattacaacgtaatcatatcaacagaggtagataatcagttaatcaaccggttttttaatcataatgctcattgaatgttcattacaacgagataaagatttgctgcaacttccatttgcagagtttcagtctaccagcgttcttcaaggttaatgtactagataaatatattgcatactgaagtggaacaagatttttccttttcgataataaaagctttattgaactcagcccattacgtcaatgtggaacaagtttgtagtgtcagcagatcgctgcttatatttatgttttatttcaatgaaattggaatgccatgaacagaagaataagaacatcaaaggaacaagcagggtaccagtatttttcttgatggtatggcaccaagcttctgtagagctgtcttcaagtcaccgctgccatttatactgggtagcttatgtacaccctcagcagcaaccaatatggttatctacggataagaagcaaaagcatataagatattgcatgatgattgctagcaacacaggtaatcagaaacattttatcgatcaaacctacaaatgctggaattagaacatgaaaaccccaggaacaccagaatagtgctatatgactggaattatagtgttctttaaatgtaaattgaaatgataaaagggatcctacatggtatcatcgtagtagctcaaaaagaatttgctactaatgctagattgctagccaataaatcactactccattataaatgaaagttcttgagtaacaacaatttgtgcttcatagcagttcaaaatattgatattaaagtacaaaagaagtaaagaacagtatgggtaaggcaatatcactaataggggctatatcatgacagaatcttccaatgccatccattatttttattctactaggtgaaaatatacaaaatatcaatcactcatcagtaatgggggctatatcactaatgaagttcccatgttaccggccattgcatgatgtcaagtatcacataaaagggaacgccttgatctgatcacctgatcaccttttcctaaagaaaaaaacataccacaatgtactcgttgctaaaaccgctcgatctttggctgcctgctttctgcctcttgatgctgttcacattcacaagtgtctcttcatcaaatttgcctctttcctcaattgatagttgattaaaacgtttctccccatcatctatacttcttttcacatcaacctttagaacaaatattaaaaatatatacagtaaggagcttgtcaaaattcaaatctatatgacctggcaacaaatgattactacatgatatagtggccgcgcatgttatacattatgcctatagattatataaagaacacatataacatttcaaacatttcttttcatttttctgggagcgatagtaaaacttaattacattctattgaaggatgaatagaagaataagatgatttcagtaataatacattggaagagtgaagggtaagtgataaataaaaactcaaggacaaagtatgcatactgatgagtaagctgagatgcagcaatctggatgccgaagtaatgccaatgttgtctctgcaaaacagaagaaaagaaccatagttcagatgatttcaacgcaatagtaaaaaatcttaagaaaatatcataatatcatatcttggtatttttcattcaaaatgaattgcagtgtaatgcaggttggacactttgactacatagctacattatcactaacaattttatttcaggagcatgtataaccgccaacaaacacaactagtaaaaaaccaccattttctttttatttttacatattgctctccaaaaccaaaaccccctcctgatatccattatagatgaaactttgccggccaatatgaaaatgatctttctgaacaaaccaaggtagataaactcagtcatctgctactcaaacatagcactcaaaataaggcactcaaaataaaagcggtatattgacatcaagtgacagcaataagagccaaaagaaacagaactatgccatttcaaaatatctacaccataaaattactctgaagtagaatgaagcagcatatatgatctgatagctttggttttaccagttagcacatagctcagccctgccggggtagaagtatctgccttctcagctatctgatcaagctctttctgaaatgatctggccatgcccagcaaaccaacctaggaacatacttataggttagaaagtaaaaaaaaaaaaaaactgattcctcttcaatcccc

SEQ ID NO: 1757 - DNA, 1193 bp, Hordeum vulgare
aaggcagcccagcccagcccagcgaggcccaaagtcctcgtccctctcggacgtgactgactctctcggctcgttcctttctttcttgggaccgaagccggactcgccttcgcctccagtccagtcccccaaattacaacccctctcgctcgcccgtccgtccccaaatctctcccccctcacgaaccccagccgaaccagcagcggcgtcgccggcgatggagtgcgtcatcggagtggtcggccgcgacttcgcggtggtggcggcggacacgtcggccgtgcagagcatcctcgtccacaagacggacgaggacaagatcatgctcctcgactcccacaagctcatgggcgcctccggcgagcccggcgaccgcgtgcagttcaccgagttcatccagaagaacctccacctctaccagttccgcaacaacatgccgctcagcaccgccgccaccgccaacttcacccgcggcgagctcgccaccgccctccgcaagaatccctactctgtaaacattatacttgcagggtttgataaagatgccggtgcatcgatgtactacattgactacatcgcgacactccacaagatcgacaagggagcatttgggtacgggtcgtacttctgtttgtcgctgatggacaagttgtaccaccctgacatgactgtcgaggaagcggtagaccttgttgacaagtgcatcaaggagatcagactccggctggtcgtcgcgcctcagaatttcgccatcaagattgtggacaaggatggcgccagggactatgctaggcgtgagatcggaggtgacagtcctgcagccgcaaccacagccgcaacagtagcaacaactgcctgaggtgatcggccctgtcggtggtcatttgtctggctggaggctgaacccttcctgttaattgtttctgagtactgtcactatgtaatcgcaatacgtttcggtttgagaactgtgttgcaaattctcccaggcgtggactagtctgtttatgacccccttttcatggttatatgttttactgtttcttgctctcaaatgctgtggtttggttatttcggactttctgcttatgtctgctgctgcttattactgtcccttgtgatgttgttgatgttgagaatttgcatataatgcatgctgcggtgtccatctgttaaatctaaaatggtgctg

SEQ ID NO: 1758 - DNA, 1017 bp, Triticum aestivum
ctctctcgccgtctgctcgctcgctcgtcccccaaatcccaccccctccccgaccgaaccccggcggcgtcaccggcgatggagtgcgtcatcggcgtggtcggccgcgacttcgcggtggtggcggcggacacgtccgccgtgcagagcatcctcgtccacaagacggacgaggacaagatcatgctcctcgactcccacaagctcatgggcgcctccggggagcccggcgaccgcgtgcagttcaccgagttcatccagaagaacctccacctctaccagttccgcaacaacatgccgctcagcaccgccgccaccgccaacttcacccgcggcgagctcgccaccgccctccgcaagaatccctactctgtaaacatcatacttgcagggtttgataaagacgctggtgcatcgatgtactacattgactacatcgcgacgctccacaagatcgacaagggagcattcgggtacgggtcgtacttctgtttgtcgctgatggacaagttgtaccgccctgacatgactgtcgaggaagcggtagaccttgttgacaagtgcatcaaggagatcagactccggctggtcgtcgcgcctcagaatttcgccatcaagatcgtggacaaggatggcgccagggactatgctaggcgtgagatcggaggtgacagtcctgcagccgcaaccgcaaccgcaacaatagcaacaactgcctgaggtgattggccctgtcggtggtcatttggctggctggaggctgaacccttcctgttaattgtttccgagtactgtcactatgtaatcgcaatacgtttcggttcgagaactgtgttgcaaattctcccagatgtggactagtctgtttatgacccccatttcatggttatatgtttcactgtttcttgctatcgaatgctgtgttccgggtatttcggacttcctgcttatgactgctgctgcttattactgttgagctgttgtcgatgctgagaatttgtgtataatgcgtgctgc

SEQ ID NO: 1759 - DNA, 1040 bp, Pseudoroegneria spicata
  misc_feature (128)..(128): n is a, c, g, or t
  misc_feature (604)..(604): n is a, c, g, or t
  misc_feature (683)..(684): n is a, c, g, or t
  misc_feature (699)..(699): n is a, c, g, or t
  misc_feature (911)..(911): n is a, c, g, or t
  misc_feature (917)..(917): n is a, c, g, or t
aaattacaacctctctcgccgtctgctcgctcgcccgtcccccaaatctccccgtcttccccacgaatccccagcggcgtcaccggcgatggagtgcgtcatcggcgtggtcggccgcgacttcgcgntcgtggcggcggacacgtccgccgtgcagagcatcctcgtccacaagacggacgaggacaagatcatgctcctcgactcccacaagctcatgggcgcctccggcgagcccggcgaccgcgtgcagttcaccgagttcatccagaagaacctccacctctaccagttccgcaacaacatgccgctcagcaccgccgccaccgccaacttcacccgcggcgagctcgccaccgccctccgcaagaatccctactctgtaaacatcatacttgcagggtttgataaagatgctggtgcatcgatgtactacattgactacatcgcgacactccacaaaatcgacaagggagcatttgggtacgggtcgtacttctgtttgtcgctgatggacaagttgtaccgtcctgacatgactgttgaggaagcggtagaccttgttgacaagtgcatcaaggagatcagactccggctggtcgtngcacctcagaatttcgcgatcaagattgtggacagggatggcgccagggactatgctaggcgtgagatcggaggtgacnntcctgcagccgcaancgcaacaatagcaacaactgcctgaggtgattggccctgtcggtggtcatttggctggctggaggctgaacccttcctgttaattgtttccgagtactgtcactatgtaatcgcaatacgtttcggtttgagaactgtgttgcaaattctcccagatgtggactagtctgtttatgacccctatttcatggttatatgtttcactgtttctngctatngagtgctgtgctccagctattttggacttcatgcttatgactgctgctgcttattactgtcccttgtgatgttgttggtgttgagaatttgcatataatgcatgctgtgtcgttcatctgtta

SEQ ID NO: 1760 - DNA, 1210 bp, Brachypodium distachyon
agcccaccgaagcccaaacttcgcttaccctcggttcgttctttcttgcaaccgaagccgagctcgactccgctataccctcctcgctcgccctctgctctcttctgtgttctcccaaatctctccgtgcgttcgttcccctcaaacccctcagccgaaccagcggaggcgaaggcgatggagtgtgtgattggcgtggtcggccgcgacttcgcggtggtggcggcggacacctccgccgtgcagagcatcctcgtgcacaagacggacgaggacaagatcatgctcctcgactcccacaaactgatgggcgcctccggggagccaggcgaccgcgtgcagttcaccgagttcatccagaagaatcttcatctctaccagttccgcaacaacatgccgctcagcaccgccgccaccgccaatttcacccgcggcgagctggctacggccctgcggaagaatccctactctgtaaacatcatacttgctgggtttgatgaagatgttggtgcatcaatgtattacattgactacatcgctacactacacaaaattgataagggagcatttggttatgggtcatacttctgtttgtcactgatggacaagttgtatcgtcctgatatgactgtcgaggaagcggtggaccttgttgacaagtgcatcaaggagatcagactccgattggtcgttgcgccacagaattttgcgatcaagattgtggacaaagatggtgccagggactatgggaagcgtgaaagtgtgagtggcaatccatctgaatctacaaccgctacaactgcctgaggtagttcgccctgttggtggtcatttggctggaggctgaaccatcctcacaattgtctctgggtactgtcactatgtaatagcaatacatttggatttgagaactgtgttgcaaattatgtttatgcccctttgtcatggtaatctctttcagcgtttcttgttcttgaatgctttgcacctgggtattttacacttgccagttatgctcatatcctcagtaatggatggttgctgtttattgttgttactacatttgtttcaaaatataagatgtttaagttttatcctaagtcaaacttcttaaaatttgaccggctttatagaacaatgtattactccctctgatacatattaattgtcgaaatattacatgtacgtagacgttttttaggcatagata

SEQ ID NO: 1761 - DNA, 1621 bp, Eragrostis curvula
  misc_feature (56)..(56): n is a, c, g, or t
  misc_feature (60)..(60): n is a, c, g, or t
  misc_feature (76)..(76): n is a, c, g, or t
  misc_feature (95)..(95): n is a, c, g, or t
  misc_feature (116)..(116): n is a, c, g, or t
  misc_feature (516)..(516): n is a, c, g, or t
  misc_feature (560)..(560): n is a, c, g, or t
  misc_feature (635)..(635): n is a, c, g, or t
  misc_feature (637)..(637): n is a, c, g, or t
  misc_feature (652)..(652): n is a, c, g, or t
  misc_feature (665)..(665): n is a, c, g, or t
  misc_feature (691)..(693): n is a, c, g, or t
  misc_feature (695)..(695): n is a, c, g, or t
  misc_feature (704)..(704): n is a, c, g, or t
  misc_feature (712)..(712): n is a, c, g, or t
  misc_feature (716)..(716): n is a, c, g, or t
ctagaaccagatcggcacaagacgcaacgctagtttctcttttcttcgcccctcgnaacnaacacagcaactcctnctctcccctaaaggcgcgncggcgaagcaggcggcgggcngcgatggagtgcgtaatcggcgtcgtcggccgcgacttcgcggtggtggcggcggacacctccgccgttcagagcatcctcgtccacaagaccgacgaggacaaggtcatggtcctcgactcgcacaagctcatgggtgcctccggggagcctggtgaccgggtgcagttcacggagtacatacagaagaacctccacctctaccagttccgcaacaccatcccgctctccacggccgccaccgccaacttcacccgcggcgagctcgccactgccctccgcaagaatccgtatatggtcaatgttatactcgctggttatgacaatgatgttggcgcctccctgtattacattgactacattgcgacgttgcacaagattgagaaaggtgcttttgganatgggtcgtacttctgtttatcgctgatggacaagttgtatcgnccggacatgaccaaagaggaagcagtagatcttgttgacaagtgcatcaaggagatccgacttcgattggttgtngngcctcagaatttcgngatcagattgtgnacaaggatggtgctaaggagtatgcnnngngtgaatatnttagcganagtnccccagatgcggcacctgtatctgaagcctgaagtatttgcccctctggttgttggacttcctgctgcaggttgaacctttgtgttaaactgttgattgtttctcagactgcttccatgtaatcgcaagtactggaccatgaaaaatatgctgcgtagtttcagcccagacttttactctgtttctgaatctctctcttctgtttctgggtgttgtttcctcctcgagaacactttgagttcgagcttagttaaatacggtgtgcagcctgcagttctagagaaaaataataaaaaaaaccaaaaaaaaaaataaaaaacaaaaaaaggtattctgctttgaaacccctgcttaatcccatatgaattcccggcccccctggaggttcaaccttattgggaaaactccccaccccgtttgatgcctaacttggataattcaaaagggccccctaaaatagcttggtgtaatcaagggtcaaaacttgtttccttgggtgatattatttatcccctctacatttccactcaccatacaaaccccggaaaacaaaatttgaaaacgccgggggagcgctaagagataagctaactcttactttaatttactttacgccccaagtgcccctctttaaaatactaagaatacttgaccgatggcctgtgagaattaatgtaatctctctaaagatcccagggtaaaatagaggattattggtttatgggagtcaatctctccactttcctatctcatacagataagtacggtatggtcattatcgttttgtgtcgtgacagtaagatgggtatgatctattggccttattctgtaaataatactcattttcaccaacactatttttttcactactcaaactcaacttggatctgttattaattaccttc

SEQ ID NO: 1762 - DNA, 2424 bp, Zea mays
atggagccacgatgtctcaacggaggtgctggtgtctccatggcacgtggggctgcaagatgtaaccacgacttggtggctggcgcatctggtggctgtcatggtgcgactacaatagagtttggggattttttttgtcgtgaggtactgaagtgggctttgtcgcttcgttgggcttcatgcaaggtagccagcagaagtactggggctcacacaagtggcactcctacctatctcgctcaagagacctcttgtgtccgtgcctccgtggtcgcgtcgtccctgagaaccaaccagacggtggacatggtgttcggcggcgaccgtgccatgggagcggcccccggcgccgacgccgcaagcacgatgcggttcgcgttgcacgtcgtgcgcgggcggtggttcatgttcttcgcgtccatcctgatcatggcggcagccggcggcacgtacatattcgccatctattccaaggcgatcaagacgtcgctcgggtacgaccagcagacgcttaacacgctgagcttcttcaaggacgtgggcgccaacgtgggcatcctgcccgggctcatcaacgaggtcaccccgccgtgggtggtgctggcctgcggcgccggcatgaacctggtgggctacctcatgatctacctggccatctccggtcgcacggcgcggccgcccgtgtggctgatgtgcgtctacatcgccgtcggcgccaactcgcagtcgttcgccaacaccggctcgctcgtcaccgccgtgaagaacttccccgaggaccgcggcgtggtgctcggcctgctcaaggggttcgtcggcctcagcggcgccatcttcacccagctgtaccgcgccatctacggcaccgacaacgacggcaccgacctggtgctgctcatggcgtggctccccgctgccatatcgctcgtcttcatccccaccatccgcatcatgccgcggaacaccgccgcgcgcggggagcgcaaagccttcttcctcttcctctacgcctccatcgtgctggcagtgtacttgctcgtcatgaacgtcgttgagctggaggtgatccacttcccgaagccggcgtactacgtcacggccgtggtgcttctccttctcatcttcttcccgatcgtcatcgtcgtgaagcaagaactgaagacgtaccttgcgccgccggagccggcgacagcagcagcaacctccgccgccatcgtgacgatcaccgtaaacgagaagacgcgggcgtcgagcaataacgtggcaccggagtcgaccgatcatcgtcatcaggccacggccgccgccgccgccaacgacgacgcagacagctcgccgtcctgcttccaggacgtgttccggccgcccgcgcggggccaagactacaccatcctgcaggccctgttcagcgtggacatgctggtcctgttcgtggccaccatctgcggcatcggcggcacgctgacggcggtggacaacatggggcagatcgggcagtcgctggggtacccgcagcggtccatcacaacgtttgtgtccctggtgagcatctggaactacgccgggcgcgtggtggccgggttcgcctccgagtacgtgctggcccggtacaaggtgcctcggccgctggcgctcacggtggtgctcctcctggcgtgcgtgggccacgcgctgatcgccttcggcgtcaacaatgggttgtacgcggcgtccgtgatcctgggcttctgcttcggcgcgcagtggccactgctgttcgccatcatctccgaggtgttcgggctcaagtactactccacgctctacaacttcggcgccgtggccagccccgtgggctcctacatcctcaacgtccgcatcgccggccgcatgtacgaccgcgaggcactccggcagggcgggcagcggggaaaggacctcacctgcatcggcgtgcgctgcttcagggagtcgttcctcatcatcaccggcgtcacgttactgggcgcgctcgtgtcgctgctgctggcgtggaggacgaggaacttctaccgtggcgacctttacggacggttcagagaggtcggcatggtcggagcgactgccggaggagcaaatgacagaaaggtgcatgaggccgaggcgagcaccagcggtggtgccagtgactctgacaccaaggacactagtagcagtgagaccgttaatggcagtaaggtctgaattgttgacgtgtgctgtgtctctctcagggttaagtcaagtggcctgaatatatgcatatttgagctagtagtactatgtgcgtgtgatcaccagcgtcgccccgccagcacgcacgaccgcgtcaactgcgtgcgcgcgcacgaagcgtaacctactacgcaccgggccggtccaacggcacgcacggcgtggaggtcccagcgtccggcgagccggcgg

SEQ ID NO: 1763 - DNA, 1915 bp, Setaria italica
gagaaccatcaggcgatcaacgatggtgttcggcgaccgcgccgccacgggcgcgcccggcgccggcgcggcgccggcgagcacgatgcggttcgcgctgcacgtgatgcgcgggcggtggttcatgttcttcgcgtcgatcctgatcatggcggcggccggcggcacctacatcttcggcatctactccaaggcggtgaagtcgtcgctcgggtacgaccagcagacgctcaacacgctcagcttcttcaaggacgtgggcgccaacgtcggcatcctcccgggcctcatcaacgaggtcaccccgccgtgggtcgtcctggcgtgcggcgccggcatgaacctcgccggctacctcatgatatacctcgccgtctccggccgcacggcgcggccccccgtgtggctcatgtgcgtgtacatcgccgtcggcgccaactcgcagtcgttcgccaacaccggcgcgctcgtcaccgccgtcaagaacttccccgaggaccgcggcgtcgtgctcggcctgctcaagggcttcgtcgggctcagcggcgccatcttcacgcagctctaccgcgccatctacggcaccgacaacgacggcgcggaactcgtgctgctcatggcgtggctccccgccgccatctcgctgctcttcatccccaccatccgcatcatgccgcggcgggacgcggccgggcaggagcgcggcagggagcgcagggccttcttcctcttcctctacgcctccatcgtgctcgccatctacctcctcatcatgaacgtcgtcgagctggaggtgatccgcttccccaagccggcctactacgtcacggctgccgtcctcctcctgctcatcttcttcccgatcgtcatcgtcgtcaagcaagagctcaagacctacctccagccgccggcgccggcgatcacgacctcctccatcgtcacgataaccgtcgatcacgagaaaacacacccgtcctcggcccaggtgacaccgccaccggcttctgatcaggccgccgccgccggcacctcgccgtcgtgcttccaggacgtgttccggccgccggcgaggggccaggactacaccatcctgcaggccctgttcagcgtggacatgctggtcctcttcgtggccaccatctgcggcatcggcggcacgctgactgccatcgacaacatgggccagatcggccagtcgctgggctacgcgcagcgctccatcaccacgttcgtctccctggtgagcatctggaactacgccggccgcgtggtctccggcttcgcctcagagcacctcctcgcccgctacaaggtgccccgcccgctggcgctcaccgtagtcctcctcctcgcctgcgtcggccacgggctgatcgcctccggcgtcagcaacgggctgtacgcggcgtccgtgatcctgggcttctgcttcggcgcgcagtggccgctgctgttcgccatcatctctgaggtgttcgggctcaagtactactcgacgctctacaacttcggcgccgtggcgagccccgtgggctcctacatcctcaacgtgcgggtcgccggcaggatgtacgaccgggaggcgctccggcagggcgggcggaaggggcgggacctcacctgcatcggggtgcggtgcttcagggagtcgttcctgatcatcaccggcgtgacgctgctcggcgcgctcgtgtcgctggtgctggcgtggaggacgagggagttctaccgcggggacctgtacgggcggttcagggaggtcggcatggtcggagcggccgccggcgggggaggaggagaggataagaaggtgcgtgaggtagcgagcagcagcggcggtgtcagtgacactgacaccggtaataaggactccactagtaccagtgagagcggcaatggcaacaaggtctgaatt

SEQ ID NO: 1764 - DNA, 2966 bp, Panicum virgatum
taaatgaaagatcctctggggaattccttttgattatccgaattggaagctcagacattccacatcccttactagctcaccacatataagttagccaccacaattacaggagttcagacgagtggcacacgcagctacctcaagcgaaaccctctagtgcgtcgtcgtcccgatcgagaaccaccaggcgacgacgatggtgttcggcgaccgcgccacgggcggccccggcgccgacgccgcgggcacgatgcggttcgcgcggcacgtcgtgcgcgggcggtggttcatgttcttcgcgtccatcctgatcatggcggcggccggcggcacctacatcttcggcatctactccaaggccgtcaagacgtcgctcgggtacgaccagcagacgctcaacacgctcagcttcttcaaggacgtgggcgccaacgtcggcatcctcccgggcctcatcaacgaggtcaccccgccgtgggtggtgctggcgtgcggcgccggcatgaacctggccggctacctcatgatctacctcgccgtctcggggcgcacggcgcggccgcccgtgtggctcatgtgcgtgtacatcgccgtcgggcgtcggcgccaactcgcagtcgttcgccaacaccggcgcgctcgtcaccgccgtcaagaacttccccgaggaccgcggcgtcgtgctcggcctgctcaagggcttcgtcggcctcagcggcgccatcttcacccagatctaccgcgccgtctacggcaccgacaacgacggcgcggagctcgtgctgctcatggcgtggctccccgccgccatctcgctgctcttcatccccaccatccgcatcatgccgcggccgagcgccgcggccgcgcggccgagcggggagcgcaaggccttcttcctcttcctctacgcctccatcgtgctcgccgtctacctcctcgtcatgaacgtggtcgagctggaggtgacccacttccccaagccggcctactacgtcacggccaccgtgctcctcctactcatcttcttcccgatcgtcatcgtggtcaagcaagagctcaagacctaccttcagccgccggcgccagcggcagcgtcctcctccatcgtggcgatcaccgtcgaggacgagaaaacgcacgaagcaccggcgcctgacgatcatcaggccgccgccgccgacagcggcaataacaactcgccgtcgtgcttccaggacgtgttccggccgccggcgaggggccaggactacaccatcctgcaggccctgttcagcgtggacatgctggtcctgttcatggccaccatctgcggcgtcggcggcacgctgacggcggtggacaacatgggccagatcgggcagtcgctgggctacccgcagcgctccatcaccacgttcgtctccctggtgagcatctggaactacgccgggcgcgtggtgtccggcttcgcctccgagtacgtcctcgcccggtaccaggtgccccgcccgctggcgctcaccgtcgtcctcctcctcgcctgcgtcggccacgcgctcatcgccttcggcgtgagccacgggctctacgcggcgtccgtgatcctgggcttctgcttcggcgcgcagtggccgctgctcttcgccatcatctccgaggtgttcgggctcaagtactactcgacgctctacaacttcggcgccgtcgcgagccccgtggggtcctacatcctcaacgtgcggatcgccggccggatgtacgaccgggaggcgctccggcagggcgggcgcagggggcgggacctcacctgcgtcggggtccgctgcttcagggagtcgttcctcatcatcaccggcgtcacgctgctgggcgcgctcgtgtcgctggtgctggcctggaggacgagggagttctaccgcggggacctgtacggccgcttcagggaggtcggcatggtcgggcgcgcggcagctgccggaggagaggacaagaaggtggatgaggtagtaaccagcagcggcggcggtgtcagtgacacggacgccaaggccactagtactagcagcagcagggagagcagcaatggcaacagcaaggtttgatgaattggctaatgaggtgaagaaagaaagattgctcctgctccttgagcaaatgtaccaccacagagtccattgatgcatgtaccgtgtcaggttcaattggtctgtaggatgcatgcatgtttcagcgagctagtgcatagcggtacatcgtgttgggcgaatttgtgcactgcgctacttacgtgtaccgcgcgacgatctcacggtgactttgcgtatgcctgcacagcacggaccgtcggacgcggaaacgcgccgtgcgcgtgtagccgctccacagccgtcgcgcacggcagggccggcggcggtgcgtggtaacgggtgaccaacggcggcaacgccgtcgtgcgcgtctgagagtttgagacgtttcggcgcgacaaaatgcaagcgtcatccttccttgggctccagcccataagcctacgaaaaacagaggtcgaaccagttcagcccgccggccgaattttaaaagggagggaaaaagtctgttctacggttctacctcccccaactttcacgaaaatttgattttctccctccaattacaaaatcagatatctcatctcctctaagttatcaaaactagacaatttttctccctgagtggtggtttgagattgacgtggctgcggtttttctatttttcttttatgtttatttcgaccgagtttttgaaaaattatagtaaatcgcaaaaaattataaaatagaaaatctaattttgttagactccacatgagtagatctatgcatggaacatatgataccatacactttagtacaaattttttgttgtcactttagatatatatactattttgtaattaatcaatagctacagtttctgtggtctaattatggtaaattttttatggt

SEQ ID NO: 1765 - DNA, 2331 bp, Panicum virgatum
accttaaacaaaaagagtcgttgaactatcaatggtcaatcctaacaaatcctaaatgaaagctcctctttgagggatcggaattccttttgattatccggtcgaataggaagctcacacactccacagcccttgctgtctcaccacatatataggagtataagttagccaccacacacttacaggatcggagctcacacgagtggcgcgcagctacctcaagcgaaacccggccccctgtgcaattgcgcgtcgtcgtcgtctcaccagcgcaaacgcgacgacgatggtgttcggcgagcgcgccgcgggcggcccgggcgccgacgcggcgggcacgatgcggttcgcgcggcacgtggtgcgcgggcggtggttcatgttcttcgcgtccatcctgatcatggcagcggccggcggcacctacatcttcggcatctactccaaggccgtcaagacgtcgctcgggtacgaccagcagacgctcaacacgctgagcttcttcaaggacgtgggcgccaacgtcggcatcctcccgggcctcatcaacgaggtcaccccgccgtgggtggtgctggcctgcggcgccggcatgaacctggctggctacctcatgatctacctcgccgtctcggggcgcacggcgcggccgcccgtgtggctcatgtgcgtgtacatcgccgtcggcgccaactcgcagtcgttcgccaacaccggcgcgctcgtcaccgccgtcaagaacttccccgaggaccgcggcgtcgtgctcggcctgctcaagggcttcgtcggcctcagcggcgccatcttcacccagatctaccgcgccgtctacggcaccgacaacgacggcgcggagctggtgctgctcatggcgtggctccccgccgccatctcgctgctcttcatccccaccatccgcatcatgccgcggccgatcgccgcggccgggcgggcgagcggggagcgcagggccttcttcctcttcctctacgcctccatcgtgctcgccgtctacctcctcgtcatgaacgtggtggagctggaggtgacccgcttccccaagccggcctactacgtcacggtcgccgtgctcctcctcctcatcttcttcccgatcgtcatcgtggtcaagcaagagctcaagacctacctgcttcagccggcgccggcgccagctgcagccatcgtgacgatcaccgtcgaggacgagaagacacgcgaggcggcgcctgcagctgatcaggatcaggccgccgccgacagagacagctcgtcgccttcgtgcttccaggacgtgttccggccgccggcgcggggccaggactacaccatcctgcaggccctgttcagcgtggacatgctggtcctgttcgtggccaccatctgcggcatcggcggcacgctgacggcggtggacaacatgggccagatcgggcagtcgctgggctacccgcagcgctccgtcaccaccttcgtctccctggtgagcatctggaactacgccggccgcgtggtctccggcttcgcctccgagtacgtcctcgcccgctacaaggtgccccgcccgctggcgctcaccgccgtgctcctcctcgcctgcgtcggccacgcgctcatcgccttcggcgtgagccacgggctctacgcggcgtccgtgatcctgggcttctgcttcggcgcgcagtggccgctgctgttcgccatcatctccgaggtgttcgggctcaagtactactcgacgctctacaacttcggcgccgtggcgagccccgtggggtcctacgtgctcaacgtgcggatcgccggccggatgtacgaccgggaggcgctccggcagggcgggcgcagggggcgggacctcacctgcgccggggtgcgctgcttcagggagtcgttcctcatcatcaccggcgtcacgctgctgggcgcgctcgtgtcgctgctgctggcgtggaggaccagggagttttaccgcggggacctgtacggccgcttcagggaggtcggcatggccgctgccggaggaggagaggataagaaggtcgccggcggcggtgtcagtagtgacacggacgccaagcaggacactagtagcagtagcgagagcagcaatggcaacaccaaggtttgaaagaatgaattgctaatgatcgaggtgaagaaagattaattgctccttgagcaaattaaatgtaccaccacagagtccattctccattggtgtaccgtgtcaggttccattgatcgatctgtagggtgcgtgcatgtttcagcgagcgctgcgcatcgtgttgggcggactgcgctacattctacttgcatgtgccg

SEQ ID NO: 1766 - DNA, 1953 bp, Setaria italica
aagtacaggagctgacacacaacacaggtggtagctaatatagctacctcaagcgaacctcttgtgcgtggccgtcccgagaaccatcaggcgatcaacgatggtgttcggcgaccgcgccgccacgggcgcgcccggcgccggcgcggcgccggcgagcacgatgcggttcgcgctgcacgtgatgcgcgggcggtggttcatgttcttcgcgtcgatcctgatcatggcggcggccggcggcacctacatcttcggcatctactccaaggcggtgaagtcgtcgctcgggtacgaccagcagacgctcaacacgctcagcttcttcaaggacgtgggcgccaacgtcggcatcctcccgggcctcatcaacgaggtcaccccgccgtgggtcgtcctggcgtgcggcgccggcatgaacctcgccggctacctcatgatatacctcgccgtctccggccgcacggcgcggccccccgtgtggctcatgtgcgtgtacatcgccgtcggcgccaactcgcagtcgttcgccaacaccggcgcgctcgtcaccgccgtcaagaacttccccgaggaccgcggcgtcgtgctcggcctgctcaagggcttcgtcgggctcagcggcgccatcttcacgcagctctaccgcgccatctacggcaccgacaacgacggcgcggaactcgtgctgctcatggcgtggctccccgccgccatctcgctgctcttcatccccaccatccgcatcatgccgcggcgggacgcggccgggcaggagcgcggcagggagcgcagggccttcttcctcttcctctacgcctccatcgtgctcgccatctacctcctcatcatgaacgtcgtcgagctggaggtgatccgcttccccaagccggcctactacgtcacggctgccgtcctcctcctgctcatcttcttcccgatcgtcatcgtcgtcaagcaagagctcaagacctacctccagccgccggcgccggcgatcacgacctcccgtcctcggcccaggtgacaccgccaccggcttctgatcaggccgccgccgccggcacctcgccgtcgtgcttccaggacgtgttccggccgccggcgaggggccaggactacaccatcctgcaggccctgttcagcgtggacatgctggtcctcttcgtggccaccatctgcggcatcggcggcacgctgactgccatcgacaacatgggccagatcggccagtcgctgggctacgcgcagcgctccatcaccacgttcgtctccctggtgagcatctggaactacgccggccgcgtggtctccggcttcgcctcagagcacctcctcgcccgctacaaggtgccccgcccgctggcgctcaccgtagtcctcctcctcgcctgcgtcggccacgggctgatcgcctccggcgtcagcaacgggctgtacgcggcgtccgtgatcctgggcttctgcttcggcgcgcagtggccgctgctgttcgccatcatctctgaggtgttcgggctcaagtactactcgacgctctacaacttcggcgccgtggcgagccccgtgggctcctacatcctcaacgtgcgggtcgccggcaggatgtacgaccgggaggcgctccggcagggcgggcggaaggggcgggacctcacctgcatcggggtgcggtgcttcagggagtcgttcctgatcatcaccggcgtgacgctgctcggcgcgctcgtgtcgctggtgctggcgtggaggacgagggagttctaccgcggggacctgtacgggcggttcagggaggtcggcatggtcggagcggccgccggcgggggaggaggagaggataagaaggtgcgtgaggtagcgagcagcagcggcggtgtcagtgacactgacaccggtaataaggactccactagtaccagtgagagcggcaatggcaacaaggtctgaatt

SEQ ID NO: 1767 - DNA, 4484 bp, Zea mays
ccgcctattggcctcgtccgcttccgcttcgacccctccccggcccgcctcggcctcgcgctccctcctcctcctcctcctcctcgcctccgcacccgggcaacccccgccctgccacggcgccgcggccagagccaggctctcccgcgtggaattcacgggacggaggccgctggtgccgcccgccgccgcctccgccaagatggacgccggggagatggaggacgtgcgggccgccgcggccgccgaggaggtcatcagcagcaggggcggctccgtgctggggaagaagaccatcctcaagagcgaccacttcccgggctgccagaacaagcgcctctccccgcagatcgacggcgcgcccaattaccgccaggctgggtcgctgcgtgttcatggtgttgcaatgcccacgatggaagggattgctaatgtgctaaatcatatcggagcacacaagaaaggaaagcaaacccggattctatggcatagtcttcgggaggaaccagttatctacatcaatggtcgaccctttgttttgcgggatgttgaaaagcccttctcgaatcttgaatacacgggaattaaccgggagagagtggaacaaatggagtttcgccttaaggaagatattcttcaggaagcttcaaggtatggtaataagatactggtcactgatgagctgccaagtggtcagatggtggatcagtgggaatcagttgtgtatgatacagttaagactccacttgaggtatatgaggagttgcaacatcaaggctacctagttgactacgaacgtgttccaattactgatgagaaagcaccaaaggaaggagattttgacaacctggtacgtcgaatctctcaagttgatatagaaacagaaattgtgtttaactgccaaatggggagggggcggacaactactggtatggttatagctacattggtttacctaaaccgaattggagcttcaggtatccctagaacgggctctattgggaaggtcttctatgctggaaatgatgtagacgattatatgcctagctcagaagaagcaatactcagaggcgaatatgctgtcattaggagtttagtccgagttctcgaaggtggtgttgaaggcaaaaggcaagtggacaaagttattgacaaatgcgactccatgcagaacctaagagaagctattgctacttaccgcaataacattcttcggcaacctgatgagatgaaacgagaggcatcactttccttctttgtggagtacttggaacgttattacttccttatatgctttgctgtctatgtgcattcggtgagctctgctcaccaaacaacattatcagtagaagttagtttttctgattggatgagagcaaggcctgaactgtacagcattcttcgaaggctattgagaagagatccaatgggtgctcttggttactcaagttcaaaaccccctcttacaaaaattgttgagtctgctaatgggcgtccacaagatatggacgttgttgctgccatgaggaatggagaagttcttgggcgtctaactgttttaaaaagcgaccactgcccaggcagccacagccttaatttacccgagagggtggagggtgcaccaaattttcgggaaatccctgggtttccagtctatggtgttgcaaatcctacagttgatggtattcgagctgttatccagtgcatcagtacaagcaagggagggcgacctgtgctatggcataatatgagagaagaaccagttatctacataaatggaaaaccatatgtgctacgcgaagtggaaagaccttgcaagaatatgctggagtacacagggattgatcgtgatagggtcgaacgcatggaagctcggctgaaggaggacattttacgcgaggcagaaagatatggtggagcgataatggttattcatgaaactgacgatggagagatctttgacacatgggaaaatgtagataatgaagctgttctgactccgttggaggtatacaaaaacttggtgagtgaaggccttccgatcaaatatgcacgggtgcccattactgatggtaaagctcccaaaagttcagactttgacacgatagccttcaatgttactgctgctagcaagggcactgctttcgtattcaattgccagatgggcaggggcagaacaactacaggaactgtgattgcttgcttgctgaaacttcgaattgatcatggcagacctattagaatcccagtttgtcaatatgaccatgaagatgatgctatttactcaactggaggagatgcaacagatcacaatggtcacttgaattcagaatcatggaaacctcgtactttgacgaagttaaattctggatttggaatcaatgacattcttctgctgcgaaaaattacaagattatttgataatggaattgagtgtaggcagactttggatactgttattgatagatgttcagctttgcagaatattcggcaagctgttttgaactacacaagagtaattaatcaacaacatgttgagcctagagttaggagggttgcattaaatcgtggcgctgaatatttggagagatacctcaaattaattgccttttctgcataccttggtagtgaagcatttgatggtttctgtggacaaggacaaacaaagatctcatttaaaggatggctgcaacagcggccagagatccaaaccatgaaatggagcataagactgcgacctggccgttttttcactgtgccgcatgagcagaaagcaacatatccacctccacaaggtgatgtaacaatggaaaccattgtcaaagctcgtagtggttctgttctgggaaagggatcaatactcaaaatgtacttctttcctggacagaaaaggtcaagcagtgtgaatttccggggtgcacctcatgttattaaggtggatggataccctgtgtatagcatggcaacacccactattgatggagcgagtgatgttttgtcgtatctgggctctaaagacacaaccggaagaaacattgcacagaaggtggtcgtcacagatcttagagaggaagtggttgtttacatcaagggatcgccatttgttttgagagaactagatcaacctgttgatactttgaagcatgttggcattagtggtccaatggtagagaacatagagacaaggctaaaggaggatatactctctgaagttaaacagctaggtggtcggttactgcttcatcaagaagaatttaatgcagccacaaatcaatgtagtgtggtaggttactgggaacacatagatctggaggacgtgatgacaccagctgaagtgtacagcacattgagagacaagggctattgtatcgagtacaaaagaatacctctaaccagggaaagagaagcattagctgccgatgtagatgctatacaatcatcaattgatgaatctgctaggtactatctctttatttcacacactggatatggaggtgttgcttatgcgatggccattacctgcctgggactgagtgcagatgcaaagtttgtaatggaagaaacagcagaaacacactttgtatcaacatctcttgcgaaaaatgtgtccatcaaaactaaaactgacatagcacttaagcagggtgactaccgtgacatattaaaccttactagagtgttggtacatgggcccaagagcaaagaagaggttgacacagttattgacaggtgttctggtgctggtcatctgcgcgaagatattatgcattacaggaaagcactgcaagattgttcacatgacgacgacgacgactgtgatgaggaacactcttatctcactgatatgggcacaaaagctttgaggcgttacttttttctgatcaccttcagatcctacctatacagcacgacatcatgcaaaacaacatttacatcatggatgaaggcaaggcctgaacttggccacctttgcgacaatctaaagctggacaaataggccatcttcatgtgacgtgattatgtagttgtgtcacttccttggacacattcacccagagtttcaaaaaggaaggagactaaaagaacgggtagagaggaagcagtggttatgggagttgtggacaatgaaagagcagcttaggctgtccgaaagtagggcattgtactatacttgtcggtgttaattgacaccagcaagcatgtatatattgtcaggcgtattatagatgaacatattagatatttctattgtagtattttctcaaattttaaaagaatcatttcatgcagttcattctcatgtatgtatctgatatgcttgctttttcagcagcgtttttttagacaaagctcttcggcagctttgatttttgacttctctgccttctgggcgtcaatatggccgcagccttttctaggagttgtattgagctaggatgaagcttgaaagaaatacgatgtcttgtttctaaagcccccttatt

SEQ ID NO: 1768 - DNA, 4435 bp, Setaria italica
ccttccccctcctattggcttccgcttccgccccactcccggaccccatcgtccccgtgctcgctccctcctcctcatcgccaccgcctcgccgtcccgtcccgccccgcgcccaatctcctcaccggggccgccgtcgcatgcgccccgcccctgccgcgggaggaggaggtgctgctgctgccgccgcgcggaattgaggggagcgaggctgggggagtccacggcgaacgcggcggggatggaggccggcgagatggaggacgtgcgggcggccgcggccgccgagcaggtcatcagcagcaggggcggctccgtgctcgggaagaagaccatcctcaagagcgaccacttccccggctgccagaacaagcgactctccccgcaaatcgatggcgcgcccaattaccgacaggctggatcattgcgtgttcatggtgttgcaatgccgacaatggaagggatcgctaatgtgctaaatcatattggagcaaaaaagaaaggaaagcaaacccggattctatggcatagtcttcgggaggaaccggttatctacatcaatggtcggccctttgtcttgcgggatgttgaaaagcccttctcaaatctggaatacacgggaattaaccgagagagagtagagcaaatggagtttcgccttaaggaagatattcttcaggaagcttcaagatatgggaataagatacttgtcaccgatgagctgccaagtggtcagatggtagaccagtgggaatcagtggtatctgatacagtgaaaactccacttgaggtctatgaggagttgcaacatcaagggtaccttgttgactacgaacgtgttccaattactgatgaaaaagcaccaaaggaaggggattttgacaacttggtacgtcgaatctcccaagttgatttagaaacagaaattgtgtttaactgccaaatggggaggggacggacaactactggaatggtcatagctacattggtttacctaaaccgaataggagcttcaggtatcccgaggacagggtcgattgggaaggtattctatgctggaaatgatgtagatgactatatgcctagctcagaagaagcaatactcagaggagaatatgctgtcatcaggagcttagtccgagttcttgaaggtggtgttgaaggcaaaaggcaagttgacaaagttattgacaaatgtgactctatgcagaacctaagagaagctattgctacctaccgcaatagcattcttcggcagtctgatgagatgaaacgggaggcatcactttccttctttgtggagtacttggaacgttattacttcctgatatgttttgctgtctatgtgcattcagtgagctctgctcaccaaacaacattttcagtagaagttagtttttctgattggatgagagcaaggcctgaactgtacagcattcttcgaaggctactgaggagagatccaatgggtgctcttggttattcaagttcaaaaccccctcttacaaaaattgttgagtctgctgatgggcgtccacaagatatggatgtcgttgctgccatgaggaatggagaagttcttgggcgtcaaactgttttaaaaagtgatcactgcccaggttgtcacaaccttaatttgcctgaaagggtagagggtgcgccaaattttcgggaaatccctggatttccagtctatggtgttgcaaatcctacggttgatggtattcgagctgttattcagcgtatcagtacaagcaaaggagggcgaccaatactgtggcataatatgagagaagaaccagttatctacataaatggaaaaccatttgtgctacgtgaggtggaaagaccttgcaagaatatgttggagtacacggggatagatcgtgaaagggtggaacgcatggaagctcggctgaaggaggacattttacgggaggcggaacggtatggtggagcaataatggttattcatgaaactgacaatggtgagatctttgacacatgggaaaatgtggataatgaagctgttctgactccattggaggtatacaaacacttggagtgtgaaggccttcagataaaatatgcacgtgtacccattactgatggtaaagctcccaaaagttcagactttgacacgatagccttgaatgttgcttctgctagcaaggacactgcttttgtattcaattgccagatgggcaggggcagaacaactactggaactgtgattgcttgcctgctgaaacttcgaattgatcatggcaggcctattagaattccatcatgtcaaaataaccatgaagatgccaatgatgctgcttactcaactggagaagatacagcagactacaatgggcacttgagttcagaatcttggaaaactcgcactttgacaaagctaaattctggatttggaattaaagacatccttctgctgcgaaaaattactagattatttgataatggaattgagtgtagacagactttggatactgttattgatagatgttcagctttgcagaatattcgccaagctgttctgaagtatacaaaagtaattaatcaacaacatgtggagcctagagttaggagggttgcattgaatcgtggtgctgaatatttggagagatacctcaagttaattgcattctcggcataccttggtagtgaagcatttgatggtttctgtgggcaaggagaagtgaagatctcatttaaaggctggctgcaacagagaccagagatccaaaccatgaaatggagcgtaagactgcgacctggccgttttttcactgtaccgcatgagcagaaagcaacatatccacctccacaaggtgatgtaacaatggaaaccgttgtcaaagctcgtaatggttctgttctaggaaagggatcaatactcaaaatgtacttctttcctggacagaaaaggtcaagcagcgtgaatttccggggtgcaccacatgtttttaaggtagatggataccctgtgtatagcatggcaacaccaactattgatggagctagtgatgttctgtcatatctgggctctaaagacacaaccggaagaagcattgcccagaaggtggtcgtcaccgatcttagggaagaagtggttgtttacatcaagggcacaccatttgttttgagagaactggatcaacctgttgatactctgaagcatgttggcattagtggtccaatggtagagagcatagagacaaggctaaaggaggatatacttgctgaagtcaaacaactaggtggccggttacttctccatcaagaagaatttaatgcggacacgaatcaatgtaatgtggtaggttattgggaacgcatagatctggaggacgtgatgacaccagctgaagtgtacggcacattgagaggcaagggctatgatatcaactataaaagaatacctctcaccagggaaagagaagcattagctgctgatgtagatgctatacaatcattaatcgatgaatctgctaggtactatctctttatttcacacactggatatggtggtgttgcttatgcaatggccattacctgcctgacactgggtgcagatgcaaagtttgtcatggaagaaacagcagaaacacactttgtatcaacttctcttacaaaaaatgtgtccatcaaaacatccactgacatagcacttaggcaggttgactaccgtgacatattaaaccttattagagtgttggtacatgggcccaagagcaaagaagaggttgatgcagttattgacaggtgttctggtgctggtaatttgcgagaggatattctgcaatacaggaaagcactgcaagatttttcgcatgacgatgatgatgacgatgaggagctctcttatctcactgatatgggtacaaaagctttgaggcgctacttctttctgatcaccttcaggtcctacctctactgtgcaacgccacgtgaagcaacgtttagatcatggatgaaggctaggcctgagcttgggcacctttgcgataatttaaagctggataaatagataatcttcagggacgtgattatgtagttaattgtggctcttccttgggcaaactcacctcgagttttagaaagggaaggagacagaatggctagctagagaggaagctgtggtcatgggagttcgggagaaagaaagcagcttaggctgggcattgtactgtacttgtcggtgttaattgacaccagcaagcatgtatatattgtcaagcttattgtaggtcacatattagaacttttcagtttagtattttcctccccttttttctttttaccgttgtatttagttcattctcatgtatgtatatcatatgtgtgcttcttggacagctttgatttatgagttttctgggcatcgatatatggccagtgccctttttataaattatattgcgtt

SEQ ID NO: 1769 - DNA, 4511 bp, Brachypodium distachyon
ctcctttcggctgcgtccacctccgtttccccccctatcgcatcctcttctctcctcccttgcccccgctgcgcctactggctctctgcccccgtccttctcttccctccacgccactctcgcgccgcgccatccctccctctcctgccccgtctccgtcccgccccgccgcccccgcgtctcgtctcgccgtcgggtttgcacgcgccgcgccctgccggttgtgcctgaggaggaggcggcgcgccgtgggacgacgacgaggaggatcggggatggaggtgggcgagatggacgacgtgcaggcggtaggggagcaggttatcagcagcaggggcggctccgtgctcgggaagaagaccatcctcaagagcgaccacttccccggctgccagaacaagcgcctcaccccgcacatcgacggcgcgcccaattaccgacaggcaggatccttgcgtgttcatggtgttgcaatgccgacgatgaaaggaatcgtgaatgtgctaaaccatattggagcacaaaaaaagggaaaacaaacccgagttctgtggcacagtcttcgagaggaaccagttatctatatcaatggtcgcccttttgttctgcgagatgttgaaaggcccttttcaaaccttgaatatacgggaatcaaccgggagagagtggagcagatggaatttcgcttgaaagaagacattctgcaggaagcctcaagatatgggaataaaatcctagttactgatgagctgccaaatggtcagatggttgaccagtgggagtcagtgatgtctgacacagttaagactccacttgaggtctacgaggagttacaacatcaaggataccttgttgactacgagcgtgttcctattactgatgaaaaagctccaaaggaaggagattttgacaatctggtgcgtcgaatctctcaagttgatatagagactgaaattgtgtttaattgtcaaatggggaggggacggactactactggtatggtcatatctacattggtttacctaaatcggataggagcttcaggtatcccaaggacaagttcaattgggaaggtcttctatgctgtaaatgatgtagatgacttcagtcctagctcagaagaagcaattcttagaggagaatatgctgtcattaggagcttagtccgagttctggagggtggtgttgaaggcaaaaggcaggtcgacaaagttattgataaatgtgactctatgcagaacctaagagaagctattgcgacctaccgcagtagcacccttcggcaacctgatgagatgaaacgggaggcatcactttccttctttgtggagtacttggaacgttattactttctcatatgttttgctgtctatgtacattctgtgagctctgctcatcaagcaacttcttcagaagttagtttttcggattggatgagagcaagacctgaactgtacagcattcttcgaaggctgctgaggagagatccaatgggtgctctcggttattcaagttcaaaaccctctcttccgaaaattattgaatcagctgatggacgtccccatgagatggatgttgttgctgccatgaggaatggagaagttctgggacgtcaaactgttttaaaaagtgatcactgcccagggtgtcagaatctcaatttacctgaaagagtggagggtgcacctaattttcgggaaattccaggattttcagtctatggtgttgcaaatcctactgttgatggcattcgagctgttattcagcgtgttagtacaagcaaggggaggcgaccaatactctggcataatatgagagaagagccagttatttatataaatggcaaaccatttgtgctacgagaagtggaaaggccatacaagaatatgctcgagtacacggggatcggtcgtgatagagtggagcgcatggaagctcggttgaaggaagatattttacgggaagcagaacggtatgatggagccataatggttattcatgaaactgacaatggtgagatctttgatgcatgggaaaatgtcagtaccgatgctgttctcactcctctggaggtatacaaacgtttggactcggaaggccttccaatcaaatatgcacgagtgcccataactgatggtaaagcccccaaaagttcagattttgacacaatagccttgaacgtcgcagctgcttgcaaggatgctgcttttgtattcaattgccagatgggcaggggcagaacaactacaggcactgtcattgcttgcctgcttagactccgaatcgatcatggcagatctattagaatgccaactatccaagataatcatgaggatacaaatggtgctgattattcaagtggagaagaaacaatagaccataatggtcacttgaattcagaatcatgggaacttcagactttgacagacgtacaccctagatttgacattaatgacatccttctgttgcggaagattacaagattatttgacaatggagttgagtgtaggcatattttagatactgttattgacaaatgttcagctttgcagaacattcgccaagctgttttgcagtacacaaaagtaattaatcaacaaaatatggagccaagagttaggagagtcgcattaaatcgtggcgctgaatatttggagaggtacctgaaattaattgcattctcggcataccttgggagtgaagcatttgatggtttctgcgggcaaggagaaacaaagatctcatttaaaaactggctccaacagcggccggagatccaaaccatgaaatggagcataagactgcgacctgggcgatttttcactgtacctgatgaacctaaagcaacatgtcaacctccacaaggtgatgttacaatggaagccattgtcaaagcacgtaatggttctgttctgggaaagggatccatactcaaaatgtatttctttcctggacagagaaggtcaagcagcatgaacttccgtggcgcgccacatgttatcaaggtggatggataccctgtgtatagcatggcaacaccaactgttgatggagcaagagatgttctgtcgtatttgggctctaaagatacaactggaagaagcattgcccaaaaggtggtcgtcacggatattagggaggaagtggtagtttacatcaagggaacaccatttgttttgagagaactagatcaacctgttgatacactgaagcatgttggcataagtggcccaatggtagagaacatagaggcaaggctgaaggaggatatactctctgaagttaagcagctagatggtcggctgcttctgcatcaagaagaaattaacacaaccacaaaccagtgtagtgtgttaggttattgggagcacatagatctggaggatgtgatgacaccagctgaagtgtacagcacattgagagctcaggggtattgtattgactacaaaagaatacctctcaccagggaaagagaagcattagctgctgatgtagattcgatacaatcgtcaatcgatgaatctgctaggtactatctctttatttcacatacaggatatggtggtgttgcgtatgcaatggccattacatgcctgggacttggtgcagatgcgaagtttgtcatggaacaaacagcggaaacacactttgtatcaacttatcttacaaaaagtgtatcagtcaaaacctccactgacatagccctcaggcagggtgactaccgtgatatactaaaccttactagagcactcgtacatggccctaagagcaaagaagaggttgacagagttattgacaggtgcatcggtgccgggcatttgcgggaggatattctgcaatataggaaggcattgcgagattgttcacatgatgatgatgatgatgaggcatggtcatatctcatggatatgggtactaaagctttgaggcggtacttctttctgatcacatttaggtcctacctctattgtacatccttacgcgaagcaacatttgcatcatggatggagggtaggcctgaactcggccacctttgtgataacttaaagctggataggtagaatatatcttatcatggccataaatttggagcttcggcagtctttgactcgtttgcccatcggctgtggacctgagaacatggaactgaaacgaaatgactggggaggacacatatgaattggaaatgatagtttgtattggctgaaactggggcgttgtatgaaacttgtttctgccaattgacagcagcaaggaatgtatatattgtcaagcttaaattttaggacaagaaaaacagttttccgacctacctgttttctccttcttcctttctccagtcatagtatgtaatttcattcagatacatggcccttttatctgcaacatccggcctcattgctcaacaactctggctttcatgagagcacctttactgtcaatagtagtatgggcacaaccaccagtaaattatttaaacctgccttttgcaacagaaaaagatttgcttg

SEQ ID NO: 1770 - DNA, 4365 bp, Triticum aestivum
gttcgttccccctccccctatcgcatcgtcttcgtctcgcctactggctccttgcctcctctgcccccgtccttctcttcccaccgccgcgttctcccttcctcctcttaccccgtatccgcatcacgcgcctcgccgccctgtcggtgccttacaagccggtgcaccgtcagaggaggaggattcgtggaggacaggatggaggtgggtgagatggacgacgtgcaggcggtgggagagcaggtcatcagcagcaggggcggctccgtgctcgggaagaagaccatcctcaagagtgaccacttccccggctgccagaacaagcgcctcaccccgcacatcgacggcgcgcccaattaccggcaggcaggatcactgcgtgttcacggtgttgcaatgcccacaatggaaggaattgtgaatgtgctaaatcatattggggcacaaaagaagggaaagcaaacccgagttctatggcatagtcttcgggaggaaccagttatctatatcaatggtcgcccttttgttctacgagatgccgaaagacccttctcaaaccttgaatatacgggaatcaaccgggagagagtcgagcagatggagtttcgtttgaaagaagatattcttcaggaagcttcaagatatgggaataagatcctagttactgatgagctgccgaatggtcagatggtggaccagtgggagtcagtgatgtctgatacagttaagactccacttgaggtctatgaggagttacaacatcaaggataccttgttgattacgagcgtgttcctataactgatgaaaaagctccgaaggaaggggattttgataacctggtacatcgaatctctcaagttgatatggagactgaaattgtatttaattgtcaaatggggaggggacggactactaccggcatggtcatatctacgttggtttacctaaatcggataggagcttcaggtatcccaaggacaagttcaattgggaaggttttctatgctggaaatgatgtagatgactacagtcctagctcagaagaagcaattctcagaggagaatatgctgtcattaggagcttagtccgagttctggagggtggtgttgaaggcaaaagacaggtggacaaagttattgacaaatgtgactctatgcagaacctgagagaagctattgcgacctaccgcaatagcactcttcggcaacctgatgagatgaaacgggaggcatcactttccttctttgtggagtacttggaacgttattacttcctcatatgttttgctgtctatgtacattcggtgagctctgctcaccaagcaacatcttcaggagttaatttttctgattggatgagagcaagacctgaactgtacagcattcttcgaaggctgctgaggagagatccaatgggcgctcttggttattcaagctcaaaacccactcttccaaaaattattgaatctgctgatgggcgcccacatgagatggatgttgttgctgccatgaggaatggagaagttcttggacgtcaaactgttttaaaaagtgatcactgtccagggtgtcacaatcttaatttgcctgaaagagttgagggtgcacctaatttccgggaaattccggggttttcagtctatggtgttgcaaatcctactgttgatggcattcgggctgttattcagcgagttagtacaagcaagggaaaccggccgatactctggcataatatgagagaagagcccgtcatttatatacatggaaagccttttgtgctacgagaagtagaaagaccgtacaagaatatgctggagtacacggggatcggtcgtgatagagttgagcgtatggaagctcggttgaaggaggatattttacgagaagcagaacggtatgatggggcaataatggttattcatgaaaccgacaatggtgagatctttgatgcatgggaaaatgtcaataatgaagctgttctgactccactggaggtatacaaatgtttggactctgaaggccttccaatcaaatatgcacgagtgcccattaccgatggtaaggcccccaaaagttcagattttgatacggtagcctttaatgtcgcagctgcttgcaaggatgctgctcttgtattcaactgccagatgggcaggggcagaacaactactggtactgtgattgcttgcctgctcagacttcgaatcaatcacggcagacctattggaatgccagccatccaaaataatcatgaagatacaactgatgccgattactcaagcggagaagaaacaatggaccacaatggtcacttgaattcagaatcatggaaacctcacactttgacagagctacaccctagatttgacattaatgacatccttctgttgcgaaagattacaaggctatttgacaatgggattgagtgtagacagattttagatactgttattgacaagtgttcagctttgcagaacattcgccaagctgttttgcaatacacaaaggtgattaatcaacaaaatatggagccaagagttaggagagtcgcattaaatcgtggtgctgaatatttggagaggtacctgaaattaattgcattctcggcatacctcgggagtgaagcatttgatggtttctgcgggcaaggagaaacaaagatctcatttaaaaattggctgcaacagcgtccggagatccaaaccatgaaatggagcataagactgcgacctgggcgttttttcactgtacctgatgagcataaagcaacatgtcaacctctgcaaagtgatgtaacgatggaagccatcgtgaaagcccgtaatggttctgttctgggaaagggatccatactcaaaatgtatttctttcctgggcagagaaggtcaagcagcatgaacttccgtggtacaccacatgttatcaaggtggatggataccctgtgtatagcatggcaacaccaactgttgatggagctagagaagttctgtcgtatttgggctgtaaggatacaactggaagagacattattcagaaggtggtcatcacggatcttagggaggaagtggtagtttacatcaagggaacaccgtttgttttgagagagttagatcaacctgttgatacactgaagcatgtgggcataagtggcccaatggtagagaacatagaggcaaggctgaaggaggatatactttctgaagttaaacagctagaaggtcggctgcttctgcatcaagaagaatttaacacagccacaaatcaatgcagtgtattaggttattgggagcacatagatctggaggacgtaatgacaccggctgaagtgtacagcacattgagggatcaggggtattgtattgactacaaaaggatacctctgaccagggaaagagaagcattagctgctgatgttgattcaatacagtcatcaatcaatgaatcttctaggtactatctctttatttcacacacgggatatggtggtgttgcttatgcaatggccattacatgcctgagacttggtgcagatgcaaagtttgtcatggaacaaacagcagaaacacacttcgtatcaagttctcttacaaaaagtgtatctgtgaaaaccttcactgacatagccctcaggcagggggactaccgtgacatactaaaccttactagagcactgatacatggtcctaaaagcaaagaagaggttgacaaagttattgacagatgtgttggtgctggggatttgcgggaggatattttgcaatacaggaaggcattgcgagattgttcacatgatgatgatgatgatgaggcacggtcatatctcatggatatggggactaaagctttgaggcgttacttctttctgataacatttaggtcctacgtccattgtacatccttgcatgaagtaacatttgcgtcatggatggaggctaggcctgaactcggccacctctgcgataacttaaagctggatagataaaatataccttggtcattattttggagcccggggtgtcttgggactggtggaccgtggactcaccatttctggacctgagaaggtggtactaaaagcgatgagtaaggagtaaagataatttggagggagtatgtatattggccgtaagaggggcattgtattggacttgcttctgctaatttacagcggcaagcatgtatgtgtatatatttatatattgtcaagcttaagttggactaggacagtacagttgagctttccgatctactccctctgtgcggacgttttttgacacttcaaaaaacgtctcattatgagatggagggagtacatgttttccactgcttccaaattatattcatcatttagatgcatggcctt

SEQ ID NO: 1771 - DNA, 4675 bp, Oryza sativa
ggagtagcagcatcagcagtagcagtactaaacttgtactgcaacacatggcaagcagccagggagagagaagaagaagatagagatagggacagagagagcctgtactgcactgcactgctgcctagcctatctatccatccccatcgccacatgcctctcctgcagctgcggcctgcggccaactcgtagtactcctataaggcaaggcctcgctaccccaaccgtcccctttcgcctccgcgtttcatctcctcgcctcgtctcgcctcgcctattggccgcccgctccccgcatcctcccatctcgccgcgttatcgccttccgcctcctcctccgccgccgcctacgcttctcgccgccgccgccgccgcctacgcttatcttgttgtgctggttgcatgcgccgcggcgcaggggctgacggagaggggtgcgcgtggaattgagaggagtggcggatggaggcggtggaggagcaggtggcgccggagcaggtcatcagcacgaggggaggctcggtgctcgggaagaagaccatcctcaagagcgaccacttccccggctgccagaacaagcgcctctcgccgcaaatcgacggcgcgcccaattatcgccaggcgggttctttacgagttcatggtgttgcaatgccgacaatgaagggaattgtaaatgtgttaaatcacattggagcacaaaagaaaggaaaacaaacccaggttctatggcatagtcttcgcgaggagccggttatctacatcaatggtcgcccttttgttctgcgagatgttgaaaggcccttctcaaaccttgaatatacgggaattaaccgggaaagagtggaacagatggagtttcgcctgaaagaagatattcttcaggaagcttcacgatatggtaataagatcctcgtcactgatgagctgccaaatggtcagatggtggaccagtgggagtcagtggtaactgatacagtcaagacccctcttgaggtatatgaggagttgcagcatcaaggataccttgtagattatgagcgtgttcctattactgatgaaaaggccccaaaagaaggagattttgacaatctggtacgccgaatctcccaagttgatatagaaactgaaatcatatttaattgtcaaatggggaggggaaggacaaccactggtatggttatagcaacattgatttatctgaaccggataggatcatcaggtatccctaggacaagttcaatcgggaaagtcttccattctggaaatgatgtagatgactatatgcctagctcagaagaagctatcctcagaggagaatattctgtcattaggagcttggtacgagttctggagggtggtgttgaaggaaaaaggcaagttgacaaagttattgataaatgtgacacgatgcagaacttaagagaggctattgctacataccgcaatagtattcttcgacaacctgatgagatgaaacgggaggcatcactttccttctttgttgagtacttggaacgttattacttcctcatatgctttgctgtctatgttcattcagtgtgctctgctcaacaatcaaacttttcagaagaagttagtttttctgattggatgagagcaaggcctgaactgtacagcattcttcgaaggctgttgaggagagatccaatgggcgctcttggttattcaagttcgaaaccctctcttgcaaaaattgttgaatatgctgatggacgccctcatgagatggatattgttgctgccatgagaaatggagaagttcttggacgccaaactgtgttaaaaagtgaccactgcccaggttgtcacaaccttcatttacccgaaagagtggagggtgcacctaattttagggaaattcctgaatttccggtttatggtgttgcaaaccctactgttgatggcattcgagctgttattcagcgtattagtacaagcaagggagggcgaccaattctgtggcataatatgagagaagaaccagttatttatataaatgggaagccatttgtactacgtgaagtggaaagaccatacaagaatatgctggagtacacgggaattgatcgtgatagggtggaacgaatggaagctcgtttgaaggaggatattttacgggaagcggaacgctatagtggggccataatggttattcatgaaactgacaatggtgagatatttgatgcatgggaaaatgtaaataatgaagctgtcctgactccattggaggtgtacaaacttctggagtctgaaggtcttccaatcaagtatgctcgagtgccaatcactgatggcaaagcccccaaaagttcagattttgacacaataaccttaaatgtggcagctgctcacaaggatactgcatttgtttttaattgccagatgggcaggggaagaacaactacaggtactgtgattgcttgtctgctgagattgcgaattgatcatggcagacctattagattgccagcttgtgaatataaccatgaagatccaaatgaattgggttactcaagtggagaagaaacaacggatcacaatggtcaccttaattcaagttcaccaagacctcatactgtgacagaacaacatcctagatttggaattgatgacatacttgttttgcggaagattacaagattatttgacaacggaatcgagtgtagacaaactttggataatgttattgacaaatgctcggctttacagaatattcgccaggctgttttgcagtacacaaaagtaattaaccaacagcatgtggagcaaagagttaagagggttgcattaaatcgtggtgctgaatatttggagaggtacttgaaattagttgcattctcagcatatctttggagtgaagcatttgatggtttctgcgggcaaggagaggcaaagatgtcatttaaagcatggatacaccagaggccagagatccaaagcatgaaatggagcatacggttacgacctgggcgttttttcactgttaatgatgaatccaaagcatcttttcagccttcacaaggtgacgtaatgatggaagccattgtcaaagctcgtaatggttctgttttgggaaagggatcaatactcaaaatgtacttctttcctggacagaaaaggtcaagcactattaacttctgtggtgcaccacaagttttcaaggttgatggataccctgtgtatagcatggcgacaccaactgttgatggagcaaaagaagttctgtcatatttgggctctaaagatactgggagaagcattcctcaaaaggtggttgtcacggatcttagggaggaagtggttgtttacatcaagggaacaccttttgttttgagagaactagatcagcctgttgatactcttaagcatgttggcataagtgggccaatggttgaaaacatagaggcaagactaaaggaggatatactctccgaagttaaacaacaaggtggtcggctacttctgcaccaagaagaatttaactcgtcaacaggccaaagtagtgttgtaggtttttgggaacatataggtacggaggatgtgatgacaccggctgaagtatatagtgtactgagaaatcaggggtactgtatcgactacaaaagaatacctctcaccagggaaagagaagcattagcttctgatgtagatgcaatacaatcgtcggttgatgagaatgctaggtactacctctttatttcacacacaggatatggtggtgttgcttatgcaatggccattacatgcctgggactgggagcagatgaaaagttcatcatggaacaaacagcagaaacacacttcatatcaacttctcttacaaaaagtgtgtctatcaaaacatcagctgatatagctctcaagcaaggtgactaccgtgacatattaaaccttacaagggtactggtacatggcccaaaatgcaaagaagaggttgacactgttattgacaggtgtgttggtgctgggcatttgcgggaggatattatgcattacagaaaggcactgcaagattgttcacttgatgatgatgagacatggtcatatctaatggatatgggcactaaagctttgaggcggtacttcttcctgatcaccttccgatcctacctctactgttcatctttgcgtgagccaacatttgcatcatggatggaggccaggcctgaacttggccatctctgcgataatctaaaactggataaatagatatatgagttatctctccattggatcattgaacagcttgctagttcgtggacttgaggaagatagggctgaaataatttcttaggaaggaggaaacataagaaccggcagaaaggagtagttcgtaggacattttaccagacttgttggcgccaattggcaccagcaaggatgtatatataattccgaggttaaattgtagaggaacatagctgaggttactagttttgtttttctccgtttattttgcaataaatgttatgtaatttgtttatatatatgcatatccttgttctgtctgcttctttatcagtaactcaaaactgttgccacatacggatattgtaatacgagctgtattatgcaagtgtacagtacattgtaaaaaatatatataggaaaagtttcgaaaagaatatactcctatatgggtgaaccgtca

SEQ ID NO: 1772 - DNA, 4051 bp, Triticum aestivum
tggcatagtcttcgagaggaaccagttatctatatcaatggtcgcccttttgttctacgagatgccgaaagacccttctcaaaccttgaatatacgggaatcaaccgggagagagtcgagcagatggagtttcgtttgaaagaagatattcttcaggaagcttcaagatatgggaataagatcctagttactgatgagctgccgaatggtcagatggtggaccagtgggagtcagtgatgtctgatacagttaagactccacttgaggtctatgaggagttacaacaccaaggataccttgttgattacgagcgtgttcctataactgatgaaaaagctccgaaggaaggggattttgataacctggtacatcgaatctctcaagttgatatggagactgaaattgtatttaattgtcaaatggggaggggacggactactaccggcatggtcatatctacgttggtttacctaaatcggataggagcttcaggtatcccaaggacaagttcaattgggaaggttttctatgctggaaatgatttagatgactacagtcctagctcagaagaagcaattctcagaggagaatatgctgtcattaggagcttagtccgagttctggagggtggtgttgaaggcaaaagacaagtggacaaagttattgacaaatgtgactctatgcagaacctgagagaagctattgcgacctaccgcaatagcactcttcggcaacctgatgagatgaaacgggaggcatcactttccttctttgtggagtacttggaacgttattacttcctcatatgttttgctgtctatgtacattcggtgagctctgctcaccaagcaacatcttcaggagttagtttttctgattggatgagagcgagacctgaactgtacagcattcttcgaaggctgctgaggagagatccaatgggcgctcttggttattcgagctcaaaacctactcttccaaaaattattgaatctgctgatgggcgcccacatgagatggatgttgttgctgccatgaggaatggagaagttcttggacgtcaaactgttttaaaaagtgatcactgtccagggtgtcacaatcttaatttgcctgaaagagttgagggtgcacctaatttccgggaaattccggggttttcagtctatggtgttgcaaatcctactgttgatggcattcgggctgttattcagcgagttagtacaagcaagggaaaccggccgatactctggcataatatgagagaagagcccgtcatttatatacatggaaagccttttgtgctacgagaagtagaaagaccgtacaagaatatgcttgagtacacggggatcggtcgtgatagagttgagcgtatggaagctcggttgaaggaggatattttacgagaagcagaacggtatgatggggcaataatggttattcatgaaaccgacaatggtgagatctttgatgcatgggaaaatgtcaataatgaagctgttctgactccactggaggtatacaaatgtttggactctgaaggccttccaatcaaatatgcacgagtgcccattactgatggtaaggcccccaaaagttcagattttgatacggtagcctttaatgtcgcagctgcttgcaaggatgctgctcttgtattcaactgccagatgggcaggggcagaacaactactggtactgtgattgcttgcctgctcagacttcgaatcaataacggcagacctattggaatgccagccatccaaaataatcatgaagacacaactgatgccgattactcaagcggagaagaaacaatggaccacaatggtcacttgaattcagaatcatggaaacctcacactttgacagagctacaccctagatttgacattaatgacatccttctgttgcgaaagattacaaggctatttgacaatgggattgagtgtagacagattttagatactgttattgacaagtgttcagctttgcagaacattcgccaagctgttttgcaatacacaaaggtgattaatcaacaaaatatggagccaagagttaggagagtcgcattaaatcgtggtgctgaatatttggagaggtacctgaaattaattgcattctcggcatacctcgggagtgaagcatttgatggtttctgcgggcaaggagaaacaaagatctcatttaaaaattggctgcaacagcgtccggagatccaaaccatgaaatggagcataagactgcgacctgggcgttttttcactgtacctgatgagcataaagcaacatgtcaaccttccatcgtgaaagcccgtaatggttctgttctgggaaagggatccatactcaaaatgtatttctttcctgggcagagaaggtcaagtagcatgaacttccgtggtacaccacatgttatcaaggtggatggataccctgtgtatagcatggcaacgccaactgttgatggagctagagaagttctgtcatacttgggctgtaaggatgcaactggaagagacattattcagaaggtggtcatcacggatcttagggaggaagtggtagtttacatcaagggaacaccgtttgttttgagagagttagatcaacctgttgatacactgaagcatgtgggaataagtggcccaatggtagagaacatagaggcaaggctgaaggaggatatactttctgaagttaaacagctagaaggtcggctgcttctgcatcaagaagaatttaacacagccacaaatcaatgcagtgtactaggttattgggagcacatagatctggaggacgtaatgacaccggctgaagtgtacagcacattgagggatcaggggtattgtattgactacaaaaggatacctctgaccagggaaagagaagcattagctgctgatgttgattcaatacagtcatcaatcaatgaatcttctaggtactatctctttatttcacacacgggatatggtggtgttgcttatgcaatggccattacatgcctgagacttggtgcagatgcaaagtttgtcatggaacaaacagcagaaacacacttcgtatcaagttctcttacaaaaagtgtatctgtgaaaaccttcactgacatagccctcaggcagggagactaccgtgacatactaaaccttactagagcactgatacatggtcctaaaagcaaagaagaggttgacaaagttattgacagatgtgttggtgctggggatttgcgggaggatattttgcaatacaggaaggcattgcgagattgttcacatgatgatgatgatgaggcacggtcatatctcatggatatggggactaaagctttgaggcgttacttctttctgataacatttaggtcctacgtccattgtacatccttgcatgaagtaacatttgcgtcatggatggaggctaggcctgaactcggccacctctgcgataacttaaagctggatagatagtggtcattattttggagcccggggtgtcttgggactggtggacgcgtggactcaaccatttctggacctgagaaggtggtactaaaagcgatgagtaaggagtaaagataatttggagggagtatgtattggccgaaagaggggcattgtattgaaaattaacagaggcaagcatgtatgtgtttatatatttatatattgtcaagcttaagttggactaggacagtaaagttgagctttccgatctactccctctgtccggtaatgtaagacgccatttaacactacactagtataaaaaaaacatcctacattatgggacagagggagtacatgtttttcactgcttccaaattatagtcgtcatttagatgcatggccttgttttgctcaacaaactggactttaggagctcttcctgtacttttttattatgctccttcgggttaagtaatttattggagttggttcgatctgtaaattaacgttggaacctacgcttttccttataacaagatttattttccttcgtcgtaatctgaaataaagagagggcgtcacttattgc

SEQ ID NO: 1773 - DNA, 3298 bp, Zea mays
cttccatttccacaagacccttgcgtgctctctctctctcctcttggcgacgactgggtggcaggtgcccaggtcttcttgggacccttcgccggcgacaagcaccaccaggttcagtcatgagtgggcttctcatgagcttccctaagtgatgcttcatatgttttctaacatgtaacatctcccgatgttatccatgtactggatatatccttagaagtcagagatgcagaagtctgatcatcatgagcagaagctaacttcaccaagagggttaatccataagatacttcgtcgtacaaatagcaggcgttctcccactgcagctgaccaacaaccttctcctgtatctccagaaacaagcaactcatcaatattctcaaagcaaaaggatgttgatgatgccatcaaggattcagaaaagctgagcacacatactatcagaattgaagatgagaaatctgatttgctagggtctgaaatttattctggaaagcttacattagataacaaaacaaaaagttcatcaaatgaacagtctggatcaggatctagtagcaattgctttgatgctaggctcagcactgaagccctaatatggggttctaacatccttaagcttgaggatattgtatctgtatcatataattctggtctccggtatttcaccgtgcatgcttgtcctcttgaaaaaatatccagtggactatcctgctttatgaagcctagaagaacccaaacggacttgaagttcgtatcctcttctccgcacgaggcctttcggtgggttaatagttttgcggaccagcaatgttacgtaaacctgttgcctcaccccatggcatctagcaagaagcattcttctgaactcattcagtttgatgccatgtttgatccttatgttaaatgtcggtctccaccaaagatacttgtcatcttgaatcctcgatctggacatggtagatctagcaaagtttttcatggaaaagtggaacccatatttaagcttgcaggtttcaagatggaagtggtaaaaactacacatgctgggcatgcaaaatctcttgtatcaactattgattttagtacctgtcctgatggtattgtatgtgtgggtggtgatggaattgtaaatgaggtcctcaatggtcttctatgcagagatgatcaaaatatgtctgcctctgtaccaataggtataatacctgctgggtctgataactcacttatttggacagtcttgggtgtcaaggatccaatttctgcagcattgtcaattgtcaggggaggtcttacacctattgatgttttttctgttgaatggattcaaagtgggactatgcattatggtacaaccgtatcatattttggttttgttagcgatgttcttgagctctcagagaagtatcagaagcattttggtcctttacgatactttgtagctggttttctcaaattcctgtgtttgccaaagtacagttttgaattggaatatcttccagtatcagatgttaatggcgccgagcataaaattttggtaggacaagaaaaggttgacgcgtctgatctatatgatgatgtaattcggagatcaagagcagaatgtttaccacgcgcctcaagtttatctagcattgattcaataatgtctacaggcatcatgtctggggcagagctggaggtttgtagtcctcgtgcaaataatgaaccttctgaggttgttcgtggacttgatccgaaatcaaagcgcttatcgttaggaagagctagtacatttaaagaaccagaagaagtgctccatccccactcccatggtacatctactcccagctggcgtagatctaagtcaaaatcaaggactgaaaaggcaaagccaggcttgtctgctacacacgatgcaaaatcttctaaggttaatgcagacaaagaggacacatcatccacaatttctgatcctggacctgtggctgtatgggattcaggaccaaagtgggacgatgaacctaaatgggataatcaacctaactgggaacccgagacttcaattgagctccatagccctcgcgaggatattgagcttggtctgactaaggagctggtacctagtttagatgaaaggtggacagttaggaaaggacgctatcttggtgtactggtgtgcaaccattcatgcaagactgtgcagagtctgagctctcaggttgttgctcccaaggctgaatatgatgacaattgtttggacctgctgttagttggtggaagtggaagactgagattactgaggtttttggtgcttttgcagtttggaaagcacatatctcttccaaatgtagaatatgtaaaggtgaaatctgtgaggctcaaagcaggcccaaatacacacgacggatgtggtatcgatggcgaactactccatgtcaaggggcaagttcgctgtagtttgttgcctcaacaatgtcaattgatgggcaggccagtgaaaaaccctgtacagtagctgtaaatacactatgcggactgtctgcagctctgaggtcagcccagaatcttgcacctgtggtgtgtacaagcggcgaaccatggattttcgtctgcatccacatgtcagtaattatattcagaagtgagaacatgaacatcctagctggcactcagctccagagatgtacatttgtggttgacgagcagaaggtgctgagtgggtgctgtttcatccatatgtaaagccaaagcctatctcggacagcagcttgttgcgcacctcttgcttttgcctttttctcgtccgatagaatgcatctactatacagccatcctgatgagtgtacttggttgctccagaacatagtgtccacctccaccagccgggtgtctttggaggttccctgatgccggccacttgatactcattgtagggacaacaccccagtgcccgtgtccttgatcagtctgttgtgtttgcgaagtgtgaataagatataggactgtttgattcccggtacagcgcagggtttcagcagaaagggctggatggatgatgttttgtggcgatgctgcctcgttgagtctttaaaacgggtgtaactcttcttcttttgtgagtcgtgatgatgtatgaaccgtgtactgatttgtaaaccttgcctggcaggcatacaactgtttctgaggtgtggtattctctgccggggaataagcagcgtagcttctcctttcgtacgctgccagcaaagcagcgctcgtgctagtatgaacaacttacaccaggcaaattttgtgatgggttttgtgagaaaga

SEQ ID NO: 1774 - DNA, 3361 bp, Setaria italica
gcggctagcctccgcggtccgcgcccacggtcgtctccgaccactgcgagctagggtttggcttccccgcctaatcgagctcggggatttggcccccctgcggcgggaggtctcggctaggctcggcccccggttccatccgatttggctcagtcatgcctcatgagtgggcttctcattagcttccccaagtgatgctttgtatctctatgttttttccgaacatgtaacatcccccgatgttatccatgtaccggatatacctttagaagtcagagatgcagaagtctgaccatcatgagcagaaacttacttcaccaagagggctaatccataaaatacttcgtcgtacaaatagcaggcgttctcccactgcagcagagcaacaaacttctcctgtatctccagaaacaagcaacgcaatattttcaaagcaaaaggatcctgatgatgtcatcaatgatccagaaaaggcgagcacacatagtatcagaattgaagatgagaaatctgatttgcttggatatgaggtttattctgggaagcttacattagataacagagctagaagtgcatcaagtgaacagtctggatcagggtctagtggcaattgctttgatgctaggctcagcactgaagcccttatatggggttctaacgtccttaagcttgaggatattgtatctgtatcatataattctggtctccggtatttcacggtgcattcatgccctcttgaaaaaagatccagtggactctcctgctttatgaagcctagaagaacccaaaaggacttgaagttcctatccccttctccacatgaggcctttcggtgggttaatagttttgcagaccagcaatgctatgttaacctgttgcctcaccccatggcatctagcaagaagcattcttctgaacttattccatttgatgccatgcttgatccttatgttaaatctcggtctccaccaaggatacttgtcatcttgaatcctagatctgggcatggtagatctagcaaagtttttcatggaaaagtggaaccaatatttaagcttgcaggtttcaagatggaagtgataaaaactacacatgctggtcatgcaaaatctcttgtatcaactattgattttagtacctgtccagatggtattgtatgcgtgggtggtgatggaattgtaaacgaggttctcaacggtcttctgtgcagagatgatcaaaatgtgtctgcctctgttccaattggtattatacctgctggatctgataactcacttgtttggacagtcttgggtgtcaaggatccaatatctgcagcattgtcaattgtcaggggaggtcttacacctattgatgttttttctgttgaatggattcaaagtgggattatgcattatggcacaaccgtatcatattttggttttgttagtgatgttctggcactctcagagaaataccagaagcgttttggacctctccgttactttgtagctggttttctcaaattcctgtgtttaccaaagtacagttttgaagtggagtatcttccaatatcagatgccaatggtgctgagcataaaattttggtaggacaagaaaaggttgatgcatcagatctttatgatgatgtagttcggagatcgagagcagaatgtttaccgcgtgcctcaagtttatctagcattgattcaataatgtctacaggaatcatgtctggggcagagctggaggtttgtagtcctcgtgcaaacaacgaaccttctgagcttgttcgtgcgcttgacccaaaatcaaagcgcctatcattaggtagagcgagtacatttaaagaaccagaagaagtgctccatccccagtctcatggtacatctactcccagctggcgtagatccaaatcaaagtcaaggactgaaaaggcatggccaggcttgactagtacgaacgatgcaaaatcctctaaggttaacacggcacatgacaaagaggacacatcgtcaacaatttctgatcctggacctgtgtgggattcaggaccaaagtgggacgcagagcctaaatgggataatcagcctaactgggaacctgagacttcaattgaactccatagtcctcaagaggacattgagcttggtctgactaaggagcttgtaccaagcttagatgagagatggacagttaggaaaggacgttatcttggtgtactggtgtgcaaccattcatgcaagactgtgcagagtctgagctctcaggttgttgctcccaaggctgaatatgatgacaattgtttggacttgctgttggttggtggaagtggaagactcagattactgagattttttgtgcttttgcagtttggaaagcatatatctcttccaaatgtagaatatgtaaaggtgaagtctgtgaggctcaaggcaggcccaaatacacatgacggatgtggtattgatggtgaactactccatgtcaaggggcaagttcgctgtagtttgttgcctcaacaatgtcaattgatcggcaggccagccaaaaaccctgtacagtagctgtaaatacattactctgcagactcagtctgcagctctgagatcgggccagaatcttgcacctgtacaagcggcgaactgtggaattttgtccacatccacacatccgcaattatattcagaagtcagagcatccttgctgacactcagctccagagatgtacatttgtggttgataagcaagaaggtgctgggtgggtgctatttatccagatgtaaagccaaggcctatctcagacaacagcctgttgcgcacctattggtttcaccttttctcttgtctgatatctaatacatctactatagagccatccagatgagtgtacttgggtccagaacatagtgttccacctcctccaccccggtggtgtgtacggttgtttggaggtccctgatgccgcccacttgatgctcattacccccattatagggacaacacctccagcgccgtgtccttgatcagcttgttgtgtttgcaaagtgtgaataagactatataggcctgttggattcccagtacagttgtagggtttcagcagaaagggacggacgatatttgtggcaccggtgccgcaactttttcatgtgtgtaactcttgttctttgtgatgtattgtgtagtgatttgtaaacgttgtttgccatacgagttggaattccttatatgtgctgttctctgctggataataagtagcgtagcttctggttctgggaggctcttttgtttgcatgctgccggcgacagcgagcagtgcttgtacgaggaatagtttgccaccagctgaattttcggatgcgattgtgactttgtgaga

SEQ ID NO: 1775 - DNA, 3405 bp, Panicum virgatum
gtcctcctcccccctcgcctcgccctcttccttcctcgggcggctagccaggctcctctcttcctctgcctccgccgcgcgcggtcgtctccgaccactgcgagccgcgagctagggtttggctcccccccgcctaatcgagctcggggatcggcatcccccgcggcgggaggtctcggctaggctcgacccccccggttcgacccgatttggcttagtcatgagtgtcttctcatgagcttcccctattgatgctttacagctctatgctttttcttaacatgcaacatctccggatgttatctatgtactggatatacacttagaagtcagagatgcagaagtctgaccatcatgagcagaatcttacttcaccaagagggctaatccataaaatacttcgccgtacaaatagtaggcgttctccaactgcagcagagcagcaaacttctcctgtatctccagaaacaagcaacacaatattttcaaagcaaaaagatcctgatgatgtcatcaatgatccagaaaaggcgagcacacatagtatccgaattgaagatgagaaatctgatttacttggatgcgaggtttattctgggaagcttacattagataacagaactaagagtgcatcaagtgaacaatctggatcagggtccagcagcaattgctttgatgctaggctcagcactgaagcccttatatggggttctaacatccttacgcttgaggatattatatctgtatcatatcattctggtctccggtacttcacggtgcattcatgtcctcttgaaaaaagatccagtggattctcctgctttatgaagcctagaagaacccaaaaggatttgaagttcctatccacttctccacatgaggcctttcggtgggttaacagttttgcagaccagcaatgctatgtaaacctgttgcctcaccccatggtatctagcaagaagcattcttctgaactcattccatttgatgccatgcttgatccttatgttaaatgtcggtctccaccaaagattcttgtcatcttgaaccctagatctggacatggtagatctagcaaagtttttcatggaaaagtggaaccaatatttaagcttgcaggtttcaagatggaagtggtaaaaactacacatgctggtcatgcaaaatctcttgtatcaactgttgattttagtacctgtccagatggtattgtatgcgtgggtggtgatggaattgtaaacgaggttctcaacggtcttctatgcagagatgatcaaaatgtggctgcctctgttccaatcggtattatacctgctgggtctgataactcacttgtttggacagtcttgggtgtcagggatccaatttctgcagcactgtccattgtcaggggaggtcttacacctattgatgttttttctgttgaatggattcaaagtgggactatgcattatggcacaactgtatcatattttggttttattagtgatgttcttgaactctcagagaaatatcagaagcgttttggtcctctccgttactttgtagctggttttctcaaattcctgtgtttgccgaagtacagttttgaattggagtatcttccagtatcagatgtcaatggtgctgagcatagaattttggcaggacaagaaaaggttgatgcatcctatctttatgatgatgtagtacggagatcgagagcagaatgtttaccgcgtgcctcgagtttatctagcattgattcaataatgtctacaggcatcatgtctggggcagagctggaggtttgcagtcctcatgcaaacaacgaaccttctgagcttgttcgggcgcttgacccaaaatcaaaacgtctatcattaggcagagcaagtacattcaaagaaccagaagaagtgctccaccccccggctcatggtacatctactcccagctggcgtaggtccaaatcaaagtcaaggactgaaaaggtgtggccaggcttgactgtgacgaacgatgcaaaatcctccaaggttaacatggcgcatgacaaagaggacacgtcgtcaacaatttcagatcctggacccgtgtgggattcaggaccaaagtgggacgcagagcctaaatgggataatcagcctaactgggaacctgagactccaattgagctccatagtcctcgggaggatattgagcttggtctgactaaggagcttgtaccaagcttagatgagagatggacagttcgcaaaggacgctatcttggtgtattggtgtgcaaccattcatgcaagactgtgcagagtctgagctctcaggttgttgctcccaaggctgaatttgatgacaattgtttggacctgctcttggttggtggaagtggaagactcagattactgagatttttggtgcttttgcagtttgggaagcatatatctcttccaaatgtagaatatgtaaaggtgaagtctgtgaggctcaaggcaggcccaaatacacacgatggatgtggtattgatggtgaactgctccatgttaaggggcaagttcgctgtagtttgttgcctcaacaatgtcaattgatcggcaggccagccaaaaaccctgtacagtagctgtaaatacattactctgcagactcagtctgcagctcttgaggtcagaccagaatcttgcacctgtacaagcggcgaactgtggaattttgtccgcatccacacatccgtaattatattcagaagtcagagcatccttggtgacacccagctctagagatgtacatttgtgcttgatgagcaagaaggtgctgggtgggtgctatttatccagatgtaaagccaaagcctatctcagacagcagcctgttgcgtacgtattggtttcaccttttctcttgtctgatatctaatgcatctactatagagccatccagatgagcgtacttgggtccagaacatactgttccacttccaccccccgttgtgtgcggctgtttggaggtccctgatgccggccacttgatgctcattacccccattatagggacaacacctccagcgccgcgtccttgatcagcttgttgtgtttgcaaagtgtgaataagactatataggcctgttggattcccagtacagttgtagggttcagcagaaagggacggacgatatttgtggtgccaccgccgcatcttttttcatgtgtaactcttgttctttgtgatgtatgagctgtgcagtaatttgtaaacgttgtctgccccacgagttggaaatttctcatacgtgctgttctctgctagcgaataagcagcgtagcttcagggaggctcttttcgcttgcatgctgccggccagcggtgcttgtacagttgtacgaggaatagcttgccgccaggcgaattttcggatgtgattgtga

SEQ ID NO: 1776 - DNA, 3609 bp, Oryza sativa
ataccttcgtcctcctcgtcgtcgttgccttgctgtctctctccgttaattaataaatttcccccctcctcttccttccttcctccaccggctacgcgctccgtctctctctctctctctccgtttgcttcgaccaagctagggtttcgccgccgaatcgagctcggtggcgcggggattttgcggtggggcggagcgcccgcggcggtggggaggcttcgggtggcctcggcctccgtccggctcgatccgatcggcacacagccataagttggtgttccatgagcttataagagtgatgccattattggcatgtttctatagcatctagcatctcccaatgttatgcatgtactgggctcccttaaaagatggaaattcagaagtctgatcatcatgagcagaatcttacttcaccaagagggctaatccataaagtgctgcgtcgcacaagtagcaggcgttctccaactgcagcagaccataacccttctcctgtattcctggagacaagcaattcaaaattcttaaagcaaaaggatattgatgatgccatcaaggatccagagaaggcaggcacacacgacaacagaattgaagatgagaagtctgatttgttagggtatgaaatttgttctgggaagcttacattggataacaaagccaaaagtgcatcaggtgaacagtctggatcagggtccagtagcaattgctttgatgctagactcactactgaagccttggtatggggttctaatatccttaagctcgaggacattgtatctgtatcatatcattccgggctccgtcacttcactgtgcatgcatgccctcttgaaaaaagatccagtggactttcctgctttatgaagcctagaaaaattcaaaaggacttacgtttcctatccacttctccacacgaggcttttcggtgggttaatggttttgcagatcaacaatgctatgtaaatctattacctcaccccatggcatctagcaagaagcattcatctgaactcattccatttgataatatgtttgatccatgtgttaaatgccggtctcccccaaagatacttgtcatcttgaatcctcgatctggacatggtagatctagcaaagttttccacggaaaagtggaacctatattcaagcttgcaggtttcaagatggaagtggtcaaaactacacatgctggtcatgcaaaatctcttgtatcaacaatagatttcagtacctgtccagatggaattgtatgtgtgggtggcgatgggattgttaatgaggttctcaatggtctcctttgtagagatgatcaaaatgtggctgtatctgttccaattggtataataccagcagggtccgataactcacttgtttggacagtattgggtgttaaagatccgatttctgcagcaatgtcaattgtcaggggaggttttacacccattgatgtttttgccgttgaatggattcaaagtgggactatccattttggcacaacagtctcatattttggttttgttagtgatgttcttgaactctcagagagataccagaagcgttttggtcctctccgttactttgtagccggttttctgaaattcttgtgcttgccaaagtataactttgaattggagtatcttccaatatcagatggtggtggtggtgagcataaaattgtggaagggcaagataaagttgatgcatcagacctctatgatgatgtagttcggaggtcgcgagtagaatgtctacctcgtgcctcaagtttatctagcattgattcaatcatgtctacaggaataatgtcaggtggagatctagaggtttcgagtccacatgctaataatgaaccctctgaacttgttcgtgcacttgacccaaaatcaaagcgcctatcattagggagaacaagtactttcaaagaaccagaagaagtgatccatcctcaggctcatgtttcatcgactcccaactggcgtagatccaaatcgaaatcaaggacagaaaaggcatggccaggctcgggtgctacaaatgatgcaaattcctctcgtggtaccacaacacatgacaaagaagacgcctcctccacaatttcagatcctgggcctgtgtgggattcaggacccaagtgggatgatgagcctaaatgggataatcaacctaactgggaaccagagactcccattgacttacctggtccattggatgatattgaacttggtctgactaaggaactagtcccaagcttagatgaaagatggacagttaggaaggggcggtatcttggtgtactggtatgcaaccattcatgcaagactgtgcagagtttaagctctcaggttattgctcctaaggctgaatacgatgacaattgcctggacctactgttggttggtggaagtgggaggctgaggttactgaaatttttggtgcttttgcagtttggaaagcatatttctcttcccaatgtggaatatctgaaggttaagtctgtgaggctcaaggctgggcccaacacacatgatggatgtggtattgatggtgaactattgcatgtcaaggggcaagttcgatgcagtttgctgcctcagcaatgtcgattaatcggcaggccagccaaaaatcctgtacagtagctgtaaatacatgactccaaagtctgcacagttctcaagtttgcccgatatcctgttcatgtacaatcggcaaaggtgtggattatttttgtccacgcccacagattcatagctacagtcaagaggtcagaacagctttgctggcaccttgcttcagaggtgtacatcgtgtgcttgatcatagctaaagtcagaagtcagaacagccttgctgacacccaacttcagaggtgtgcatcgtgtgcttgacgagcaaaagtgcctggtgaggtgatgtctatccaaatgtaaaagcctatccggagtctggactgcagcttgttgtgtagtacatctcgtggtttctcctttttaccttgctgatatctaatacaactactatagagtaatctcgaatcggtgtacttgcattcgaaacaacacagtggctgccacccccagtgtgcgcggttgtttggaggtccctgtttgtgtggttgttttgaggtccctgatgccggccacttgatgttcatcgcccccattaaagggacagcaccccgaatgtgatgtccttgatcagcttgagccttgtagtgtttacaaagtgtgaataagacttgtgtcctgcggtgtttgtgttctcagtacagtataggatttttcaacaggaaaaaaaagatggacaatctgtagtgcagaactgctcatgtacctttctatcccctcccttgtaacttgttcttcgtgaattgtggtgatgtatgagttgtatttgtacgtgttgtctgccacatgagctagatgatgatgatcatcttgtgaagatagagttactgatgtgtattgttgtcgtttggaggataagcaatttggtggttgggtgggctttctttacttgcctgttatattctcacaggaatgcgcacatcttgtagtagtactactctccgtttcacaatataagttattctaatattttcaa

SEQ ID NO: 1777 - DNA, 3169 bp, Secale cereale
cgggaccgtcctgtacaccattctttcctcttctttgttcgtcctctccctagtcctgacctacccaagctccaacccgaccgctgtgcccagccctagagctgccgcggtgccgtagctcatagccacccctctgcctcaacccgcaacccctccgcctctcacgcgcttcgccgccatcgccgtcctcgttctacgtcctcgcgttcctgccgtctggaccccgtctgcaatttcggccattggtttttgaggctcaatcataagtggcttcgcatgagctttgtggagtgatgcctttattgttgtaggcttttcctatcatgtagcttcaatgctatgcttgtactggatttacgtttagaagaaagagatgcagaagtctgaccatcacgagcagaatcttacttcaccaaggggactgatccataaagtgctccgtcgtacaaatagcaggcgatctccaactgcagcagagcaagatccttctcctgtatttccagaaacaagcaatactaaattcttaaagcaaaagaatgtagaagttgcaatcaaagatccagaaaaggggagcactcacgatacccgaattgaagatgagaagtctgatttgttaggatacgaagtttgttctgggaagcttacattagataacaaaggtagaagcgtttcaggtgaacagtcgggatcaggttctagtgggaattgttttgatgctaggctcaccactgaagccttagtatggggctctaacatccttaagcttgaggacattgtatctgtatcatacaattctgggctccggcatttcaccgtacatgcatgccctcttgaaaagagatctaatggactttcctgctttatgaagcctagaagaatccagaaggacttgcgttttctatccactgctccacatgaggcctttcggtgggttaatggttttgcagaccagcaatgctatgtaaatctgttaccacaccccatggcatcaagcaaaaagcattcttctgaactcattccatttgatggcatgcttgatccatatgttaaatgtcggtctccaccaaagatacttgtcatcctgaatcctcgatctggacatggtagatctagcaaagttttccatgggaaagtggagcccatatttaagcttgcaggtttcaagatggaagtgattaaaactacacatgctggtcatgcaaaatctcttgtatcaactattgattttagtacctgtccagatggaattgtgtgtgttggtggcgatggaattgttaacgaggtactcaatggtcttctgtgcagagatgatcaaactgaggcaggctctgttccaattggtataatacctgcaggatctgataactcacttgtttggacagtcttgggtgttaaagatccaatttctgcagcattgtccattgtcaggggaggttttacacctattgatgttttttctgtcgaatggattcagagtgggactacacattttggcacaacagtctcatattttggctttgttagcgatgttcttgaactctcagagaaataccagaagcgttttggtcctctccgttacattgttgctggttttctgaaattcctgtgcttgccaaagtacagttttgaattggagtatcttccagtagcagatgttgatggtgctgggcataaaattgtggagggacaagaaaaggttgatacgtcagacctctatgacgatgtagttcagaggtcgagagcagaatgtttaccacgcgcctcaagtttgtctagcattgattcaatcatgtctacgagcataatgtctgggggagaaccggaggtttctagtccacatgctaataatgaaccgtctgaacttgtgcgtgcacttgatccgaaatcaaaacgccagtcattagggaggacaagtactttcaaggaaccagaagaattgctccatcctcaggcatcaactcccagctggcgtagatccaaatcaaagtcaaggacagaaaaagcatggccaggtttgactgctacaaatgacactaaaccttccaagggcaccacaacacatgataaagaagacacatcatccacggtttcagatcctggacctgcatgggatacaggacccaagtgggatctggagcctaaatgggataatcaacctaattgggaacctgaaactcctatcgagctacatggtccatcagatgacattgagcttggtctgactaaggaactagtcccaagcttagatgaaagatgggtcatcaggaaagggcgctatctcggtgtattggtatgcaaccattcatgcaagactgtgcagagtttaagttcccagattgttgctcccaaggctgaatatgacgacaactgtctggacctgctgttggttggtggaagtgggagactaaggttattaaggtttttggtgcttttgcagtttggaaaacacatttctcttccgaatgtggaatatgtaaaggtgcgatccgtgagacttaaggcagggccgaatacacatgatgggtgtggtattgatggggagctactccatgtcaaggggcaggtccggtgcagtttgctacctcagcaaagtcgtttgatcggcaggccagccaaaaaccctgtacagtaactgtaaatacatcaccctgcagccctatatctgcctggaaattcacacctgtacaaccggcaactttcttgatctttttacctctgcatccagaacagcctcgctgacagacaggcacatataactccagcgatgtacactcgcgcttgatgaccgaaagtgccagacggtgacatttatccaagagttgtaaagcctatctggtctgcagcctgttgcgcatctcttcgtttcgccttctctttggctggtatcggatgtgttatagagccatctatctgatcagtgtacttttggggacggttcggttcggaagagcatggtgcccacccctggtatgtgcggttgtttggaggtccctggtgccggccacttgatgcttgtcaccacccattagagggacaaacaaaacactcccaatgctatgtccctgatcagcttgtgacaaaaagtgcgaacagatttctgtcatgtcgtgttcccggtatagtataggatttggatgaaaccaaaaaggagagaagatatttgtggtgc

SEQ ID NO: 1778 - DNA, 3183 bp, Triticum aestivum
atgagctttgtggagtgatgcctttattgtcgtaggcatttcctaacatgtagctccaatgctatgcttgtactggatttacttttagaagaaagagatgcagaagtctgaccatcacgagcagaatcttacttcaccaaggggactgatccataaagtgcttcgtcgtacaaatagcaggcgatctccaactgcagcagagcaagatccttctcctgtatttccagaaacaagcaatactaagttcttaaagcaaaaaaatgtagaagatgcaagcaaagatccagaaaaggggagcactcacgataaccgaattgaagatgagaagtctgatttgttaggatacgaagtttgttctgggaagcttacattagataacaaagacagaagcgtttcaggtgaacagtcgggatcagggtctagtggtaattgttttgatgctaggctcaccactgaagccttagtatggggctctaacatccttaagctcgaggacattgtatctgtatcatacaattctgggcttcggcatttcaccgtgcatgcatgccctcttgaaaagagatctaatggactttcctgctttatgaagcctagaagaatccagaaggacttgcgtttcctatctactgctccacatgaggcctttcggtgggttaatggttttgcagatcagcaatgctatgtaaatctgttaccacaccccatggcatcaagcaaaaagcattcctctgaactcattccatttgatgccatgcttgatccatatgttaaatgtcggtctccaccaaagatacttgtcatcctgaatcctcgatctggacatggtagatctagcaaagttttccacaggaaagtggagcccatatttaagcttgcaggtttcaagatggaagtgattaaaactacacatgctggtcatgcaaaatctcttgtatcaactattgattttagtacctgtccagatggaattgtatgtgtgggtggcgatggaattgttaatgaggtactcaatggtcttctgtgcagagatgatcaaattgaggcaggctctcttccaattggtataatacctgcaggatctgataactcacttgtttggacagtcttgggtgttaaagatccaatttctgcagcattgtccattgtcaggggaggttttacacctattgatgttttttctgttgaatggattcagagtgggactacgcattttggcacaacagtctcgtattttggctttgttagtgatgttcttgagctctcagagaaataccagaagcgttttggtcctctccgttacattgttgctggttttctgaaattcctgtgcttgccaaagtacagttttgaattggagtatcttccagcagcagatgttgatggtgctgggcataaaattgtggagggacaagaaaaggttgatacgtcagacctctatgacgatgtagttcagaggtcgagagcagaatgtttaccacgcgcctcaagtttgtctagcattgattcaatcatgtctacgagcataatgtctgggggagaaccagaagtttctagtccacgtgctaataatgaaccatctgaacttgtgcgtgcacttgatccgaaatcaaaacgccagtcattagggaggacaagtactttcaaggaaccagaagaatcgctccatcctcaggcatcaactcccagctggcgtagatccaaatcaaagtcaaggacagaaaaagcgtggccaggtttgactgctacaaatgacactaaaccttctaagggcaccacaacacatgataaagaagacacatcatccacaatttcagatcctggacctgcgtgggatacaggacccaagtgggatatggagcctaaatgggataatcaacctaattgggaacctgaaactcctatcgagctacatggtccatcagatgacattgagcttggtctgactaaggaactagtcccaagcttagatgaaagatgggtcattaggaaagggcgctatctcggtgtattggtatgcaaccattcatgcaagaccgtgcagagtttaagttcccagattgttgctcccaaggctgaatatgacgacaactgtctggacctgctgctggttggtggaagtgggaggctaaggttattaaggtttttggtgcttttgcagtttggaaaacacatttctcttccgaatgtggaatatgtaaaggtacgatccgtgagacttaaggcaggcccgaatacacatgatgggtgtggtattgatggggagctactccatgtcaaggggcaggtccggtgcagtttgctacctcagcaaagtcgtttgatcggcaggccagccaaaaacactgtacagtaactgtaaatacatcaccctgcagccctatatctgcctggaaattcacacctgtacaaccggcaactttcttcatctttttacctctgcatccagaacagcctcgctgacagacaggcacatataactccagcgatgtacattcgtgcttgatgaccgaaagtgccagacggtgacatttatctaaggaatgtaaagcctatctggtctgcagcccactgcgcttctcttcgtttcgcctgttctttggctggtatcggatgtgctatagagccttctatctgatcagcgtacttgggagggatggttctgttcagaacagcatggtgcctacccctggtgtgtgcggttgtttggaggtccctggtgccggccacttgatgcttgtcaccccccattagagggacaagcataacactgccaatgctatgtccctgatcagcttgtggtgtttacagaaagcgtgaacagatttctatcatgtcgtgttcccggtatagtataggatttggatgaaccaaaaaaggagagaagatatttgtggtgctgctggctttcccacctatagttctttttgtgtttgtgtttgtgcgcgaagtgtgatgtattgagttgtaatttgtcccagctgtctgccataaacgttttggatcataaatctttgtcaagataaacctgcaggtacatatgtggtactatgtgttgttctctgctggggaataaacagcatggtttgatagtgtgacattgttggtcgcatagaactgaattgtgcctgacaacccctggagggctgaaacttattaatcatcagaaaaggtctgtaaagc

SEQ ID NO: 1779 - DNA, 3223 bp, Triticum aestivum
gtttcctctccaccgtcctgtacaccattctttcctcttcttcgtcctctccctagtcccgacctacccaagctccaacccgaccgctgtgcccagccctagagctgccgccgtgccgtagctcatcgccacccctccgcctcacccccgcaacccctccgcttctcacgcgtttcgccgccatcgccgtccccgttccacctcgtcgcgaccctgccgtctggaccccgtctgcaattttggccattggttttcgaggctcagtcataagtggcttcacatgagctttgtggagtgatgcctttattgtcgtaggcatttcctaacatgtagctccaatgctatgcttgtactggatttacttttagaagaaagagatgcagaagtctgaccatcacgagcagaatcttacttcaccaaggggactgatccataaagtgcttcgtcgtacaaatagcaggcgatctccaactgcagcagagcaagatccttctcctgtatttccagaaacaagcaatacaaaattcttaaagcaaaagaatgtagaaggtgcaagcaaagatccagaaaaggggagcactcacgataaccgaattgaagatgagaagtctgatttgttaggatacgaagtttgttctgggaagcttacgttagataacaaaggcagaagcgtttcaggtgaacagtcgggatcagggtctagtggtaattgttttgatgctaggctcaccactgaagccttagtatggggctctaacatccttaagctcgaggacattgtatctgtatcatacaattctgggcttcggcatttcaccgtgcatgcatgccctcttgaaaggagatctaatggactttcctgctttatgaagcctagaagaatccagaaggacttgcgtttcctatctactgctccacatgaggcctttcggtgggttaatggttttgcagatcagcaatgctatgtaaatctgttaccacaccccatggcatcaagcaaaaagcattcctctgaactcattccatttgatgccatgcttgatccatatgttaaatgtcggtctccaccaaagatacttgtcatcctgaatcctcgatctggacatggtagatctagcaaagttttccacgggaaagtggagcccatatttaagcttgcaggtttcaagatggaagtgattaaaactacacatgctggtcatgcaaaatctcttgtatcaactattgattttagtacctgtccagatggaattgtatgtgtcggtggcgatggaattgttaatgaggtactcaatggtcttctgtgcagagatgatcaaattgaggcaggctctcttccaattggtataatacctgcaggatctgataactcacttgtttggacagtcttgggtgttaaagatccaatttctgcagcattgtccattgtcaggggaggttttacacctattgatgttttttctgttgaatggattcagagtgggactacgcattttggcacaacagtctcgtattttggctttgttagtgatgttcttgaactctcagagaaataccagaagcgttttggtcctctccgttacattgttgctggttttctgaaattcctgtgcttgccaaagtacagttttgaattggagtatcttccagtagcagatgttgatggtgctgggcataaaattgtggagggacaagaaaaggttgatacgtcagacctctatgacgatgtagttcagaggtcgagagcagaatgtttaccacgtgcctcaagtttgtctagcattgattcaatcatgtctacgagcataatgtctgggggagaaccagaagtttctagtccacgtgctaataatgaaccatctgaacttgtgcgtgcacttgatccgaaatcaaaacgccagtcattagggaggacaagtactttcaaggaaccagaagaatcgctccatcctcaggcatcaactcccagctggcgtagatccaaatcaaagtcaaggacagaaaaagcgtggccaggtttgactgctacaaatgacactaaaccttctaagggcaccacaacacatgataaagaagacacatcatccacaatttcagatcctggacctgcgtgggatacaggacccaagtgggatatggagcctaaatgggataatcaacctaattgggaacctgaaactcctatcgagctacatggtccatcagatgacattgagcttggtctgactaaggaactagtcccaagcttagatgaaagatgggtcattaggaaagggcgctatctcggtgtattggtatgcaaccattcatgcaagaccgtgcagagtttaagttcccagattgttgctcccaaggctgaatatgacgacaactgtctggacctgctgctggttggtggaagtgggaggctaaggttattaaggtttttggtgcttttgcagtttggaaaacacatttctcttccgaatgtggaatatgtaaaggtacgatccgtgagacttaaggcaggcccgaatacacatgatgggtgtggtattgatggggagctcctccatgtcaaggggcaggtccggtgcagtttgctacctcagcaaagtcgtttgatcggcaggccagccaaaaacactgtacagtaactgtaaatacatcaccctgcagccctatatctgcctggaaattcacacctgtacaaccggcaactttcttcatctttttacctctgcatccagaacagcctcgctgacagacaggcacatataactccagcgatgtacattcgtgcttgatgaccgaaagtgccagacggtgacatttatctaaggaatgtaaagcctatctggtctgcagcccactgcgcttctcttcgtttcgccttttctttggctggtatcggaagtgctatagagcaatctatctgatcagcgtacttggggggacggttcggttcggaagagcatggtgcccacccctggtatgtgcggttgtttggaggcccctggtgccggccacttgatgcttgtcaccccccattagagggacaagcataacactgccaatgctatgtccctgatcagcttgtggtgtttacagaaagcgtgaacagatttctatcatgtcgtgttcccggtatagtataggatttggatgaaccaaaaaaggagagaagatatttgtggtgctgctggctttcccacctatagttctttttgtgtttgtgtttgtg

SEQ ID NO: 1780 - DNA, 3272 bp, Triticum aestivum
ggctcagtcataagtggctttgcatgagctttgtggagtgatgcctttattgttgtaggcttttcctaacatgtagctccaatgctatgcttgtactggatttacttttagaagaaagagatgcagaagtctgaccatcacgagcagaatcttacttcaccaaggggactgatccataaagtgcttcgtcgtacaaatagcaggcgatctccaactgcagcagagcaagatccttctcctgtatttccagaaacaagcaatactaaattcttaaagcaaaagaatgtagaagttgcaagcaaagatccagaaaaggggagcactcacgataaccgaattgaagatgagaagtctgatttgttaggatacgaagtttattctgggaagcttacattagataacaaaggtagaagcgtttcaggtgaacagtcgggatcagggtctagtggtaattgttttgatgctaggctcaccactgaagccttagtatggggctctaacatccttaagctcgaggacattgtatctgtatcatacaatgctgggcttcggcatttcatcgtgcatgcatgccctcttgaaaagagatctaatggactttcctgctttatgaagcctagaagaatccagaaggacttgcgtttcctatctactgctccacatgaggcctttcggtgggttaatggttttgcagatcagcaatgctatgtaaatctgttaccacaccccatggcatcaagcaaaaagcattcttctgaactcattccatttgatgccatgcttgatccatatgttaaatgtcggtctccaccaaagatacttgtcatcctgaatcctcgatctggacatggtagatctagcaaagttttccacgggaaagtggagcccatatttaagcttgcaggtttcaagatggaagtgattaaaactacacatgctggtcatgcaaaatctcttgtatcaactattgattttagtacctgtccagatggaattgtatgtgtgggtggcgatggaattgttaacgaggtactcaatggtcttctgtgcagagatgatcaaattgaggcaggctctgttccaattggtataatacctgcaggatctgataactcgcttgtttggacagtcttgggtgttaaagatccaatttctgcagcattgtccattgtcaggggaggttttacacctatcgatgttttttctgttgaatggattcagagtgggactacgcattttggcacaacagtatcatattttggctttgttagcgatgttcttgaactctcagagaaataccagaagcgttttggtcctctccgttacattgttgctggttttctgaaattcctgtgcttgccaaagtacagttttgaattggagtatcttccagtagcagatgttgatggtgctgggcataaaattgtggagggacaagaaaaggtcgatacgtcagacctctatgacgatgtagttcagaggtcgagagcagaatgtttaccacgtgcctcaagtttgtctagcattgattcaatcatgtctacgagcataatgtctgggggagaaccggaggtttccagtccacatgctaataatgaaccgtctgaacttgtgcgtgcacttgatccgaaatcaaaacgccagtcattagggagaacaagtactttcaaggaaccagaagaattgctccctcctcaggcatcaactcccagctggcgaagatccaaatcaaagtcaaggacagaaaaagcatggccaggtttgactgctacaaatgacactaaaccttctaagggcaccactacacatgataaagaagacacatcatccacagtttcagatcctggacctgcgtgggatacaggacccaggtgggatctggagcctaaatgggataatcaacctaattgggaacctgaaactcctatcgagctacatggtccatcagatgacattgagcttggtctcactaaggaactagtcccaagcttagatgaaagatgggtcattaggaaagggcgctatcttggtgtattggtatgcaaccattcgtgcaagactgtgcagagtttaagttcccagattgttgctcccaaggctgaatatgacgacaactgtctggacctgctgctggttggtggaagtgggaggctaaggttattaaggtttttggtgcttttgcagtttggaaaacacatttctcttccgaacgtggaatatgtaaaggtacgatccgtgagacttaaggcaggtccgaatacacatgatgggtgtggtattgatggggagctcctccatgtcaaggggcaggtccggtgcagtttgctacctcagcaaagtcgtttgatcggtaggccagccaaaaaccctgtacagtaactgtaaatacataaccctgcagcactatatctgcctggaaattcacacctacaaccggcaactttcttgttctttttacctctgcatccagaacagcctcgctgacagacaggcacatataactccagcgatgtacattcgcgcttgatggccgaaagtgccatacggtgacatttatccaagagttgtaaagcctatctggtctgcagcctgttgcgcttctcttcgtttagccttttctttggctggtatcggaagtgttatagagcaatctatctgatcagtgtatttgcggggacggtttggttcggaagagcatggtgcccacccctggtatgtgcggttgtttggagtcccctggtgccggccacttgatgcttgtcaccccccattagagggacaaacaaaacactcccaatgctatgtccctgatcagctcgttacaaaaagtgcgaacagatttctatcgtgtcatgttcccggtatagtataggatttggatgaaccaaaaaaggagagaagatatttgtggtgctgctggcttttccacctatagttttttgtgtgtgatgtattgagttgtaatttgtcccagctgtctgtcataacgtgttggatcataaatctttgtcaagataaacctgcaggtacatatgtggtactatgtgttgttctctgctggggaataaacagcatggtttgatagtgtgacattgttggtcgcatagaactgaattgtgcctgacaacccctggagggctgaaacttattaatcatcagaaaaggtctgtaaagcgttcggcgcggacaagccgacaaacgccacgcttctggcaaccgggatcattgaaaactttatttaggtacggaaaccatcccttgaactctccaat

SEQ ID NO: 1781 - DNA, 4374 bp, Brachypodium distachyon
tattcggatttcggagaccacatggccacaaccacacctgccggtctgcgctctctttctccccttgggctggagccccggctctttctccttttcttctttttcctgtttgagccgcacccctcccttctggcccatctcgctgccgagcgccccaagccccttgatcgtcttcctcctcgcgagagcgccgccaccgctccctcctccttctggcccatccagctgccgagcgccccagccccctcgcgcgagcgccgctaccgccggtcgatctccccttcgattctctcgctcccgaccgtttctcctcccatcaccccacgagccgattccgctctttagctccccgtttcatctccttaatatcccccaattcgtaactgaggcaaaaatcaaggcagggcggccgccctaccttgccctactgggtcctccgcccatgtgatgaggcttagtcatacatggcttcccatgaacttcggagagtgatgcctttgttcttgtatggttttccttaacatgtagctccaatgttattcttgtgctgcatttattcttagaagacggagatgcagaagtctgacaatcacgagcagaaacttacatcaccaaggggactgatccataaagtttttcgtcgtacaaatagcaggcgatctccaactgcagcagagcaagacccttctcctgtatttccagaaacaagcaatgctaaattcttgaagcaaaataattcagaagatgctatcaaggatcaagaaaaggcgagcacgcatgataaccgaattgaagatgagaagtctgatttgttaggatatgaagtctgctctgggaagcttacattagattacaaaggtagaagtgtttcagctgaacagtctagcggcaactgctatgatgctaggctcaccactgaagcttttgtatggggttctaacatccttaagcttgaggacattgtatctgtatcatacaattctggactccggcatttcactgtgcatgcatgccctcttgaaaaaagatccattggtctttcctgctttatgaagcctagaagatcccaaaaggacttacgattcctatctgcagctccccatgaggcctttcagtgggttaatggttttgcagatcaacaatgctatgtaaatctgttacctcaccccatggcatctagcaagaagcattcttctgaactcattccatttgatgccatgcttgatccttatgtgaaatgtcgatctccaccaaagatacttgtcatcttgaatcctcgatctggacatggtagatctagcaaagttttccacgggaaagtggagcccatatttaagcttgcaggtttcaagatggaagtggttaaaactacacatgccggtcatgcaaaatctcttgtttcaactatcgatttcagtacctgtccagatggaattgtatgcgtgggtggcgatggaattgttaatgaggtgctcaatggtcttctgtgcagagatgatcaaaatgagtcagtctccattccaatcggtataatacctgcagggtctgataactcactagtgtggacagtcttgggtgttaaagatccaatttctgcggcattgtcaattgtcaggggaggttttacacctattgatgttttttctgttgaatggattcagagtggcactactcattttggaacaactgtatcatattttggttttgttagcgatgttcttgaactctcagagaaataccagaagcgttttggtccactccgttacattgtagctggttttctgaaattcttgtgcttgcccaaatacagttttgaactggagtaccttccagtatcgaatgctgatggacctgagcataaaactgtggaagggcaagaaaaggttgacacatcggacctctatgatgatgtagttcagaggtcaagagcagaatgtttaccacgtgcctcaagtttatctagcattgattcggtcatgtctacaagtataatgtctgggggagaaccggaggtttctagtccccatgctaataatgaaccctctgaacttgtccgtgcacttgacccgaaatcaaaacgcctgtcattagggaggacgagtactttcaaagaaccagaagaagtgctccatcctcaggcctcgactcctagttggtgtagatccaaatcaaagtcaaggacagaaaaagcatggccaggtttgactactacaaatgatacgaagtcgtctaggggcactacaacgcatgataaagaagacacatcgtccacagtttcagatcctggacctgcatgggatacaggacccaagtgggatatggaacctaaatgggataatcaacataactgggaatctgagactcccattgagctacatggtccatcagatgacatcgagcttggtctgactaaggaactggtgccaagcttagatgaaagatgggttgttaggaaagggcgttatcttggtgtattggtttgcaaccattcatgcaagactgtgcagagtttaagttcccaggttgttgctcccaaggctgaatatgatgacaattgtctggacctgctgttggttggcggaagtgggaggctgaggttattaagatttttggtgcttttgcagtttggaaaacacatttctcttccacatgtcgaatatttaaaggtaaaatccgtgagactcaaggccggcccaaatacacatgatggatgtggtattgatggtgaactactccatgtcaaggggcaagttcgctgtagtttgctacctcagcaatgtcgcttgatcggcaggccagcccaaaaccctgtacagtagctgtaaatacattactctgcatcctgcagccccaaggtctgcctggaatcttgcacctgtaccaccggcagtgtcgtgggatttgtgtcccgtgtccagaacagcagtgctgacagacaggcacgcagacccagggatgtacatatgtgcctgtgattagtaaaagtgctggatggtgacatttatccaagaaatgtaaagcctatcaacaacctgttgtgcatctgttcttttcgcctttacttgagctgatatctgatgtagccatcctgatcagtgtacttggggtttagaacatcacagcgctcaccccaggtatgtgcggttgtttggctgtccctgtttgtgctattgtctggaggtccctgctgccggcaacatgatgcttgttagcccccattaaagggacaaagcacctccgatgcaatgtccctgatcagtttgtagtgtttacagaagtgtgaataaggttttctatcatgtcgggttcccagtacagtataggatttgaacgacaagaaaaaggaagaagatatttgtagtgctgctgcctctttcaccttgtaactctttttcacctgtttattgtgattgtgatgtattaagttgtaatttgctcgaattgtctgccataaacgacttggatcatataacttgttgaagataaacttgccgatatgttttgtgtgttgttctctgctgggtaataagaaacatggtttgatgtatcgttcacatgcctgattctttctcgggtctgctattgttcatttcgatcgtgaagcatggagtggttccttattttatcatcttgttcatgagaaccatacaagccctgcaaggctgttagcgcagtcaatccgctcttccctgtcatcctctggacaggaagagaacagtggacaaacagtacgcctctggcaggtaagtggccgtctgataattgcaggcatgagcagcgagttggtagcacgaccgagatccctaaaaaggaaagccaaaaggcaaatgccacgggaacaaaaggcacctgacgacgattcttttggatctcaaaatccatatatggctagcttatgctgtgcaccacaaaaggcaggaaggaagggacgaagaagaaaagcaaccgaccgtgatagtgcaggtgcaaatacccaacgacgaaatacacagctcgtactagttgtactactgcagcctctactaccaactcagtacatagggaaggaacaaaaagccgggaagaatcaacaacgggctgctgctggtttggttaagtgacacgggagagtcaagacgtggaccggggcatgaagagctagcacttgcagttgcagccgcggccggcgccggcgaggaggccgagggagacgcagcgtccgccgcgccggcagccgccgtagtggcagaggtccatgcaggcgctgttggccgccgcgtcgcctgggtcgcactgctccaccgggatcgtcaccccgcacgccacccccgacgggtagtcctccacccacgccgcctccgccaccaaagccactgccaaaccacacaaaacaac

SEQ ID NO: 1782 - DNA, 1447 bp, Setaria italica
catgaactaattagatgtaatagattcatcttgcgaattaactttcatttatgcaattggttttataattaacctatatttaatacttataattaatatctgaatctcaagataacgtggactaaattttaatctcgtaaaccaaacaggctcccccggttcaaagctcccaaaaggatgggccggcgggcgcgtcacgtgacgcccgcccgtgagcctccacctggcgtccccctacaggcttgcaggtgggccaccccacgtgccatcgatcttatccacacacccgtgctggccgcgccacgtcctgccttccgctgcccgcgacccgccacgaccgaaccgtgcacccccggcgccagccccacccgcatccgttcgcggtctacggaccgggtctagggtcgcgagggcgctccggcccaaagcgcaacactgcgctataaccgctcggcctcataccttcttctcgctcgctcagccgctcagatcccgaaagctttgggggaagggaagggagactgtgcaccggatcggccttcggtgattacgacgggagagggatgggcctcctcgacaagctgtgggacgacaccgtcgcggggccccgcccggacaccgggctcggccgcctccgcaagcagcccgcgcgccccgccgccgtcaagatcaatgatccggcaggggacgccacggcgttcgtcccgccgtcgccggcgtcgggcagcgaggagacgcccgtgaaggtgacgcgcagcatcatgatcaagcgccccgcggggtacccgtcgtcgccgaggagcgcggccagcacgccgccggcctcgccgctggggaccaccccgcccatctcgccgttcgccggcgccggtggtcgcttcagaaggaaatcatcatctgatgcatatgagagggcatccccgccagggacgaccagccaccctcctccctttgaagtgtgagcacgcaacatgttcacacccctttttgctccttgacaagcatctacttcacctaagtcaggggaaggaggagggaagacatcaagaggggaacggggataagtcgctggctgtcttacctctactgtgatatattgtagatgccgctatgtgtagtgtttttgcatccactctgtggctttagtctgtagaatatgctgaaagctcttggtgttgtgccgtgtcaataagctgctgtgtgcatatggcgggttagggctgcgtggagctttgccgcagcctgcaatctcgccgcgttgtgtttgtttcctctacctgctgtgtcaaatggatggtgtgtggaggatggggtcgtgcttgtaatgttagcagggttcgaggtggagtgcatgtaatcctttttcgatgtgtatggtatctaataaactgaaggtgttttcttgaacttgctgtgaatctatgatgccatatgatgcacccgggcc

SEQ ID NO: 1783 - DNA, 1050 bp, Zea mays
ctgatttataaataagcgctgcctgcttggcttcatatcttctcgcccagatccacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgtcccgcggggtacccgtcttcgccgaggagcgcggcaagcacgccgccggcctctccactagggactaccccgcccatctcgccgtttgccggcgctggtggtcgcttcagaaggaaatcatcatccgacgcatatgagagggcaacccctccagggacgaccagccaccctcctcccttcgaagtgtgaaccggctgcaccctcacacttgttttgctccttgacaagcatctcttcacctataataaggtagaggcagggaggagagaagacgacatcaagaggggaacggggatgagttgcgggtttacctctgctgtgatatattgtaggtgccactatgtgtattgttcccccctatctactacgtggcataggttgtattctagtatgttgaaagctcatggtgccgtgctgtatcaataaggtgttatgcgcatagagtggctcaggaccagggctgcgtttgcgctttgccactggctgtgttgtatgtttcttctgctgctatgccattagggtttagggatggtgtgtggatggcgtcgtgcttgtagtgttagctgggtttgaagcggactacatgtaggtttgttcaatgtctggtatctattagctgaaggtgtttgcctgtaagttgtaactctctgtgaactgtgatgcgggataatgctaagaatagatgatcgttctaagtgacc

SEQ ID NO: 1784 - DNA, 1310 bp, Panicum virgatum
ctccacacgggatgggccggcgagcgcgtcacgtgacgcccgcccggcgaaaggcccacctggcaccccgccacaggccggcaggcgggccaccccacgtgcgcggccccatcgatcttatccacacccgccacgtccctgccttccgcgccccgcaacccgccacgacgggccggccgtgcaccccggtgccgggcccacccgcatcagtacgcggtccacggaccgggtgcagggagcgagtgcgcggcggcccgaggcccagctgctgtataaataagcgccgcccgctcggctcttcttctcgctcgttcgctcagatccggaagctttggggaaggagctgtgcgtcgtgcacgggatcggtatcgcgcagtggcagctggccgggtgactacgacgggagcgggatgggcctcctcgacaagctgtgggacgacaccgtcgcggggccccgcccggacaccggcctcggccgcctccgcaagcagcccgtgcgccccgccgccgtgaagatcaatgatccggccggggacgcggcggccttcgtcccgccgtcgccggcgtcgggcagcgaggagacgccggtcaaggtgacacgcagcatcatgatcaagcgccccgcggggtacccgtcgtcgccgaggagcgcggccagcacgccgccggcctcgccgcttgggaccaccccgcccatctcgccgttcgccggcgccggtggtcgcttcagaaggaaatcatcgtctgatgcttatgagagggcatccccaccagggacgaccagccccactcctcccttcgaagtgtgagcacgcaacatgctcacacacctttttgctcgttgacaagcatctacttcaccaaaggtgtaggggaggaggagagaggacatcaagaggggaacaggaataaaccacgggccgtcttacctctactgtgatatattgtagatgctgctatgctagtgtttttgcatccacagtgtggcttagtttgttgaatatgttgaaagctctttgtggtgtgccgtgtcaataagctgctgaagtgtgcatgtggcagcagggctgcgtggagctttgcccttgctgcgttgtgtttgttccctctacctgctgcgtgtcaaatggatagggtcttgcctgtaatgttagcggggtttgaggtggagtgcatgtaatgtaatcctttttgatgtgtggtatcttgtaaactgaaggtgtttgcttgaactcactgtgaatccgcgatgctatgtgatggatgctgtgcagcacattcgtagattgaacatcgaccgcattgactgt

SEQ ID NO: 1785 - DNA, 1047 bp, Zea mays
accttcttctcgaccagatccggaagttctgtgggtagaggactagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgtcccgccgccgtcaagatcagtgatccggccggggacgctgcagcgttcgtgccgccctcgccggcttcgggtagcgaggagacgccggtgaaggtgacgcgcagcatcatgatcaagcgccccgcggggtacccgtcgtcgccgaggagcgcggcaagcacgccgccggcctcgccactggggactaccccgcccatctcgccgtttgccggcgccggtggtcggttcagaaggaaatcatcgtccgacgcatacgagagggcgaccccgccagggacgaccagccaccctcctcccttcgacgtgtgaactgaccgcaccctcgcacttgtttttgctccttcacaagcatcatctacggtagacagggaggaccggagaagaaagacatcaagaggggaatggggatgatctagtcgcgggttgtcttacctctactgtgatatattatattgccgctatatctgtatggtttccttcctagtatgtggcatatgatgtataataataatacgtcgaacgctcatggtactgtgctgtgtgtgccatgtgcataggggtgggtgcctcagggtcagggattcgtgtgcgctatgccgcagcttggatctcgccgtgggccgtgtcgtgtgtttcctcctgctctgctatgtatgtcatcactgacggtgtgtggaggttgggttcatatatatgcttgtaatgttagctggtttgaggtgtggactacgagagtagttttgttcagtgtctggtatctagtagctgaaggtgtttgcttgaaactctgtcaactgtgatgtgggataatgctaagaagatgaatagatgatcgttgggttgtcttgtc

SEQ ID NO: 1786 - DNA, 951 bp, Pennisetum glaucum
gaagctttgggagaagggaagggaagggaagggaagcgaagtagactgcgcaccggatcggccttcggtgatcacgacgggagagggagggatgggcctcctagacaagctgtgggacgacaccgtcgcggggccccgcccggacaccggcctcggccgcctccgtaagcagcccgtgcgccccgccgccgtcaagatcaatgatccggccggggacgccgcggcgttcgtcccgccgtcgccggcgtcgggcagcgaggagacgcccgtgaaggtgacgcgcagcatcatgatcaagcgccccgcggggtacccatcgtcgccgaggagcgcggccagcacgccgccggcctcgccgctggggaccaccccgcccatctcgcccttcgccggcgccggtggccgcttcagaaggaaatcgctgtctgatgcgtacgagagggcatccccaccagggacgaccagccaccctcctccttttgaagtgtgagcacgcaacacgttcatcactccttttttgctccttgacaagcatctacttcacctaaggtagaggaaggaggagagaagacatcaagaggggaacggtgataagtcgttggctgtcttacctctgctgtgatatattgtagatgtcgctgcgtagtgtttttgcatccactctgtggcttcagttgtagaatatgttctaagctcttggtggtggtggtggtgtgtgtgttcctgtctggctgtctcaataagttgctgtgtgcacatggcggctaagggctgtgtggagctttgccacggcccggaagctcactgtgtcgtgtttgtttcctcttacctgtcgtgtggaatggatggtgtgtgcaggatggggtcgtgcttgtaatgttagcaagggtttgaggtggagtgcatgtgtatgtaatccttttatgtgtggtatctaataaactgaaggtg

SEQ ID NO: 1787 - DNA, 915 bp, Panicum virgatum
ctcagatccggaagctttggggaaggagctgtgcgtcgtgcacgggatcggtatcgcgcagtggcagctggccgggtgactacgacgggagcgggatgggcctcctcgacaagctgtgggacgacaccgtcgcggggccccgcccggacaccggcctcggccgcctccgcaagcagcccgtgcgccccgccgccgtgaagatcaatgatccggccggggacgcggcggccttcgtcccgccgtcgccggcgtcgggcagcgaggagacgccggtcaaggtgacgcgcagcatcatgatcaagcgccccgcggggtacccgtcgtcgccgaggagcgcggccagcacgccgccggcctcgccgcttgggaccaccccgcccatctcgccgttcgccggcgccggtggtcgcttcagaaggaaatcatcgtctgatgcttatgagagggcatccccaccagggacgaccagccccactcctcccttcgaagtgtgagcacgcaacatgctcacacacctttttgctcgttgacaagcatctacttcaccaaaggtgtaggggaggaggagagaggacatcaagaggggaacaggaataaaccacgggccgtcttacctctactgtgatatattgtagatgctgctatgctagtgtttttgcatccacagtgtggcttagtttgttgaatatgttgaaagctctttgtggtgtgccgtgtcaataagctgctgaagtgtgcatgtggcagcagggctgcgtggagctttgcccttgctgcgttgtgtttgttccctctacctgctgcgtgtcaaatggatagggtcttgcctgtaatgttagcggggtttgaggtggagtgcatgtaatgtaatcctttttgatgtgtggtatcttgtaaactgaaggtgtttgcttg

SEQ ID NO: 1788 - DNA, 701 bp, Saccharum officinarum
agaggactagggactgtgcaccagatcggtggtctggccgtggcagttgggtgattacgacggagagggatgggcctcctcgacaagctgtgggacgacaccgtcgcgggcccgcgcccggacaccggcctcggccgcctccgcaagcagcccgtgcgccccgccgccgtcaagatcaatgatccggccgaggacgctgcggtgttcgtgccgccctcgccggcttcgggcagcgaggagacgccggtgaaggtgacgcgcagcatcatgatcaagcgccccgcggggtacccgtcgtcgccgaggagcgccgcaagcacgccgccggcctcgccactagggaccaccccgcccatctcgccgtttgccggcgccggtggtcgcttcagaaggaaatcatcatctgacgcatatgagagggcaaccccaccagggacgaccagccaccctccttctttcgaagtgtgaattgactgcaccctcacacttgtttttgctccttgacaagcatctacatcacctaaggtagacagggaggagagaagacatcaagaggggaacggggatgagttgcgtgtttacctttactgtgatatattgtagatgccactatgtgtattgtttcctatctactatgtggcatgtgttggataatatgttgaaagctcatggtgccgtgctgtgtcaataaggtgctatgt

SEQ ID NO: 1789 - DNA, 979 bp, Panicum virgatum
cagatccggaagacttggggaaggagctgtgagcgcacgggatcgacctcgcgcagtggcaggtggctgggtgactacgacgggagcgggatatgggcctcctcgacaagctgtgggacgacaccgtcgcgggcccccgcccggacaccggcctcggccgcctccgcaagcagcccgcgcgccccgccgccgtgaagatcaatgatccggccggggacgcggcggccttcgtcccgccgtcgccggcgtcgggcagcgaggagacgcccgtcaaggtgacgcgcagcatcatgatcaagcggcccgcggggtacccgtcgtcgccgaggagcgcggccagcacgccgccggcctcgccgctagggaccaccccgcccttctcgccgttcgccggcgccggtggccgcttcagaaggaaatcatcgtctgatgcttatgagagggcatccccaccagagacgaccagccgcactcctcccttcgaagtgtgagcacccagcatgctcacactcctttttgctccttgacaagcatctacttcaccaaaggtagaggaggaggaggagagaagacgtcaagaggggaacgggaataaaccacgggctgtcttacctctactgtgatatattgtagatgccgctatgcgtctgtttttgcatccactctgtggcttagtttgtagaatatgttgaaagctcttggtggtggtgtgccgtgtcaataagctgctgatgtgtgcatgtggcagctaagggctgcgtggagctttgcccttgctgcgttttgtttgttccctctacccgctgtgtgtcaaatggatggggtctcgtctgtaatgttagcatggtttgaggtggagtgcatgtaatgtaatcctttttgatgtatggtgtctagtaaactgaaggtgtttgcttgaacttaactgtgtatctatgatgctatgtgatgatggatgctgtacagcacattcgtattg

SEQ ID NO: 1790 - DNA, 500 bp, Cenchrus ciliaris
cggaagctttgggggaagggaatccttcggtgaacactaccgcagagggagggatgggcctcctcgacaagctgtgggatgacaccgtcgcgggcccccctttagaggagcggcctcggccgcctccgcaagcagccggcgcgccccgccgccgtcaagatcaatgatccggcaggtgacgccgcggcgttcgtcccgccgtcgccggcgtcgggcagcgaggagacgcccgtgaaggtgacgcgcagcatcatgatcaagcgccccgcggggtacccgtcgtcgccgagaagcgcggccagcacgccgccggcctcgccgctggggaccaccccgcccatctcgccgttcgccggcgccggtggccgcttcagattgaaatcgttgtctgatgcatacgagaggccatccccaccagggacgactagcctccctcctccctttgaagtgtgagcacattgttcacactcctttttgctccttgacaagcatctacttca

SEQ ID NO: 1791 - DNA, 1310 bp, Oryza sativa
gtgggcctcgctccccgtggccgtggcccgctcctataaataggctcccccgccacttcacttcttcttctccccagatccgaagcgagaagcctcttttggatctatccattcgggtcaccgtggcagttcggtaattttggcggagaggaggaggaggacgacgacgacgacgacgtgatgggtctcctcgacaagctgtgggacgacaccgtcgcggggccccgccccgacaccggcctcggccgcctccgcaagcacgccgccgcccgccccgccgccgtcaagatcaacgacccgacaggggacgcggcgatggtggccgtcccgccgacgacgccggccggggcggaggaggcgccggtgaaggtgacgcgcagcatcatgatcaagcgccccgcggggtacccggcgtcgccgaggagcgcggccagcacgccgccggcctcccccgccggatccacccctcccatctcgccgttcgccggcgccggtggtcgcttcagaaggaaatcatcgtccgacgcatatgagagggcaacacctgggacaaccagtcaccctcctccctttgaagtgtgagcccccagcgtgctcacgctcgtttttgctcctaggccagcgtctactgcacacacaaggcagaggaggaggagagacatatcagagaccgaagcggatggaagtcgagtgttgtctacctatcttacctctactactgtgatataacgtagatgctactagtaattaagtacgcctgctgctgctcgccgtctactatgttgagtcgtgtatggtttgtgtagtaaggttgtcgtctgctgtgtcatatatgtacatatgtttgctctgggctgcgatggagcttgctgcagtctgcagccaagcccgcagttcatcgctgcgtcgtgttttcgcgtccttttaagccctctgcaactatgtcaaatggatgggcatgtggaggatggtggaatgagctttcaggctgtgatgctaaagatggaagcactgatggctggtgtgtgattttgcttgatgtattatctgaattctcaagtagtagatgctttgcttgaaccttgtatatttgcaatgctcgaggcttcttggctagaagatgttttgcttgaaccctgtatatttggaatgttccaataagctaactggcctgtcttttgtgcatgttcgctgtctggtctggatgctttgataattgggattcgtaagaggtctgaaaagtgttaacactaaaccagatcgcaaggcaaatgcaagctattagatcgccagttggaatcttactgtga

SEQ ID NO: 1792 - DNA, 822 bp, Pseudoroegneria spicata
  misc_feature (31)..(32): n is a, c, g, or t
  misc_feature (34)..(35): n is a, c, g, or t
ctggtagtagctgggagttcggaccgatccnncnntctcatctctctcagtggcagtctggtaattggagacaaggcatgggcctcctcgacaagctgtgggacgacaccgtggcggggccccaacccgacaccggcctcggccgcctccgcaaactcgccgcccgccccgccgccgtcaagatcaccgatgtggctcctgacgccgcgacggtgatcccgcccacgacgccggccggcggcgaggacgcgccgatgaaggtcacgcgcagcatcatgatcaagcggccggcggggtacccctcgtcgccgaggagcgcggcaagcacgccgccagcctcgccgctgggatgcacgccgcccatctccccgttcgccggcgccggtggccgcttcagaaggaaatcatcctcagacgcatatgagagggctacaacacctggggcgtcgaccagtcaccctcccccctttgaagtgtgactgcccagctggggcgctcatgcaagtttttgctccttggcccgcatctacttcacgcaaggcagtggaggaggaagagaagaaatatcatcgtcagggaaatcgagaaaatgccgaggagtctgccttacctctactgagatacagtatgtaatatagatgaatgtgtagtgttctctctctactatgtatgcagtgcacgcgtgtgtggttatgtgtagagaaggtggtgttgaaagttgctgctgatgtgctgtgttagtatgtacttagccacttaggtcacccctggcacgcagctcctcgtttgtgttttgaagatacggtgtagtacgtgtaattt

SEQ ID NO: 1793 - DNA, 1157 bp, Brachypodium distachyon
gcccctgccctctccacttccactcttctcctcgctctctcagatccgaaaacttgggaagaagactctggctgttctgaacttctgatctatccatctctcagtggttttctggtaaaatcggagacgagggatggggctgcttgacaagctgtgggacgacaccgtcgcgggtccccgccccgacaccggcctcggccgcctccgcaacctcgcctcccgccccgccgccgtcaagatcaacgatgttgctgcggacgcggcgcccaaggttatcccgcccacgacgccggccggcggcgaggacgcgccggtgagggtcacgcgcagcatcatgatcaagcggccggcggggtacccgtcttcgccgaggagcgcggccagcacgccgccagcctcgccggctggatccacgccgcccatctccccgttcgccggcgccggtggtcgcttcagaaggaaatcatcctcagatgcatacgagagggcaacaccacctggaccgtcgaccagtcaccctcccccctttgaagtgtgacctctcagcgtgctcacgctcggttttgctcctcggccagcatccacttcaggcaaggcagaggagaaggagaagacataacatcgtcagaggaacgagagggtctgcctctcctgtgatatagtaatgtagatgtcaatgtgtagtgttctctttctactatatatgcagtgcaggcgtgtatggttatgtgtagagaaggtgttgaaagttgctgttagtctactactatggtgcctggagatctcttctctacacagcatctccttggtgtttcatctactacggtgctaccacgatgcgtgtggaggatgttgctgtctttgcaagctgtaatgtaatgttaagcagggcgtagaggtgtgtaatcttgcttggtgcggttatctgaagtacggagtagtccgcgttgtttgcttgaacttctgaattgtctccgtgtctttggcatgatctcgagtcatcactcattacctggtactttcttctgcatggttactctatgcatgtcatagctcgctcattctaaaatgctggaatggtcgccaatggtaactttggctttgccattacttgtgtgcttatcccatatcaatggagattggtcaattattatacc

SEQ ID NO: 1794 - DNA, 945 bp, Hordeum vulgare
aatcttctccttctctcagatccgaaaacttggggagactggttgttgggtgttcggatcggtccatccatctcagtggcagtctggtaattggagagacgaggtatgggtctcctcgacaagctgtgggatgacaccgtcgcggggccccaaccggacaccggcctcggccgcctccgcaaactcgccgcccgccccgccgccgtcaagatcaacgatgtggctccggacgctgcgacggtgatcccacctacgacgccggccagcggcggggatgcgccgatgaaagttactcgcagcatcatgattaagcggccggtggggtacccctcgtcgccgaggagcgcggccagcacgccgccagcctccccgctaggatccacgccgcccatctccccgttcgccggcggcggtggtcgcttcagaaggaaatcatcctcggatgcatacgagagggctacaccacccggggcgtcgaccagtcaccctcctcccccttttgaagtgtgactgcccagcgtgctcatgctcgtttttgctcctcggccggctctacttcaagcaagggagaggaggaagaggagtataaaatagatgaatgtgtagtgttctctttctactatatatgcagtttacgtgtgtatggttatgtcaagcagagaaggtgttgaaagttgctgctgctactgtgctgtgttagtatgtacttaggtcacctctattctggcacgcagctcctcgtttgtgttttgtctactatgttgtcgaggccttgtccttccatcatgttcgtgtgttgtgcggatggaagcagtaatgttaagtacgtagtacgtgcaattttgcttgatggtgttgtctgaagtagttcccggtgtttgcttgaacttttctgtattatctgcgtgtgtttgccattataatccctagcactttctcatgcac

SEQ ID NO: 1795 - DNA, 1002 bp, Pseudoroegneria spicata
  misc_feature (7)..(9): n is a, c, g, or t
gatcccnnncttggggagactggtagttggctgttcggatcggaccatccatctcagtggcagtctggtaattggagacgaggtatgggcctcctcgacaagctgtgggacgacaccgtcgcggggccccaaccggacaccggcctcggccgcctccgcaaactcgccgcccgccccgccgccgtcaagatcaacgatgtgactccggacgccgcgacggtgatcccacctacgacgccggccagcggcggggatgcgccgatgaaagtcacccgcagcatcatgattaagcggccggcggggtacccctcgtcaccgaggagcgcggccagcacgccgccagcctcgccgctaggatccacgccgcccatctccccgttcgccggcggcggcggtcgcttcagaaggaaatcatcctcggatgcatacgagagggctacaccacctggggcgtcgaccagtcaccctcctcccccctttgaagtgtgactgcccagcgcgctcatgctcgtttttgttcctcggcccgctctacttcatgcaaggcagaggaggaggaagagaagacatatcatcgtcagaaatcgagaaatgccgagggtctgccttacctctactgtgatctagtacaatatagatgaatgtgtagtgttctgtttctactatatatgcagtgcacgcgtgtatggttatgtgtagagaaggtgctgaaagttgctgctgctgtgctgtgttagtatgcactaaggtcacccctgtgctgcgcagagctagctgcggcacgcagctcctcgtttgtgttttgtctactatgttgtggaggcctcgtccttccatcacgttggtgtgtggtgcggatggaagctgtaatgttaagtagggggcgagatacggtgtacgtagtacgtgtgattttgctttatggtgttgtctcaagtaagtagttcccggtgtttgcttgaacttttctgtattatcttcgtgtgtttgccatgataatca

SEQ ID NO: 1796 - DNA, 1001 bp, Secale cereale
cggtcgagtcctcgaagccgaaaacgttggggtagactggtagttcggtctgttcggatcggtccatccatctcagtggcagtcgtaattggagacgaggtatgggcctcctcgacaagctgtgggacgacaccgtcgcggggccccaaccggacaccggtctcggccgcctccgcaaactcgccgcccgccccgccgcggtcaagatcaacgatgtggctccgggtgccgcgacggtgatcccgcctacgacgccggccagcggcgaggatgcgccgatgaaagtcactcgcagcatcatgattaagcggccggcggggtacccctcgtcgccgaggagcgcggccagcacgccgccagcctcgccgctaggaaccactccgcccatctccccgttcgccggcggcggtggtcgcttcagaaggaaatcatcctcggatgcatacgagagggctgcaccacctggggcgtcgaccagtcaccctcctccccccctttgaagtgtgactacccagcgcgctcatgctcgtttttgctcctcggcctgctctacttcatgcaaggcagtgtaggaggaagagaagacatcatcgtcagggaaatcgagaaatgccgagggtctgccttacctctactgtgatctagtataatatagatgaacgtgtagtgttctctttctactatatatgcagtgcacgcgtgtatggttatgtgcagtgatggtgttgaaagttgctgccgctgtgttagtgttagtatgcacgtaggtcacccctgggctggcacgcagttcctcgtttgtgtttgtccttccatcacgtttcgtgtgtggtgcggatggaagctgtaatgttaagtaggggggcgagatagatacggtgtacgtagtatgtgtaattttgcttgatggtgttgtctcgagtagttctcggtgtttgcttgaacttctctgtattatcttcgtgtgtttgccataataatccccagtactttctcttcgg

SEQ ID NO: 1797 - DNA, 1094 bp, Triticum aestivum
cggaaacttggggagactggtagttggctgttgggatcggtccatccatctcagtggcagtctggtaatgggcctcctcgacaagctgtgggacgacaccgtcgcggggccccaaccggacaccggtctcggccgcctccgcaaactcgccgcccgccccgccgccgtcaagatcaacgatgtggctcctggcgccgcgacggtgatcccacctaccacgacggccggcggcgaggatgcgccgatgaaagtcacgcgcagcatcatgattaagcggccggcggggtacccctcgtcgccgaggagcgcggccagcacgccgccagcctcgccgctaggaaccacgccgcccatctccccgttcgccggcggcggtggtcggttcagaaggaaatcatcctcggatgcgtacgagagggctacaccacctggggcgtcgaccagtcaccctcctccaccctttgaagtgtgactgcccagcgcgctcatgctcgtttttgctcctcggcccgctctacttaatgcaagcccgaggaggaagagaggacgtatcagagaaatctgagaaacgccaagggtctgcctttcctctactgtgatagtataatatagatgaatgtgtagtgttctgtttttactatatatgcagtgcacgcgtgtatggttatgtatgtgtagagaaggtgttgaaagttgctgctgctgtgctgtgctgtgctgtgttagtatgtacttgctgtgttagtatgtacttaggtcgtcacccctgggctggcacgcagctcctcgtttgtgttttgtctactatgttgtggaggcctcgtccttccatcacgttcgtgtgtgctgcggatggaagctgtaatgttaagtaggggggtgagatacggtgtacgtagtacgtgtaattttgcttgatggtgttatctcgagtagttctcggtgtttgcttgaacttttcagtattatcttcgtgtgtttgccatgataatccctagtactttcttctgcacagttactctccggacgctgtctgttctaaataaatgttgtaaatggtccgtaacatctgagagtgaatactacttgcctct

SEQ ID NO: 1798 - DNA, 865 bp, Saccharum officinarum
tggttccggaggaaggagtgcgagcagactgcagccgaatggcggcagcggcgcggccatccaatgccactcttctcgcgcgcctccgggacggcacggccaagttcgagctcctggacgactctgcgcttgcgcacgcgcccccggcctggccccgactccactgcttcgccagggttgcctcctcgctgaggggtgggtggtcggcggcgctaaacaaggtggagcattacggggttcagagggtcaccggcgatggccggtgcatgtttcgagcgttggctaaaggaatggcaaaaaacaaggggattcctttggccccaagggaggaggtacaagatgcagatgatttacggatggcagtgaaagaaattatatgcgacagggagactgagcggcaggagtatgaagaagcagttatagcaattactatggagcaatcattgaaacgctactgccaaaggataaggcggcctgatttctggggtggagagtcagaactcctggttttgtctaggctgtgtcggcagccaataattatatatattccagagcgtgagtaccatggtcggggtaatggcttcattcctatagctgaatatggtttggaattcaccaaaaatacaaagcagtggaagaaaaagacaccagtaagactattgtacagcgggaggaaccattatgatttgctagtctgacatggctgcagaactatgtaacttttagtggccggtggcataccatggctggattatcttttgtttttatacctgtgcttatgccccttttttagccaccaatgaaattagttcagttatcaaaatatcaatttcgtaatatatatatgtcatttgcaaaaaaaaaa

SEQ ID NO: 1799 - DNA, 984 bp, Zea mays
ggaggatagatggctcatggctgccatcgtctaggctcaacatccgaaagacgggccatggtcggtttccttcctcaccccagcggcggacatctatccgaaaataggccgcacctcgtccgctttgctccttgttcatccttcacctgctgatggcggcagcggcgcggccatccaacgccactcttctcgcgcgcctccgggacggcacggccaagttcgagctgctggatgactctgcgtttgcgcttgcgcacgcgcccccggcctggccccgacttcactgctttgccaggattgccccctcgttgaggggtgggtggtcggcagcgttgaacaaggtggagcattacggggttcagagggttaccggcgatggccggtgcatgtttcgagcgctggctaaaggaatggcaaaaaacaaggggattcctttggccccaagggaggaggtagaagatgcagatgatttacggatggcagtgaaagaaattatatgtgacagcgagactgggcggcaggagtacgaagaagcagttatagcaattactgtggagcaatcattgaaacgctactgccaaaggataaggaggcctgatttctggggtggagagtcagaattcctggttttgtctagactgtgtcggcagccaataattatttatattccagagcgtgagtaccatggtcggggtaatggtttcattcctatagctgaatatggtttggaattcaccaaaaatacaaagcagtggaagaaaaagacaccagtaagactattatacagtggaaggaaccattatgatttgcttgtgtgacatagttgcagagcaatgtatttttctagtgcccgtcgtcataccatggttgtattattttttgtttttatacctgtgcttgtgccccttttttgagccaccaatggaattgattcagttatccaaatatcagtttcgaaatatatatatttctcgtttgcatgct

SEQ ID NO: 1800 - DNA, 786 bp, Cynodon dactylon
ccgggggggcatcgacttgcgttgcgtgtgtttgcagattgcagcagaatggcagcagcggcgcggccatctaacgccactcttcttgcgcggctcagggacggcacggccaagttcgagctcctcgaggaatccgcgccggctcctccgtcctggccccgcctccactgtttcgccaggatttcctcctcgctgaggggagggtggtctgcggcgctgaacaaggtagagcactacgggattcagagggtcactggcgacggccggtgcatgtttcgagcgttggttaaaggaatggcaaagaataaggggattcctttgaccccaagggaggaggtacaagatgcagatgatttgcgaatggctgtgaaagaagtaatatgtgacagcgcagccgaacggcaaaagtatgaagaagctattattgcaattaccgtggagcaatcattgaaacgctactgccaaaggataagacggcctgatttctggggtggagagtcagaactcttggttttgtccaaactgtgccagcagccaataattatttatattccagagcatgagtaccacggccggggtaatggtttcattcccatagctgagtatggattagaatttaccaaaaattcgaagcagtggaagaaaaagatgccagtaaggctgttatacagtgggaggaaccattatgatttgttaatataacatgattgcagaattggttcacgtaaaatgccagttctgagaatcagttttccggttcaagaacttgttcaattatcaatatat

SEQ ID NO: 1801 - DNA, 1297 bp, Triticum aestivum
attcggctctcctcctctcctccggtgccgcttccggtcttccagattgcagccaatggcgccaccggcgcggccatccaatgccacgcttcttgcgcggctcggggagggcacggccaggttcgagctcctcgaggaccccgcgcctgctcccgcgccgccggtttggccccgcctccactgcttcgccaggattggctcctcgctgaggggcgggtggtcggcggcgttgaacaaggtggagcactacggggtccagagagtcaccggcgatggccggtgcatgtttcgagccttggctaagggaatggcaaagaccaggggaattccattgaccccaagggaggaggtacaagatgcagacgacctacggctggcagtgaaagaggttatatgtgataaccaaaccgagcgtcaaaagtatgaagaggcgattatagctattacagtggatgaatctttgaaacgctactgccaaaggataaggcgacctgatttctggggtggagagtcagaactcttggttttgtctagactgtgtcggcaaccaatcattatttacattccggagcgtgagtaccgcggacggggcaacgggttcatcccaattgcggagtacgggttggagtttaccaaagactcgaaagaggggaagaaacgggtgccggtgagactattatacagtgggaagaaccattatgatttgctgatataaaatgggcacatgagatatgccccgatgaagcatcagaataccggcagccaccgcccatctgtggcgcatacacaaattcccgtttactttccatggttacatccttcgatcctgctatgctcctgcttgtcagttacgatgctgtaacagctgtttcgtcgatgacagtcatgggcatttggggaatttgtggatttggagctagaagaattagcactgacctgatgatagcgccacacgagctaactatgtgctgcatggtgcagtgctgttttggcagtgatttggttggcgtggtgccgtggagttgttgattgcgtttccggttggtgccgggcagaataatggtgcgttggtcgcactcgcactcggtggttgacgattggacttgcttcaaatccaatcattatgtgagtatgtgatggttattaggtatatcattttgcaacgcactgctggccggaatgatatcttccttagatgagctgtacgggcgtgtttggtagtactatcagcttattaggggtaccgtccggcccagtgaacaaatttgatggctgttacgggcacattccagtatgc

SEQ ID NO: 1802 - DNA, 1278 bp, Panicum virgatum
tagaaattctgaattatgaagaggaatggggatattgcttctctctttaggaagcatgaagcaaagaaatttgctgctgttgctttatctccaccagctccggctacaaaagttgttgaagagggagatcgggagcacgagagtggaactgaagaaattgtggaatgaagaaattgtggaatccagccttgtgcaatcttctgtggtttcagaaatacatttggacttaatatgtttgaaccatttgcattataatttatggaaccttggtacttaattgttgaatttaagatatgcaatgttatatactgaattataagagtttttaccgaattatataagatatatatactatttgtatacggacaatataccgaattgcaagtgaaaaaaatatcgcggcataccctttactcaaatcctaggtacgccactgcttcgcgccggcacctgcgccagcaccgtcttggccccggctccactgcttcgccaggattgccccctcgctgaggggcggttggtcagcggcgctgaacaaggtggagcattacggggttcagagggtcaccggtgatggccggtgcatgtttcgggcgttggctaaaggaatggcaaagaataaggggattcctttgaccccaagggaggaggtacaagatgcagatgatttacggatggcagtgaaagaaattatatgtgacagcgagactgagcggcagaagttcgaagaagctgttatagcaattactgtggaacaatccttgaaacgctactgccaaaggataaggcggccagacttctggggtggagagtcagaattcctggttttgtctagactgtgtcgtcagccaataattatttatattccagagcgcgagtaccatggtcgtggtaatggcttcatccccatagctgaatatggattggaattcgccaaaaattcaaagaattggaagaaaaaggcacctgtaagacttttatacagcgggaggaatcactatgatttgctcatttgacatggttacatggctgttcagaggggggtgtgtgtgggttttgtaactctcttcttatattaatgcaatgatacacagtcctcctgtgctatcatttttttttgttgcattgtcattctatggttgcattttttttctttctattcatatgctggttgtttagccaacaatagaattggttcagctataagtatctctttttttttgccaaaataagtatcaaaattccaattttgaaatagagagtgtcgttcgatgggct

SEQ ID NO: 1803 - DNA, 4087 bp, Oryza sativa
aaacatcctaattaatagatataattaccttttcaggactctatccacgtgcggcaatcatcttgaagcatatcaactcaaacccaatgttggatacgagtcatattgccggaatcggctgtatcacctaacccagtctgattcagatttagccgattctagtcgtagccgatctggactccagccgattcttactctgttcccgcaacaacccttatctttggttccgcttcgatcccatgttcacccccgatgctgatattaccaaatttggtcgttaacagttgtcaatgtcttttaaaaaattttaataaacaacgagaagaagtcccctcgagaaataaaagtttacgtcccacaaacaaatcttatttaataagggcattctattcttgcttaatcttattcaaaagagaataatccttgggagtacggagtactgcactgctcctaccttctgcaaatccaatcaatcgcgggttaatatcccagcacaggtcctcgtggacatcgtcgtgttgtcgggcgcgtgttcttgtgagccagcaatctccttcgatctgcgcgccatcctccccgatcgtgacctgcgccatcctccccgattgagactcgcgccagcagaattaacaatcaaggattgccttttcttccacagaaaaaaatcgccttctcgcgggtgggtggcagggtgggtatacgtacacgtctccgaagccgcaaccaaaaccaggcaaccagcacgcgatggggaggggcgagcaggaggcggcggcgagccatgggttcggtagcatggaggagttctgggggttctacctgacccagcactccaagcccggcacccggcggtggcacttcctcggcacgctcgccgcgctcgcctgcgcgctcctcgcggccgtctccggccgcgccgcgccactcctcgccgcgcccgtcctgggttacggtatggcgtggtacagccacttcttcgtggagggcaaccggccagccacgttcggccaccccgtctggtctttcctctgcgacctccgcatgttcgccctcatcctcaccggccgcatcgacgccgagctcgctcgcctccgcctccagccgcctcacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcagggaggtgtagaggttggtgggtgggtcgattggcttagcgagaggtggacgtgcgcgtgagatgccaggaggacggaatttgaccgcgcgcgcggtgcatctcgcggcggcgcgcgtactcgggtgttcgtttgcaggcccggaacgtcgcgtatgcggccgaaggcccaacaacaaagtccccgttgataactgggcccccgtccgtttcctctcctcggccgcatatctgcacaagacggcaaacaccgcccactcttgcagaattcttcctctccgcttctctgctcatctgctggtggtggctgcagattgcgctccgatggcgcaagcggtgcggccgtgcaatgccacccttctcgcgcggctccgtgacggcgaggcgaggttcgagctcctcgaggactccgcggccgcggccgcggcctcgcccgctcctgctccagtttggcccggcctcagctgcttttctagggttgctacctccctgaggggcgggtggtcgggggcgctgaacaaggtggagcactacggggtccagagggtcacgggtgatggccggtgcatgtttcgggcgttggtgaaaggaatggcaaagaacaaggggattccattgacctcaagggaggaggtacaagatgcagatgatttacggatggcagtaaaagaagttatctgcgatgatgagactgaacgacaaaaatatgaagaggcagttatagcaattactgtggatgaatcattgaggcgctactgccatagaataaggcgatctgatttctggggtggagagtcagaactcttggttttgtctaaattgtgtcggcagccaatcattatttatattccagagcgtgagtaccatgggcgtggaaatggttttattcctatagcagagtatggactggaattctccaaggactcaaaacagtggaagaaaaaggtgccagtaagactgttatacagtgggaggaatcattatgatttgctagtataacatggttgcaccgaacgttatcagtaccctgaaggtctgaactatttatgacaactgattttgattccatcattccattgttattctttgatcccacgtagttttttgcttgcgtctctgcagacagcttcgatgctactccatccattccaaattgatctaatatagttttttttgaagttattcttaaatgatctacatatttgtgttcatttattgagtattcgttatttgtacattggagtaaatggacattgatgcatgcatctatgcacacaagtatttataacccacatgcaatatcttgatttgctattggctaagaaatattagggatggtgtatacatcgagtttgttgctagagtaaatatagtatgagagacttattagcttttcttggtcttggggtacctatgaaaatgtaaatcaatttggaatggagggagtatatagctactggtctacctaaggaaaacccatata

SEQ ID NO: 1804 - DNA, 1188 bp, Hordeum vulgare
taccccggccgggcacatctctaacaccgctatccccttcctcctacattcggctctcctccgactgcagcttccggtcttccagattgctgccaatggcgccaccggtgcggccatccaatgccacgcttctcgctcggctcggggagggcacggccaggttcgagctcctcgaggaccccgcgcctgctccggtttggccccgcctccacggcttcgccaggattggatcctcgctgaggggcggctggtcggcggcgctgaacaaggtggagcactacggggtccagagagtcaccggcgatggacggtgcatgtttcgagccttggctaagggaatggcaaagaccaggggaattccattgaccccaagggaggaggtacaagatgcagacgacttacggctggcagtgaaagaagttatatgtgacaaccaaaccgagcgtcaaaagtatgaagaggcaattatagccattacagtggatgaatctttgaaacgatactgccaaaggataaggcgacctgatttttggggcggagagtcagaactcttggttttgtctagactgtgccggcaaccaatcattatttacattccggagcgtgagtaccgcggacggggcaacgggtttatcccaattgccgagtacgggttggagtttaccaaagactcaaaagaggggaagaaacgggtgccggtgaggctattatacagcgggaagaaccactatgatctgctgatataaaatgggcacatgagacacgtccgggctaagcatcagacagaataccggcagccacaccgcccatccgtggcacatatataaattcccgttttctttccatggttacattcttcgatcctgctaattaagctcttgttcttcggttatgatgctgtaaccgctgtttcgttcatcacggtcatgggcattttgggaatttgtggatttggagctagaattaccaccggcctgaacctggtgatagcgccacacgagctaactatgtctctgctgcatggtgatggtgatggcgtggaggccagtgctgctttggaagtgatttggttggcgtcgtgccgtggggttgttgattgcgttttccggttggtgccgggcaggataatggtgccttggtcgcactcggtggttgacgacgaggctcgcttcaaatccaatcatcatg

SEQ ID NO: 1805 - DNA, 1492 bp, Brachypodium distachyon
gacgctgggccggccgtcatccagttttctcctcacctccgcgacgcctctctcctccgtggtccgttccacaccctctcctccgctgccgcttccggattgcagccaatggagccagccgcgcggccatccaatgccacacttctggcgcggctcggggagggcgcggccaggttcgagctcgtcgacggcgccgcccctgatcccgcgccgccggtttggccccgcctccactgcttcgccaggattggctcctcgttgaggggcggttggtcggcggcgctgaacaaggtggagcattacggggtccagagggtcacgggcgacggccggtgcatgtttcgagcgttggctaaaggaatggcaaagagtaggggaattccattgagcgcaatggaggaggtacaagatgcagacgatttacggctggctgtgaaagaagttttatgtgacaaccaaaccgaacgtcaaaagtatgaagaagctattatagccattacagtagatgaatcattgaaacgctactgccaaaggataaggcggcctgatttctggggtggagagtcagaactcttggttttgtctagactgtgtcggcaaccaatcattatttacattccggagcatgagtaccgtggacggggtaatggttttattcctatagctgaatacggattggagttcaccaaaaactcaaaggagagaaagaaaagggtgccagtaagactattatacagtgggaggaaccattatgatttgctgatataaaatggttaataacatgtacctggctcaactgctcaagtatcagaatatcagtactcactacccatccgtggcacataactgatccccttgccatggttctattctctgaccaagttgatgcttgtctttttgccacacagttgtatgctataaccgacgttatatccatctgattaaagtcatagtcatgagtatttcgccgagtgcatttgcagcttttgagccaaaatgaacactaacctgatagtgtcacatgacctaactatctgttgcatgatgagttctagcatagtgaggccaaagctttttgccaatgccaatgtgatttggttggcgtcgtgccgtcaagttgttgaccacatttccggttggtgccgggcatgataatggtgtgttcgtcggacttggtggttgaaaggagaaggcgatgggacatggttcaaacccaattataaacgtcatcttgcaagcccggttgataggaatgatatttttaatgagctgtacactacgccacatctatcggctgtatttcttcttttttttgcgaggatcggctgtatttctaggcccctggaaaataacatccaaggtttcagatgccagttgctcatgtttttgtaaatgtcgacaggaaagagttgctaaagaagcatggacgtacgtgttgaaaattgggcgatcattcaaacaaagaaaaaaaaatacggtgatgtttacggac

SEQ ID NO: 1806 - DNA, 2027 bp, Saccharum officinarum
cgacgaagcaacagagaggagggaggtgggaggagactaggagagggactggcctcatccaccctcccttccacttgcaggcattgcctgttctccactccagttcctggctccgtggctcgaggacggagcggaaggagggagaggcgccggtgctgtgcatccccagtcccatctccatccaattcacgactctgccgcggccggagccggaggaggaaggcgccatccacaggcaagcgaagggaatgccgccgttctagtctcgcagatctgctccgccgcgctgtgttcaccggaaattttggcgttgagagcgcaggttctcgcagaagctcgcgagcatatggccatggccgagggggagaagcaccatggcgggtagggctctctgatctcgtaggccttgcacgcggaccggcccaagcgcttcccgttcgatccgccggctagccgagaacgaaaaccgatcgagcgattgcttgactcgggagcaaagccgaggtcgtaatggcgtcgtgggacaacctcggggagctctccaacatcgcgcagctcacggggctggacgccgtcaagctcatctccctcatcgtcagggcggcgtccacggcgcgcctgcacaagcgcaactgccgccgcttcgcgcagcacctcaagctcatcggcggcctgctggagcagctccgcgtgtcggagctccgcaagtacccggagacgcgggagccgctggagcagctcgaggacgcgctccgccggggatacctgctcgtcaactcctgccaggaccgctcctacctctacctcctcgccatgggctggaacatcgtctaccagttccgcaaggcgcagagcgagatcgacaattacctacgcctcgtcccgctcatcacgctcgtcgacaatgcccgcattcgggatcggcttgagtatattgagagggaccaatgtgaatattcttttgacgaggaagacaagaaagtgcaagatgctctgttgaatcctgacccttgcacgaatcctacaatagtgctcaagaagactctgtcatgttcctatccaaacttgcctttcaatgaggccctccgaaaggaaagtgagaagcttcaggttgagcttcaaagatcacagagcaacatggatctgggttcgtgtgaggttattcaacacctgcttggagtaaccaaaactgtggaatctacaattccagaggaagaaacaaatgctaaagcttcggaaaagaagggttcaaactacagtgaatccaaaggggatagtgcaaaatcgtttgacgatgatgacgactatcctaagaagcaaaaggatgactatcctaagaagcaaaaggatacctgcagcacacaacgatgttcttcgcaagtttcatatggccatgatcttgtctcaagtagaggatcgtacagcgatgagtggcatgcagatttacttggctgctgttcagaaccggctttgtgtttgaagaccttgttcttcccctgtggaaccttctcaagaatttcttcagtcgccaaggacaggccaatgtcttctggagaggcgtgcaatgatattatggcatactccctaatattgtcctgctgctgttatacatgctgtgtaaggagaaagcttcgccaaaagttggacattgcgggaggctgctgtgacgactttctttcacatctgctttgctgttgctgtgcgcttgttcaagaatggcgggaagttgagattcgtggagcctatagcgaaaagacaaaggttaccccaccaccatgccaatatatggagcactgaacagccgtatgcccgtatgggtagaccggaacttctgtaaagatattaacagaatagtgatactacactatttctgtgtagtatttatgcttactgtccattgttcgtcctggtacttccatgtatatgtcgggacatagcagcagagctgcagagtagtgtgtaccttgtaaacacatcagttacaggccggtagagcctaacatcggttaacaccgtcagttcttggc

SEQ ID NO: 1807 - DNA, 2214 bp, Zea mays
agaaggacacggggaacgcaacatggctgtggtcattgcctcattggagtgaaccggtggtgggcagtgcggagtgccagcccagccagcagtaaccgccgaagcaaccggtgaggagggaggggaggggctggccgcatccactctccccttccacttgcaggcattgcctgttctccactccagttcccagctccgcagctcgaggacggaacggagggagatagggccaggggaagggacggagagccccgtctccaattcacaacactgccacggccggagccggaggaggaaggcgccagccgtagtccacaggcaacgcaagggaatgccactgttctagtctcgctctcgcagatctgctccgccgcgccctgttcaccgggaattctggagctgagggcgcaggttcgagcagaagctcggagcatggccatggccgagggggagaagcaccatgcccggtgccggtggtaggtagggctctctgatatcgcaggcctttcacgcggcccggcccaaaggcttcccgtccgtaccgtcggctagccgaggacggaaaccgagatcgggtgattgcttgactcgggagctgagccgaggtcgcaatggcgtcgtgggacaacctcggagagctctccaacatcgcgcagctcacggggctggacgccgtcaagctcatttccctcatcgtcagggcggcgtccacggcgcggctgcacaagcgcaactgccgccgcttcgcgcagcacctcaagctcatcggcggcctgctggagcagctccgcgtgtcggagctcaggaagtacccggagacgcgggagccgctggagcagctcgaggacgcgctccgccggggctacctgctcgtcaactcctgccaggaccgctcctacctctacctcctcgccatgggctggaacatcgtctaccagttccgcaaggcgcagagcgagatcgacaattacctccgcctcgtcccgctcatcacgctcgtcgacaatgcccgcattcgggatcggcttgagtatattgagagggaccaatgtgaatattcctttgacgaggaagacaagaaagtgcaagatgctcttttgaatcctgacccttgctcgaatcctacaattgtgctcaagaagactctctcatgttcctatccaaacttgcctttcaatgaggccctccgaaaggaaagtgagaagcttcaggttgaacttcaaaggtcacagagcaacatggatctgggttcgtgtgaggttatccaacacctgcttggagtaaccaaaactgtggaatctacaattccagagaaagaaacaaatgttaaagctccagaaaagaagggttcaaactacagtgaatccaaaggagagactgcaaaatcgtttgatgatgatgacgactatcctaagaagcaaaacgatgactatcctaagaagcaaaaggaaacctgcagcacacaacgatgctcttcacaagttccatatggtcatgatcttgtctcaagtagaggatcgtacagcgatgaatggcatgcagatttacttggctgctgttcagaaccggctttgtgtttgaagaccttgttcttcccctgtggaaccttctcgagaattgcttcaatcgccaaggacaggccaatgtcttctggggaggcttgcaatgatattatggcgtactccctaatattgtcctgctgctgttatacatgctgtgtaaggagaaagcttcgtcaaaagttggacattgcgggaggctgctgtgacgacttcctttcacatctgctgtgttgttgctgcgcgcttgttcaagaatggcgggaagttgagattcgcggagcttatagcgaaaagacgaaggttacaccaccagcatgccagtatatggagcactgaacagctgtatgcccgtacgggtagacccgaacttctgtaaagatattaacagaatatctgatatcgtactgcaagagcagtggtactacactgctcctgtgtagtgtttattcttactgtctattgttcgtcctggtcctggaacttgcatgtatatgttggggcatagcagcagagtatgtactctgtaaaaacacatcagttacaggctggtagagcctaacatcgcttaacaccgtcagttattggcaaaaaagttctttgtgcgtgtgcgtgtttaccttaatagcagttaaaaaaaagaagagctttagtc

SEQ ID NO: 1808 - DNA, 2047 bp, Setaria italica
gcagagcagccgaggtgggggggagaggaggagagggaactgagccgcgcagcctctcctcgcctcatccgctctccacgcctccccctccccctgccattccacttgccggcattgcctgttctccactccagttcccccgctgcgcggctcgagggagggagatagggttgcacacgcccagtccagtctccaattctgccacggctgccaaggagaggcgataggaggaatgctgctgctgtgatcttccagatctgcccggtcgcggtcgttttctccgcaatcaagaaccgaaagcgaggttcttggaaccatggccggcgggtggatgcaccgtggctagtagaattggccgggtctccctgatcttcgccctgcgcgcgagttaggcgagagaccgagcgactcgtgcgtgaagtgaaggagaagaattcaagatcgcaatggcgtcatgggacaacttaggggagctctccaacatcgcgcagctcacggggctggacgccgtcaagctcatctccctcatcgtcaaggcggcgtccacggcgcggatgcacaagagcaactgccgccgcttcgcgcggcaccttaaactcatcggcggcctgctggagcagctccgggtctccgagctcaggaagtacccggagacgcgcgagccgctggagcagcttgaggacgcgctccggcgcgggtacctgctcgtcaactcgtgccaggaccgctcctacctctacctcctcgccatgggctggaacatcgtctaccagttccgcaaggcgcagagcgagatcgacaactacctccgcctcgtcccgctcatcacgctcgtcgacaatgcccgcattcgggatcggcttgagtacattgagagggaccaatgtgaatattcttttgatgaggaagacaagaaagtgcaagatgctctgttgaatcctgatccttgtacaaatcctacaatagtgctcaagaagactctgtcatgttcctatccaaacttgcctttcaatgaagccctcaagaaggagagtgagaagctccaggtggagcttcaaagatcacaaagccacatggatctgggctcatgtgaggttattcagcacctgcttggagtaacaaaaactgtggcatgtaccattccagaggaagaaacaaatgcaaaagtttctgaaaaggattcaaattacaaggaatccaaaggagatgttgcaaaatcgtatgatgatgatgactatcctaagaagcaaaaagatgcctgcagtacacaacgatgttcttcaccagtttcatatggacatgatcttgtctcaagaagaggatcatacagcgatgagtggcatgcagatttacttggctgctgttcagagccagctctgtgtttgaagacattgtttttcccctgtggaaccttctcgagaattgcttcagtcgccaaggacagaccaatgtcttctggagaggcttgcaatgatattatggcatactccctgatattatcctgctgctgttatacttgctgtgtaaggagaaagcttcgccaaaagttggacattgcgggaggctgctgtgatgacttcctttcacatctgctgtgttgttgctgcgcccttgttcaagaatggcgggaggttgagattcgtggagcttatggcgaaaagacgaagactaccccacccccatgtcaatacatggagcactgagcagccatgacaggggacctggacttctgtaaagatattgacaaaatatattctgatatcgtacttccagagtagtgatactgatacgacaatattttctgtgctgtatttatgcttactgtccattgtcctcctggtacttccattccatgatcctgttatatcagtatatgttggggcatagctctgcacagtatgtactttgtaaacataccagtaacaggcctgttagagcctaacatcggttaacgtcgtcagttcttgccaagatctggaagtccatttttttgtgtgctcctttttaccctaacaacagtagcaaaaaagaaaagagcgctctattc

SEQ ID NO: 1809 - DNA, 2132 bp, Panicum virgatum
gtgaaacggtgagcgcggcgagtccagcaaccaacagtagcctctctctctctctgctcgtcgcctcatccgctccgctccacgcccctcttggcctcttccccttcccacttgcaggcattgcctgttctccactccagttccccgccgcgccgctcgagggaggagggggatagggagagggagaggcgcagcgccgtcgcgcatccccactccagtctccgactctgtcacggctggaggaggtgacagcgagaggcgataagaggaatgctgctgctgtgatctttcagatctgcccggccgcggtcgttttccctgcaatcaagaaccgagagcaaggaggttcttggagccatggccggcggcaggacgcaccgtggcgggtaggatagcccttgggtctccccgatcttcacctcgcgcgcgaattaggctggaggccgagcggctcgtgtgtggaggaggaggagagggggtgagaaattcaagatcgcaatggcgtcgtgggacaacgtgggggagctctccaacatcgcgcagctcacggggctggacgccgtcaagctcatctccctcatcgtcaaggcggcgtccacggcgcggctgcataagcgcaactgccgccgcttcgcgcagcacctcaagctcatcggcggcctgctggagcagctccgggtctcggagctcaggaagtacccggagacgcgtgagccgctcgagcagctcgaggacgcgctccggcgcggctacctgctcgtcaactcgtgccaggaccgctcctacctctacctcctcgccatgggctggaacatagtctaccagttccgcaaggcgcagaacgagatcgacaactacctccgcctcgtcccgctcatcacgctcgtcgacaatgcccgcattcgggatcggattgagtacattgagagagaccaatgtgaatattcttttgatgaggaagacaagaaagtgcaagatgctctgttaaatcctgatccttgtacaaaccctacaatagtgctcaagaagactctgtcatgttcctatccaaacttacctttcaatgaagcccttaagaaggagagtgagaagctccaggtggagcttcaaagatcacaaagcaacatggatctgagctcatgtgaggttattcaacacctgcttggagtaacgaaaactgtggcatgtaccattccagaggaaggaacaaatgctaaagtttctgaaaaaaaggactcaaattacaatgaatccaaaggagatggtgcaaaatcgtatgatgatgatgactatccaaagaagccaaaagatacctgcagtgcaccacgttcaccagtttcatatggacatgatcctgtctcaaggagaggatcatacagtgatgagtggcatgcagatttacttggctgctgttcagagccagctttgtgtttcaagaccttgtttttcccctgtggaacattctcgagaattgcttcagtggccaaggacagaccaatgtcttctggagaggcctgcaatgatattatggcatattccctgatattatcctgctgctgttatacttgttgtgtaaggagaaagcttcgtcaaaagttggacattgcgggaggctgctgcgatgacttcctttcacatctgctgtgttgttgctgcgcccttgttcaagaatggagggaagtggagattcgtggagcttatggcgaaaagacaaagactaccccgccgccatgtcaatacatggagcactgagcagccatgacgggagaccgggacttctgtaaagatattgacaaaaaacattctaatatcgtactgccagagtagtgatacgacaatatgttcggtgctgtatttatgcgtaatgccccttgtcctcctggtacttccatgattctgttcttttagtatatgctggggcatagctgcacagtatgtatatgtactttgtaaacacaccagttacaggcctgttagagcgtaatatgggttaacatcgtcagttcttaccaagatcaggaaggccactttttgtgtgcgcctttttacccttacaacagtagcaaaagaagaaaagagttctctattctcgagttggaaagatggatcctataaacttccagtgttctttt

SEQ ID NO: 1810 - DNA, 1551 bp, Panicum virgatum
ggaggaggaggagagggggtgagaaattcaagatcgcaatggcgtcgtgggacaacgttggggagctctccaacatcgcgcagctcacggggctggacgccgtgaagctcatctccctcatcgtcaaggcggcgtccacggcgcggatgcacaagagcaactgccgccgcttcgcgcggcacctcaagctcatcggcggcctgctggagcagctccgggtctcggagctcaggaagtacccggagacgcgcgagccgctcgagcagctcgaggacgcgctccggcgcggctacctgctcgtcaactcgtgccaggaccgctcctacctctacctcctcgccatgggctggaacatagtctaccagttccgcaaggcgcagaacgagatcgacaactacctccgcctagtcccgctcatcaccctcgtcgacaatgcccgcattcgggatcggattgagtacattgagagagaccaatgtgaatattcttttgatgaggaagacaagaaagtgcaagatgctctgttaaatcctgatccttgtacaaaccctacaatagtgctcaagaagactctgtcatgttcctatccaaacttacctttcaatgaagcccttaagaaggagagtgagaagctccaggtggagcttcaaagatcacaaagcaacatggatctgagctcatgtgaggttattcaacacctgcttggagtaacgaaaactgtggcatgtaccattccagaggaaggaacaaatgctaaagtttctgaaaaaaaggactcaaattacaatgaatccaaaggagatggtgcaaaatcgtatgatgatgatgactatccaaagaagccaaaagatacctgcagtgcaccacgttcaccagtttcatatggacatgatcctgtctcaaggagaggatcatacagtgatgagtggcatgcagatttacttggctgctgttcagagccagctttgtgtttcaagaccttgtttttcccctgtggaacattctcgagaattgcttcagtggccaaggacagaccaatgtcttctggagaggcctgcaatgatattatggcatattccctgatattatcctgctgctgttatacttgttgtgtaaggagaaagcttcgtcaaaagttggacattgcgggaggctgctgcgatgacttcctttcacatctgctgtgttgttgctgcgcccttgttcaagaatggagggaagtggagattcgtggagcttatggcgaaaagacaaagactaccccgccgccatgtcaatacatggagcactgagcagccatgacgggagaccgggacttctgtaaagatattgacaaaaaacattctaatatcgtactgccagagtagtgatacgacaatatgttcggtgctgtatttatgcgtaatgccccttgtcctcctggtacttccatgattctgttcttctagtatatgctggggcatagctgcacagtatgtatatgtactttgtaaacacaccagttacaggcctgttagagcgtaatatgggttaacatcgtcagttcttacc

SEQ ID NO: 1811 - DNA, 2489 bp, Panicum virgatum
cgggtcttgtttaattccaacgcagaagggtgctgaacctgaacccaagtacagtggaagtattcaactgaccggccttggaatctgaacagatggccaacctgtcagccacaggcgaaggagcaaagcataccatttcctgctgagacgcgcatgctcccaaaagctaactattcctttgtcgctgatcgcggtggagtgctagtgccgctgcccccacctgcctgcccacgagtgacgcgagcgctggacgcgagcgaggcccaggcggggggcgcccggcacggcacccgcgcgcagcacaagcacccaaaactgtgcgcgcggcacggactcggagacacggggaacgcaacgcaacatgtggcgaggcgagcgagctgaggtgttttggtcagtggagcgaaccggtgaccgcgagtccagcaccagccaccaggaggcattgcctgctcgtcgcctcatccgctccgcgccccctccacttcccacttccaggcattgccggttctccactccagttccccgccgcgccgctcgagggaggagggggatagagagagggagtggcgcagcgccgtcgcgcatccccagtccagtcttccagtctccgattctgtcaccgccggaggaggtgacagcgagaggcgataagaggaatgccgctgctgtgatctttcagatctgcccggccgcggtcgttttccctgcaatcaagagccgaaagcgaggttcttggagccatggccggagggaggacgcaccgtggcgggtaggtttgcctggggtctccccgatcttcgcctcgcgcgcgaattagccgagaggccgagcggctcgtgtgtggaggaggaggagggggggggggtaagaaattcaagatcgcaatggcgtcgtgggacaacgttggggagctctccaacatcgcgcagctcacggggctggacgccgtgaagctcatctccctcatcgtcaaggcggcgtccacggcgcggatgcacaagagcaactgccgccgcttcgcgcggcacctcaagctcatcggcggcctgctggagcagctccgggtctcggagctcaggaagtacccggagacgcgcgagccgctcgagcagctcgaggacgcgctccggcgcggctacctgctcgtcaactcgtgccaggaccgctcctacctctacctcctcgccatgggctggaacatcgtctaccagttccgcaaggcgcagaacgagatcgacaactacctccgcctagtcccgctcatcaccctcgtcgacaatgcccgcattcgggatcggattgagtacattgagagagaccaatgtgaatattcttttgatgaggaagacaagaaagtgcaagatgctctgttaaatcctgatccttgtacaaatcctacaatagtgctaaagaagactctgtcatgttcctatccaaacttacctttcaatgaagcccttaagaaggagagtgagaagctccaggtggagcttcaaaggtcacaaagcaacatggatctgggctcatgtgaggttattcagcacctgcttggagtaacgaaaactgtggcatgtaccattccagaggaaggaacaaatgcgaaaatttctgaaaaaaaggattcaaattacaatgaatccaaaggagatggtgcaaaatcatatgatgatgatgactatccaaagaagccaaaaaatacctccagcgcaccaggatgttcttcaccagtttcatatggacatgatcctgtctcaaggagagtatcatacattgatgagtggcatgcagatttacttggctgctgttcagagccagctttgtgtttcaagaccttgtttttcccctgtggaaccttctcgagaattgcttcagtggccaaggacagaccgatgtcttctggagaggcctgcaatgatattatggcatactccctgatattatcctgctgctgttatacttgctgtgtaaggagaaagcttcgtcaaaagttgaacattgcgggaggctgctgcgatgacttcctttcacatctgctgtgttgttgctgcgcccttgttcaagaatggcgcgaagtcgagattcgtggagcttatggtgaaaagacgaagactaccccaccgccatgtcagttcatggagcactgagcagccatgacgggagacctggacttctgtaaagatgttgacaaaaaaaaattctaatatcgtactgccagagtagtgatacgacaatatgttctgtgctgtatttatgcgtactgtccattgtcctcctggtgcttctatgattctattatgaattatacttgtatatgttgggacatagccgcacagtatgtactttgtaaacacaccagttacaggcctgttagagcctaacatgggttaacatcgtcagttcttgccaagatctggaagtccaacttttgttgtgtgtgcctttttaccctaacaacagtagcaaaagaagaaaagagctctctattc

SEQ ID NO: 1812 - DNA, 3166 bp, Brachypodium distachyon
tgcggccggaaatctcatctgtatcttcctcgcagggaaaggggaagggggggaatgctaccggtgtgatctcgcagatctgcgccgccccacagtgtgttctccgggaaatctcgagccggaagcgaggtgttcttgcgaggcgcagggcgatgggtacaatcggctgggtctctctcacctctgctccctgatttgttctctgcacctctttttttttcctgcacaagaaaatcgagtgattttctgtggggggaggaggaaccgaggagacagcaatggcgtcgttgggggacgtcgccaacgtggcgcaggtgacggggctggacgcggtgcggatcatagccctgatcgtcaaggcggcgtccacggcgcggatgcacaagcgcaactgccgccgcttcgcgcagcacctcaagctcatcggcggcctgctggagcagctccgggtgtccgagctcaagaagtaccccgagacgcgcgagccgctggagcagctcgaggaggcgctccgcaggggcttcctgctcgttcactcctgccaggaccgatcctacctctacctcctcgccatgggctggaacatcgtctaccgcttccgcacggcgcagaacgagatcgacaactacctccgcctcgtccccctcatcacgctcgtcgacaatgcccgcgtgcgggagcgaattgagtacatcgaaagggatcaatgtgaatattctcttgatgaagaagacaaggaggtccaagatgctttgttaaaccctgaccctagcacaaatcattcaatagtgctcaagaagactctgtcgtgttcttatccaaatttgccgtttaatgaagctcttcgtaaggaaagtgagaagctccaggtggagcttcaaagatcacaaagcaacatggatatgggccagtgtgaggttatccatcacctgcttggagtaactaaaactgtggcaagctctatcccagacgaaagtacaaatgcaaaggttaccaaaaaaactgattcaaataaaacaaaagttagtgaagacagtgcacaatcatatgattatgactctccaaagaagcaaaaagatgcctgcgatgcaccacgaagttcttcacctgttccgtacggtcatgatctggtctcgagtactagtgatgagtggcatgcagatttacttggttgctgttcagagccatcattgtgtctgaagacattcttttttccctgcggaacattctcaaggattgcatcagtcgccaagaacaggcccatgtcctcgtcagaagcctgcaatgatattatggcatactccctgatattgtcctgttgctgttacacttgctgtgtaaggagaaagcttcgtcaaaaactaaacattgcgggagggtgctgtgacgatttcctttcacatgtgatgtgttgttgctgtgcacttgttcaagaatggcgggaagtagagattcgtggtgcatatggagagaagactaaggtaaccccgccgccatgccaatacatggaacattgagcagcaatgcgaggcctggactcctgtaaagtttattgacctaaaattgtcagaaaccgtactgccatggtagtgatacagcagcgacattactgtatgtgtgttgtatttattcgtgttggtactatgtgtcttagcatgtctcctttgtaaacagtaactaaaatcttcagttgcaggccagttagagccacagagttaacaacatcgtcattgttttctatcaaggagcagaattttttcccttgtctttttttcttacccctgatgacagtaatagaaaaaaagaagctccttttccatatggaaaattgaatacagttcacaagaaacaattcagttacagcagaatctgaacacttggtattgatggatccaccatgatacatctgcagcatgacagccaagatgatgagctgcctacgcggtggaaggcgtatgccgccgttttcgcttcttctttaccaagctcacctggaggctacatccatccaaaacctgccaatcattcctcgtgagtaagaatggatcgatcgaactttcatcccatacatctagaaagtggaaaatcaataactgaccagtccgttgagagcagcgagagcatccgcctgttgtgaatgctccgtcgccatggttaccaggcgtccaggccaatgccgtgtgatgtcttggtcttacctccgcgctggatactttgccgtgcttgctgaagaaatattgcagccgaccgtgaggaggcaggttgcgcaccaacaccttgatgaaacaaggctgctgctgagggctgtcaatttgaatgtcgcttgttggagtaattggagccacctcctcctgctgctgctgcttcctccattttggagcgtgcagcaacctcccgcggatttcctgatcgagtaaagccaataccattcatttttggtggccaattacaggagaggatttttgcagtgtgattaaattggatgctgttacctggatgggggagatggagggctgggggacgagccaggcgcacatgtcgtcgtgccatccttgaggaagccactcgaccaactcgttcttcccgtccacaaggttgtgcctgaacacgccgtgctgccggtcttgcgtcgagccgtcgtggtcgttccgcgtaccaggatcttgccgccgtggtacgcggcgctgaactcgccgtactcggaatcgaggctctccacgcggcgtcgcccgggcggaggagcgccgccgtgaacctgctcccgaacgtgacggtggtgtacaggagcacggtgccgtcgccgtagacggtgccgcttggactctccttccagtagccgtcggggaagggcggcacgaaggtgacggctcctgtagtcctgcgagagggtcgtggagaccgccgtcggcgctggcaacccagctctgccggcggggtaatggcggcagcgcgcggtagctcgccttggagaagacgcatctggacttgagttccttgtccggcgcgagaagccagggcaggaacgagggctgggtcgtcgttgggtcgtgcgactcgcgccatggcttgcagacggcgtggaagcggatgaagtcgcccgcgtcgtgcaggcggccggagatttcgcggagcagatccgacgggagatccgtcgaccacggccgtc

SEQ ID NO: 1813 - DNA, 2206 bp, Oryza sativa
gtccacccgacgctcagcaactggagcaagcacgggcaacgagtcgcagtaaaacagcagtgcggactcggagacagtacggggaaaacgcacatcgagcggtggagagtggagtggagtcgaatgcagcgcgagtgagtccaaaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacggcaatggcgtcgtgggagaacctcggggatgtggcgaccgtcgtgcagctgacggggctcgacgcggtgcggctcatctccatgatcgtgaaggcggcgtcgacggcgcggctgcacaagcgcaactgccgccggttcgcgcagcatctgaagctcatcggcggcctgctggagcagctgcgggtgtcggagctcaagaagtacccggagacgcgggagccgctggagcagctcgaggacgcgctccgccgcgcctacctgctcgtccactcctgccaggaccgctcctacctctacctcctcgccatgggctggaacatcgtgtaccagttccgcaaggcgcagaacgagatcgacaactacctccgcctcgtcccgctcatcaccctcgtcgacaacgcccgcgtcagggagcggatggaatacattgaaagggatcaatgtgaatattcttttgatgatgaagacaaggaggttcaagatgctctgttaaaccctgatccaagtacaaatcctacggtagtgctcaagaagactctgtcatgctcttatccaaacttgccatttaacgaagcgcttcgaaaggaaagtgagaagctccaagtagaacttcaaagatcacaaagcaacatggatatgggccaatgtgaggttattcaacacctcctaggagtgactaaaactgtggcaagttcgattccagagaaatgtgccactcctaaggtttctgaaaaagctgactctaatcacacaaaagtcagtgaagatagtgcaaaaacatatcatgatgactctccaaagaagcaaaaggatgcctgcactgcaccacgaagttctccgccatcttcttatggccatgatctggtctcaagcagaggatcatacagcgacgagtggcatgcagatttgcttggttgctgttcagagccatctttgtgtttgagaacattctttttcccctgtggaacattctcaaagattgcttcaattgcgaagaacaggcccatgtcatcgtcggaagcatgcaatgatattatggcatattccctgatattatcctgctgttgttacacttgctgtgtgaggagaaagcttcgtcaaaagctaaatattgcgggaggttgcattgatgatttcctatcacatttgatgtgttgttgctgtgcgcttgttcaagaatggcgggaagttgagattcgtggagcttatggagagaggactaagattagcccaccctcatttcagtacatggaacactaagcagcgatgcaaggcttgagcttctgtgaagataatgacctaaaggctagagcaacccggtatcgtactacaatagtaatgatgacacagctacaacattgttgtatttatgcttaccctgcattgtttgtgttggtactctgtttatagtaacatcagttggtgttgggcacagtatgttgtatgtagtactttgtaagaaaaaacacaagttacatgccctcgttgtgctcgtctctgttgaatcccccatgcataatttaacctttagcttcatttgcactataaaacagtaacaatattaaaaaagtctcaaattgcaaagg

SEQ ID NO: 1814 - DNA, 1844 bp, Triticum aestivum
tgccactcctgcccgcttaattgctcgccggaggaggtagctaaagaaagagccgctgtggcaggcgacgaaaaggggaaaacccaccgaccatggcaaggcggggaatgctggcgcgccggcgcgagtgagcgatctcgcagatctacgcccgccgccgcacagcgtctgctctcccagaatctccagccggatcgtctggggccgccgatggatagtacgatcttcgctccgcgcgcggattaacgagcccggccgcattccgcttctccgcgccaccaaggagatcgggtgattcgtcggggggaagggagaaaccggtgccgcagcgatggcgaacgtgggggacctggccaacatcgcgcagctcacggggctggacgcggtgcgcctcatcggcctcatcgtcaaggcggcggccacggcgcggatgcacaagagcaactgccgccgcttcgcgcagcacctcaagctcatcggcggcctgctggagcagctccgggtgtcggagctcaagaagtacccggagacgcgggagccgctggagcagctcgaggacgcgctccgccggggctacctgctcgtcaactcctgccaggaccgctcctacctctacctcctcgccatgggctggaacatcgtctaccgcttccgcaccgcgcagaccgagatcgacaactacctccgcctcgtgccgctcatcacgctcgtcgacaacgcccgcgtgcgggagcgaattgagtacattgaaagggatcaatgtgaatactctcttgacgaggaagacaaggaggtccaagaagctctgttaaaccctgaccctagcacaaatccttcgatagtgctcaagaagactctgtcctgttcttatccaaacttgccatttaacgaagcccttcgaaaggaaagtgagaagctccaggtggagcttcaaagatcacaaagcaacatggatatggcccagtgcgaggttattcatcacctgcttggagttactagaaccgtggaaagttctattccagaggaaagtaccgatgccaaggttaccaagaaaaccaagtcaaagtgcacaaaagttaatgaagacagtgcaaaatcatatgatgatgactctccaaagaagcaaaaagatgcctatgttgcaccacggagttcttcacctgttccctacaaccatgatctggtctcgagtacagcatcatacagtgatgagtggcatgcagatttacttggttgctgttcagagccagctctgtgtctgaagaccttcttttttccatgtggaacgttctcaaggattgcttcaatcgccaagaacaagcccatgtcttcgggagaagcctgcaatgatattatggcgtactccctcatattgtcttgttgctgttacacttgctgtgtaaggagaaagcttcgtcaaaggctaaatattgcgggagggtgttgtgacgatttcctttcacatgtgatgtgctgttgctgtgctcttgttcaagaatggcgcgaagtagagattcgtggtgcatacggagggaagacaaagataaccccgccggcacaccagtacatggagcactgagcagctactctgcgatccctaaaaaaaaagagcagctccgcgagaggcctggactcctgtaaattaaagatattgacctaaaattgtcagaaaccgtactgccatggtagtgatacccgtccaacatgctctactgtttgtgttgtatttatgcgtcatcttggtattatgggtcttagaactcaattaatttgtaaaaagtaactaaactcttcagtctcaggccggttagagtcagtgttaacattgccattgttgtctatat

SEQ ID NO: 1815 - DNA, 1828 bp, Secale cereale
aaaaggggaacgactaccaaccatggtaagcggggaatgctgccgcgccggtgcgagtgagagcgatctcgcagatctgcgcccgccgccgcacagcgtctgcttccccggaacctccggccgaatctgtctccagcgccgcagatgggcagcacagtccaccgggcaactccgatcctcgcttcccgcgcggattaaccagcccggccgcattccgctcctccgcaccgagaagatcgggtgattcgtcggggggaagggcgaagccggggccgcagcgatggcgaacgtgggggacctggccaacatcgcgcagctcacggggctggacgcggtgcgcctcatcggcctcatcgtcaaggcggcggccacggcgcggatgcacaagagcaactgccgccgcttcgcgcagcacctcaagctcatcggcggcctgctggagcagctccgggtgtcggagctcaagaagtacccggagacgcgggagccgctggagcagctcgaggacgcgctccgccggggctacctgctcgtcaactcctgccaggaccgctcctacctctacctcctcgccatgggctggaacatcgtctaccgcttccgcaccgcgcaggccgagatcgacaactacctccgcctcgtgccgctcatcacgctcgtcgacaacgcccgcgtgcgggagcgaattgagtacattgaaagggatcaatgtgaatactctcttgacgaggaagacaaggaggtccaagaagctctgttaaaccctgaccctagcacaaatccttctatagtgcttaagaagactctgtcctgttcgtatccaaacttgccgtttaatgaagctcttcggaaggaaagtgagaagctccaggtggagcttcagagatcacaaagcaacatggatatggcccagtgcgaggttattcatcacctgcttggagttactagaactgtggaaagatccattccagatgaaagtacagatgccaaggttaccaagaaaaccaattcaaagtgcacaaaagttaatgaagacagtgcaaaatcatatgatgatgactccccaaagaagcaaaaggatgcctatatcgcaccacggagttcttcacctgtcccctacaaccatgatctggtctcgagtacagcatcatacagtgatgagtggcatgcagatttacttggttgctgttcagagccagctctgtgtatgaagaccttcttttttccatgtggaacattctcaaggattgcttcaatcgccaagaacaagcccatgtcttcgggagaagcctgcaatgatattatggcgtactccctcatattgtcttgttgctgttacacttgctgtgtaaggagaaagcttcgtcaaaggctgaatattgcgggagggtgttgtgacgatttcctttcacatgtgatgtgctgttgctgtgcgcttgttcaagaatggcgggaagtagagattcgaggtgcatatggaggaaagacaaagataaccccgccggcacaccagtacatggagcactgagcagctactctgcgatccctaaaaaaaaagcagctattctgcgagaggcctggactcctgtaaattaaagatattgacctaaaattgtcagaaaccgtactgccatggtagtgacacaggtccaacattactgtttgtgttgtatttatgcgtaccgtacgctcatgttggtgttatggatcttagaattcaactaatttgtaaaaagtaactaaactcttcagtcgcaggccggttagagtcactgttaacattgccattgttgtctatatttcaaaggtgtgtttttttactaaagtc

SEQ ID NO: 1816 - DNA, 1962 bp, Secale cereale
tcccactcactccagtcgcccccctcccctcggtcgcgccgctcgagggagatagcgtcgcgtgcagctctgccgctcctacccgcttaattgctcgccgaggcagccggatgaggtagctaaagaaagtgccgctgcggcaggagacgaaagggggaaaaccaccgaccgtagggcgggggaatgctgccgcgccggtgctagtgagcgatctcgcagatctgcgccgccgccgcacagcgtctgcttccccggaacctccggccgaatctgtctccagcgccgcagatgggcagcacagtccaccgggcaactccgatcctcgcttcccgcgcggattaaccagcccggccgcattccgctccgccgcaccgaggagatcgggtgattcgtcggggggaagggagaagccggggccgcagcgatggcgaacgtgggggacctagccaacatcgcgcagctcacggggctggacgcggtgcgcctcatcggcctcatcgtcaaggcggcggccacggcgcggatgcacaagagcaactgccgccgcttcgcgcagcacctcaagctcatcggcggcctgctggagcagctccgggtgtcggagctcaagaagtacccggagacgcgggagccgctggagcagctcgaggacgcgctccgccggggctacctgctcgtcaactcctgccaggaccgctcctacctctacctcctcgccatgggctggaacatcgtctaccgcttccgcaccgcgcagaccgagatcgacaactacctccgcctcgtgccgctcatcacgctcgtcgacaacgcccgcgtgcgggagcgaattgagtacattgaaagggatcaatgtgaatactctcttgacgaggaagacaaggaggtccaagaagctctgttaaaccctgaccctagcacaaatccttcaatagtgcttaagaagactctgtcctgttcgtatccaaacttgccgtttaatgaagctcttcggaaggaaagtgagaagctccaggtggagcttcagagatcacaaagcaacatggatatggcccagtgcgaggttattcatcacctgcttggagttactagaactgtcgaaagatccattccagatgaaagtacagatgccaaggttaccaagaaaaccaattcaaagtgcacaaaagttaatgaagacagtgcaaaatcatatgatgatgactccccaaagaagcaaaaggatgcctatattgcaccacggagttcttcacctgtcccctacaaccatgatctggtctcgagtacagcatcatacagtggtgagtggcatgcagatttacttggttgctgttcagagccagctctgtgtatgaagaccttcttttttccatgtggaacattctcaaggattgcttcaatcgccaagaacaagcccatgtcttcgggagaagcctgcaatgatattatggcgtattccctcatattgtcttgttgctgttacacttgctgtgtaaggagaaagcttcgtcaaaggctgaatattgcgggagggtgttgtgacgatttcctttcacatgtgatgtgctgttgctgtgcgcttgttcaagaatggcgggaagtagagattcgaggtgcatatggagggaagacaaagataaccccgccggcacaccagtacatggagcactgagcagctactctatgatccctccaaaaaaaaaagacagctactctgccagaggcctggactcctgtaaattaaagatattgacctaaaattgtcagaaaccgtactgccatggtagtgatacaggtccaacattactgtttgtgctgtatttatgcgtaccgtacttcgctcatgttggtgttatgggtcttagaattcaactaatttgtaaaaagtaactaaactcttcagtcgcaggccggttagagtctttgttaacattgccattgttgtctatatttcaaaggtgt

SEQ ID NO: 1817 - DNA, 3354 bp, Zea mays
ccttccgctacgatacaaaagctcgagaacccacgcacgcgcgcaccccccacccaccccacgtctcgcttctccccaccccgcccgctacagcgccggtggggggcccccgcggctgccggcgaccggtcgccgccgccgaggccgtcctcgccgccccgacattctccagctggtgcgttctcgttcctggcttccggccttggctggcctcctccccgcggaactgaggcgaattggcgcgggagggcacgggatcttgccgtcctgtcctggcgtctcctgccgcaccgcgtttgggcaacttttttttgtcggcgaaaaaagaatacatgaaaacgccgccttttgctcggggcgcttcacgggcctccgcagcattagccatggtttagcggaggcgattctccttgcaggcttgcagctgtttccggggtggtggattttcaaggaataaagaatgatcaacctcttcgaattgagcgttggagccagcgccaaggtctcctcaagagatggctctccggtgagaggaactcagtcggagcggaaggagtacgccggatcaaaggcgttgactggcagcacgaggaggagctcgtcggatagatcgggcggtacgcccatgaaaatgctgatagctcaggaaatggccaaggagggggacgcgaatcagaagaccactaacgttgtggcgaggctgatggggcttgacgataatgtggatcttgctaagcctgtcgtgcccccaaacaggaggagtttcccggacggccatttatctgctacactggcaagagtaaacaaccaaattccatttgagaagcacacgagttccgccgaagatgtggagtacaaggatgtctacgaagttgggtaccagccaccaagaggtgatgaatatccaaggaggaggaggccgagtgaagatcatgacaagagaaggatggatcttgtccgccagaagtttgttgaagcaaagcggcttgcgtcacatgataatatcctccagtcgaaggaattccacgatgctcttgaggttctgaattcaaacaaagatctgtttctcaaatttctcgaagaacctaactctctctttgcgaagcagtctgggggactcggttctgcaccaacatcacctcagagaaagcacattactgtgttgaagccctcgaaatcagtggagatgaagggtgacaaagcaattagaaggcagacaaaccatgcagccggaaacagaacagacaggagcaacgtgcacaagtctgatgcagctcatgtgaaggaagataagcttcccaaacacaccaggatagtggtcttgaaacctacctcggtaattgcttccatggagcaatctgagcaaagttatcatgctgatctcgatgattctgaagcgcctgttctgtcaaggcatctgagtgatgagatagattggtcggtacatggaatttctcgacgccacactgaatctttgcagggttgcatacagtcaaatatgttcggcgcagatagaccataccatcagtatgctgaagaagagggcaatagcttgagtgactcagatattggaaccccaacatcacatcactcttgggagtacatctaccggtttagcaatccttactttggctctttgagccatgcttcttgctcccctgagtcacatgtaactagggaggctaagaagcatgcttctgacagatgggcaaccgttccatccagtgagatgacccaggacaaggtaccagtgcgaagaagtttgagcacacttggtgaaatgcttgccatgccggatatgaagaaagaagaggctgctgaacaagcatctcctgatgctacccaccagttgtgtgagccaacagttggcgtatcatctaattgtgctgttggcgaaggtgagggagaaagctccctcaggaaaatctcgaggtcacgatctgttccggtctcttcaacagcttttgatagcctgcggttagatggtggatgtttggatgctcagcataaagaacctacagtgccgaaggaggtcaaacctaagagtgggaaatcatctttgaagggaaaaatcacgagtttcttctcaaaacgtaagaaagcagaaaaggagaagcctagcccatctcccttgggaaccctgaacggtcgaggttcgtcagtcagcactgtagcagttgctaaaccagatgctccacagcatgtttgtgctagttcacaggatgatgtttccttcgaaagtttagaagaccagtttaatcacggaccaatcggagctccggttgatgaacccgaagcaccctctgtgtctaagcctccagcttcgcttgagaagacgctatcatttgagattcgagcttcccacttcgaccagcccagccctacatcggtttttgatgtacaatttgaggatatcagcgagaaatcccccatttcatcagaaagcgcgattactgctaaacaagagcctctatccaggtctataccaatcggatcgatcgcgaggaccttatcatgggacgacgcttcccaagaggctcctccgcagtgttctaccaaaggagacagcaaccacgagcaggagcagcacgagttcgtcgagaagacgctggcatccgctggcttctgcaacgagaagacccaggacatctttgcccggtggcattcgctcgaccggcccttggaccccgccgtggtcgagcagctgctggaacgcaaggtggaggacgccaagtgccgagagaggcggtcgaaccagaggctcctaatcgactctgtcaacgccgccctgctcgacatcggccagagcaaagtctgggggggcgcgtacccttgcaccgcacggcactattccaacgctccgggagttggcacgtgcgatgatgatgtgctagtgaccgacgaggcgtggaggctggtgaggagctggctcttcgatgacgagaacgacatcgccgggttgggggacaacgcgggccttgcggcggactgggttgtcggtagggagatccacggcaaagggtgggccgagacgctgcggatggaggtggacgagatgagcagggagatatgtggcgaggtcctgggcgagttggttggggaggcgttttcggagcttgccggcgctgcggggtggcattgaagctgcctgccttctattttccctgcttgtggtggcgtccacctgctgctgctgcttttacttccaatccggttcttgtgtgtatattaccctcgtaactgctcaaagtgttccctgctgctgcctctctatctgtgttgcatctctttcagcattgatacattcacggtaataacatttacggatgaatacagctgctgcactgcacttga

SEQ ID NO: 1818 - DNA, 3240 bp, Setaria italica
cctcccactacaatacaaaagctcaagaacccacgcacgcgcgcaccccacccaccccacgtctcgctctccccaccccacctcccgctacagcgccggtggggggcccccgcggctgccggcgaccgggcgccgccgccgtcgccgttgtcgttcctcgccgcccccgcattctcgaactggcatttgccatgatttagcggaggcaattttcttcgcagctgcttccggggtggtggactgaaggaataaagaatgatcaacctctttgatttgagcgttggagccagcgccaaggtcgcctcaagagatggctctccggtgagaggaactcaatcagaacggaaggagtacgctggatcaaagacagtgactggctgcacaaggaggagctcgtcggataggtcaggtggcacgccaatgaaaatgctgatagctcaggaaatggcaaaggagggggacgcaaatcagaagactactaatgttgtagcaaggctgatggggcttgacgataatgcggatcttcctaagcctctgccttcaaacaggaggactttcccggatggccatttatctgctacattggcaagagttaacaaccaaatgtcatttgagaagcgtgcaagttccatggaagatgtggagtataaggatgtatatgaagttggataccagccaccaagaggtgaatgtctgagcaatgaatctccaaggaggcccaatgaagatcacgacaagagaaggatggatcttgtccgccagaagtttgttgaagcaaagcagctagcatcacatgataatctcctccagtcgaaagagttccatgatgctcttgaagttctgaattcaaacaaagatttgtttctcaaatttctcgaagaacctaactcgctctttgcaaagcaatctggagaacttcattctgcaccaacatcacctcaaagaaagcgcattaccgtgttgaagccctcgaaatcagtggacacaagggatgacaaagcaattaaaaggcagaaaaaccatgcagttgatggaaacagggtagaaagaagcaatagtcacaagtctgatgctgctcatgtgaaagtcgaaaggcttccgaaacacacccggatagtggtcttgaaaccaacctcagcaattgcttccatggagcaatttgaccaaaattatcatgctgatctggatgattctgaagcacctgctatatcaaggcgtttgagtgatgagatagattggtcagtgcatgggatgtgtcgacgccacaatgaatcaaatcctatgagcgcatatagaccatatgatcaatatgctgaagaagagggcgctagcttaagtgactcggatattggaactccaacatcacgtcattcttgggagtacatctaccggtttagcaatccttactttggctcatctttgagccatgcttcttgttctcccgagtcacatgtgactaaggaggctaagaaatatacttctgacagatgggcaattgttccgtccagtgagataacccagggaaaggtgctagtgcgaagaagtttgagcacacttggtgaaatgcttgccatgcctgatatgaagaaagaagaggttgctgatcaagcatctccggatgctactagccaattgtgcagcaatgagccaacagttggtgtatcatctaattgtgctgttggtgatggtgagggagaaagctctctcaggaagatctcaaggtcaagatctgttccggtctcttcatcagcttttgacagcctaaggttagatggtggatgttcagaggctcaacacaaagaatctacagcgtcgaaggatgtcaaacctaagaatgggaagtcatctctgaagggaaagatctcaagtttcttctcaaaacgtaagaaaacagaaaaagagaaggttaacccatctcccttgggaaccccgaatagtcaagttccgtcagccagtactgttgtaattgataaatcagatgttccagaacatgtttgtactaacttacaaaacggtgttgctttcggctatttggaagagcggttcgagaatggaccaactgtagttccgcttgatgaacttgaagcaccctctacttctaagtctccagtttcccttgagaaagcactgccatttgagatccgcaattcccacttcgatcagccaagccctacatcagttcttgatgcacaatttgatgatgtcaatgagaaatctcccatttcatcagagagagcaattactgttaagcaagaacctctatctaggtcgcttccaattggatcaattgcaaggaccttatcatgggatgatgcttctcaagaggcttcattgtgctgtaccaaaggtgatagccatgagcaagaacagtatgagtttgttgagaagattctaacgtctgttggcttctgtaatgagaaggcccaagacatctttgtccggtggcattcacttgactgccctttggacccagttgtgcttgaccaactgctggagcgcaaagtggaagatgccaagtgcagagagagacggtcaaaccagaggctcctcatcgattctgtcaatgctgctctactagacattggccaacgtaaactttggggtgcatacccttgtactgcacggtattccaatgcaccgagagttgctacatgtgatgtgctagtaaccgatgaagcatggaggttagtgaaaagttggctcttcgatgatgagaacgatattgccggtttgggagacaatgcaggccttgcagcggattgggttgtcgataaggagattcatggcaaagggtggtctgaaatgctgcggtccgaggtggatgaaatcagcaaggagatatgcggggatgtcctgagcgagttggttggggaggcattttcagagcttgctgatgctgagtgccattgaagctgctttattttccctgcttgtggcgtccacctgttgcttttatttccaatctggtggagaccgtcccctgaggctgatctgcactacccagagctgttcttgtgtgtatattgccctcataactgttttgtatgccgctcaaatgttcctcatcaccatcgatccattcacagcaataactttatgaatacagctgctgcatttcaaattctttacgccacatgttctgttctctgctatgtggtgtcaaaaaatagatgtatgtaaagctggaggcctcaagcgctgtgctgtgcagccttagtgctaattgcaggctcctagagg

SEQ ID NO: 1819 - DNA, 4036 bp, Panicum virgatum
ttcctcaggcatttgccataatttagtggaggcaattttcgttgcagctgtttccggggtggtggattgagggaataaagaatgatcaacctctttgatttgagcgttggagccagcgccaaggtcgcctcaagagatggctctccggtgagaggaactcgatcagaacggatggagtacgctggatcaaagacagtgactggctacacaaggaggagctcgtcggatagatcaggtggtatgccaatgaaaatgctgatagctcaggaaatggctaaggagggtgacacaagtcagaagacagctaatgttgtggcaaagctgatggggcttgatgataatatggatcttcctaagcatccaccttctaacaggagttttcccgatggccatttatctgctacattggcaagagttaacaaccaaatgtcatatgagaagcgtgcaagttcaattgaagatgtggagtacaaggatgtctatgaagttggctaccagccgccaagaggtgaatgtctgagcagtgaatctccaaggaggccatatgaagatcatgacaagcaaaggatggatcttgtccggcagaaatttattgaagcaaagcagctagcatcacatgataatatcctccagtcaaaggaatttcatgatgctcttgaagtcctgaattcaaacaaagatttgtttctcaaatttcttgaagaacctaactcgctctttgcaaagcaatctggagaacttcattctgcaccaacatcacctcagagaaaacgcattactgtgttgaagccttcgaaatcagtggacagaaagggtgacaaagcaattaaaaggcaaaaaaaacatgcagttgacgggaatagagcagaaaggagcaaaaatcacaagtctgatgctgctcatttgaaagttgaaaggcttccgaaacacacccggatagtggtgttgaaacctacctcaacgattgcttctatggagcaatttgagcaatattatcatgccgatctggatgattctgaagcacctgctgtatcaaggcgtttgagtgatgagatagattggtcgatacacggaatgcatcgacgccactatgaatctttgcagggttgcatacagtctgatactattagcacaggtagaccatatgatcaccatgctgaagaagggggcactagcttatgtgactcaaatattggaactccaacatcacatcatacttgggattacatctaccggtttagcaatccttactttggctcgtctttgagccatgcttcttgttcccctgagccacatgcgactagggaggctaagaaatatacttctgacagatgggaaattgttccatccagtgagataacccaggaaaaggtggcagtgcgaagaagtttgagcacacttggtgaaatgcttgctatgcctgatatgaagaaagaagaggttgctgatcaagcatctccggatgctacgaaacagttgtgcagcaatgagccaacagttggtgtatcatctaattgtgttgttgatgttggtgagggaggaagatccctaaggaagatctcaaggtcaagatctgttccagtctcttcattagcttttgacagcctaaggttagatggtggatgttcagtttctcaacataaagaatctacagtgacaaaggaggtcaaacctaagaatgggaagtcatctctgaagggaaagatatcgagtttcttctcaaaacgtaagaaagcagaaaaagagaaggttagcccatctcctgtaggaaccccgaataatcaagttttgtcggccagtactgcagaaattggtaaatcagatgttccagaacatgtttgtactagcttacaagatggggttgctttgggctatttggaagagcggttcgagaatgaactaactgtagttccggttcatgaacttaaagcaccctctacttctaagtctccagtttcccttgaaaaggcactgtcatttgagattcacaattcccacttcgaccagcctagccctacatcagttcttgatgctcaatttgaggatgtcaatgagaaatcccccatttcatcagagagcgcaattactgttaaacaagaacctctatccaggtcgcttccaattggatcaattgcaaggaccttatcatgggatgatgcttctcaagaagctccgttgtgctgtgcccaagatgatagccatgagcaagaacaatatgaatttgtcgagaagattctaacgtctgctgggttctgtaatgagaaggccaaagacatctttgttcggtggcattcacttgactgccctttggacccagttgtgtttgaccaactgttggaacgcaaagtagaagatgccaagtgcagagagagacggtcaaaccagaggctcctcattgattctgtcaatgttgccctactagacattggtcaaagtaaactttggggtgcatacccttgcactgcacggtattccaatgcacctagagttgctacatgtgatgtgctagtaatcgatgaagcgtggaggttaataagaagttggctcctcgatgatgagaacgatattgccggtttgggagaccatgcaggccttgcagcggattgggttgtctgtaaggagattcatggcaaagggtggtccgaaatgctgaggttggaggtggatgaaatcagcaaggagatatgcggggatgtcctgaacaagttggttgaggaggcattttcagagcttgctgatgctgggtgccattgaagctgctttattttccgtgctagtggtgtccacctgttgcttttatttccaatatggtgaagaccgtcccctgaggctgatctgcactacccaaagctgtctcgtgtgtatattgccctcataactgttatgtatgttgctcaaatattcctcaccatcattgatacgttcaaagtaataacttttatgaatacaagtgctgcattcaaattatttttggccacatgttttgttctctctctgctaggtgacaaaagatagacatctgtaaagctggaggcctcaagtgttgtgctgtgcagcattttagtgctaattgcaggctcctaggggataattacctcagtctatcacttccaagcaagtatgattagaggtcatgtgcctcctttgaaagcctacagcggtccaaccaatgcaccacctttcagtgcatttctttactgaccctcctgtcctcttctgcctttgatcactttgttaatccaacttgcagcaaggttacaagctgcaagttcttgaggaggagaattaaaaagggcatgctggcagcaaaatccattgacattctggggaataacatcctttttgctggtgagaggggaatccttgcattgttttgtggatccaatggctaccttctcagatgtgcttttcaatttttttttgttgccttgatctagtagtagcatcttttaggctagtgttttgtttgagtagcatcttttaggctagtgagttctttgtttgccttcttctaagtgctgttacttgcgggccagctcggcgctattgcttgtcgtggtccggcgatgcgcaagtgttgtgatctgtcaggcgctggtcgctgggcctcgcggtccatgaaagatgcaggacttctcccagttctctgttgtacatgttgtgttgttggtcaactttctgaatctttttagttgctgcaactaaccatgccgtgctataacaattatttacctatgcgctggataagttctctgtcccttccaggcagaatagttgtagagactacggtggttaccttgcgtggtggcttgatcacttgatgacggcggttaacaggctcacggttagcttcaactttcacctgctcattttgaggcttacctgaatgttgttttcgataagacaatagcaacgttccttgtctgtccagacagtgttgtttggttcttggtgattaaactactagggaccctgtcatagtttttactctgcagttgtaactggattggctagttctatataactcctcaggtta

SEQ ID NO: 1820 - DNA, 2091 bp, Zea mays
gtcagccagacggccagaccccaaacagagcaggactagcactggcagtctagcacacccgcactgcgtctccgcagcacacactcgcacgcacgagaaggccggagaggcggcgcacccggagaggcaaaggcaagcgatccctctccctccctccctcgtatccaggacaacagcccgtgcgatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgtcgtcgcgctcgtcgacgccgccacgggccaccgggtcacgttccaggaactctggcgcgcggtggaaggggcggccaccgcgctcgccgcgccgccgctgtcgctccgcaagggccaggtcgcgctcatcctctccccgaactccgtccacttccccgttgccgccctcgcagccatgtccctcggcgccgtcctcaccaccgccaacccgctcaacacgcccgccgagatcgccaagcaggtcgccgacgcgcgccccgtcgtcgccttcaccacccgcgacctcctccccaagctcccgcgcgccggcgccggcgccggcatccgcgtcgtcctcctcgagcccgaccgcctcccctccgaccctagccccgtcgtcgccaccatcggggagatctccgccacgccgcccgaccccacgcgccgccgggaccgcgtcacacaggacgacccggccacgctgctctactcctcgggcaccacggggcccagcaagggcgtcgtcgccacgcaccggagcctcatctccatggtgcagatcatcatgtcgcgcttccgcctcgaggcctccaacaggaccgagaccttcctctgcacggtgcccatgttccacgtctacggcctcgtcgccttcgccacggggctgctcggctgcggcgccaccatcgtcgtgctctccaagtacgagctccccgagatgctgcgcgccatcaacgaatacggggtcacctacctcccactcgtgccgcccatcctcgtcgccatgctggcgcaccccaaccgcctgccgctcgggggcctgcgcaaggtgctctccggcggagcgccgctcagcaaggagctgatcgaggggtttaaggagaaatacccgcaggtggagatccttcaggggtacgggctgacggagagcacggctatcggcgcgtccacggactctgccgaggagagcagccggtacggtacggctgggctgctgtcgccaagcaccgaggctaagatcgtcgacccagagaccggcgaggcgctgccggtgaaccgcaccggcgagctctggatccgggggccatacgtcatgaaagggtatttcaagaacgcggaggcaacacaatcaacattgacacctgatggatggctcaagactggggatctctgctacatagatgaggatggttatctcttcgttgtggatcgtctgaaggagttgatcaaatacaaagggtaccaggtgcctccggcggagttggaagctcttttgctaacacatccagaaatcgaagatgtcgccgttataccgtttcccgaccgtgaggtcggccagttcccaatggcctacgtagtgaggaagaaagggagcaatttgtcagagcgcgaggtgatggagttcgtggcgaaacaggtagcgccttacaagaaggttagaaaggtggcgtttgtggcggagattcccaagaacgcgtccggcaagattctgaggaaggatctcatcaagctcgccacatccaaatccaaactatgaaaattgtttttcgtgtttacagtgctggaatacgcctgtcgtccacgagcggcgagccattctctacgctgccccggtagtttggttgtagaatgcttgtataactgaagatcccgtcggctatgtgcttgcttgtgtacagtgctctgttctcgtacaatacaatattgggagggaatactaggcgtctgtacgtaggcttggatggaaataatatccggtaatttcagtgttggtatc

SEQ ID NO: 1821 - DNA, 2178 bp, Setaria italica
acgcaggcacgcagccggcctacgcaccaaccactcgcacacggccagagagcagaggcggcgccagcacccgatcccgcgcagcgatccgatcccgccgatcgcgatggcgccgccggaggtggacccgcgcagcggctactgcgccgcgacgcgctctttccgcagcaagcgcgcgcccgtcccgctccccgccgaccgtgacctcgacgtcgtcgccttcctcgcctcccgccgccacgcggggaccgtggcgctcgtcgacgccgccacgggccgccgggtcacgttccccgaactctggcgcgcggtggcgagcgcggccaccgcgctcgccgcgccgccgctgtccctccgcaagggccacgtcgcgctcatcctctccccaaactccgtccacttccccgtcgccgcgctcgccgccatgtccctcggcgccgtgatcaccaccgccaacccgcttaacacgcccgccgagatcgccaagcaggtcgccgacgcgcgacccgtcgtcgccttcaccacccgcgacctcctccccaagctccccgccgccggcgacggcctccgggtcgtgctcctcgagcccgagcgtctcccctccgaccccgccgccgtcgtcgccaccattgaggagatctccgccacgccgcccgaccccgcgcgccggagggaccgcgtcacgcaggacgacccggccacgctgctttactcctcgggcaccacggggcccagcaagggcgtcgtcgccacgcaccggagcctcatctccatggtgcagatcatcatgacgcgattccgcctcgagggggccgacaggaccgaggccttcctctgcaccgtgcccatgttccacgtctacggactcgtcgccttcgccacggggctgctcggctgcggcgccaccatcgtcgtgctatccaagtacgagctccccgagatgctgcgcgccatcaacgagtacggggtcacctacctgccgctcgtgccgcccatcctcgtcgccatggtggcgcaccccaagccgctgccgctcggccagttgcgcaaggtgctctccggcggagcgccgctcagcaaggagctcatcgagggattcagggagaagtacccgcaggtggagatcctgcaggggtacgggctcacggagagcacggccatcggcgcgtccacggactctgcagaggagagccgacggtacggcacggctgggctgctgtcgcccaacaccgaggccaagatcgtggaccccgagaccggtgaggcgctgccggtgaaccgcaccggcgaactctggatccggggaccatacgtcatgaaagggtacttcaagaacccagaggcaacacagtcaacggtgacacctgacggatggctcaagactggggatctctgctacatagacgaggatgggtatctcttcgtagttgatcgtctgaaggagttgatcaaatacaaagggtatcaggtgcctccggcagagttggaagctcttttactaacacatccagaaattgctgatgtcgctgttataccgtttcctgatcgggaggtcggccagttccctatggcctacgtagttaggaagaaggggagcaaattgtcagaacgcgagatcatggagtttgtggcgaaacaggtagcgccttataagaaggttagaaaggtggcgtttgtggcagaaatccccaagaacgcttccggcaagatactgaggaaggatctcatcaagctcgccacatccaagctatgaaatgtccattggtctgattttactgtattggcatcgacgagcagtgagccattctttgcaccgtcctagtattggccagcgttctaagtgaagatcccatcggctatgtgcctgtgcatacactgttcacatacaactttgggagggtatattgggtctgtacctaggttgaataatcagcatggaaaataatttccgagttctagtgttctctttttcccatgaatggatcatcacagtcacagggcattgtcctggactcgtcgctccttctctgttgttgcttgatggtgtttactcgttcgttgttcagtgctctgttcttgcttgatggtgtgaagtggaccgccaaatgcccaagtgcagtacagtaaagtggcgctaagctttgggcccatatctccggaacgtgtatgacatgcaga

SEQ ID NO: 1822 - DNA, 1838 bp, Pennisetum glaucum
gccgagtgccgacgcaccaaccactcccccacggccagagagcagaggcggcgccagcacccccccggccggccccccgccgatcccgcgcgcagcgatccgatcccgccgatcgcgatggcgccgccgccggaggcggacccgcgcagcggctactgcgccgccacgcgctccttccgcagcaagcgcgcgcccgtcccgctccccgccgaccgcgacctcgacgtcgtcgccttcctcgcctcccgccgccacgcggggaccgtggcgctcgtcgacgccgccaccggccgccgcgtcacgttcccggacctctggcgcgccgtcgccggcgcagccaccgcgctcgccgcgccgccgctgtccctccgcaagggcagcgtcgcgctcatcctctccccgaactccgtccacttccccgtcgccgcgctcgccgccatgtccctcggcgccgtcgtcaccaccgccaacccgctcaacacccccgccgagatcgccaagcaggtcgccgacgcggggcccgtcgtcgccttcaccacccgcgacctcctccccaagctccccgccggcctccgcgtcgtcgtgctcctcgagcctcaccggctcccgtccgaccccgccgccgtcgtcgccaccatcgacgagatctccgccaccacgcccgaccccgcgcgccggaaggagcgcgtcacgcaggacgaccccgccacgctgctctactcctcgggcaccacggggcccagcaagggcgtcgtcgccacgcaccggagcctcatcgccatggtgcagatcatcatgacgcggttccgcctcgagggcgccgacaggaccgaggccttcctctgcaccgtgcccatgttccacgtctacggactcgtcgccttcgccacggggctgctcggctgcggcgccaccatcgtcgtgctctccaagtacgagctccccgagatgctgcgcgccatcaacgagtacggggtcacctacctgccgctagtgccgcccatcctcgtcgccatggtcgcgcaccccaagccgctgccgctcggccagctgcgcaaggtgctctccggcggagcgccgctcagcaaggagctcatcgagggcttcagggagaagtacccgcaggtggagatcctgcagggctacgggctcacggagagcacggccatcggcgcgtccacggactctgcagaggagagccgcaggtacggcacggccgggctgctgtcgcccaacaccgaggctaagatcgtcgatcccgagaccggtgaggcgctgccggtgaaccgcaccggcgaactctggatccggggaccatacgtcatgaaagggtacttcaagaacccagaggcaacacagtcaacggtgacacctgaaggatggctcaagactggggatctctgctacatagacgaggatgggtatctcttcgtagttgaccgtctgaaggagttgatcaaatacaaagggtatcaggtgcctccggcagagttggaagctcttttgctaacacatccggaaatagcagatgttgctgttataccgtttcctgatcgggaggtcggccagttcccgatggcctacgtagttagaaagaaggggagcaatttgtcagaacgcgaggtgatggagtttgtggcgaagcaggtggcgccttacaagaaggttagaaaggtggcgtttgtgacagaaatccccaagaacgcgtcgggcaagatactgaggaaggatctcatcaaggtcgccacatccaagctatgaaatgtccactggtctgattttactgtgttggctatgtgcccactgttgatacacaacttttggagggtatattgggt

SEQ ID NO: 1823 - DNA, 2200 bp, Oryza sativa
acagcagccaggaaccagccacacattccacagccgcgacgcgacaccggaaacaaacgcaggtagcaactgcaaggggcagttggctggagctcggtgatctgtgggtctgatcgcgatgggacgctcaccggagatggaggtggacgcgcgcagcggctactgcgccgccacccgcacgttccggagcaggcgcgccgacgtgccgctgcccgccgacccggaggtcgacgtggtcagcttcctcgcctcgcgccgccactcgggcgttgtggccctcgtcgacgccgcgactgggcgccggatcaccttcaccgagctctggcgcgccgtggccggggcggcatccgccctcgccgcgcaccccgtctccctccgcaagggccacgtcgcgctcatcctctcccctaactccgtccacttccccgtcgccgccctcgccgccatgtcgcttggcgccgtcctcaccaccgccaacccgctcaatacccccgccgagatcgccaagcaggtcgccgacgcccgccccgtcctcgccttcaccacccgcgagctcctccccaagctcccgcgtgcccacgacctccgcgtcgtcctcctggaatccgcccgcctccccggcgacagctccgacccgcggatcgtcgccaccatcgaggagatctccgccacgacgcccgacccggcgcgccgcaaggaccgcgtcacgcaggacgatccggccaccctgctctactcctcggggacgacggggccaagcaagggcgtcgtcgccacgcaccggagcctcatctccatggtccagatcatcatgacgcgattccgcctcgagggctcggacaagacagagacattcctctgcacggtgcccatgttccacgtctacggcctcgtcgccttcgccacggggctgctcggttgcggcgccacggtggtcgtgctctccaagtacgagctcccggagatgctgcgctcgatcaacgcctacggggtgacctaccttccgctcgtgccgccgatcctggtcgccatggtggcgcacccgaagccgctcccgctcgggcagatgcgcaaggtgctatccggcggcgcgccgctgggcaaggagctgatcgaagggttcagggagaagtatccgcaggtggagatcctgcaggggtacgggctgacagagagcaccgccatcggcgcgtccacggactccgccgaggagagccgccggtacgggacggccgggcttctgtctcccaataccgaggctaagattgtcgacccagattccggcgaggcgctgccggtaaaccgcaccggcgagctctggatccgtggaccgtacgtcatgaaaggctacttcaagaacgcagaggcaacacagtcaacgctgacaccagatggatggctaaagaccggtgatctctgctacatagatgaggatggatatctcttcgtagtggaccgcctcaaggagttgatcaaatacaaaggttaccaggtgcctccggcagaactggaagctcttttgttgacgcacccagaggttacggatgttgccgttataccgtttcctgatagggaggtcggccagttcccgatggcctatatagtgaggaagaaaggaagcaacttgtcagagcgcgaggtgatggagtttgtggcaaaacaggttgcgccttacaagaaggttagaaaggtggcgtttgtgacggacattcccaagaatgcatccgggaagatactgaggaaggatcttattaagcttgccacatccaaactatgaaatgccaatcaattatctactactccacaatatattaagcttgtcaagaatgcattcggcaagatattgaatacgttttggaattggcatagacactttagttgttgtgtaccctctttctcaatatggtgggtatttgtaaatgaagatatcatcagtcatgtgcatttcttctatacatgatctggtagagttacactgtatccattcttgtataatcaaataaaaaataatttccgagttcgagccttcgatgtacactcatgtctgcccatcgcagaaagaaaaaaagaggaaaaacagagactcatatctgtccagaatcctgttttgggtctgatcagttcggtgatcaccaggctttctttgccttgatgggcctccacgcctgtaatggcgtatcaggacgaccttgtttttgga

SEQ ID NO: 1824 - DNA, 2113 bp, Hordeum vulgare
ccgccaccgcaggcagagggagaaagcagttactactcctgcaactggtgagacgacccacacaacgcacacccgcgcgcacgaaagacgcacgcacagcgacagccaaccgagagagagagaccgaccagccggcgcggcgatccgatcgcgatggccacggcgacggcggacccgcggagcggctactgcgccgcgacgggcgcgttccggagcaagcgcgcggtggtgccgctcccggcggaccgtgacctggacgtggtcaccttcctggcctcccgccgccactcgggcgtcgtcgcgctcgtcgacgcctccacgggccgccgcaccaccttcgccgacctctggcgcgccgtggccggggccgccaccgcgctcgccgcgccgcccttcggcctccgcaagggccacgtcgcgctcatcctctcccccaactcggtccacttccccgtcgccgcgctcgccgccatgtcgctcggcgccgtcgtcaccaccgccaacccgctcaacaccgccgccgaggtcgccaagcaggtcgccgacgcccgccccgtcctcgccttcaccacccgcgacctcctccccaagctgccccgcggcctccgcgtcgtgctcctcgagcctccctcccccgccgacgacccgcggatcgtcgccaccatcgacgagatctccgccaccacgcccgaccccgcgcgccgacgggaccgcgtcacgcaggacgaccaggccacgctgctctactcctccggcaccacggggcccagcaagggcgtcgtcgccacgcaccgcaacctcatctccatggtccagatcgtcatgaaccgcttccgcctcgaggactcggacaccacggagaccttcctctgcacggtgcccatgttccacgtctacggcctcgtcgccttcgccaccggcctgctcggctgcggcgccaccatcgtcgtgctctccaagttcgagctccccgagatgctgcgctgcatcaccgcctacggggtcacctacctgccgctcgtgccgcccatcctcgtcgccatggtcgcgcaccccaagccgctgccgctcggcaacctgcgcaaggtgctctccggcggcgcgccgctaagcaaggagctcatcgaaggcttcagggacaagtacccgcaggtggagatcctgcaggggtacgggctgaccgagagcacggccatcggcgcgtccacggactcggccgaggagagccgccggtacgggacggccgggctcctgtcgcccaacaccgaggccaagatcgtcgacccggagacaggcgaggcgctgccggtgaaccgcaccggcgagctctggatcaggggaccctacgtcatgaaaggatacttcaagaacacagaggcaacacagtcgacggtgacgcccgacggatggctcaagaccggtgacctatgctacatagacgaggatgggtatctcttcgtggtggaccgtctgaaagagttgatcaaatacaaaggctatcaggtgcctccagcagagttggaagctcttctgctgacccatccagaggtttccgatgtcgctgttattccgttcccagacagggaggtcggtcagttcccgatggcctatgtcgtgaggaagaaagggagcaatttgtcagcgcaggaggtgatggagtttgtggcgaaacaggtagcaccttacaagaaggtgaggaaggtggcgttcgtgacagacatccccaagaatgcgtctggcaagatactgaggaaggatcttatcaagctcgcgacctccaagctgtgaaatgtggaccgttatcctgctctgtgtattatcccttgaagtgtcaattggttcatccttggatcttcatcattgtacaactattgttttctttttgcccttcgtcccaatagccctctgactatctgtaactgaaggatctcagcggctgtgtactagtacatgaggtctctgtgtaaattggttctatatacaagctctgttgtacctagacttgaacaaccaaatccaaaataatttccgagtttgaggtgcaagtactgcaaatgcaaggcattataattagtgtgtatatttatacaggaagattaacattgctcacctt

SEQ ID NO: 1825 - DNA, 2086 bp, Secale cereale
tactactactggtcagacccggagccggcacccagacaaagcccaccggcgcgcacgaaagacacacagcgacagccaaccgagagatcgatcgatcgaccagccggcgcggcgacccgatcgcgatggccacggcggcggcgggggtggacccgcggagcggctactgcgccgcgacgggcgcgttccggagcaagcgcgcggcggtgccgctccccgcggaccgggacctggacgtggtcaccttcctggcctcccgccgccactcgggcgtcgtcgcgctcgtcgacgcctccacgggccgccgcaccaccttcgccgacctctggcgcgccgtggccggcgccgccaccgcgctcgccgcgccgcccttcggcctccgcaagggccacgtcgcgctcatcctctcccccaactcggtccacttccccgtggccgcgctcgccgccatgtcgctcggcgccgtcgtcaccaccgccaacccgctcaacaccgccgccgagatcgccaagcaggtcgccgacgcccgccccgtcctcgccttcaccacccgcgacctcctccccaagctgccccgcgccgccgacggcctccgcgtcgtgctcctcgaatcctcctctccctctcccgccggcgccgccgacccgcggatcgtcgccaccatcgacgagatctccgccaccacgcccgaccccgcgcgccgccgggaccgcgtcacgcaggacgaccaggccacgctgctctactcctccggcaccacggggcccagcaagggcgtggtcgccacgcaccggaacctcatctccatggtccagatcgtcatgaaccgcttccgcctcgaggactcggacaccacggagaccttcctctgcacggtgcccatgttccacgtctacggcctcgtcgccttcgccaccggcctgctcggctgcggcgccaccatcgtcgtgctctccaagttcgagctccccgagatgctgcgctgcatcagcgcctacggggtcacctacctgccgctcgtgccgcccatcctcgtcgccatggtcgcgcaccccaagccgctgcctttgggcaacctgcgcaaggtcctctccggcggcgcgccgctcagcaaggagctcatcgaagggttcagggagaagtacccgcaggtggagatcctgcaggggtacgggctgacggagagcacggccatcggcgcgtccacggactcggccgaggagagccgccggtacgggacggccgggctcctgtcgcccaacaccgaggccaagatcgtcgaccctgagaccggcgaggcgctgccggtgaaccgcaccggcgagctctggatcaggggaccctacgtcatgaaaggatacttcaacaacacagacgcaacacagtcgacggtgacgtccgacggatggctcaagaccggagacctctgttacatagacgaggatggttatctcttcgtggtggaccgtctgaaagagttgatcaaatacaaaggctatcaggtgcctccggcagagttggaagctcttctcctgactcatccagaggtttcggatgtcgctgttattccgtttccagacagggatgtcggtcagttcccgatggcctacgtcgtgaggaagaaagggagcaacctgtcagcgcaggaggtgatggagtttgtggcgaaacaggtagcaccttacaagaaggtcaggaaggtggcgttcgtgacggacatccccaagaatgcgtctggcaagatactgaggaaggatcttatcaagctcgcgacgtccaagctgtgaaatgtcgacccttatcctgctctgtgttatcctctgaagtgtcggttgattcatccttggatcttcatcattgtgcaattattattttctcttttgcccttcgtcccaatagccctctgagtatatgtaactgaaggatttcagcaattatgtagtgcatgaggtctttatgtaaattggttctttacaggctctgttgtacctagacttgaataaccaaatccaaaattatgtccgacttttaggtgtaaatactgaaagtgcaagacattatacatcagagtacatatttataaagg

SEQ ID NO: 1826 - DNA, 2321 bp, Brachypodium distachyon
gacgagtctcaacgacacgcgggttccaccttccccaccagtctgccggtacttcttctattactgacgaagtactggtcagacgcccgcaccgcacgagcacgagacgagagagccgccggagacagagcaaaatcaaatcccaaacgagccaaaccatctctccccgcgatggcccaatcggagacggcggacacgcggagcggctactgcgccgcgacgggctccttccggagcaagcgcgcggcggtcccgctccccgtcgaccgtgacgtcgacgtcgtcaccttcctcgcctcccgccgccactcgggcgtggtcgcgctcatcgacgccgccacgggccgccggaccaccttcggggagctctggcgcgcggtggccggggccgccacggcgctcgcctcggcccccttctccctccgcaagggccacgtggcgctcatcctctcccccaactccgtccacttccccgtcgccgccctcgccgccatgtcgctcggcgccgtcgtcaccaccgccaacccgctcaacaccgccgccgagatcgccaagcaggtcgccgacgcccgccccgtcctcgccttcaccacccgcgaactcctccccaaactgccccgcgaccacccgctccgcgtcgtcctcctcgaatccgccgccggggaccccctccccgccgatccgcgcatcgccgccaccatcgaggagatctccgccacgccgcccgaccccgcgcgccgccgcggggaccgcgtcacgcaggacgaccaggccacgctgctctactcttccgggacgacggggcccagcaagggcgtcgtctccactcaccggaacctcatctccatggtccagatcgtcatgacccgcttccgcctcgaggagtccgactccacggagaccttcctctgcacggtgcccatgttccacgtctacggtctcgtcgccttcgccaccggcctgctcggctgcggcgccaccatcgtggtgctctccaaattcgagctccccgagatgctgcgctgcatcaacgcctacggggtcacctacctgccgctcgtgccgccgatcctggtcgccatggtcgcgcacccgaagccgctgccgctcgggcagctgcgcaaggtgctctccggcggcgcgccgctcagcaaggagctgatcgaagggttcaaggagaagtacccgcaggtggagatcctgcaggggtacgggctcacggagagcacggccatcggcgcgtctacggactcggccgaggagagccgccagtacgggacggctgggctgctgtcgcccaacaccgaggctaagatcgtagaccctgagaccgctgaggcactcccggtgaaccgcaccggcgagctgtggatcaagggaccatacgtcatgaaaggctacttcaagaacacagaggcaacaaaggcaactgtgacacctgaaggatggctcaagactggtgatctctgctacatagacgaggatgggtatctcttcgtggtggatcgtctgaaggaattgatcaaatacaaaggctaccaggtgccaccggcagagctcgaagctcttttgctgacacatccagagattaccgatgccgctgttatcccgtttcctgataaggaggtcggccagtttccgatggcctatattgtgagaaagaacgggagcaacttgtcagcgcatgaggtgatggagtttgtggcgaaacaggtagccccttacaagaaggtcagaaaggtggcgttcgtgacggacatccccaagaatgcatccggcaagatactgaggaaagatctcatcaagctggcgacatccaagctctgaaatttggattggactggccccttcctgcattagtgttggctcgtcatcattgtacacttggctctcttctgccctttgtccaaattaatttcggtgagtatttgtaactgaagatctcatcagttgtgtacattggagggtatactgcttcttctgtacctagaattgaataaccataataccaaatccaaaacaatttcccagtttgaggtgttagatggatctgagatcaacccatccagattcctacacggctacactggtttgtgtacagactgtaactctgtaattacgagatctagaccagacattacagtatgtatatggccagtcagtttactttcactatatttcttggctgtggtggttcgtagcctccactgggatatccaatgagatttttctttatatataatctttttcgaacagattttgcccatttgagcgcacctcgaacatgtgtttggtaaggtatataaatgtcaaaatctgag

SEQ ID NO: 1827 - DNA, 2404 bp, Setaria italica
ccaacccatctccccgcgcccgcggcaaaataaaatccccgaccccgacgcgccacccgcaaatctcgctgcctctccctccgtctcccgccgccgccgcctcggccgctagctcgcccgctcgcgcgccgcccgatccgatggcaaccgccgccgcggggccgtcgcctcgccggcggctcgccgcggcggtcgtcgcggtcgcgctcgccctggccctcgctccggcggccgcgaggcccgacaaggagatgcgggagaagttctacgggacgctcgtcaccaacggcacgcacaacgcctccggggatggcagcatcgccgagatgttcggccgcgtgctcgacaaggagttcgccgacagcgacacgcccgacgctcctgacaagagtaacttcaacaacagcgtatctgatcatcaagctgttctggagacagtagctgtcattacacatgacaagaagaagaacgattcacagaacacaaattccccaaaacctttccaaataggtgacatgttcggaggtcaggacgagacatctgatgacttggaaactgtgatagataaagaggataatgtttttgtgatgtcaaatcgtaaaacaaagtatccaacacttcaattagatttaaggttgattaaagatctggtggttataatcgtttcggctaccggtggcggtatcatattctcttgtatggggcagccggttattgttggctacctacttgctggttctctagttggtcctggtggtttgaactttatcagtgaaatggtgcaggtggaaacttttgctcagtttggtgtagtgtttcttcttttcgctcttggtctcgagttttcactgactaagttgaaagtggttggtcctgttgctgtacttggtggtctgcttcagattgcgttgttcatgttcttgtgtggcctcactgcggcgttgtgtggtgctaagtcatctgaaggagtgtttgttggagccttcttgtccatgtcatctactgcagtggtttccaagtttttagtggaaaaaggcagcacaaacacacttcatggtcaagtgacaattggaacacttatacttcaggattgtgcagttggcctactgtttgctctccttcctgttcttggaggtgctagtggcatttttggaggagtgatgtcaatggcaaaactgttgcttgtgctgtccatatttatagctgttacatatatgatgacatggtcaattgttcctcgattcttaaaactgatgattcagttatcttcacagacaaatgaactctaccagttggcctccgttgctttctgcttgctgctagcctggtgcagtgattatttcggattgagtcttgaactggggtcatttcttgctggcgttatgatatccaccacagattttgctcatcatactttggaacaggtggaagccattcgcaatttgtttgcagcactcttccttgcaagcattggaatgctcatacatgttaagttcttgtggaatcatgttgacatattacttgcagctgttatactggttataatagtaaagagtatagtcgtaactgttgtcgtaaaggcatttggatacagcatcagaacagctttcgttgttgggctatccttagctcagataggagagtttgcttttgtgcttttgagccgtgcctcacatcttcatcttgttggggggaaaatgtatctgctattactgggaacaactgcccttagcttggtaacaactcctctcattttcaaactaattcctgtggtaatgcaccttggcatccttatgcgttggttccccacggaaaatagtgtgcaaaatgagcttcctttacaggagaaagccgttatgcttgaagcccacaaccgatcgctctaacattttgcatagctaagacaattctttcaactgacggtgatttatttgtgcgttgactctctgcacatgccgtggtaacattggaggaacagttacaccaatcccttttgtggtgatctgggaacacgaagcgatggccaaaattaacagcttggccacccgtggagcttccgtatagcattcttttggttggaattttgggttgtacatactgtatatgttgtcaaggtagcatacacgggcgtttgtccatacgagtaaggcgctgatgggggccttggttttgtatcattcttgccacctcaatttaggaagctactagatagggattttggtaccctgtgctcaaatgtactactctttttttgtaagaagattatggaaaagctgtatttttgtagtatgtattgctctgttcttgtcaattgtcgtgaacacatccactccatccatcaagttgatcatagcactgtaacttggaacgcgtatgttaaggtactgccattcgtgtgtcgaac

SEQ ID NO: 1828 - DNA, 2498 bp, Zea mays
gcctctcccttcccagttcccccgcctgccgccgcctcgtgctctcgtgctcgcgcgaccggatggaggatattcggacgacgactccaccgcgccaaccgacccctctcgcctctctcggtctctcctccgactcaccccgcgcccgcggcgagaaataaaagagaaatcccccgacgaccccgacgcgccacccgcaaatctcgctctccccgctgcccgcccgcccgcaccccacccctcgctcgcgcgccgcggcgcccgcgcgatccgatggcccccgccgccgcagcagcagaagcagcggggccctcgcctcgccggcgcctcgcggcggccgtcctcgcgctcgcgctcgcgctcgcctgtgtcctcgcgcaggcggccgccaggcccgacaaggagacgcgggagaagttctacgggacgctcgtcgccaacggcacacacaacgcctccggggacggcagcatcgccgagatgttcggccgcgtgctcgacaaggagttctccgacagcgacacgcccgacgctcccgacaagagtagcttcaacaacagcgtgtcagatcatcaagctgttctggagactgtagctgtcattacacatgacaagaagaagaatgattcacaacatactaattccccaaaacctttccaaataggtgacatgtttggaggccaagatgaaacctccgatgacttggaaactgtgattgataaagaggataatgtttttgtgatgtcaaatcgtaaaacaaagtatccaactcttcagctagatttacgattgattaaagatctggtaattataatcgtttcagctactggtggtggtatcatgttctcttttatggggcagccggttatcgttggctacctgcttgctggttctctagttggacctgggggtttgaactttatcaatgaaatggtgcaggtggagacttttgctcaatttggtgtagtgtttcttctttttgctcttggtctcgagttttcactgactaagttgaaagtcgttggtcctgttgctgtacttggaggtctgcttcagattgttctgttcatgttcttgtgtggcctcactgcagcgttgtgtggtgctaaatcatctgaaggagtgtttgttggtgccttcttgtctatgtcatctactgcagtggtttcgaagtttttagtggaaaaaggtagtacaaacacgcttcatggtcaagttacaattgggacgctaatacttcaggattgtgcagttggcctgctgtttgcactccttcctgttcttggaggtgctagtggcatttttggaggagtgatgtcaatggcgaaactgttgctagtgctatccgtatttgtagctgttacatatatgatgacatggtcaattgttcctcgattcttaaaactgatgattcagttatcttcacagacaaatgaactctaccaattggcctccgttgcattttgcttgcttctagcctggtgcagtgactattgtggattgagtcttgagttggggtcatttcttgctggtgttatgatatcaaccacagattttgctcatcatactatggagcaggttgaagccattcgcaatctatttgcagcactcttccttgcaagcattggaatgctcatacatgttaagttcttgtggaatcatgttgacatattacttgcagctgttatactggttataatagtaaagagtattgtcgtagctattgttgtaaaggcatttggatacagcatgaggaccgcttttgttgttgggctgtccttggctcagataggagagtttgcttttgtgcttttgagccgggcctcccatctccatcttgttggggggaaaatgtatctattattactgggaacaactgcccttagcttggtaacaactcctctcattttcaaactaattcctgtggtaatgcaccttggcatccttatgcgttggttcccctcggaaaacagtatgcagagtgaggaaaaggcggttatgcttgaagcccacaacagatcactctaacattgcctagccacaacattcttttgactgacggtgatttatttgtgcatcgactctttgcgcatgccatggaaacattggagaaacaattacacaccagtactccctttttgcggcgatatgggaacacgatgggatggacagagttaacagcttggccagccttggggctctccgtatagcattcttttttattgcgcttttgagttgtacatataggggatactgtacatgtcgtcaaggtagcatacagggggaaggcgccgatgggccttggttttgtatcattgttgccaactcgatcagtcgacagtctagaaagctagatagggatttttggtacctcgtgctcaaatgtacacttattgtcagaagacgatgggaaagttgtatgttatgtatttgttatgcccttgtgacgactaattgaccatggacacatgaatggtaacgtgttcaccgtatcgatt

SEQ ID NO: 1829 - DNA, 2537 bp, Oryza sativa
ataaccaccacaaggcgcaggggccgccttcgcctcgcgttcccgtcttctcgtgctcggacggcgactccgccaccgcgccaaccacaccaatcttcccgcggaatcaaaatccaccgaccccgacgcgccacccgcgaatctctccccctcccgccgccgccgcggcctcctcctccgcctcctccgcctcggccggtcggtcgagccgccgccggaccgatccgatggccccggcggccgcgggacgggtacccttgtctcgccggcgctccaccgccgcgctgctcctggtggccctcgcgctcgtcctcggggtgcagctccgctccgccgcggcgaggcccgacaaggagatgcgggagaagttctacgggaaactggtcaccaacggctcgggcaacgccaccggggacggcagcatcgccgagatgttcggccgcgtgctcgacaaggagttctccgatagcgacacccccgaggcaccagacaagagtagcttcaacaacagcatctcagatcatcaagctgttctggagactgtagctgtcattacacatgataaaaagaagaatgattcagagcaggcaaattcttcaaaaccttttcaaataggtgacatgtttggaggtcagaatgaaaattctgatgacttggaaactgtaatagataaggaggataatgtttttgttatgtcaaatcgtaaaacaaagtatccgacacttcaactagatttaagattgattaaagatctagtagttataattgtttcagctactgctggtggtatcatattctcttgtttggggcagccggttattgttggctatctactggccggttctctcgttggacctggaggcttgaactttatcagcgaaatggttcaggtggagacttttgcgcaattcggtgtggtgtttcttctattcgctcttggccttgagttttcactgacaaagttgaaagcggttggacctgtcgctgtaattggtggtctactgcagattgttctgttcatgttcttgtgtggcctaactgctgcgttgtgtggtgctaaatcatcggagggagtatttgttggtgctttcttgtcaatgtcatctactgcagtggtttctaagtttctagtggagaaaggtagcaccaatgcgcttcatggtcaagttacaattggtacacttattcttcaggactgtgccgttggactattatttgctctccttccagttctgggtggtgctagtggcatttttggaggcgtgatgtcaatggctaaactgctgcttgtattatccgtatttataactgttgcatatatgatgacttggtcatttgttcctcgattcttgaaactgatgattcagctatcatcgcagacaaatgaactctatcagttggcttctgttgctttctgcttgctgctagcctggtgtagtgattatcttggattgagtcttgaactaggctcatttcttgctggcgttatgatctcaaccacagattttgctcatcatactttggagcaggtggagccaattcgtaacttatttgcagcactcttccttgcaagcatcggcatgctcatacatgtcaagttcttgtggaatcatgttgacatattgcttgcagctgttatactggttataatagttaagagcgtagtcgtaacagttgtggtgaaagcatttggatacagcatcagaacagcttttgttgttgggctatcattagcacagataggagagtttgcatttgtgcttcttagccgtgcttcgcatcttcatcttgttgggggaaaaatgtatctattattactgggaacaactgcacttagcttggttacaactcctctcattttcaaactaattcctgtggtaatgcaccttggtattcttatgcgctggttcccctcggaaagcagtatgcagaatgagctacctttacaggataaagcaaccatgcttgaagcctacaacagatcactctaacattacaaagccacagacattcattcatttgactgacaatgatttattcgtgcattaactctttgcacatgccgtggaacattggacagacaattccatcatttctttttgcggcaatacgtctacacaagcgatgactaaagacacagtttgacaggccggggatctgttggtataccatttaagttgaaaaattgagttgtacatactgtacatgttgtcagcgtagcatattctttagactgtaaggccccaagccttggttttgtatcatccctgccaactcaacctaggagttaggtaggatttttggtgtaatgctatcagatataccgagagaaccgatatgtgctgattccccatcagaagaccatgggaaagctctatgttagtatatattgtccatttgtcctatgtatgagctgccaggtgacttgttctgttcttgtcgtatggataaacattttgtcacaacattctcttgtcctagtatgagctaccattggaaagtagcagcattttattctcccgtgaaggaaaaaactc

SEQ ID NO: 1830 - DNA, 3080 bp, Brachypodium distachyon
atggccggcgcgggggccggcgccggcatcggcgcgtcagcaaagagctccacgggcatcagcaaactgtccaccgtgagcacgcacaacggcacctcgtccaacaccgtggccgccaccctggacttcctgacgcccgtgtccagcgacacgtcatcgccacgcgccaccacggtgacattgtactccccggccgccgtggacgccagcgtgcgcagcggccttgccccggccttgaccagcttcagcgacggcttgggctcgtacgccggcaccgcgtggtacatcagcagccgcacgaggtcatccttctccatcttccccacgtccggcgttcccgccttggccacgaacgcgtcgtcgttgggcgcgaacagcgtgagcccagtggccatggccgcctggtacgccttgagcacgccggggttccccgccacgagcgccgcgaaccgcttgcacccggccttctctagcagcctggtcaagttcgcggcgtccggcacgtcgaagagcccgtcgaactcgatgggcgccgagatctccagcacggcaaagtcgtacggcgtctgcttcacggctttcacgagcgtggcgtcgaacttggctcccttgttggcggacgcgaacccgaagtcgccgctgtccagcttggcgatcttgacggtgcccatggcgtccccggcggcctggaagaaggtgtcggaacgacgtgatgttgtgctgaaccccgccgccgccgccgccgccgcgcaccattggcgccgccaggcaacacaagagcagcactactacgccaggagcgacgaccggccgctcgcccgccatgccccgatccggatggcgcatgggggctcctcctcctccccgccgtcccgccggcgcttcacggccgccgtcttcgcggtcgccgtggcgctcgccctcgcgccgcagctgcggcccgccgcggggaggcccgacaaggagacgcgggagaagttctacggaaggctcgtcaccaatggcacccacaacgcctccgcggaggacagcatcgccgacatgttcggccgcgtgctcgagaaggagttctccgacagcgacaccaacgagacaccggacaagaatagcttcaacaacagcatctcagatcatcaagctgttctggagactgtagctgttattacacacgacaggaaaaatgattcgcagctggcaaattcctcaaggcctttccaaataggtgatatgtttgggggtcagaatgagaattctgatgaaactgaaactgtgatagataaagaggataatgtttttgtgatgtccaatcgtaaaacaaagtatccaacacttcaattagatttaagattgattaaagatctggtggttataattgtttcagctactggtggcggtatcatattctcttgtttgggccagccagttattgttggctatctacttgctggttctcttattggacctggaggcttaaacttgatcagtgaaatggtgcaggtggagacctttgcacagtttggtgtggtgtttcttcttttcgctcttggccttgagttttcattgccaaagttgaaagcggttgggcctgttgctgtcgttggtggtctacttcagattgctctgtttatgttcttgtgtggtctaactgctgtgttgtgcggtgctaaaacatctgagggagtatttgttggcactttcctgtcaatgtcatctactgcagtggtttccaagtttctagtggaaaagggtagcacaaatgcactccatggtcaagttacaattggtacccttatccttcaggattgtgcagttggcctactttttgctctcattccagttcttggtggttctagtagcttatttggaggaatgatgtcaattgggaaactgttgcttgtactatccatatttgtaactgttgcatatatgatgacttggtcatttgtgcctcgattcctaaaactgatgattcagttatcatcacagacaaatgaactctatcagttggctgcagttgccttttgcttgctgctagcctggtgcagtgattatcttggattgagtcttgaactgggctcatttcttgctggtgttatgatatccaccacggattttgctcatcatactttggagcaggtggaagcaatccgtaacttatttgcagcactcttcctcgcaagcattggcatgctcatacatttcaagttcttgtggaatcatgttgatatattacttgcagctgttatactggttataatagttaagagtttagtcataacagttgtcataaaagcatttggatacaacatcagaacagctttcgttgttggcctatcgttagctcagattggagagtttgcttttgttcttctgagccgtgcttcacatcttcatcttattggggggaaaatgtatctgttattactgggaacaactgctcttagcttggtaacaacacccctcattttcaagctaattcctgtggtaatgcaacttggcatccttatgcgttggttcccctcagaaagtaatgtgcataatgaggaaaaagtaactatgcttgaagttcacaacagaacgctctaacactgcaaagccaccacattcatttgactgacagcgatttatttgtgcatcgactctttgcacacgctgcggaacactgcgcaaacagttccatcatttccttccacggcaatacaggggcatgacgcactaaatataacactttaaagggaaggggagctataaatccaagaaaatgactttgtacatactgtacatgtattcgacgtagcatattctttacacagtaaggccctgggcctagttttgtaccattcttgccaacagtctaggagttagatagggattttgtatgctgtgctcaggcgtaccgaacaagtgagatgtactgtgcccccaccagattattgtgggtaagctgtatgctatatatatcggcaattgcctgtgcctgaatgctctattaccaggtcacacgatcttgtcttgtcttatccactacactaccattttgttacggagtataacattctctggacactgttactctccgg

SEQ ID NO: 1831 - DNA, 2305 bp, Triticum aestivum
gcccgacaaggagacgcgggagaagttctacgggagcctcgtcgccaacggcacccacaacgccaccgccggggacaacagcatcgccgacatgttcggccgcgtgctcgacaaggagttctccgacagcgacgcctccgaggtgccggacaagaacagcttcaacaacagcatctcagatcatcaagctgttctggagactgtagctgttatcacacacgacaagaaaaatgatacacagcaggcaaattcctcaagacctttccaaataggtgacatgtttggttctcagaatgaaaattctgatgacacggaaactgtgatagacaaagaggataatgtttttgtgatgtcaaatcgtaaaacaaagtatccaacacttcagttagatttaagattgattaaagatctggtagttataattgtttcagctactgctggtggtatcatattctcttgtttggggcagccagttattgttggttatctacttgctggttctcttattggacctggaggcttgaacttgatcaatgaaatggtgcaggtggagacctttgcccagtttggtgtggtttttcttctttttgctcttggccttgaattttcattgccaaagttgaaagtggttgggcctgttgctgtgcttggtggtgtacttcagattgctttgttcatgttcttgtgtggcctaactgctgcgttgtgcggtgctaaattatctgagggagtatttgttggcactttcttgtcaatgtcatctactgcagtggtttccaagttcttagtggaaaagggtatcacaaatgcgcttcatggtcaagttacaattggcacccttatccttcaggattgtgcagttggcctgctgtttgctctcattccagttctgggtggttcaagtggcatatttggaggaatgatgtcaatggggagactgttgcttgtactgtccatatttgtaactgttgcatatatgatgacttggtcatttatccctcgattcttaaaactgatgatccagttatcatcacagacaaatgaactctatcagttggctgctgttgctttctgcttgctgctagcttggtgcagtgattatcttggactgagtcttgaactgggctcatttcttgctggcgttatgatatccaccacagattttgctcaccatactttggagcaggtggaagcaatccgtaacttatttgcagcactcttccttgcaagtattggcatgctcatacatttcaagttcttgtggaatcacgttgacatattacttgcagctgttatactggttataatagttaagagtatagtcataacagctgtcataaaatcatttggatacagcatcagaacagctttcatcgttggtctatcattagctcagattggagaatttgcttttgtgcttctgagccgtgcctcacatcatcatcttataggggggaaaatgtatctgttattactgggaacaactgctcttagcttggtaacaactcccctcattttcaaattaattcctgtggtaacgcaactcggcatccttatgcgttggttcccctcagaaagcggtgtgcagaatgaggaaaaggcaacaatgcttgatgtttacaacagaacactctaacattgcaaagccaagacattcattccactgacaacgatttatctgtgcaaagactctttgcacatgccacggatcgctgcacaaatattttcatcatttccctccacgacagtatagcgggggtgtgatgcaatgactaaggataacattttgaatggccggggagttatccatataccactccaatgcaagaactgagtttgtacatactgtacatgttgtcgaagtagcatattctttacacggtatggccgtgaggccttggttttgtaccattcttgccaacttaatcttaggagttagatagggattttgtatgccgagctcagatgtaccgcacaagtgacatgtactattttccccatagcggggtgggggtggggtggtatgctatatatcgccaattgcctttgtgcgtgaaatgccagctgacatgatctggtgttgtctttcaacaatcattttctcacagcattatatggatattgttactctcctgtcattatgtgtggcgaagtagtgaagattgtttgctggggtacagattgttattctcccgacactgtccatcttgtctctggatgtttgtttatgctagctcattcatcctaagttggcggaattttgctgtcacttagagcatctctagccctcccatcctttaatccc

SEQ ID NO: 1832 - DNA, 1999 bp, Zea mays
tgattcctccactccggccttgcccgacgatctccagctgtccttcaatcaaattatcaacccaacgccatttcggcgctcccgcttcccacaggagtcacagctcaacaaatccctacccaaatccacctccccgccccccaccgccatggctcccccaccaacctcgcgctgcctcgccctcgctctcatcctcatcggcgccctctgcgccgccgccgccgccgcgcggttcgccccggcggacaaccacctccttgcgtgcggcgcggcggcgcccgccgtcctccccgacggccgccgcttcgtgccggactctggctgcgcatccacccgcctccggtcatcctccccgtccctctcctccgcggcgccgcccggctccccgccgccgccgtcctcgctcctcgcctccgctcgggtcttctcctgccgcgcgtcctacgacctcgatgtccgccgccgcgggcaccacatcctccgcctccatttctaccccttcgtccccgccctcgccgcggcccgcttccacgtcggcgccggggggctcctcctcctccacaacttcacggcctcgtcccccgtcgtcaaggagttcatcctccccgtggactccgacgtcctcgtgctcaccttcgtccccgactccggctccactgccttcgtcaacgccatcgagctcgtctctgcgcccgaagagctcgttggcgacatcggcaccctagtcacgtccggcggcgccgctcagatacacgagctgtcgtctcaggtgtttgagactctctacaggatcaacgtcgcggggcgcaaggtcacgccattcaacgacacactgtggcggacatgggttaacgatgagaaattcctcatcgacaccgactcctccaactacatggtgtggtcgtccagtggccggattgcttatcccaagggtagcaagcagatgacaagagaagtggctcctgacaatgtctacaactctgcaagatccgtgaggccaggggtgaatgtgacttggggtttccctgtgcctgctagcagccggtaccttgtgcgtatgcacttctgtgacattgctagcaaggctctgtatgagctctacttcaatatctacgtcaatggtgatcttgcagtcaaggatttcgatctctccagtgcaactggattcttggcctatccttattacattgactttatcgtcgatgtgaaggatgaggggatactgaaattggcgattggtggcttaaagaagagtcgatctgatgaagtaagtggtatccttaatgcactggagataatgaggatgaacaagaccagtggaggtatggatggagacttcccaattgatctacacatggaatatgtggtgagtaaggggattggagaatttgcccgctccctgctctgtggtttcatctttgttgggttgtttgtggctttggtcacgctgatggtgaggttgaggaccgagttgaggaataacggcacagcttggtcctggagacagatgaactccgatgaagggaaactggccagaacatatcagcttgtgcccagtaagacggactattgaatattgcaggctgggcatctttgaggagtgacaacctgcggctgttgtgtgcatctaatcacatcatactttttattaagttgtaagtactgtagttttatcacctctctaaaagtattgtagttttgtatcatcactcctttcatgcttggactttgcattctccatgctttgtcaatggtcaatggaggacatgctcatgatgctgtaaaagtactctaccctagatgtggctgtattgctattgcctcatttattcagtttgacttctgaaacatggattcacagctgaattgcatttgaatataattagttgtagtggagacatttgattataaaaaaataagtcaaatagctgcagaagccatcatgccattgtatttgtaacatgatttggctgttgctgacttactgttttcttctcca

SEQ ID NO: 1833 - DNA, 1854 bp, Panicum virgatum
ctcgtctcccccagctcgacgcgctgaattaattaatcaaactccatttcccccctcctacgacacaacaaatcgccacccaaatccaccacctccccgttccccaccgccatggcttccccaccaaccgcttgccgcctcgccgtcctcctcctcggcgtcctctgctccgccaccgccgtcgccgccgcgcggtacgccccggcggacaaccacctcctcgcgtgcggcgcggaggccccggccgtcctccccgacggccgccgcttcgtcccggactccggctgcgcctccacccgcctccgctcccccgccccgaccctctcctccgccgcgcccccgggctccacgccgccgccttcccctctccacgcctccgcgcgggtcttctcctgccgcgcgtcctacgacctcgccgtccgccgccgcgggcaccacatcctccgcctccacttctaccccttcggccccgccctctccgcctcccgcttccacgtgggcgccgggggtttgctcctcctccacaacttcaccgcctcgtcccccgtcgtcaaggagttcatcctccccgtggattccgacgtcgtcgtcctcaccttcgtccctgactcgggctccaccgccttcatcaacgccatcgagctcctctctgcacccgaggagatcgttggcgacattggcaccctcgtcacatccggcggcgccgctcagatcgacgggctttcatcccaggtgtttgagactctctacaggatcaccatcgccggtcgtaaggtcacaccgttcaatgacacgctgtggcggacatgggttaacgatgcggacttcctcgttggcacggactcggccaactacaaggtatggtcgttcagtggccggatcgcttatcccaagggcagcaggcagatgacccgggaggtggctcctgacaatgtctacagctctgcgagatcagtgaagccaggggccaatgtgacttggggtttccccgtgcctgctggcagccggtacctcgtgcgtatgcacttctgtgacattgttagcaaggcgttgtatgagctctacttcaatatctacatcaatggcaatcttgcagtcaaggatttcgatctctctagcagcaccggattcttggcctatccttattacattgactttattgttgacgtggagggtgaggggatgctgaaattggccattggtggcttgaagcagagccgatctgatgaagtaagcggtatccttaatgcgctggagattatgaggatgaacaagacgagtggcggtatggatgggaacttcccaattgcgctagacatggagtatggggtgagtaaggggatcggggaattcgctcgctccctgctgtgtggtttcatctttgctgggttgtttgtggctttggtcatgctggtgctgaggttgaggactgagctgaggaacaatggtacagcttggtcttggaaaccaatggactctggtgaagggaaattggctaaagcatatcagcttgtacccagtaaggcagactattgaatgatatgagcttagcatctttgaggagcggcaaactacagctgttgtatgtatctaatctcgtaatatttgtattcagttgtaagtattatagttgtagttttacttctttttactcctttcatgcttgaactttgggttgtctaagctctgataatggagggacatgctcattatattgtgaaagtaaagtattttaccccagatgtgtctgtattgctactacttcacttattcagttcattttctgaaatacacttgaatgaatgcttgtgatatccatagcaaatttgctgtggtggattcacgatggtgtag

SEQ ID NO: 1834 - DNA, 1826 bp, Panicum virgatum
gattcctatactccgtccggcctgtcgatctccagctgtcctccaattaatcaaacaccatttctccccctcccacaactcaacaaatcgccacccaaatccaccacctccctccccgtccccctccgccatggcttccccaccaacccctcgccgcctcgccgtcctcctcctcggcgtcctctgctccgccgccgccgtcgccgccgcgcggtacgccccggcggacaaccacctcctcgcgtgcggcgcggaggccccggccgtcctccccgacggccgccgcttcgtcccggactccggctgcgcctccacccgcctccgctcacccgccccgaccctctcctccgccgcgcccccaggctccccgccgccgccttcccctctccacgcctccgcgcgggtcttctcctgccgcgcgtcctacgacctcgccgtccgccgccgcgggcaccacatcctgcgcctccacttctaccccttcgcccccgccctctccgcctcccgcttccacgtgggcgccgggggtttgctcctcctccacaacttcaccgcctcgtcccccgtcgtcaaggagttcatcctccccgtggattccgacgtcgtcgtcctcaccttcgtccctgactcgggctccaccgccttcatcaacgccatcgagctcctctctgcacccgaggagatcgttggcgacattggcaccctcgtcacatccggcggcgccgctcagatcgacgggctttcatcccaggtgtttgagactctctacaggatcaccgtcgccggtcgtaaggtcacaccgttcaatgacacgctgtggcggacatgggttaacgatgcggacttcctcgttggcacggactcgaccaactacaaggtatggtcgttcagtggccggatcgcttatcccaagggcagcaggcagatgacccgggaggtggctcctgacaatgtctacagctctgcgagatcagtgaagccaggggccaatgtgacttggggtttccctgtgcctgctggcagccggtacctcgtgcgtatgcacttctgtgacattgttagcaaggcgttgtatgagctctacttcaatatctacgtcaatggcaatcttgcagtcaagaatttcgatctctctagcaccaccggattcttggcctatccttattacattgactttattgttgacgtggagggtgaggggatgctgaaattggccatcggtggcttgaagcagagccgatctgatgaagtaagcggtatccttaatgcgctggagattatgaggatgaacaagacgagtggcggtatggatggaaacttcccaattgcgctagacgtggagtatggggtgagtaaggggatcggggaattcgccctctccctgctgtgtggtttcatctttgctgggttatttgtgactttggtcatgctggtgctgaggttgaggaccgagctgaggaacaatggtacagcttggtcttggaaaccaatggactccggtgaagggaaattggctaaagcatatcagcttgtgcccagtaaggcagactattgaatgatatgagcttagcatctttgaggagcggcaaactacagctgttgtatgtatctaatctcgtaatatttctattcggttgtaagtattgtagttgtagttttacttctttttactcctttcatgcttgaactttgggctgtctgagctctgccaatggaggacatgctcactatattgtaaaagtattttaccgcagatcagtctgtattgctactacttcacttatccagctcattttctgaaatacacttgaatgaatgcttgtgat

SEQ ID NO: 1835 - DNA, 1932 bp, Panicum virgatum
ttagcgggcgacgtggcacgatggtttcgcccggtttggtgcaagaatcgtatttagagattcctacactccgtccggcctgtcgatctccagctgtcctccaattaatcaaacaccattttccccctcccacaactcaacaaatcgccacccaaatccaccacctccctccccgtccccctccgccatggcttccccaccaacccctcgccgcctcgccgtcctcctcctcggcgtcctctgctccgccgccgccgtcgccgccgcgcggtacgccccggtggacaaccacctcctcgcgtgcggcgcggaggccccggccgtcctccccgacggccgccgcttcgtcccggactccggctgcgcctccacccgcctccgctcacccgccccgaccctctcctacgccgcgcccccaggctccccgccgccgccttcccctctccacgcctccgcgcgggtcttctcctgccgcgcgtcctacgacctcgccgtccgccgccgcgggcaccacatcctgcgcctccacttctaccccttcgcccccgccctctccgcctcccgcttccacgtgggcgccgggggtttgctcctcctccacaacttcaccgcctcgtcccccgtcgtgaaggagttcatcctccccgtggattccgacatcatcgtcctcaccttcgtccctgactcggcctccaccgccttcatcaacgccatcgagctcgtttctgcgcccgaggagatcgtaggcgacattggcaccctcgtcacatccgccggcgccgctcagatcgacgggctttcgtctcaggtgtttgagactctctacaggatcactgtcgccggtcgtaaggtcacgccgttcaatgacacgctgtggcggacatgggttaatgatgcggacttcctcgttggcacggactcgaccaactacaaggtatggtcgttcagtggccggatcgcttatcccaggggtagcaggcagatgacccgggaggtggctcctgacaatgtctacagctctgcgagatcagtgaagccaggggccaatgtgacttggggtttccctgtgcctgctggcagccggtacctcgtgcgtatgcacttctgtgacattgttagcaaggcgttgtatgagctctacttcaatatctacgtcaatggcaatcttgcagtcaagaatttcgatctctctagcaccaccggattcttggcctatccttattacattgactttattgttgacgtggagggtgaggggatgctgaaattggccatcggtggcttgaagcagagccgatctgatgaagtaagcggtatccttaatgcgctggagattatgaggatgaacaagacgagtggcggtatggatggaaacttcccaattgcgctagacgtggagtatggggtgagtaaggggatcggggaattcgccctctccctgctgtgtggtttcatctttgctgggttatttgtgactttggtcatgctggtgctgaggttgaggaccgagctgaggaacaatggtacagcttggtcttggaaaccaatggactccggtgaagggaaattggctaaagcatatcagcttgtgcccagtaaggcagactattgaatgatatgagcttagcatctttgaggagcggcaaactacagctgttgtatgtatctaatctcgtaatatttctattcggttgtaagtattgtagttgtagttttacttctttttactcctttcatgcttgaactttgggctgtctgagctctgccaatggaggacatgctcactatattgtaaaagtattttaccgcagatcagtctgtattgctactacttcacttatccagctcattttctgaaatacacttgaatgaatgcttgtgatatccatagcaaatttgctgtcgtggattcacgatggtgtagtctaatac

SEQ ID NO: 1836 - DNA, 1846 bp, Setaria italica
aattgattcctccactccggcctgcacatctccagctgtccttcaattaatcaacaccatttccccctcccccaactcaacaaatcgccgcccaaatccaccacctccccgtccccgccgccatggttcccccaccaacccctcgccgcatcgccgtgctcctcctcggcttcctttgctccgccgccgccgtcgccgccgcgcggtacgccccggcggacaaccacctcctcgcgtgcggcgcggaggccccggccctcctccccgacggccgccgcttcgtcccggactccggctgcgcttccacccgcctccgctcccccgccgcgaccctcgcctccgccgctccgcccggctccccgccgccgccttcccctctccatgcctccgcgcgggtcttctcctgccgcgcttcctacgacctcgccgtccgccgccgcgggcaccacatcctccgcctccacttctaccccttcggccccgccctctccgtgtctcgcttccacgtcggtgccggggggttactcctcctccacaacttcacggcctcgtcccccgtcgtgaaggagttcgtcctccccgtggacaccgacatcctcgtcctcaccttcgtccccgagtctgactcgaccgccttcatcaacgccatcgagctcgtctctgcgcccgaggagctcgtcggcgacattggcaccctcgtgacatccggtggcgccgctcagatcgacgggttgtcgtctcaggtgtttgaaactctttataggatcaccgtcgccggccgtaaggtcacgccgttcaatgacacactgtggcggacatgggttaacgatgggaaattcctcgtcaacaccgactctaccaactacaaggtatggtcgttcagtggccggattgcttatcccaagggtagcaggcagatgacccgggaactggctcccgacaatgtctacagctctgcgagatcagtgaggccaggggccaatttgacctgggtttttcccgtgcctgctggcagccggtacctggtgcgcatgcacttctgtgacattgttagcaaggcgctgtatcagctctacttcaatatctacgtcaatggcaatcttgcagtcaaggatttcgatctctccagcaccaccggattcttggcctatccttattacattgactttattgtcgacgtggaggatgaggggatgctgaaattggccatcggtggcttgaagcaaagccggtctgatgaagtaagcggtatccttaatgcgctggagataatgaggatgaacaagacaagtggcggtatggatgggaacttcccaattgcgctggacacggagtatggggtgagtaaggggattggggaattcgcccgctccctgctttgtggtttcatctttgctgggttgtttgtggctttggtcatgctggtgctgaggttgaggaccgagctgaggaataatagtacagcttggtcttggaaaccaatggactccggtgaagggaaattggctaaagcatatcagcttgtgcccagtaaaacagattattgaatggtatgagcttagcatctttgaggagtggcaaactacagctgctgtatgtatctaatcgcgtaatacttctatttcagttgtaagtattgtagttttagttttacttcttcttttttaactctttcatgcttgaactttgggttatctgttgctctgctaatggaggacatgctcactgtattgtaaaagtattttacctcaaatgtgtctgtattgctaccacctcacttgttcagttcatttcctgaaatatgtttgaatggatgcttgtgatacccattgtaaatttgctgttg

SEQ ID NO: 1837 - DNA, 2118 bp, Zea mays
tacgggactggacccctagaacaaccaccacactctcctccctccctccccgcccacactccaccacccgcgccccgccgcccgccccgccgccgcctcctacttcgcctcggccgcctcggatccggaccgagcgccggccatggcgctcgccttcgacgagttcgggcgccccttcatcatcctgcgggagcaggagaagaagacgcgcctgcgggggctcgacgcgcagaaggccaacatcggcgcgggcaaggccgtcgcgcggatcctccgcacctcgctcggccccaagggcgcggacaagatgctccagtcccccgacggcgacgtcatcatcacaaatgatggggcgaccatcctggagcagatggatgttgacaaccagatcgcaaagctgatggtggagctgtcccgtagtcaagactacgaaatcggggatggtaccaccggtgtggtagtcatggcaggggcgctccttgagcaggccgagaagcttttagaacgtggtattcaccccattagggttgctgaaggctatgagatggcatcaaaggtagcttttgatcacctagaacgaatctccgaaaagtttgagttcagtgcagacaacattgagcccctggttcagacatgcatgacaactctatcctcaaagattgttaaccgttgcaagcgggcattggcagagattgctgtcaaagcagtacttgcggttgcagatttggagaggaaggatgttaacttggatttaattaaagtagaaggcaaggttggtgggaagctggaggacaccgagcttgtatatggaattattgttgacaaagatatgagccatccacaaatgccaaagagaattgaggatgctaagattgccatcctgacatgcccatttgagccaccgaagcctaagaccaagcataaggttgacattgatactgtcgagaaattccagacactgcgtgagcaagagcagaaatacttcgatgaaatggttcagaagtgcaaagatgctggtgcaaccctggttatttgtcagtggggttttgatgatgaagccaatcatttgttgatgcatagaaatctgccagctgtcagatgggttggtggtgttgaattggaattgattgccattgcaacaggaggacgaattgttccgagattccaagagttgagtcctgaaaagcttgggaaggctggattagtcagagagaaatcattcggaacaacaaaggataggatgctttacattgagcagtgtgccaattccagagctgtaactatcttcattcgtggtggaaataaaatgatgattgaggagaccaagcgcagtcttcatgatgctctttgtgtggcaaggaatctgatccggaacaactcaatcgtgtacggcggtggctcagcagagatatcttgctcaattgctgttgaaactgctgcagatcggcaccctggagttgagcagtacgctatcaggtcattcgctgatgcattagacgctgttccactggccttggctgaaaacagtggtttgtcgccaattgataccttgacggcggtaaaagctcagcaagttaaggagagcaacccccactgcggcatagactgcaacgatgtaggcaccaacgacatgaaagagcagaacgtctttgagaccctgattggcaagcagcagcagatcctgctggccactcaggtggtgaagatgatcctgaagatcgacgacgtcatctcaccgtccgagtactgatgaagcctgaaggaaggaggaaaaaaaaagagaggaacaggtggctatgctggatgagagtttagtaggcagcattgctgatgtgttgattggtttactccttgttcaggcgtgctccttgtatcttatgagctgcctagcacctttttgtgtgaggggttgtttgtattgcacgatattgcatcgaggaatacgtatgtacgtgttgtcaagaccctaggcaattctcttcagggctgtgagatggttggggtactgataccttttttttgtattgttttcatttcaccacttagctgaagctgtcctttttgttttatgaatgctgcaatagtttggcgccctcactctgtttggtctgaacaagg

SEQ ID NO: 1838 - DNA, 1963 bp, Zea mays
actggactactggagccctataggctatagccaccaccgcactcgcctccctctctccctcccacactccaccacccgcgccgccgcctcctactccgccccggcccctctgatccggaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgaccacctagaacatatatccgaaaagtttgagttcagtgcagacaacattgaacccctggtccagacctgcatgacaactctatcctcaaagattgttaaccgttgcaagcgggcgttggcagagattgctgtcaaagcagtacttgcggttgcagatttggagaggaaggatgttaacttggatctaattaaagtagaaggcaaggttggtgggaagctggaggacactgaacttgtatatggaattattgttgacaaagatatgagccatccacaaatgccaaagagaattgaggatgctaagattgccatcttgacatgcccatttgagcctccgaagccaaagacaaagcataaggttgacattgacactgtcgagaaattccagacactgcgtgagcaagagcagaaatactttgatgaaatggttcagaagtgcaaggatgctggtgcaaccctggttatttgccagtggggttttgatgatgaagccaatcatttattgatgcatagaaatctgccagcagtgagatgggttggtggtgttgaattggaactgattgccattgctacaggagggcggattgttccgagattccaagagttgagtcctgaaaagcttggaaaggctggattagtcagagagaaatcattcggaacaacaaaggaccggatgctttacattgagaagtgtgccaattctagagctgtaaccattttcatccgtgggggaaacaaaatgatgattgaggagaccaagcgcagtcttcatgatgctctttgcgtagcaaggaatctgatccggaataactcgattgtgtacggtggcggctcagccgagatatcttgctcaattgctgttgaaactgctgcagatcggcacccgggagttgagcagtatgctatcaggtcattcgctgatgcattagatgctgttccactagcgttggccgaaaacagtggtttgtcaccaattgataccttaactgcggtaaaagctcaacaagtcaaggagagcaacccccactgtggcatagactgcaacgacgttggcaccaccgacatgaaagaacagaacgtcttcgagaccctgattggcaagcagcaacagatcttgcttgccacccaggtggtgaagatgatcctgaagatcgacgatgtcatctcaccgtccgagtactgacggaaagaaggaacggatggctatgctggatatgcgtaggcggcattgctgatgtgttttgattggtgtacctccttgtccaggcttgctgcctaccactcactccctgtgtgacgttttgctgaaattggtttgtactgtgcacgataatatctggaaatagactctagacagtccttagttatctttttattatataaaaaaagtcagcgccttctcgtta

SEQ ID NO: 1839 - DNA, 2045 bp, Panicum virgatum
cgctgatccgggcccttctgggagcgcgcgctccgcgcgagcggcggccatggcgctcgccttcgacgagttcgggcggcccttcatcatcctcagggagcaggagaagaagacgcgcctgcgcgggctcgacgcgcagaaggccaacatcgcctcgggcaaggccgtctcgcggatcctgcgcacctcgctcgggcccaagggcatggacaagatgctccagtcccccgacggcgacgtcaccatcacaaatgatggtgcgacaatcctggagcagatggatgttgacaaccagattgcgaagctgatggtggagctgtcccgcagtcaagactacgaaatcggggatggtaccactggggtggtggtcatggcaggggctctcctagagcaggctgaaaaacttctggaacgtggtattcacccgataagggtcgctgaaggttatgagatggcgtcaaggatagcttttgatcaccttgagcgcatctcccaaaagtttgagttcagtgcggacaatatagaacccctggttcagacctgcatgacgacactgtcatcaaagattgttaaccgttgcaagcgagcactggcagagattgctgtcaaagcagttcttgcggttgctgatttggagaggaaagatgttaacttggatttaattaaagtagaaggcaaggttggtggaaagctggaggacacggagctcatatacggaattgttgtcgacaaagatatgagtcacccgcaaatgccaaagagaattgaggatgctaagatagccatcctgacttgcccatttgagccaccgaagcctaaaacaaagcataaggttgacattgacactgtagagaaattccagaccctgcgcgagcaagagcagaagtacttcgatgaaatggttcaaaaatgcaaggatgttggcgcgaccctggttatatgtcaatggggttttgatgatgaagccaatcatcttttgatgcacagaaatctgccagctgtcagatgggttggtggtgttgaattggaattgattgccattgctacaggaggccggattgttccgagattccaagagctgagtcctgaaaagctcgggaaggctggattagtcagagagaagtcatttggaacaaccaaggaccggatgctttacattgagcagtgtgccaattccagagctgtaactattttcattcgtggtggaaacaaaatgatgattgaggagaccaagcgcagtcttcatgatgctctttgtgtggcaaggaatcttatccgcaataactcaatcgtgtatggtggaggctcagcagagatatcttgctcgattgctgttgaaactgctgcggatcgacaccctggagttgagcagtatgctatcagatcatttgctgatgcattagatgctgttccactagctttagcggaaaatagtggtttgccgcctattgatacgttaactgcagtgaaagcacaacaagttaaggagagcaacccccactgcggcatagactgcaatgatgttggcacgaacgacatgaaggagcagaatgtctttgagactctgattggcaagcagcagcaaatcttgcttgccacacaggtggtgaagatgatcctcaagatcgatgacgtgatctcgccatccgagtactgatgaagtaagcctaagaaagaaggggagcagtaggctgatgtgctgatcttcattgagcttatttttgagaagtcttgctggatacgagagggccataagttgcaggacatcaagactaaggacatgcttcatgttgagaggattgccagtatgtggtctgtgccaagaggggttgttaggcgagtcgttttgtgcagggtgcaggcggagctgcactgcaagtgccaccgaccaaaagaaccattccccatgctgtacgggtcattttcagtttatgctgtttcatcgagcttattccagacccaaattaaaaatctgtaagaatttattgaggttatcagaaattgatggttatgttatggtaaatttaacgggttgttgctatacc

SEQ ID NO: 1840 - DNA, 2524 bp, Panicum virgatum
gcaggtaaattttttgaggaaaagggcaggtaaattctaccatggaggggggaaaaaggccaggcgatcgccgccgaggagggcttgactttacggtggccgctcgtccgaggccgccgccgccggccggagcgagggagaccggagaggcggccgcggggagcggcgggagggtttaacggttgctgcatgcttgccgcagccacgcgcggatggccgcgtgtgggctgggccggctctgttgggcttttgggccttctctgttgggctcgaaatggtaaatgggccagcccaaccactagcgaggaagagggttttggaggaagaagaagcggaaccctcgccccgcgccgcctagaaacaccgccacgccccgccgctccctccccgtccccgccgccgcactccaccccgctccgccgtccgatccgctcgctgatccgggcccttctgggagcgcgcgctccgcgcgagcggcggccatggcgctcgccttcgacgagttcgggcggcccttcatcatcctcagggagcaggagaagaagacgcgcctgcgcgggctcgacgcgcagaaggccaacaacgcctcaggcaaggccgtctcgcggatcctgcgcacctcgctcgggcccaagggcatggacaagatgctccagtcccccgacggcgacgtcaccatcacaaatgatggtgcgacaatcctggagcagatggatgttgacaaccagattgcgaagctgatggtggagctgtcccgcagtcaagactacgaaatcggggacggtaccactggggtggtggtcatggcaggggctctcctagagcaggctgaaaaacttctggaacgtggtattcacccgataagggtcgctgaaggttatgagatggcgtcaaggatagcttttgatcaccttgagcgcatctcccaaaagtttgagttcagtgcggacaatatagaacccctggttcagacctgcatgacgacactgtcatcaaagattgttaaccgttgcaagcgagcactggcagagattgctgtcaaagcagttcttgcggttgctgatttggagaggaaagatgttaacttggatttaattaaagtagaaggcaaggttggtggaaagctggaggacacggagctcatatacggaattgttgtcgacaaagatatgagtcacccgcaaatgccaaagagaattgaggatgctaagatagccatcctgacttgcccatttgagccaccgaagcctaaaacaaagcataaggttgacattgacactgtagagaaattccagaccctgcgcgagcaagagcagaagtacttcgatgaaatggttcaaaaatgcaaggatgttggcgcgaccctggttatatgtcaatggggttttgatgatgaagccaatcatcttttgatgcacagaaatctgccagctgtcagatgggttggtggtgttgaattggaattgattgccattgctacaggaggccggattgttccgagattccaagagctgagtcctgaaaagctcgggaaggctggattagtcagagagaagtcatttggaacaaccaaggaccggatgctttacattgagcagtgtgccaattccagagctgtaactattttcattcgtggtggaaacaaaatgatgattgaggagaccaagcgcagtcttcatgatgctctttgtgtggcaaggaatcttatccgcaataactcaatcgtgtatggtggaggctcagcagagatatcttgctcgattgctgttgaaactgctgcggatcgacaccctggagttgagcagtatgctatcagatcatttgctgatgcattagatgctgttccactagctttagcggaaaatagtggtttgccgcctattgatacgttaactgcagtgaaagcacaacaagttaaggagagcaacccccactgcggcatagactgcaatgatgttggcacgaacgacatgaaggagcagaatgtctttgagactctgattggcaagcagcagcaaatcttgcttgccacacaggtggtgaagatgatcctcaagatcgatgacgtgatctcgccatccgagtactgatgaagtaagcctaagaaagaaggggagcagtaggctgatgtgctgatcttcattgagcctatttttgagaagtcttgctggatacgagagggccataagttgcaggacatcaagactaaggacatgcttcatgttgagaggattgccagtatgtggtctgtgccaagaggggttgttaggcgagtcgttttgtgcagggtgcaggcggagctgcactgcaagtgccaccgaccaaaagaaccattccccatgctgtacgggtcattttcagtttatgctgtttcatcgagcttattccagacccaaattaaaaatctgtaagaatttattgaggttatcagaaattgatggttatgttatggtaaatttaacgggttgttgctataccatcaatattgtcatcatgtgacgaaatgcgaacacaggttcttcgg

SEQ ID NO: 1841 - DNA, 2221 bp, Cenchrus ciliaris
  misc_feature (1328)..(1328): n is a, c, g, or t
  misc_feature (1526)..(1526): n is a, c, g, or t
  misc_feature (1737)..(1737): n is a, c, g, or t
  misc_feature (1745)..(1746): n is a, c, g, or t
  misc_feature (1751)..(1751): n is a, c, g, or t
  misc_feature (1755)..(1755): n is a, c, g, or t
  misc_feature (1806)..(1806): n is a, c, g, or t
  misc_feature (1861)..(1861): n is a, c, g, or t
  misc_feature (1872)..(1872): n is a, c, g, or t
  misc_feature (1878)..(1878): n is a, c, g, or t
  misc_feature (1899)..(1899): n is a, c, g, or t
  misc_feature (1905)..(1905): n is a, c, g, or t
  misc_feature (1921)..(1921): n is a, c, g, or t
  misc_feature (1935)..(1935): n is a, c, g, or t
  misc_feature (2169)..(2169): n is a, c, g, or t
  misc_feature (2171)..(2171): n is a, c, g, or t
  misc_feature (2179)..(2179): n is a, c, g, or t
  misc_feature (2191)..(2191): n is a, c, g, or t
ctcgcccgcgccgtctagaaacaccgccactctccgctccccgtcctccgcactctcacctcgcgccgccgccgcccgtccgatccgggctcttccagcagggcgcgctccgcgccaagcgagcggccatggcgctcgccttcgacgagttcgggcgccccttcatcatcctcagggagcaggagaagaagacgcgcctgcgcggcctcgacgcgcagaaggccaacatcgcctccggcaaggccgtagcgcggatcctccgcacctcgctcgggcccaagggcatggacaagatgctccagtcccccgacggcgacgtcaccatcacaaatgatggggccacgatcctggagcagatggatgttgacaaccagattgctaagctgatggtggagctttcccgcagtcaagactatgaaatcggagatggtaccacgggggtggtcgtcatggcaggggctctcttagagcaggctgagaaacttctggaacgtggcattcacccaataagggttgccgaaggttatgagatggcatcaaggatagcttttgatcaccttgagcgcatctcccagaagtttgagttcagtgcagacaatatagaacccctggttcagacctgcatgactacgctgtcatcaaagatagttaaccgctgcaagcgggcactggcagagattgctgtcaaagcagtccttgcagttgctgatttggagaggaaagatgttaacttggatttaattaaagtagaaggcaaggttggtgaaaagctggaggacacggagctcatatatggaattgttgttgacaaagatatgagtcacccacaaatgccaaagagaattgaggatgctaagatagccatccttacttgcccatttgaacccccgaagcctaagacaaagcataaggttgacattgacactgtagagaaattccagaccctgcgcgagcaagagcagaagtactttgatgaaatggttcagaaatgcaaggatgccggtgcgaccctggttatctgtcagtggggtttcgatgatgaagcaaatcatctcttgatgaacagaaatctgccagctgtcagatgggttggtggtgttgaattggaattgattgccatcgctacaggaggccggattgttccgaggttccaagagctgagtcctgaaaagcttgggaaggctggattagtcagagagaagtcatttggaacaaccaaggacaggatgctttacattgagcagtgtgccaattccagagctgtaactattttcattcgtggtggaaacaagatgatgatcgaggagaccaagcgcagtcttcatgangctctttgtgtggcaaggaatcttatccgcaataactcaatcgtgtatggtggtggctcagcagagatatcttgctcgattgctgttgaaactgctgcagatcgacaccctggagttgagcagtatgctatcaggtcatttgctgatgcattagacgctgttccactagccttagcggaaaatagtggtttgccaccnattgatacgttaactgcggtgaaagctcaacaagtcaaggagagcaacgcccactgcggcatagactgcaatgatgttggcaccaacgacatgaaggagcaaaacgtctttgagactctgattggcaagcagcagcagatcttgcttgccacgcaggtggtgaagatgatcctcaagatcgacgacgtgatctcgccgtccgagtactgangaaggaannctganaagnggcagtcgtgcttggtgacaatctatcagtaggcagtattgctgatgtgcngacacatggtgcttattttttggggaagtctagttggatacaagagggagacaanttgtgggacgncaaagncacatgcttcatgttgagacnggttgncagtccgtgttctgcntcagaggcagaggngttgtgaggcgaatcaggtttgtgtgtagggtgcaggcagggcctcactgtggtgctgccgtcgaaaagaaccattccacatgctgtacgggtcgttttcaatttatgctggttttcattgagcttattccagacccaagtcggtctcgaaattctggtaggaatttatttaaagaacactagtcagaaaacggtgttttttttttgtttgacgatattacaaccgtctcttcntngtattgcnaaattgccaacncagcttttcaatgtggttgttgcaatacca

SEQ ID NO: 1842 - DNA, 2141 bp, Sorghum bicolor
cttggcctcgcgccgtcatcgagtagtaggttctcgaaacaccgccacactccgcctctcttcgaccgctccacgcgagcacctcggctcctgcctgcatccgcgccgccgcttcccttgctcgcctccgccttctggagcgagcggcaccgcgctagcggcagccatggcgctcgccttcgacgagttcgggcgccccttcatcatactcagggagcaggagaagaagacgcgcctgcgcgggctcgacgcgcagaaggccaacatcgccgccggcaaggccgtggcgcggatcctccgcacctcgctcggacccaagggcatggacaagatgctccagtcccccgacggagacgtcaccatcacaaatgatggggccacgattctggagcagatggatgttgacaaccagattgcaaagctgatggtggagctgtcccgcagtcaagactatgagatcggggatggtaccactggggtggtggtcatggcaggggcacttctagagcaggctgagaaacttctggagcgtggtattcacccgatacgggttgccgaaggttatgagatggcttcaagggtagcttttgatcaccttgagcgcatctcccaaaagtttgaattcaatgcagacaatatagagccactggttcagacctgcatgacgactctgtcgtcaaagattgttcaccgttgcaagcgggcactcgcagagattgctgtcaaagcagtccttgcggttgctgatttgggcaggaaggatgttaacttggatttaatcaaagtagaaggcaaggtcggtgggaagctggaggacacagaactaatatatggaattgtcgttgacaaagatatgagccaccctcaaatgccaaagagaattgaggatgctaagatagccatcctgacctgcccatttgagcccccgaaacctaagacaaagcataaggttgacattgatactgtagagaaattccagactctgcgtgagcaagagcagaagtactttgatgaaatggttcagaaatgcaaggatgttggtgcaaccctggttatttgtcaatggggttttgatgatgaagccaatcatctattgatgcatagaaatctgccagctgtcagatgggttggtggtgttgaattggaattgattgccatcgctacaggaggacggattgttccaagatttcaagagctgagtccagaaaagcttgggaaggctggattagtcagagagaagtcatttggaacaaccaaggaccggatgctttacattgagcagtgtgccaactccagagctgtaactattttcattcgtggtggaaataaaatgatgattgaggagaccaagcgcagtcttcatgatgctctttgtgtggcaaggaatctaatccgcaataactcaattgtgtatggtggtggctcggcagagatatcttgctcaattgctgttgaaactgcagcagatcggcaccctggagttgagcagtatgctatcaggtcatttgctgatgcattggacgctgttccactggccttagctgagaacagtggtttgcctcctattgataccttaactgtggtgaaagctcaacaagtgaaggatagcaacccccattgtggcatagattgcaatgacgttggcaccaatgacatgaaagagcagaacgtctttgagaccctgattggcaagcagcaacagatcttacttgccacgcaggtggtgaagatgatcctcaagattgacgacgtgatctcgccatctgagtactgatgaagcctgggaaagaatagacagctgtgcttggtgacaattaggcgtcagagactcagaggggctggtggcttcgatttgtgaacggcgccgtggtttaaaaggcaaaaaccattccatatgctgtgcggttaatttgccgtgccaatgatggtacctaaagaagttagctgctgcagctgcgcgcacactcttagcacttagcagagcactatacagattcaatgatgcgctagctacctttgttgagtaaattctaatgtcactaaaatttataaggctttctttaatgtcttgaaaattgttcattttccacgaataccattatgtgaattttgtgattcttgctgtcgtttcatcgtgtacc

SEQ ID NO: 1843 - DNA, 2204 bp, Setaria italica
gctccgcgccgtctagaaagtagaagcaccgccacactccgctgctccctccccgtcccccgcactccaccacacgccgccgccgcccgtccgatccgcgggatcttccaggagagcgcgctccgcgccaagcggcggccatggcgctcgccttcgacgagttcgggcgccccttcatcatcctcagggagcaggagaagaagacgcgcctgcgcggcctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggggcgacaatcctggagcagatggatgttgacaaccagattgcgaagctgatggtggagctttcccgcagtcaagactatgaaatcggagatgggaccactggggtcgttgtcatggcaggggctctcttagagcaggctgagaaacttctggaacgtggtattcacccaataagggttgctgaaggttatgagatggcatcaaggatagcttttgatcaccttgagcacatctcccgaaagtttgagttcagtgcagacaatatagagcccctggttcagacatgcatgactacgctgtcgtcaaagattgttaaccgctgcaagcgggcactggcagagattgctgtcaaagcagtccttgcggttgctgatttggagaggaaagatgttaacttggatttgattaaagtagaaggcaaggttggtggaaagctggaggacacggagctcatacatggaattgttgtcgacaaagatatgagtcacccacaaatgccaaagagaattgaggatgctaagatagccatccttacttgcccatttgagcccccgaagcctaagacaaagcataaggttgacattgacactgtagagaaattccagaccctgcgcgagcaagagcagaagtactttgatgaaatggttcagaagtgcaaggatgctggtgcgaccctggttatttgtcagtggggttttgatgatgaagccaatcatctcttgatgcacagaaatttgccagctgtcagatgggttggtggtgttgaattggaattgattgccattgctacaggaggccggattgttccgagattccaagagctgagtcctgaaaagcttgggaaggctggattagtcagagagaagtcatttggaacaaccaaggaccggatgctttacattgagcagtgtgccaattctagagctgtaactattttcattcgtggtggaaacaagatgatgattgaggagactaagcgcagccttcatgatgctctttgtgtggcaaggaatcttatccgcaataattcaatcgtgtatggtggtggctcagcagagatatcttgctcgattgctgttgaaactgctgcagatcgacaccctggagttgagcagtatgctatcaggtcatttgctgatgcattagatgctgttccactagccttagctgaaaatagtggtttgccgcctattgatacattaactgtggtgaaagctcagcaagttaaggagagcaacccccactgcggcatagactgcaatgacgttggcaccaacgacatgaaggagcaggacgtctttgagactctgattggcaagcagcagcagatcttgcttgccacgcaggtggtgaagatgatcctcaagatcgatgatgtgatctcgccgtccgagtactgatgaaacctgagaaggggcagttgtgcttggtgacaatctatcagtaggcagcatttctgatgtgctgacaccttcatggtgcttatttttgagaagtctagttggatacaagaggggcacaagttgtgggacgtcaaagacacatgcttcatgttgagacggttgccagtccgtgttctgcgccagaggggttgtgaggcgagtcaggtttgtgtagggtgccggcagagccgcactgcggtgctgctgtccaaaagaaccattccacatgctgtaagggtcattttcaattcatgctgattttcatgagcttattccagacccaaatcagcctcaaaatcttgtaggaatttgttaaagttactagtcagaaatgatggttttgttttggtaaatttatcgtttgttggcttgttgcaataccatcatttttgttatgacgatattacaagtgtc

SEQ ID NO: 1844 - DNA, 2037 bp, Panicum virgatum
gagaattcccccacctctagaaactccacctcactcggctcggctcctccttccccgcccgcactccgccgcctcccctcccccccccgccgccgcccctccgatccaccgggcgccggccatggcgctcgccttcgacgagttcgggcgccccttcatcatcctccgggagcaggagaagaagacgcgcctgcgcggcctcgacgcgcagaaggccaacatcgccgccggcaaggccgtcgcgcggatcctccgcacctcgctcggacccaagggcatggacaagatgctccagtcccccgacggcgacgtcaccataacaaatgatggggcaaccatcctggagcagatggatgttgacaaccagattgcaaagctgatggtggagctgtcccgcagtcaagactatgaaatcggggatggtaccactggggttgttgtcatggcgggggctctcctggagcaggctgagaagcttctggaacgcggtattcacccaattagggtggctgaaggctatgagatggcgtcaaggatagcttttgaacacctagagcgcatctcccagaagtttgagttcagtgcagacaatatcgagccactggttcagacctgcatgacaactctatcgtccaagtttgttaaccgttgcaagcgggcactagcagagattgctgtgaaagcagtccttgcggttgctgatttggagaggaaggatgttaacttggatttaattaaagtagaaggcaaggttggtggtaagctggaggacactgaactcatatatggagttgttgttgacaaagatatgagccacccgcaaatgccgaagagaattgaggatgctaagattgccatcctgacgtgcccattcgagcccccgaagccgaagacaaagcataaggttgacattgacactgtagagaaattccagacgctgcgcgagcaagagcagaaatactttgatgaaatggttcagaagtgcaaggatgttggtgcgaccctggttatttgtcaatggggtttcgatgatgaagccaatcatttgttgatgcacagaaatctgccagctgtcagatgggttggtggtgttgaattggagttgattgccattgctacaggaggacggattgttccgagattccaagagttgagtctggaaaagcttggaaaggctggattagtccgagagaagtcctttggaactacaaaggaccggatgctttacattgagcagtgtgccaattccagagctgtaactattttcattcgtggtggaaacaaaatgatgattgaggagaccaagcgcagtcttcatgatgctctttgtgtggcaaggaatttgatccgcaataactcaattgtgtatggtggcggttcagcagagatatcttgttcaattgctgttgaaactgctgcagatcggcatcctggagttgagcagtatgctatcaggtcatttgctgatgcattagatgctgttccactagccttggctgaaaatagtggtttgccaccaattgataccttaactgcagtgaaagctcagcaagttaaggagagcaacccccactgcgggatagactgcaacgacgtcggcaccaacgacatgaaggaacagaacgtgtttgagactctgatcggcaagcagcaacagatgctgctcgccacccaggtggtgaagatgatactcaagattgatgatgtcatctcaccgtccgagtactgatgaaccctcggaaggagccggacggctgtggcgctgtgctggcctgctgggtggcagataggcagtcagtttattaggctgcactggtgtctgctggggtggtggttggtgtactctgtcctggcttgcccaggctgcttgttgtgtacaatgagctagctgcctacctggttttgtgtgatgcttgccgaaattttgtttgtattgcacgttagcaccaaggatacctttgaaatcagtctagacgcttgatttagaagtcttctgtgctgttttctctctctaaagatggttgcctactctgttac

SEQ ID NO: 1845 - DNA, 2139 bp, Setaria italica
acaagcaccacagcactcggcttctcccctccctccccgcccgcactccacccgcgccgccgcctccccctccgatccgggcgccggccatggcgctcgccttcgatgagttcgggcgccccttcatcatcctccgggagcaggagcagaagacgcgcctgcgcggcctcgacgcgcagaaggccaacatagccgccggcaaggccgtcgcgcggatcctccgcacctcgctcggacccaagggcatggacaagatgctccagtcccccgacggcgacgtcaccatcacgaatgatggggcgacgatcctggagcagatggatgttgacaaccagattgccaagctgatggtggagctgtcacgcagccaggactatgaaatcggggatggtaccacgggggttgtcgtcatggcaggggctctcctggagcaggctgagaagcttctggagcgtggtattcacccaattagggttgctgaaggctatgagatggcgtcaaggatagcgtctgagcacctagagcgcatctcccataagtatgagttcactgccgacaacattgagccactggttcagacctgcatgacaactctatcgtcaaagattgttaaccgttgcaagcgggcactggcagagattgctgtcaaagcagtccttgcggttgctgatttggagaggaaggatgttaacttagatttaattaaagtagaaggcaaggttggtgggaagctggaggacactgagcttatatatggaattgttgttgacaaagatatgagccacccacaaatgccaaagagaattgaggatgctaagattgccatcctaacatgcccattcgagcccccgaagcctaagacaaagcataaggttgacattgacactgtagagaaattccagacgctgcgtgaacaagagcagaaatactttgacgaaatggttcagaagtgcaaggatgctggcgcgaccctggttatttgtcaatggggcttcgatgatgaagccaatcatttgttgatgaacagaaatctgccagctgtgagatgggttggtggtgttgaattggaattgattgccattgctacaggaggacggattgttccgagattcgaggagttgagtcctgaaaagcttgggaaggctggattagtcagagagaagtccttcggaacaacgaaggaccggatgctttacattgagcagtgtgccaattccagagctgtaactattttcattcgtggtggaaacaaaatgatgattgaggagaccaagcgcagtcttcatgatgctctctgtgtggcaaggaatctaatccgcaataactcaattgtgtatggtggcggctcagcagagatatcttgttcaattgctgttgaaaccgctgcagatcggcaccctggagttgagcagtatgctatcaggtcgtttgctgatgcattagatgctgttccactagccttggctgaaaacagtggtttgccaccaattgacactttaactgcagtaaaagctcaacaagtaaaggagagcaatccccactgcggcatcgactgcaatgacgttggcacgaacgacatgaaagaacagaacgtcttcgagacactgatcggcaagcagcagcagatcctacttgccactcaggtggtgaagatgatcctcaagattgacgacgtcatctcaccatccgaatactgatgaacctgagcggcgacgggcagctatgcttgatggcagttcagtctattaggcaggcattgctggggtggtggtgatttgctggggtccgcttgttgcattcgatgagctgcctacctgtttttgtgtgatgcttgcgagattgtttgtattgcatgataggaccgaaggatacgcttgctattagcctacctcttcagatgtttgcagtattgtttctttgttacagttttcacggcttttgttgaagccttgtccatttcagatccttcggaaactgtctcttctggacgggcgttacaatccaaaagcgcgccactatgtctaaggctaccctggctggaccctaagccaggtcggtccaacactacatggaaccctaaacataagcacgaggcagattccagtgctgacagtctaaataaaaccaattgccaatggt

SEQ ID NO: 1846 - DNA, 1983 bp, Pennisetum glaucum
cgacaacccacaacactcggctcctccttcccccctccctccctctccacccgcgccgcctcgcgccgccgcccgttcgatccgggtgcttccaggagcgcgcgcgcgcgccccgcgccaagcgagcggccatggcgctcgccttcgacgagttcgggcgccccttcatcatcctccgggagcaggagaagaagacgcgcctccgcggcctcgacgcgcagaaggccaacatcgccgccggcaaggccgtcgcgcggatcctccgcacctcgctcgggcccaagggcatggacaagatgctccagtcccccgacggcgacgtcaccatcacgaatgatggggcgacgatcctggagcagatggatgttgacaaccagattgccaagctgatggtggagctgtcacgcagccaggactatgaaatcggagatggtaccactggggtggttgttatggcaggggctctcctggagcaggcagagaagcttctggaacgtggtattcacccgatcagggttgccgaaggctatgagatggcgtcaaggatagcgtttgagcacctagagcgcatctcccacaagtttgagttcactgccgacaacattgagccactggttcagacctgcatgacaactctatcgtcaaagattgttaaccgttgcaagcgggcattggcacagattgctgtcaaagcagtccttgcggttgccgatttggagaggaaggatgttaatttagatttaattaaagtagaaggcaaggttggcgggaagcttgaggacactgagcttatatatggaattgttgttgacaaagatatgagccacccacaaatgccaaagagaattgaggatgctaagattgccatcctgacgtgcccattcgagcccccgaagcctaagacaaagcataaggttgacattgacactgtagagaaattccagacgctgcgcgaacaagagcagaaatactttgatgaaatggttcagaaatgcaaggatgctggtgcaaccctggttatttgtcaatggggtttcgatgatgaagccaatcatttgttgatgaacagaaatctgccagctgttagatgggttggtggtgttgaattggaactgattgccattgctacaggaggacggattgttccgagatttcaagagttgactcctgaaaagcttgggaaggctggattagtcagggagaagtccttcggaacaacaaaggatcggatgctttacattgagcagtgtgccaattccagagctgtaactattttcattcgtggtggaaacaaaatgatgattgaggagaccaagcgcagtcttcatgatgctctttgtgtggcgagaaacttgatccgcaataactcaattgtgtatggtggtggctcagcagagatatcttgttcaattgctgttgaaaccgctgcagatcggcaccctggagttgagcagtatgctatcaggtcatttgctgatgcattagatgctgttccactagctttggctgaaaacagtggtttgccacccattgacaccttaactgcggtaaaagctcaacaagtaaaggagagcaatccccattacggcatagactgcaacgacgttggcaccaacaacatgaaagaacagaacgtctttgagacgctgatcggcaagcagcagcagatcttgcttgccacacaagtggtgaagatgatcctcaagatcgacgacgttatctcgccgtccgagtactgatgaaagccttgaaagggatggacctctgtctagtaggcggcatttgctgttgcgttgacgtgtgcactttttgttgtattcgatgagctgtgcctgcctgattttgtgtgatgctcgacgaaactgtttgtattgcacgatagcaccagggatacgtttggaattagtgtagacgctgtgtttttcttcacactattgttacattgtggtttttttacagctttccagcataaaggtaatgtcc

SEQ ID NO: 1847 - DNA, 2117 bp, Panicum virgatum
gaggaagaagaagcggaaccctcgccccgcgccgtctagaaacaccgccacactcccgccgccgcactccaccccgctccgccgccgccgtccgatccgctgatccgggcccttctgggagcgcgccctccgcgcgagcggcggccatggcgctcgccttcgacgagttcgggcggcccttcatcatcctcagggagcaggagaagaagacgcgcctgcgcgggctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggcgccacgatcctggagcagatggatgttgacaaccagattgcgaaactgatggtggagctgtcctgcagtcaagactatgaaatcggggatggtaccactggggtggtggtcatggcaggggctctcctagagcaggctgagaaacttctggaacgtggcattcacccattaagggttgctgaaggttatgagatggcatcaaggatagcttttgatcaccttgagcgtatctcccaaaagtttgagttcagtgcggacaatatagaacccctggttcagacctgcatgacgacactgtcatcaaagattgtaaaccgctgcaagcgggcactggcagagattgccgtcaaagctgtccttgcagttgctgatttggagaggaaggatgttaacttggatttaattaaagtagaaggcaaggttggtggaaagctggaggacacggagctcatatatggaattgttgtcgacaaagatatgagtcacccgcaaatgccaaagagaattgaggatgctaagatagctatcctgacttgcccatttgagcctccgaagcctaagacaaagcataaggttgacattgacactgtacagaaattccagaccctgcgcgatcaagagcagaagtacttcgatgaaatggttcaaaagtgtaaggatgttggtgcgacccttgttatatgtcaatggggttttgacgatgaagccaatcatcttttgatgcacagaaatctgccagctgtcagatgggttggtggtgttgaattagaattgattgccattgctacaggaggccggattgttccgagattccaagaactgagtcctgaaaagctcgggaaggctggattagtcagagagaagtcatttggaacaaccaaggaccggatgctttacattgagcagtgtgccaattccagagctgtaactattttcattcgtggtggaaacaaaatgatgattgaggagaccaagcgcagtcttcatgatgctctttgtgtggcaaggaatctaatccgcaataactcaatcgtgtatggtggaggctcagtggagatatcttgctcgattgctgttgaaactgctgctgatcgacaccctggagttgagcagtatgctatcagatcatttgctgatgcattagaggctgttccactagccttagcagaaaatagtggtctgccgcccattgatacgttaactgctgtgaaagcacaacaagttaaggagagcaacccccactgcggcatagactgcaatgatgttggcatgaatgacatgaaggagcagaatgtctttgagactctgattggcaagcagcagcagatcttgcttgccacgcaggtggtgaagatgattctcaagatcgacgacgtgatctcgccatccgagtactgatgaaggaagcctgagaaagaaggggagctgcgcttggtgacgatctaaagaatcattccacatgctatacggggtctcattttcaatttatgctgtttcatggggcttattccagaaccaaatcatcctaaaaatctgtaagaatttattgaggtcatcagaaactgatggttatgttgtggtaaatttgacggttgttgccataccatcaatattgttatgtgacgaaatgcgaacacctgttctccagatgatgtgaacccggacgatgttaccatgccatcactattgtttactacggttggctccaaagcatctgggttaatataagcaatcagcggaaagtaagactgtgtttaaatc

SEQ ID NO: 1848 - DNA, 2082 bp, Panicum virgatum
gagaaagaagaagcggaaccctcgccccgcgccgtctagaaacaccgccacactcccgccgccgcactccaccccgctccgccgccgccgtccgatccgctgatccgggcccttctgggagcgcgccctccgcgcgagcggcggccatggcgctcgccttcgacgagttcgggcggcccttcatcatcctcagggagcaggagaagaagacgcgcctgcgcgggctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggcgccacgatcctggagcagatggatgttgacaaccagattgcgaaactgatggtggagctgtcctgcagtcaagactatgaaatcggggatggtaccactggggtggtggtcatggcaggggctctcctagagcaggctgagaaacttctggaacgtggcattcacccattaagggttgctgaaggttatgagatggcatcaaggatagcttttgatcaccttgagcgtatctcccaaaagtttgagttcagtgcggacaatatagaacccctggttcagacctgcatgacgacactgtcatcaaagattgtaaaccgctgcaagcgggcactggcagagattgccgtcaaagctgtccttgcagttgctgatttggagaggaaggatgttaacttggatttaattaaagtagaaggcaaggttggtggaaagctggaggacacggagctcatatatggaattgttgtcgacaaagatatgagtcacccgcaaatgccaaagagaattgaggatgctaagatagctatcctgacttgcccatttgagcctccgaagcctaagacaaagcataaggttgacattgacactgtacagaaattccagaccctgcgcgatcaagagcagaagtacttcgatgaaatggttcaaaagtgtaaggatgttggtgcgacccttgttatatgtcaatggggttttgacgatgaagccaatcatcttttgatgcacagaaatctgccagctgtcagatgggttggtggtgttgaattagaattgattgccattgctacaggaggccggattgttccgagattccaagaactgagtcctgaaaagctcgggaaggctggattagtcagagagaagtcatttggaacaaccaaggaccggatgctttacattgagcagtgtgccaattccagagctgtaactattttcattcgtggtggaaacaaaatgatgattgaggagaccaagcgcagtcttcatgatgctctttgtgtggcaaggaatctaatccgcaataactcaatcgtgtatggtggaggctcagtggagatatcttgctcgattgctgttgaaactgctgctgatcgacaccctggagttgagcagtatgctatcagatcatttgctgatgcattagaggctgttccactagccttagcagaaaatagtggtctgccgcccattgatacgttaactgctgtgaaagcacaacaagttaaggagagcaacccccactgcggcatagactgcaatgatgttggcatgaatgacatgaaggagcagaatgtctttgagactctgattggcaagcagcagcagatcttgcttgccacgcaggtggtgaagatgattctcaagatcgacgacgtgatctcgccatccgagtactgatgaaggaagcctgagaaagaaggggagctgcgcttggtgacgatctaaagaaccattccacatgctatacggggtctcattttcaatttatgctgtttcatggggcttattccagaaccaaatcatcctaaaaatctgtaagaatttattgaggtcatcagaaactgatggttatgttgtggtaaatttgacggttgttgccataccatcaatattgttatgtgacgaaatgcgaacacctgttctctagatgatgtgaacccggacgatgttaccatgccatcactattgtttactacggttggctccaaagcatctgggttaatat

SEQ ID NO: 1849 - DNA, 2197 bp, Oryza sativa
gaggaagcgcagtagaagaagacagcagaaaaccctcaaaccctcgcaccccgcgccgccaccgccactccccccccccgcgccgccaccccaccccaccccaccccacgccgtctcctccgatcgccggagaaggaggaggaggcgtcagccatggcgctggccttcgacgagttcggccgccccttcatcatcctgcgtgagcaggagaagaagtcgcggctgcgcggcctcgacgcccagaaggccaacatcgccgccggcaaggccgtcgcccgcatcctccgcacctcgctcggccccaagggcatggacaagatgctccagtcccccgacggcgacgtcaccatcacaaatgatggcgcaacgatcctggagcaaatggatgtggacaaccaaatcgcgaagctgatggtggagctgtcctgcagtcaagactacgagattggggatggtaccactggtgttgtggtcatggctggctctctcctggagcaagccgagaaactgctggaacgcggcattcaccccataaggatcgccgaaggttatgagttggcctcaaggatagcttttgatcaccttgagcacatctcccacaagtttgagtttagtgctaccaatatagagcctctggtgcagacctgcatgacaaccctgtcatcgaaaattgttaaccgttgtaagaggactcttgctgagattgctgtgaaagcggtccttgctgtggctgatttggaaaggaaggatgtaaacttggacttgatcaaagtggaaggtaaggtaggcgggaaactagaggatactgagctagtatatggaatcattgtcgacaaagatatgagccaccctcaaatgccaaagaggattgaggatgctaagattgccatcctgacctgcccatttgagcccccgaagcctaagacaaagcataaggttgacattgatactgtagagaagttccagatgctgcgtgagcaagagcaaaaatactttgatgaaatggttcagaaatgcaaggatgttggagcaaccctagttatttgccaatggggctttgatgatgaagccaatcatctgctgatgcatagaaatttgccagctgtcagatgggttggtggtgttgaattagaattgattgccattgctacaggagggcggattgttccgaggttccaagagttgagtcctgaaaagcttgggaaggctggaatagtcagagagaaatcatttggaacaacaaaagatcgcatgctttacattgaacagtgtgccaactccagagctgtaactatcttcatacgtggtggcaacaaaatgatgattgaggagaccaagcgaagtcttcatgatgctctttgtgttgcaaggaatcttatccgtaataattcaattgtgtatggtggtggttcagcagaaatatcttgctcagttgctgttgaagctgctgcagatcggtacccaggagttgaacagtatgcaatcaggtcatttgctgatgcgttggatgctattccactagccttggccgaaaacagtggtttgtctcctattgatacactgacagcagtaaaatctcaacaagtaaaggagagcaatcctcactgtggcattgactgcaacgatgttgggacaaaccacatgaaggaacaaaatgtttttgaaacactgataggcaagcagcagcagatcttactggcaacccaggtggtgaagatgattctcaagatcgatgatgttatctcgccttctgactattgatgatgcttttgaagactatggagtttattgtgctagggccttggcgacaagcacttccagtaggctctacattttctgtcgatcggtttttgattaacatttacgccatgggtttgcttgcttgtgctatttgatgagctatctgtttgtgtgaacttaacttttggtactttgtttttcgcgcccgcactttgtatagcttgagacaatagcacaatccctttgaagctggcctagaagtttgagtagctaccatttgctcttgtgctgctcagattcgtagatgctatataggttgcgcgctgtggtagtatcgtattgtgttctgcatcgtccgcatgtactctacttttcttaatgatcattttgagccatatgaatatttacaattttcggttaaaactttttttttctgcaagcaagagaagggccttgg

SEQ ID NO: 1850 - DNA, 2242 bp, Brachypodium distachyon
agcgagggtttcggtgaaccgagaacaggaagacgaaagtatcagaaggaaaccctgggaagagctccgcggtgcgtcgtccagaaaacacagcgccgcctcactctctccatcccctccttccacagctccgctccgcgtgcgatccgcccttcctgaagcttctgggaggagcagcgccagcgctccggcggccatggcgctcgccttcgacgagttcggccggcccttcatcatcctcagggagcaggagaagaagtcgcggctgcaggggctcgacgcgcagaaggccaacatcgccgccgggaaatctgtcgcgcgcatcctccgcacatccctcggtcccaagggcatggacaagatgctccagtcccccgacggcgacgtcaccatcactaatgatggggcaacaatcctggagttaatggatgttgacaaccagattgccaagctcatggttgagttgtcccgtagtcaagattatgacattggagatggtaccactggggtggtggtcatggctgggtctctcctggagcaagctgaaaagctgctggaacgtggtattcacccgataagggtcgctgaaggttatgagatggcatcaaggatagcttttgatcaccttgaacgcatttccacgaaatttgagttcagtgctactgatatagagcccttggtgcagacttgcatgacaacattgtcctcaaagattgttagccgttgtaagcgggctctagctgagattgctgtcaaagctgttcttgcagttgctgatttggaaaggaaggatgtaaatttggacttgattaaagtggaaggtaaggttggtgggaagctagaagatacggagctagttcatggaatcatcgttgacaaagatatgagccacccccaaatgccaaagagaattgaggatgcacacattgccatcctgacctgcccatttgagcccccgaagcctaagacaaagcataaggttgacattgatactgtagagaaattccagacgctgcgtgggcaagagcagaaatacttcgatgaaatggttcagaaatgcaaggatgttggtgcaacccttgttatttgtcaatggggttttgatgatgaagccaaccatttactgatgcatagaaatctcccggctgtcagatgggttggtggggttgaattagaattgattgccattgctacaggagggcgtattgttccgagattccaagagttgagtactgaaaagcttgggaaggctgggttagtcagagagaagtcatttggaacaacaaaagatcggatgctatacattgaaaagtgtgctaattctagagctgttacaattttcatccgcggtggcaacaaaatgatgattgaggagaccaagcgaagtcttcatgatgctctttgtgtggcaaggaatctgatcatcaataactcgattgtttatggtggtggctcagcagagatatcttgctcaattgctgttgaggctgctgcagatcggcatgctggagttgagcagtatgctatcaggtcatttgctgatgctttggatgctattccactagctttagccgaaaacagtggtttaccgcctattgatacgctgactgtcgtaaaatcccaacatgttaaggagagcaatccccactgcggcatcgactgcaatgatgtcggtaccaatgacatgaaagagcagaatgtttttgaaactctgattggcaagcagcagcagatcttgctggcaacgcaggtggtgaagatgatcctaaagattgatgatgttatcacgccttctgaatattgatgatgcctgggaagaatggaaatcgactgctaggctggacttgctcctagaattctaatatggagtggtcgcttgttttgtttgatgagctacctaggcttgtgacgctggctcgatcatataactttggcgttcacacttcgtatagcttgagttgagacaatagcagaaactctgtcgttagttttacacccttgttgtatttttcagacgcttaatgctatggttggaccttgtttcatatctgctttgtggttagtatgacatgaattatctggtttgcttctgtctgcatctgttatcagatgatattcagctggttggtggtacttcctctgttaaggctcctattgaaatctgtgccatgctttgacgaatgatatttagtatatttatatgtatataaaagttataaagagtttttcaatatgaaaccaa

SEQ ID NO: 1851 - DNA, 2400 bp, Brachypodium distachyon
aggcctatagagatcgcagcaacgcccgccctctcactcccctcgcgccgcctcctcccggcgcgatccgactcgtccctccgaacagagcgcgcactcgcgcactcgtagcaggcggcggccatggtgctggtcttcgacgagttcggccggcgtttcatcatcctgagggagcaggagagcaagtcgcgcctgcgggggctcgatgcgcacaaggccaacgtcgccggcggcaaggccgtcgcgcgcatcctccgcacctcgctcggccccaagggcatggacaagatgctccagtcccctgacggcgacgtcacaatcacaaatgatggtgcaacaatcctggaacaaatggatgttgacaaccagatcgcaaagctgatggtggagctatcccgcagtcaagactatgaaattggggatggtaccactggggtggtggtcatggcagggtcgctcctggagcaagctgaaaaacttcttgagcgaggtattcatccaataaggattgcggaaggttatgagatggcctcgcggatagcttttgaccaccttgaacacatctccaataagtttgagttcacggccacaaatatagagcctttggtgcagacctgcatgaccactctgtcctcaaagattgttaaccgttgtaagcggatgcttgctgagattgctgtcaaggcagtccttgcagttgctgatttggaaaggaaggatgtaaacttggacttgattaaagtagaaggcaaggttggtgggaagctagaggacactgagctaatatacggaattgctgttgacaaagacatgagccatccacaaatgccaaagagaattgaggatgctaatattgccatcttgacctgcccatttgagcccccgaagcccaagacaaagcataaggttgacattgacactgtagaaaaattccagactctgcgtgagcaagagcagaaatactttgatgaaatggttcagaaatgcaaggatgttggtgcaaccttggttatttgccaatggggttttgacgatgaagccaatcacttgcttatgcatagaaatctgcctgctgtcagatgggttggtggtgttgaattggaattgattgccatagctacaggggggcggattgttccaagattccaagagttgagtcctgaaaagcttggaaaggctggattagttagagagaagtcatttggaacaacaaaagatcgaatgctttacatcgagaagtgtgcaaattccagagctgtaactatcttcattcgtggtggcaacaaaatgatgattgaggaggccaagcgaagtattcatgatgctctgtgtgtggctaggaatcttatccgcaataactctattgtttatggtggcggctcagctgagatatcttgctcaatagctgtcgatgctgctgcagatcgatatgctggagttgagcagtatgcaatcagatcgtttgctgatgcgttggacggcattccactagccttagctgaaaacagtggtttgccacctattgatacactgactgcagtaaaatctcagcaagttaaggaaggcaatccccactgtggcattgactgcaacgatgtcgggacgaacgacatgagagagcagaacgtgtttgaaaccctgattggcaagcagcagcagttattgctggcaacgcaggtggtgaagatgattctcaagattgacgatgttatcactccgtccgagttctgagtattggctatattgcaagcatggacaacgaagctggatgtgacaactggcaagcaattagtctaccagacctgaagcagttgtgtttgtttggtggagctagcgagcaacctgtgtgtttttgctgtgacgctcatccacactgtagcgcatgaaatatcttcctgtagcttagaagtttggatgaacaatctcatttttcacccctatattttcagatgcttaatgctatatagtttggatgtttttgctcgtaccttttaccatctaaaattgattattcaatcatccgtgagttaaatgcatttaatctgttctgctatagaggaatcggtgccaccatcagtccaatctggacttctggagggggagaaatgcatgtttaacagatggagaagagccaaaaccttgatttattatcgattatactctaatgcaatgtggctcaagggcttgtcacataattttacatcaagcagagaatcatctcattaactggcttcacacatgcttgagctttgcgtcggccagcatgccctctatggcggccttccagatcttccagtgcgtctggtcttccagcagcagcctcaccgtccctgccgacgtggtcagcgccaccgcgaagcacctccggccgtcgaccaccgccaccgtctctcccggcga

SEQ ID NO: 1852 - DNA, 2133 bp, Panicum virgatum
ccggaaccgggccggaccggtccggttcccaccggtttggtcaaccttgcgcgcagaaggccaacatcgccgccggcaaggccgtcgcgcggatcctccgcacctcgctcggcccgaagggcatggacaagatgctccagtcccccgacggcgacgtcaccatcacaaatgacggggcgacgatcctggagcagatggatgttgacaaccagatcgcaaagctgatggtggagctgtcccgcagccaggactatgagatcggggatggtaccactggggtggtggtcatggcaggggctctcctggagcaggccgagaagcttctggaacgtggcattcaccccattagggtggctgaaggctatgagatggcatcaaggatagcttttgatcacctagaacgtatctcccagaagtttgagttcagtggagacaatattgagcccctcgttcagacctgcatgacaactctgtcgtcaaagatcgttaaccgttgcaagagggcacttgcagagattgctgttaaagcagtccttgcggttgctgatctggagaggaaggatgttaacttggacttaattaaagtagaaggcaaggttggtggtaagctggaggacactgagctcatatatggaattgttgttgacaaagatatgagccacccacaaatgccaaagagaattgaagatgctaagattgccatcctgacatgcccattcgagcctctgaagcctaagacaaagcataaggttgacattgacactgtagagaaattccagacgctgcgtgagcaagagcagaagtactttgatgaaatggttcagaagtgcaaggatgttggtgcaaccctggttatttgtcaatggggctttgatgatgaagccaatcatttgttgatgcacagaaatctgccagctgtcagatgggttggtggtgttgaattggaattgattgccattgctacaggaggacggattgttccgagattccaagagttaagttctgaaaagcttgggaaggctggattagtcagggagaagtcattcggtacaaccaaggaccggatgctttacatcgagaagtgtgccaattccagagctgtaactattttcattcgtggtggaaacaaaatgatgattgaggagaccaagcgtagtcttcatgacgcgctttgtgtggcgaggaatctgatccgtaataactcaattgtttatggtggtggctcagcagagatatcttgttcaattgctgttgaaactgctgcggatcggcaccctggagtcgagcagtacgctatcaggtcattcgctgatgcgttagatgctgttccgctagccttggctgaaaacagtggtttgccaccaattgataccctaactgcggtaaaagctcaacaagttaaggagagcaacccgcactgtggtatagactgcaatgatgttggcaccaacgacatgaaagaacaaaacgccttcgagaccctgattggcaagcagcaacagatcttgcttgccactcaggtggtgaagatgatcctcaagatcgatgacgtgatctcgccatccgattactgatgaagactgagaaaatggacctgctactatggatgacagccagtgttgtaagcagcattgctgatgtgttgattggtgtactcttttattctggctttgctcgctagctgctagctgcatccgatgagctgcctacctgttttttgtgtcgcttgcggaattgtttctattgcccgatagcatcgaagatacatttgaaattagcgtagacgcttggttaaaaaaccattttgtgctgtatttcacctcagatggttgcagtgttgttactttgtttctgtttgtactgtttggaagtgttgacctattcatgttactggaaactgagcctgtgctcacggcaactgctcgatggcgatgacgatagttttgctcttaaggcaatctgctatggtataatccagaagcacaaagcgccgagtatttcaggtctctgaattatgggctcctcttccgtctcctttggaggccaatccctggtgctgcagaaacatgtggatgttgaaactaacatcagattggttgaagaatggttttgctgtaataaccaattttttct

SEQ ID NO: 1853 - DNA, 2148 bp, Fragaria vesca
gacgctttaaactgaaagagagagagagagagagagagggagaagatcctagacctaaccagacgacgaagaagaagcacttcactctttagtggaagagtgagtcgagcacagcagcgcatcaatggcgctggccttcgatgagttcggccggccgttcattatcctccgggagcaggagcagaagtcgcgattgcgcggcctcgatgctcagaaggctaacattgccgccggtaaagccgtcggcaaaatcctccgcacctcgctcggacccaaaggcatggacaagatgctccagagccccgacggcgaggtcaccgtcacaaatgatggcgccaccatcttggagcagatggatgttgacaatcaaattgcaaagctgatggttgagctttcgcggagtcaggactatgaaattggcgatgggacaactggagtggttgtgttggccagttcacttctggagcaggcggagcggctcttggaacgtggtattcatcccattagggttgctgagggatatgaaatggcatccaggatagcttttgatcatttgcagcatatatcgaagaaatttgaatttggagtggaaaatattgagcctttggttcagacttgcatgactactttgtcatcaaagatagtcaatcggtgcaagcgctcccttgctgagattgctgtcaaagcagttcttgctgttgctgatttagagaggaaggatgtgaaccttgatttgatcaaagtagaagggaaagtaggtggcaagttagaagatactgagctggtttatggtattcttattgacaaggatatgagccatccacaaatgcccaagcgaattgaagatgcaaaaattgctatcttgacctgtccctttgagccaccgaaaccaaagacaaagcataaggttgatattgatacagtggaaaagtttcagactctacgtgtgcaagaacaggagtactttgatcagatggttcaaaaatgcaaggatgctggtgctaccttggtcatctgccaatgggggtttgatgatgaagccaatcacctattgatgcacaggaacttgcctgctgttagatgggtcggtggtgttgagttggaactaattgcaatagctacagggggaagaattgtgcctaggttccaagagttgacaccggataaattggggaaggctggcttggttcgtgaaaaatcatttggtactacaaaagatcgaatgctgtacattgaacactgtgcaaattcaagggctgtaaccatatttatccgcggaggtaacaaaatgatgatagaggagaccaagcgtagtatccacgatgctctgtgtgttgccaggaatcttattcgcaataattctattgtctatggtggtggctcggcagagatatcttgctctgttgccgtagaagcagctgcagataaacacccaggagttgagcaatatgctatcagagcatttgcagacgctttggatgctgttcccatggcacttgcagagaatagtggccttcaacctattgaaacactaaatgcagtgaagtcccagcagattaaggagaaaaatccccactgtggaatagactgcaatgatgttggcactaatgatatgcgtgagcagaatgtgtttgagactttaattggaaagcaacagcagatcttactcgccacccaagttgtcaagatgatacttaaaatagatgatgttatctccccctccgagtactgatagtttggcttgataggttgatgcttgcttcatctgacgaaggaatttgtgtaatgtttcttgctttttggttcagaattcattttgagcgacttggaccatattgcttcacttgaggaaaactgtttgcttgtagatttggagtggctttcactgatatagtagcattgtcactcccctatcttaatggattgctttttgttgtacactcttgataggtttttgtttactagcatccattcattaaccattttctatgctcgtagcagataaaagtgttgcatcttacgagaatgcaaatgaagaaaatgtggtctgctttaagctctcttgccctgtactgacccaagtgttggccggatttgcttttagattcacttctggtttcgtaggtcttatttagatggatttcatct

SEQ ID NO: 1854 - DNA, 1998 bp, Avena sativa
gatcacaaaccctcgactccccgcggcgtctccagaaccacagcgccgcctcactctcccccctcagatcagctccccgcgcgatccgcccttccaggagttccttccggggggagcagcgccagctcttcggcggccatggcgctcgacttcgacgagtactggcggcccttcatcatcctcagggagcaggagaagaagtcgcggctgcaggggctcgacgcgcagaaggccaacatcgccgccggcaagtccgtcgcgcgcatcctccgcacgtccctcgggcccaagggcatggacaagatgctccagtcccccgacggcgacgttaccatcactaatgatggggcgaccatcctggagctaatggatgttgacaaccagattgctaagctgatggtggagttgtcacgcagtcaagactatgacattggagatggtaccactggagtggtggtcatggctgggtcgctcctagagcaggctgagaagctactggaacgtggtattcacccaataagggttgctgaaggttatgagatggcttcaaggatagctgttgatcaccttgaaagcatctccacgaaatatgagttcagtgccacagacattgagcctttggtgcagacctgcatgacaactttgtcctcaaagattgttagccgttgtaagagggccctagctgagattgctgtcaaagcagtccttgcggttgctgatttggaaaggaaggatgtaaatcttgacttgattaaggtggaaggtaaggttggtgggaagctagaggatactgagctagtacaaggaatcattgttgacaaagatatgagccacccccaaatgccaaagagaatcgaggatgcgcacattgccattctgacctgcccatttgagcccccgaagcccaagaccaagcataaggttgacattgacactgtagagaaattccagacactgcgtgggcaagagcagaaatacttcgatgaaatggttcagaaatgcaaggatgttggtgcaaccctggttatttgtcaatgggggtttgatgatgaagccaatcatttactaatgcaaagagaactgcctgctgtcagatgggttggtggtgttgaattagaattaattgcaattgctacaggtgggaggattgttccgagattccaagagttgagtactgaaaagcttgggaaggctggattagtcagagagaagtcatttggaacaacaaaagatcggatgctatacatcgagaagtgtgccaattccaaagctgtaactattttcatccgtgggggcaacaaaatgatgattgaggagaccaagcgaagtattcatgatgcgctttgtgttgcaaggaatctcatcatcaacaactcaattgtgtatggtggtggctcagcagagatatcttgctcgattgctgttgaagctgctgcagatcggcatcctggagttgaacagtatgcaatcagggcatttgctgatgctttggatgctattccattggctttagctgaaaacagtggtttgccacctattgatactctgaccgtggtaaaatctcaacatgtcaaggagaacaattctcgttgcggcattgattgcaatgatgtgggtaccaatgacatgaaagagcagaatgttttcgaaactctgattggcaagcagcagcagatcttgctggcaacccaggtcgtcaagatgatcctcaagatcgatgatgttatcacgccttctgaatactgatgatgcctgcagagaagaggaatcgactgtgctaggtgactactacgctccagtaggcagctgtatgggttgatttggatttgctcctagaattctggcactgagtggtcgctttgtttcattttacgagctatatggttttgtgtgcttgctcgatcattataacattggcgttcactcttcgtactatagaacaaatcctgtcgataccagtttagtcctttgttgtattgtttgggatgcttaatgcta

SEQ ID NO: 1855 - DNA, 2001 bp, Solanum tuberosum
gtgaaagtgttctagattcataaggcaactctctctgtcactgtcgccggagattattatttcccgatctgatcgaaagcaggtcaccgggaacaatggcgttagctttcgatgaattcggaaggccgtttataatactaagggagcaagaacaaaaaactagattaagaggcctcgatgctcagaaggccaacatttctgccggaaaagctgttgcacgtattttacgtacctcacttggtcctaaaggcatggataagatgcttcagagccctgacggcgatgtcaccatcacaaatgatggtgccaccattttggagcagatggatgttgacaatcagattggaaagttgatggttgagttgtcacgaagtcaagattatgaaattggcgatggaaccactggagttgttgtcatggctggggcactgctagaacaagctgagaagttgttagaacgtggtattcatcctattcggattgcagaagggtatgaaatggcttcaaggattgcagttgagcatttggagcgtgtagcacataagtttgaattcggtctgaatgacattgagcctttggttcaaacttgcatgactactttgtcatctaagattgtgaatagatgcaaacgtagcatggctgaaattgctgttaaagctgttttagcagttgctgatttagagaggaaggatgtaaacctggacttgatcaaagttgaagggaaagttggtgggaagttagaggacacagagctaatttatggtattatagttgacaaagatatgagtcatccacagatgccaaagcaaattgaggatgcgaaaattgcaattttgacatgtccttttgagcctcctaagccaaagactaagcataaggttgacattgatactgtggagaagtttcaaactttacgcctacaggagcagaagtactttgatgacatggtccagaagtgcaaggatgttggtgctaccttagttatctgccagtggggttttgatgatgaagctaatcacttattaatgcatagaaatttgcccgctgttagatgggtaggtggtgtggaattggagctgatagcaattgccacaggtgggagaatagtaccaaggtttcaagagttgacacctgaaaaacttggcaaggctggtattgttcgggagaaagctttcggtacaacaaaggatagaatgatttacattgagcattgtgcaaattcaagagcagtaactatatttatccgtggtggcaacaagatgatgatagaggagacaaaacgtagtatccatgatgctttatgtgttgctagaaatcttattcgcaacaattcaattgtatatggtggtggttcagcagagatttcttgctcaattgctgttgaagcggctgctgataaacatccaggagttgaacagtatgcaatcagggcatttgcagatgctttggattctgttccaatggcacttgctgagaacagtggtctccagcctattgaaactctatctgctgttaagtctcagcaaattaaggagaataatccctgctgtggaatagattgtaatgatgttggcacaaatgacatgcgtgagcaaaatgttttcgagaccctaattgggaagcaacaacagattttgcttgcaactcaggttgtcaagatgatcctaaagattgatgatgtgattactccttccgcgtattgatgttaagtatggaaatgcaaaattttcttcgtcttagagaagatgaacgttttccttctggctatgcaaaccagaagttttgttgggtgaaactttcacgatcttatgctttggcttctatgttgtctatttgagtagaatttttgtggttgatgaatttcacttgattgatgatcagtttctgtcacggtattctccattgaaagattatttgcaccttcatggtatactttatttgcaatgatgtagcaactatattaaaaggattatgcgcctgatggattttattattaaggta

SEQ ID NO: 1856 - DNA, 1976 bp, Solanum lycopersicum
aagggtttatcgcagacagcatgctagggttttgaagtgttctagattcataaaacaactctctctgtcactgtcgccggagattattatttaccgatctgatcggaagcaggtcacagggaacaatggcgttagctttcgatgaattcggaaggccgtttataatactaagggagcaagaacaaaaaaccagattaagaggcctcgatgctcagaaggccaacatttccgccggaaaagctgttgcacgtattttacgtacctcacttggtcctaaaggcatggataagatgcttcagagccctgacggcgatgtcaccatcacaaatgatggtgccaccattttggagcagatggatgttgacaatcagattgggaagttaatggttgagttgtcacgaagtcaggattatgaaatcggtgatggaaccactggagttgttgtcatggctggggcactcctagaacaagctgagaagttgttagaacgtggcattcatcctattcggattgcagaagggtatgaaatggcttcaaggattgcagttgagcatttggagcgtgtagctcataagttcgaatttggtcagaatgatgttgagcctttggttcaaacttgcatgactactttgtcatctaagattgtgaatagatgcaaacgtagcatggctgaaattgctgttaaagctgtgttagcagttgctgatttagagaggaaggatgtaaacctggacttaatcaaagttgaagggaaagttggtgggaagttagaggacacagagctaatttatggtattatagttgacaaagatatgagtcatccacagatgccaaagcaaattgaggatgcaaaaattgcaattttgacatgtccctttgagcctcctaagccaaagactaagcataaggttgacattgatactgtggagaagtttcaaactttacgcctacaggagcagaagtactttgatgacatggtccagaagtgcaaggatgttggtgccaccttagttatctgccagtggggctttgatgatgaagctaatcacttattaatgcatagaaatttgcctgctgttagatgggtaggtggtgtggaattggagctgatagcaattgccacaggtgggagaatagtaccaaggtttcaagagttgacacccgaaaaacttggcaaggctggtattgttcgggagaaatctttcggtacaacaaaggatagaatgatctacattgagcattgtgcaaattcaagagcagtaactatatttatccgtggtggaaacaagatgatgatagaggagacaaaacgtagtatccatgatgctttatgtgttgctagaaatcttattcgcaacaattcaattgtatatggtggtggttcagcagagatttcttgctcaattgctgttgaagcggctgctgataaacatccaggagttgaacagtatgcaatcagggcatttgcagatgctttggatgctgtcccaatggcacttgctgagaacagtggtctccagcctattgaaactctatctgctgttaagtctcaacaaattaaggagaataatccatgctgtggaatagattgtaatgatgttggcacaaatgacatgcgtgaacaaaatgtctttgagactctaattggtaagcaacaacagattttgcttgctactcaggtcgtcaagatgatcctaaagattgatgatgtgattactccatccgagtattgattttaagtatggagatgcacacttttcttcgtcttagagaagatgaatgttttccttctggctatgcaaaccagaagttttgttgggtgaaactttcacgattttatgctttggcttctatgttgtctatttgaatagaattttggtggttgatgaatttcacctgattggtgaccaatttctgtcaacagtattttccatcgaaatattatttatgaagattttactaatttatctgctaga

SEQ ID NO: 1857 - DNA, 1986 bp, Liriodendron tulipifera
  misc_feature (330)..(330): n is a, c, g, or t
  misc_feature (1287)..(1287): n is a, c, g, or t
  misc_feature (1311)..(1311): n is a, c, g, or t
  misc_feature (1399)..(1399): n is a, c, g, or t
  misc_feature (1419)..(1419): n is a, c, g, or t
  misc_feature (1574)..(1574): n is a, c, g, or t
acctccttccttctcctctccctctctccagcgatggcgctggcctttgatgattttgggaggccgttcataataataaaggaacaggagcagaagagcaggctgaggggattggatgctcagaaagccaacatctcagctggaaaggccgtcgctcgcattctacgcacctccctcggccctaagggcatggacaagatgctccagagccccgacggtgaagtcaccatcacaaatgatggggcaacaatcttggagcagatggatgttgataatcaaattgcgaagttgatggtcgaattatctcggagtcaggactatgaaattggngatggcaccactggagttgttgttgtggctggtgcacttttagagcaggctgaacgactattagaacgtggcattcatcccattcggattgcagagggctatgaaacggcttcaaggatagctgtagaacacttggagcatatttctcagaagttcgattttagtctgtcaaatatagaatctctagtgcagacctgcatgaccaccttatcttcaaagattgtgaatcgatgcaagcgcaccttagctgagattgctgttaaagcagtcatggctgttgcagatttagaacggaaggatgttaatttggatttgattaaagttgaaggaaaggtaggaggcaaattggaagatactgagctaatctatggaatagttgtcgacaaggatatgagccatccgcagatgccaaagagaattgaagatgcaaagattgctattttgacttgtccatttgagccacctaaaccaaagacaaagcataaggtggatattgacacagtggagaagttccagactttacggcagcaagagcagaaatactttgatgacatggttcaaaaatgcaaggatgttggtgcaaccctggttatctgtcaatggggttttgacgatgaagcaaatcatctattaatgcaccggaacttgcctgctgttcggtgggtcggtggtgtggagctggagcttattgcaattgctacaggtggaaggattgtgccaaggttccaagaattgacaccagagaagctggggaaggctgggctagttagagaaaaatcatttggaaccacgaaggaccggatgctgtatatcgagcagtgtgcgaattcaagggctgtaactatattcattcgtggtggaaacaaaatgataatagaggaaacaaagcgcagcatccatgatgccttatgtgttgcaaggaatctcatccggaacaattctatcgtatatggtggngggtctgctgaaatatcttgctcnattgctgttgagactgctgccgatagatatcctggagttgagcagtacgctatcagggcctttgcagatgctttggacgccattccantggccctcgcagagaacagnggtctccaacctattgatacattgactgcagtcaaggctcagcaaatcaaggagagcaacccacattgtggcatagactgcaatgatgtcggaacgaatgacatgcgagagcagaatgtcttcgagaccctgatagggaagcagcagcagatgtngctagcgacgcaggtcgtcaagatgatactgaagattgatgacgtaattgccccgtcagattattgatcgattcatggcatgaattgaaaattttgccttgacagaatcaacatggttattatgttcactagtagtagcattgccatgttattctgatgaagacgtgcctttactttgtcatcgttgtgttttcctgtttgataatagactaatttggttgagaattcttgtcgctttgctttcttgaatgactgttatcctactaaaatccttgtgattttatgtggcaatttgtgttgagtaatgatatgtaaccagtggactttttcctgcttgatgtagactctgttcatgaatgctaccacatcattcattattcttgaatgctacatcacttgtcattcaaaaatg

SEQ ID NO: 1858 - DNA, 2007 bp, Avena sativa
cagaaccacagcgccgcctcactctccccccttcagatcagctccccgcgcgatctgccctcccaggagtttcttcaggggggagcagcgccagcgcttcggcggccatggcgctcgccttcgacgagtacgggcggcccttcatcatcctcagagagcaggagaagaagtcgcggctgcagggtctcgacgcgcacaaggccaacatcgccgccgccaaggctatcgcgcgcatcctccgcacgtcccttgggcccaagggcatggacaagatgctccagtcccccgacggcgacgttaccatcactaatgacggggcgaccatcctggagctaatggacgttgacaaccagattgcaaagctgttggtggagttgtcacgcagtcaagactatgacattggagatggtaccactggagtggtggtcatggctggggctctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagatttctgtcaaagcagtccttgcggttgctgatttggaaaggaaggatgtaaatctggacttgattaaggtggaaggcaaggttggtgggaagctagaggataccgagctagtgcaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatacttcgatgagatggttcagaaatgcaaggatgttggcgcaaccctagttatttgtcaatgggggtttgatgatgaagccaatcatttactaatgcaaagagaacttcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctttacatcgaaaagtgtgccaattccaaagctgtaactattttcatccgtggaggtaacaaaatgatgattgaggagaccaagcgaagtattcatgatgctctttgtgttgcaaggaatctcatcatcaacaactcaatcgtgtatggtggtggttcagcagagatatcttgctcgattgctgttgaagctgctgctgatcggcatcctggagttgagcagtatgcaatcagggcatttgctgatgctttggatgctattccactggctttagctgaaaacagtggtttgccacctattgatactctgacagtggtaaaatcccaacatgtcaaggagaacaattcccgctgcggcattgattgcaacgatgtgggtaccaatgacatgaaagagcagaatgtttttgaaactctgattggcaagcagcagcagatcttgctggcaacccaggtcgtcaagatgatcctcaagatcgatgatgttatcacgccttctgaatattgacgatgcctgcagagaacatgaatcgactgtgctatgtgacatacgctccagtaggcagctgcatgggttgatttggatttgctcctagaattccgtcaccgagtggtcgctttgttttgtttgacgagctatatggttttgtgcgcttgctcgatcattataactttggtgttcacactctgtacaatagaacaaatcctgtcgataccagtttagtccgttgttgtattgtttgggatgcttaatgctattgtttggatcattattttgtctgctttgaagtaagtgttac

SEQ ID NO: 1859 - DNA, 2011 bp, Elaeis guineensis
ccactctctcctctcttccggaaccagctgctgcttcctccccgttgctctcttccccttgcggcggtcgcggtctccgcctcgtgctctgctcttcctcttcttcttcgttcttctgaggaggtttggtggaaggagaagaagaatggcgttggcgttcgatgagtacgggaggcctttcatcatcttaaaggagcaggagcagaagagccggctgaggggcttggaggcccagaaggccaacatctcggccgggaaggctgtcgctcggatcctccgcacctcccttggccccaagggcatggacaagatgctccagagccccgacggtgatgtcacaatcacaaatgatggggcaacaatcctggagcagatggatgtggataaccagattgcaaaattgatggtggaattgtcccggagtcaggactatgaaattggtgatggtacgacaggggtcgttgttatggctggtgcacttctagaacaggctgagaagcttctggaacgtggcattcatcctattaggattgcagagggctatgagatggcctctaggatagctgtggaacatcttgaacacatatcccagaaatttgaatttactgttggtaatattgaacctttggtgcagacctgcatgaccacattgtcttcgaagattgtcaatcgttgcaagcgtatgctagctgagattgctgttaaggcagttctggcagttgcagatttagaaaggaaagatgtgaaccttgatttgataaaggtagaagggaaggttggaggaaaattggaagataccgagcttgtctatggaataactgttgacaaggatatgagccaccctcagatgccgaagagaattgaagatgcgaaaattgctattctgacttgtccatttgagccaccgaagccaaagacaaagcataaggttgacattgacactgtggagaaatttcaaactttacgtcagcaagagcggaagtactttgatgatatggttcaaaaatgcaaggatgttggtgcaacccttgttatttgtcaatggggttttgatgatgaagcaaaccatcttttgatgcatcggaatttgcctgctgtcagatgggttggtggcgttgagttggaattgattgccattgctacaggtgcaagaatagttcccagattccaagaactgacacctgaaaagctaggaagggctggactagttagagaaaaatcatttggaactacgaaggatcggatgttgtatattgagcaatgtgcaaactcaagggcagtaacagtattcattcgtggtggtaacaaaatgatgatagaggaaactaagcgtagtctccatgacgcgctatgtgtggcaaggaatctgatccgtaacaattccattgtttatgggggtggctcggctgagatatcttgctcaattgctgttgaagccgctgcagataaataccctggagttgagcagtacgctatcaggtcatttgctgaagctttagattctataccaatggctctggcagagaacagtggcctccaacctattaatactttgaccgcagtcaaatctcagcaaatcaaggagaacaatccatattgtggcatagattgtaatgatgtggggactaataacatgcaacagcagaatgtatttgagacgctgataggcaaacagcagcagatcttgttggcaacacaggtggtgaaaatgattttgaaaattgatgacgttatcgccccatctgactattgattgtatttgagagccaaaatttttgtgggcaaaattatgctttcatgagaatccactacatggcaagaaacgctactgttacgtgaatttggtgtcggaaactgattgattttgctttggtgcaacttttgttctgaggttatgatttgtagattgacttgtaactttgtgggccatcatggaaaagaaacaatttatattgtgttccttggatgcttcaatggtacagtatttcaacgtccatttctgaatttaaaa

SEQ ID NO: 1860 - DNA, 2087 bp, Nicotiana tabacum
  misc_feature (830)..(830): n is a, c, g, or t
atcgcagctagggttctgaaacccttctagattcatcgcgaaaccctctttctgtcgtcgtcgccggagattttcagtatccgatctgaccggatagcaggtcaccggaaacaatggctttagctttcgatgaattcggaaggccgttcataatactaagggagcaagaacagaaaaccagattaagaggcctcgatgctcaaaaggccaacatttccgccggaaaagctgttgcgcgtatcctgcgtacctcattgggtcctaaaggcatggataagatgcttcagagccccgacggcgatgtcaccatcacaaatgatggtgcaaccattttggagcagatggatgttgacaatcagattgcgaagttgatggttgagttgtcacgaagtcaagattacgaaattggtgatggaaccactggagttgttgtcatggctggggcacttctagaacaagctgagaagttgttagaacgtggtattcatcctatacgggttgcagaagggtatgaaatggcttcaaggattgcagttgagcatttggagtgcgtagcaaacaagtttgaattcggtctgaatgatgttgagcctttgattcaaacctgcatgactactttgtcatccaagattgtgaatagatgcaagcgtagtatggcggaaattgctgttaaagcagttctagcagttgctgatttggagaggaaggatgtaaacctggacttaattaaagtcgaaggaaaagttggtggaaagttagaggacacagagctaatttatggtattgtagttgacaaagatatgagtcatccacagatgccaaagcaaatngaggatgccaaaattgcgattctgacatgtccttttgagcctccaaagccaaagaccaaacataaggttgacattgattctgtggaaaagtttcaaactttacgccaacaagagcagaagtattttgatgacatggttcagaaatgcaaggatgttggtgccacattagttatctgccagtggggttttgatgatgaagcaaatcacttattaatgcatagaaatttgcctgctgttagatgggtaggtggtgtggaattggagctgatagcaattgccacaggtgggagaatagtaccaaggtttcaagagttgacacctgaaaaacttggcaaggctggtatagttcgggagaagtcttttggtactacaaaggacagaatgatatacattgaacattgtgcaaattcaagggcagtaactatattcatccgtggtggcaacaagatgatgatagaggagacgaaacgtagtatccatgatgctttatgcgttgctagaaatcttattcgcaacaattcaattgtttatggtggtggttcagcagagatttcttgctcaattgctgtggaagcggctgctgataaacatccaggagttgagcagtatgcaatcagggcatttgctgatgctttggattctgtcccaatggcacttgctgagaacagtggtctgcagcccattgaaactctatctgctgttaaggctcagcaaattaaggagaacaatccatgctgtggaatagactgcaatgatgttggcacaaatgacatgcgggagcaaaatgtcttcgagactttaattgggaagcaacaacagatattgcttgcaactcaggttgtcaagatgattctaaagattgatgacgtgatttctccatctgagtattgatgttaagtacgagaatgctaaatttttctttgactaaagaggaggtgaatgttttcctttttcactatgccaacccataagttttgttgggtgaaattttcatgatcttatctttggtttctatgttgtgtatttgagtacagcttgttggttgatgaactgtactcattcaatggttttcaatttgattgatgatgatcagtgtctgtcacggtatgctctatcaaaagcttatcttttgctggtctcagagattttgccacttagctagaatgctcttaaaacctgaagtttgtgtgtgctctcatctgaatttggtggctccttatgtaatgaacatcttagaggattctatgatctccaaaa

SEQ ID NO: 1861 - DNA, 2127 bp, Citrullus lanatus
tcgaccagttccattcccaggagcttctcccagttctctcttctactctgttgcttcacagtcggagatccatttcatagatatatacgatctggaactccttaatctgagagtgcagctgatctccacgcaatcatggcgctcgctttcgatgagtttggaaggccgtttataatcttgaaggagcaggagcagaagaccaggttgaggggtctcgatgcccagaaggctaacattgcttctggaaaagctgttgctcgtatcctcaggacctcgctcggccctaagggcatggacaagatgctccagagccctgatggcgacgttaccataacaaatgatggtgcaacaatcttggagcagatggatgttgacaatcaaattgcaaaattgatggttgagttgtctcgaagtcaggattatgaaattggtgatggcaccactggggtggttgtaatggctggtgcactcttagagcaggctgagcgattattagaacgaggaattcatcccattcgaattgcagagggttatgagctggcctccaggatagccgtcgaccatctggagcatattgcacaaaagtttgattttggagagacaaacttagagcctttgattcaaacttgcatgaccactttatcatcaaagattgtgaatcgatgtaagcgtagtctagcagaaattgctgttaaagcagttgttgctgtggcagatcttgaaagaagggacgttaacttagacctgataaaagtggaggggaaagtagggggaaaattagaagatactgaacttgtatatggtattattgttgacaaggacatgagtcaccctcagatgccaaagcaaattgaagacgctaagattgccatattgacttgcccgtttgaacctcctaagcccaagacaaagcataaggttgatattgatacagtggagaagttccagacgttgagactacaggaacagaagtacttcgatgacatggttcaaaaatgcaaggatgttggcgctacattggttatttgtcaatggggatttgatgatgaggcaaatcatctgctgatgcatcgaaatttgccagctgtgagatgggttggtggtgtggagctagagttgatagcgatagccacaggtgggaggatagttcctaggttccaagaattgacatcagagaaacttgggaaggctggcttggttcgagaaaaatcatttggtacaacaaaagatcggatgctctacattgaacattgtgcaaattcaagggctgtgaccatttttatccgtggaggtaacaaaatgatgatagaggagacaaaacgcagtatccacgatgctttatgtgtggctaggaacctcatccgcaataactctatagtatatggcggtggctcagctgagatttcttgttcagttgctgttgagacagctgctgataaataccctggagttgagcagtatgctatcagggcatttgccgatgctctggatgctgttccaatggcacttgcggagaacagtggcttacaacctattgaaacactttctgctgtaaaatctcagcaaattaaggagaacaatccatattgtggaatagactgcaatgatatcggcacaaatgacatgagggagcaaaatgtatttgagactttgattggtaagcaacaacagattttattggcaactcaagtggtgaagatgattctgaagattgatgatgtcatttctccttcggaatattagtgcaattgtgctttttgctgccgcagttatgggccatggctttcaaatggcgtggctcagtcgtcagtgacgtgatatttctactgttagcaatagtagggatgtaccttagaattttgctggcattatttgaaatttctgagtgatgtttttgggatggtggattattgtttatgtgtgaatgtaagggatgagctcaatataagactttctccaggtttgtctggtttatacatgagcaatgtgacatcattcatcgactcttttggtgcatcttcatttttctcggattctgaaatattatcaatggattgaggaatgttttgtatgaacgtcttcatcggccacgaacctttgccgtgtttgtcctactttcccaagtta

SEQ ID NO: 1862 - DNA, 2110 bp, Nicotiana benthamiana
gggagcattttcatgtttagggtttatcgcatctagggttctgaaacccttctagattcatcgcgaaaccctctttctgtcgtcgtcgccggagattttcagtatccgatctgaccggagagcaggtcagcggaaacaatggctttagctttcgatgaattcggaaggccgttcataattctaagggagcaagaacagaaaaccagattaagaggcctcgatgctcaaaaggccaacatttccgccggaaaagctgttgcgcgtatcctgcgtacctcattgggtcctaaaggcatggataagatgcttcagagccccgacggcgatgtcaccatcacaaatgatggtgcaaccattttggagcagatggatgttgacaatcagattgcgaagttgatggttgagttgtcacgaagtcaagattacgaaattggtgatggaaccactggagttgttgtcatggctggggcacttctagaacaagctgagaagttgttagaacgtggtattcatcctataagggttgcagaagggtatgaaatggcttcaaggattgcagttgagcatttggagcgtgtagcaaacaagtttgaattcggtctgaatgatgttgagcctttgattcaaacctgcatgactactttgtcatccaagattgtgaatagatgcaagcgtagtatggctgaaattgctgttaaagcagttctagctgttgctgatttggagaggaaggatgtaaatctggacttaattaaagtcgaaggaaaagttggtggaaagttagaagacacagagctaatttatggtattgtagttgacaaagatacgagtcatccacagatgccaaagcaaattgaagatgccaaaattgcgattctgacgtgtccttttgagcctccaaagccaaagaccaagcataaggttgacattgattctgtggaaaagtttcaaactttacgccaacaagagcagaagtattttgatgacatggttcagaaatgcaaggatgttggtgccacattagttatctgccagtggggttttgatgatgaagcaaatcacttattaatgcatagaaatttgcctgctgttagatgggtaggtggtgtggaattggagctgatagcaattgccacaggtgggagaatagtaccaaggtttcaagagttgacacctgaaaaacttggcaaggctggtgtagttcgggagaagtcttttggtactacaaaggacagaatgatatacattgaacattgtgcaaattcaaaggcagtaactatattcatccgtggtggcaacaagatgatgatagaggagacgaaacgtagtatccatgatgctttatgcgttgctagaaatttaattcgcaacaattcaattgtgtatggtggtggttcagcagagatttcttgctcaattgctgtggaagcggctgctgataaacacccaggagttgagcagtatgcgatcagggcatttgctgatgctttggattctgtgccaatggcacttgctgagaacagtggtctgcagcccattgaaactctatctgctgttaaggctcagcaaattaaggagaataatccatgctgtggaatagactgcaatgatgttggcacaaatgacatgcgtgagcaaaatgtcttcgagactttaattgggaagcaacaacagatattgcttgcaactcaggttgtcaagatgattctaaagattgatgacgtgatttctccatctgagtattgatgttaagtgcgagaatgctaaatttttcttttgacttaaagaggagatgaatgttttccttttcgctatgccaacccataagttttgttgggtgaaaattttcataatcttatgctttagtttctatgttgtgtatttgagtacagcttgttggttgatgaactgtactcattcagtggttttcaatttgattgatgatcaatgtctcacggtatgctctatcaaaagcttatcttttgctggtctcagagattttgccacttagctagaatgctctcaaaacctgaagtttgtgtgtgctctcatctgaatttggtggctccttatgtaatgaacatcttagaggattctatgatctcctatt

SEQ ID NO: 1863 - DNA, 2098 bp, Cucumis sativus
  misc_feature (11)..(11): n is a, c, g, or t
gcgttcccagnagcttctctcagttctcttctctctgttctctaattcacggtcggagatccatttcatagatataaacgatctggaactccttaatcctcccagagttaacctcttctccactcagtcatggcgctcgcttttgatgagtatggaaggccttttataatcttgaaggagcaggagcagaagaccaggttgaggggtctcgatgcccagaaggctaacattgcttctggtaaagctgttgctcgtatcctcaggacctctcttggtcctaagggtatggacaagatgctccagagccccgatggggacgttacaataacaaatgatggtgcaacaatcttggagcagatggatgttgacaatcaaattgccaaattgatggttgagttgtctcgaagtcaggattatgagattggtgatggcactactggggtggttgtaatggctggtgcactcttggaacaggctgagcgattattagaacgtggaattcatcccattcgagttgcggagggttatgagctggcctccaggatagctgttgaccatctggagcatattgcacaaaagtttgattttggagagaaaaacttagagcctttgattcaaacttgcatgaccactttatcatcaaagattgtgaatcgttgtaagcgtagtttagcagaaattgctgttaaagcagttgttgctgtggcagatctcgaaagaagggatgttaacctagacttgattaaagtcgaggggaaagtagggggaaagttagaagatactgaacttgtatatggtattattgttgacaaggacatgagtcaccctcagatgcctaagcaaattgaagatgctaagattgccatattgacttgcccgtttgagcctcctaagcccaagacaaagcataaggttgatattgatacagtggagaagtttcagacattgagactacaggaacagaagtacttcgatgacatggtgcagaaatgcaaggatgttggtgctacattagttatttgtcaatggggatttgatgatgaggcaaatcatcttctcatgcaccgaaatttgccagctgtgagatgggttggtggtgtggagctagagttgatagcgatagccacaggtgggaggatagtccctaggttccaagaattgacatcagagaaacttggaaaggctggcttggttcgagaaaaatcatttggtacaacaaaagatcggatgctatacattgaacattgtgcaaattcaagggccgtgactatttttatccgtggaggtaacaaaatgatgatagaagagacaaaacgcagtatccatgatgctttatgtgtggctagaaatctcattcgcaataactccatagtatacggtggtggctcagctgagatttcttgttcagttgctgttgagacagctgctgataaataccctggagttgagcagtatgctattagggcatttgctgatgctctggacgctgttccaatggcacttgcggagaacagtggattacaacccattgaaacactttcggctgtaaaatctcagcaaattaaggagaacaatccttattgtggaattgactgcaatgatattggcacaaatgacatgagggagcaaaacgtatttgagactttgatcggtaagcaacaacagattttactggcaactcaggtcgtgaagatgattctgaagattgatgatgtcatttctccttcggactattaacgcatttgtggtttttgctgtcttcacttgttggccatggctttctaatggcatgcatggcacagttgtcagtgacgtgagactcctttttactcttagttatagtagggtaatgttgtgtaccttagaattttggctgccattatttaaaatttcagagtgtatggttttttgggaatgatagattattattatttgtgtgaatgtaaaggacgagctcgacataagcctaagccttctcttggttagtctggtttatacatgagcaaagtgacatcgttcaccaactgttttggtgctatcttccattttctcggatttggtatatttattatcaatggatggaggaatgctttgtatg

SEQ ID NO: 1864 - DNA, 1907 bp, Secale cereale
gaggcggcgccagtgctccggcggccatggcgctcgccttcgacgagtacggccggcccttcatcatcctccgggagcaggagaagaagtcgcggctgcaggggctcgacgcgcagaaggccaacatcgccgcgggcaagtccgtcgcgcgcatcctccgcacctccctcgggcccaagggcatggacaagatgctccagtcccccgacggcgacgtcaccatcaccaacgatggggcgacgatcctggagctaatggatgttgacaaccagattgcgaagctcatggtggagttgtcccgcagtcaagactatgacatcggagatggtaccaccggggttgttgtcatggctgggtcgctcctggagcaggctgagaagcttctggaacgtggtattcacccaataaggattgcagaaggttatgagatggcgtcgaggatagctgttgatcaccttgaaagcatctccacgaaatatgagttcagtgctacagacatagagcctttggtgcagacctgcatgacaacattgtcctcaaagattgttagccgttgtaagcgggctctagctgagattgctgtcaaagcagtccttgcggtcgctgatttggaaaggaaggatgtaaatttggacttgattaaggtggaaggtaaggttggtgggaagcttgaggatactgagctagtacaaggaatcattgttgacaaagatatgagccacccccaaatgccaaagagaattgaggatgctcacattgccatactgacctgcccatttgagcccccgaagcctaagacaaagcataaggttgacattgacactgtagagaaattccagacgctgcgtgggcaagagcagaaatacttcgatgacatggttcagaaatgcaaggatgttggtgcaaccctagttatttgccaatgggggtttgatgatgaagccaatcatttactaatgcaaagggagctgccggctgtcagatgggttggtggtgttgaattagaattaattgccattgcgacaggaggtaggattgttccaaggttccaagagttgactaccgaaaagcttgggaaggctggattagtcagagagaagtcatttggaacaacaaaagatcggatgctttacatcgagaagtgtgccaattccaaagctgtaactattttcatccgcggtggcaacaaaatgatgattgaggagaccaagcgaagtatccatgatgctctatgtgttgcaaggaatctgatcatcaacaactcaattgtgtatggtggtggctcagcagaaatatcttgctcaattgctgttgatgctgcagcagatcggcatcctggagtcgagcagtatgcaatcagggcatttgctgatgctttggatgccattccactagctttagctgaaaacagtggtttgccgcctattgatactctcaccgttgtaaaatcccaacatgtcaaggagaacaattcccgctgtggcatcgactgcaatgatgttggtaccaacgacatgaaagagcagaatgttttcgagactctgatcggcaagcagcagcagatcttgctggcaacacaggtggtcaagatgatcctcaagattgatgatgtcataacgccttctgagtattgatgatgccttcaagaatggaaatcgactgtgctaagtggcatgcactccattagtcagcatattttatatgggttgatttggatttgctcctagaattcttacatggagtggtcacttgttttgtttgatgagctatctagttgtgtgacgcgcgttcacattttgtagatcttgagacagtagcacaaatcctgtcgataccagttttagcccttcgttgtgttgttcagatgattaatgctatggttttggaccactaatttgtctgtttta

SEQ ID NO: 1865 - DNA, 2046 bp, Secale cereale
ccgcctcattccctcccaccacagcacccctcctcgtccgatccgcccttccggaggcatctgggagaggcggcgccagtgctccggcggccatggcgctcgccttcgacgagtacggccggcccttcatcatcctccgggagcaggagaagaagtcgcggctgcaggggctcgacgcgcagaaggccaacatcgccgcgggcaagtccgtcgcgcgcatcctccgcacctccctcgggcccaagggcatggacaagatgctccagtcccccgacggcgacgtcaccatcaccaacgatggggcgacgatcttggagctaatggatgttgacaaccagattgcgaagctcatggtggagttgtcccgcagtcaagactatgacatcggagatggtaccaccggggttgttgtcatggctgggtcgctcctggagcaggctgagaagcttctggaacgtggtattcacccaataaggattgcagaaggttatgagatggcgtcgaggatagctgttgatcaccttgaaagcatctccacgaaatatgagttcagtgctacagacatagagcctttggtgcagacctgcatgacaacattgtcctcaaagattgttagccgttgtaagcgggctctagctgagattgctgtcaaagcagtccttgcggtcgctgatttggaaaggaaggatgtaaatttggacttgattaaggtggaaggtaaggttggtgggaagcttgaggatactgagctagtacaaggaatcattgttgacaaagatatgagccacccccaaatgccaaagagaattgaggatgctcacattgccatactgacctgcccatttgagcccccgaagcctaagacaaagcataaggttgacattgacactgtagagaaattccagacgctgcgtgggcaagagcagaaatacttcgatgacatggttcagaaatgcaaggatgttggtgcaaccctagttatttgccaatgggggtttgatgatgaagccaatcatttactaatgcaaagggagctgccggctgtcagatgggttggtggtgttgaattagaattaattgccattgcgacaggaggtaggattgttccaaggttccaagagttgactaccgaaaagcttgggaaggctggattagtcagagagaagtcatttggaacaacaaaagatcggatgctttacatcgagaagtgtgccaattccaaagctgtaactattttcatccgcggtggcaacaaaatgatgattgaggagaccaagcgaagtatccatgatgctctatgtgttgcaaggaatctgatcatcaacaactcaattgtgtatggtggtggctcagcagaaatatcttgctcaattgctgttgatgctgcagcagatcggcatcctggagtcgagcagtatgcaatcagggcatttgctgatgctttggatgccattccactagctttagctgaaaacagtggtttgccgcctattgatactctcaccgttgtaaaatcccaacatgtcaaggagaacaattcccgctgtggcatcgactgcaatgatgttggtaccaacgacatgaaagagcagaatgttttcgagactctgatcggcaagcagcagcagatcttgctggcaacacaggtggtcaagatgatcctcaagattgatgatgtcataacgccttctgagtattgatgatgccttcaagaatggaaatcgactgtgctaagtggcatgcactccattagtcagcatattttatatgggttgatttggatttgctcctagaattcttacatggagtggtcacttgttttgtttgatgagctatctagttgtgtgacgcgcgttcacattttgtagagcttgagacagtagcacaaatcctgtcgataccagttttagcccttcgttgtgttgttcagatgattaatgctatggttttggaccactaatttgtctgttttatcgtaattgtttcattttttttttggtttgctttgtctaaggtatctcaggtaaagttggtgacaaaaaaaaa

SEQ ID NO: 1866 - DNA, 2034 bp, Solanum phureja
gctagggttctgaaagtgttctagattcataaagcaactctctctgtcactgtcgccggagattattatttcccgatctgatcgaaagcaggtcaccgggaacaatggcgttagctttcgatgaattcggaaggccgtttataatactaagggagcaagaacaaaaaactagattaagaggcctcgatgctcagaaggccaacatttctgccggaaaagctgttgcacgtattttacgtacctcacttggtcctaaaggcatggataagatgcttcagagccctgacggcgatgtcaccatcacaaatgatggtgccaccattttggagcagatggatgttgacaatcagattggaaagttgatggttgagttgtcacgaagtcaagattatgaaattggcgatggaaccactggagttgttgtcatggctggggcactgctagaacaagctgagaagttgttagaacgtggtattcatcctatttggattgcagaagggtatgaaatggcttcaaggattgcagttgagcatttggagcgtgtagcacataagtttgaattcggtctgaatgacattgagcctttggttcaaacttgcatgactactttgtcatctaagattgtgaatagatgcaaacgtagcatggctgaaattgctgttaaagctgttttagcagttgctgatttagagaggaaggatgtaaacctggacttgatcaaagttgaagggaaagttggtgggaagttagaggacacagagctaatttatggtattatagttgacaaagatatgagtcatccacagatgccaaagcaaattgaggatgcgaaaattgcaattttgacatgtccttttgagcctcctaagccaaagactaagcataaggttgacattgatactgtggagaagtttcaaactttacgcctacaggagcagaagtactttgatgacatggtccagaagtgcaaggatgttggtgctaccttagttatctgccagtggggttttgatgatgaagctaatcacttattaatgcatagaaatttgcccgctgttagatgggtaggtggtgtggaattggagctgatagcaattgccacaggtgggagaatagtaccaaggtttcaagagttgacatctgaaaaacttggcaaggctggtattgttcgggagaaagctttcggtacaacaaaggatagaatgatttacattgagcattgtgcaaattcaagagcagtaactgtatttatccgtggtggcaacaagatgatgatagaggagacaaaacgtagtatccatgatgctttatgtgttgctagaaatcttattcgcaacaattcaattgtatatggtggtggttcagcagagatttcttgctcaattgctgttgaagcggctgctgataaacatccaggagttgaacagtatgcaatcagggcatttgcagatgctttggattctgtcccaatggcacttgctgagaacagtggtctccagcctattgaaactctatctgctgttaagtctcagcaaattaaggagaataatccctgctgtggaatagattgtaatgatgttggaacaaatgacatgcgtgagcaaaatgtcttcgagactctaattgggaagcaacaacagattttgcttgcaactcaggttgtcaagatgatcctaaagattgatgatgtgattactccttccgcgtattgatgttaagtatggaaatgcaaaattttcttcgtcttagagaagatgaacgttttccttctggctatgcaaaccagaagttttgttgggtgaaactttcacgattttatgctttggcttctatgttgtctatttgagtagaatttttgtggttgatgaatttcacttgattgatgatcagtttctgtcacggtattctccattgaaagattatttgcaccttcatggtatactttatttgcaatgatgtagcaactatattaaaatgattatgtgcctgatggattttattattaaggtaccaccatggaggagcatttagacc

SEQ ID NO: 1867 - DNA, 2142 bp, Triticum aestivum
cccaaaccacagccagggttttgcctgaagccgccagaagttctcaagtggaagcacgaagaagaaagcaccacaaaccctcgcccccgcggcgcgtcctccctccagaaacctaccgccgcctcattctccccccaccacagcacccctcccagtcctcgtccgatccgcccttccggaggtttctgggagaagcggcgccagcgctccggcggccatggcgctcgccttcgacgagtacgggcggcccttcatcatcctccgggagcaggagaagaagtcgcggctgcaggggctcgacgcgcagaaggccaacatcgccgccggcaagtccgtagcgcgcatcctccgcacctccctcgggcccaagggcatggacaagatgctccagtcccccgacggcgacgtcaccatcacaaacgatggggcgacgatcctggagctaatggatgttgacaaccagattgcgaagctcatggtggagttgtcccgcagtcaagactatgacattggagatggtaccaccggggttgtggtcctggctgggtcgctcctggagcaggctgagaagctgctggaacgtggtattcacccaataaggatcgccgaaggttatgagatggcgtcgaggatagctgttgatcaccttgaaagcatctccacgaaatatgagttcagtgctacagacatagagcctttggtgcagacctgcatgacaactttgtcctcaaagattgttagccgttgtaagagggctctagctgagattgctgtcaaagcagtccttgcggtcgctgatttggaaaggaaggatgtaaatttggacttgattaaggtggaaggtaaggttggtgggaagctcgaggatactgagctagtacaaggaatcattgttgacaaagatatgagccacccccaaatgccaaagagaattgaggatgctcacattgccattctgacctgcccatttgagcccccgaagcctaagacaaagcataaggttgacattgacactgtagagaaattccagacactgcgtgggcaagagcagaaatacttcgatgacatggttcagaaatgcaaggatgttggtgcaaccctagttatttgtcaatgggggtttgatgatgaagccaatcacttactaatgcaaagggagctgccggctgtcagatgggttggtggtgttgaattagaattaattgccattgcgacaggagggaggattgttccaaggttccaagagttgactaccgaaaagcttgggaaggctggattagtcagagagaagtcatttggaacaacaaaagatcggatgctatacatcgagaagtgtgccaattccaaagctgtaactattttcatccgtggtggcaacaaaatgatgattgaggagaccaagcgaagtattcatgatgctctatgtgttgcaaggaatctgatcatcaacaactcaattgtgtatggtggtggctcagcagaaatatcttgctcaattgctgttgatgctgcagcagatcggcatcctggagttgagcagtatgcaatcagggcatttgctgatgctttggatgccattccactagctttagctgaaaacagtggtttgccgcctattgatactctcactgtcgtaaaatcccaacatgtcaaggagaacaattcccgctgtggcattgattgcaatgatgttggtaccaacgacatgaaagaacagaatgttttcgagactctgatcggcaagcagcaacagatcttgctggcaacacaggtggtcaagatgatcctcaagattgatgatgtcataacgccttctgagtattgatgacgccttcaagaacggaaatcgactgtgctaagtggcatgcgctccattagtcagcatattttatatgggttgattttgatttgctcctagaattcttacatggagtggtcacttgttttgtttgatgagctatctagttttgtgacgtgcgttcacactttgtagagcttgagacagtagcacaagtcatgtcgataccagtccattcgttgtgttgttcagatgcttaatgtatggttttggaccactaatttgtctgctttatcgtaattgttttattttttgtttgctttgtctaaagtatctcaggtaaa

SEQ ID NO: 1868 - DNA, 2105 bp, Triticum aestivum
ctcgagaccacaaaccctcgcccccgcggcgcctcctccctccccccagaaacataccgccgcctcattccctcccaccacagcacccctcctcgtcctcgtccgatccgcccttccggaagcacctgggaggggcagcgccagcgctccggccgccatggcgctcgccttcgacgagtacggccggcccttcatcatcctccgggagcaggagaagaagtcgcgcctgcaggggctcgacgcgcagaaggccaacatcgccgccggcaagtccgtcgcgcgcatcctccgcacctccctcgggcccaagggcatggacaagatgctccaatcccccgacggcgacgtcaccatcaccaacgatggggcgacgatcctggagctgatggatgttgacaaccagattgcgaagctcatggtggagttgtcccgcagtcaagactatgacattggagatggtaccaccggggttgtggtcctggctgggtcgcttctggagcaggctgagaagctgctggaacgtggtattcacccaataaggattgccgaaggttatgagatggcgtcgaggatagctgttgatcaccttgaaagcatctccacgaaatatgagttcagtgctacagacatagagcctttggtgcagacctgcatgacaactttgtcctcaaagattgttagccgttgtaagcgggctctagctgagattgctgtcaaagcagtccttgcggttgctgatttggaaaggaaagatgtaaatttggacttgattaaggttgaaggtaaggttggtgggaagctcgaggatactgagctagtacaaggaatcattgttgacaaagatatgagccacccccaaatgccaaagagaattgaggatgctcacattgccattctgacctgcccatttgagcccccgaaacctaagacaaagcataaggttgacattgacactgtagagaaattccagacactccgtgggcaagagcagaaatacttcgatgacatggttcagaaatgcaaggatgttggtgcaaccctagttatttgtcaatgggggtttgatgatgaagccaatcatttactcatgcaaagggagctgccggctgtcagatgggttggtggtgttgaattagaattaattgccattgcgacaggagggaggattgttccaaggttccaagagttgactaccgaaaagcttgggaaggctgggttagtcagagagaagtcatttggaacaacaaaagatcggatgctttacatcgagaagtgtgccaattccaaagctgtaactattttcatccgcggtggcaacaaaatgatgattgaagagaccaagcgaagtattcatgatgctctatgtgttgcaaggaatctgatcatcaacaactcaattgtatatggtggtggctcagcagaaatatcttgctcaattgctgttgatgctgcagcagatcgtcatcctggagtcgagcagtatgcaatcagggcatttgctgatgctttggatgccattccactagctttagctgaaaacagtggtttgccgcctattgatactctcaccgtcgtaaaatcccaacatgtcaaggagaacaattcccgctgtggcatcgattgcaatgatgttggtaccaatgacatgaaagagcagaatgttttcgagactctgatcggcaagcagcagcagatcttgctggcaacacaggtggtcaagatgatcctcaagattgatgatgtcataacgccttctgagtattgatgacgccttcaagaacggaatcgactgtgctaagtggcatgcactccattagtcagcatattttatatgggttgatttggatttgctcctagaattcttacatggagtggtcacttgttttgattgacgagctatctagttttgtgacgtgagttcacactttgtagagcttgagacagtagcacatatcctgtcgataccagttttagcccttcgttgtgttgttcggatgcttaatgctatggttttggaccactaatttgtctgctttatcgtaattgtttcatttttttgtttactttgtctaaagtatctcaggtaaagttggtgtgagtcagac

SEQ ID NO: 1869 - DNA, 2069 bp, Prunus mume
aggcttcaactttcgagcagtcaaaatctcaaaacccaaaccctaaagcaaatgctttaaacagagagaagaaggtcctagacctaagaggaagcagagagtgggaagtagaggagaagagaagcgaactgcgattgtgaagttgagagtgtgttggtggaaatggcgctcgcattcgatgagtatgggcggccattcataatactaagggagcaggagcagaagacccgattgagaggcctcgatgctcagaaagccaacatttccgctggcaaagccgttgctcggatcctccggacctctctcggacccaagggcatggacaagatgctccagagtcccgatggtgaagtcaccgtcacaaatgatggcgcaacaattctggagcagatggatgtcgacaatcaaattgcaaagttgatggttgaactatcccagagtcaggactatgaaattggtgatgggacaactggagttgttgtgttggctggtgcacttttagagcacgctgagcggctattggagcgtggtattcaccccatacgggttgcagaaggatatgaaatggcatctagaatagctttcgatcatttgcagcatatatcacagaaatttgaatttgggctggataacatagagcctctagttcgaacttgcatgactactttatcatccaagattgtgaatcggtgcaagcgcgaccttgctgagattgctgtgaaagcagttcttgctgttgcagatttagagaggaaggatgtgaatctagatctgataaaagtagaggggaaagtagggggtaagttggaagatactgagctggtatatggtattcttatcgacaaggatatgagccatccacaaatgccaaagcgaattgaaaatgcaaaaattgctatcttgacttgcccatttgagccaccgaagccaaagacaaaacataaggttgatattgatacagtggaaaagtttcagactttacgtctgcaagaacagaagtactttgacgacatggtccaacaatgcaaggatgtgggtgctaccttggtcatctgtcaatggggatttgatgatgaagcaaatcacctattgatgcacaggaacttgcctgctgtcagatgggttggtggtgtagagttggaactaattgcaatagctacaggcggaagaattgtgcccaggtttcaagaattgacacccgataagctaggaaaggccggtatagttcgtgaaaaatcgtttggcacaacaaaagatcgaatgctgtacattgaacactgtgcaaattcaagggctgtgaccatatttatccgtggaggtaacaaaatgatgatagaggagactaaacgcagcatccatgatgccctgtgtgttgctaggaatctcatccgcaacaactcgattgtctatggtggtggctcagcagagatatcttgctctgttgctgtagaggcagctgctgataaatacccaggagttgaacaatatgccattagagcatttgcagatgctttggattctgtccccatggcacttgcagagaacagtggtcttcaacccattgaaacgctatctgcagtgaaatcccagcagattaaggagaacaatccccactgcggaatagactgcaatgatgttggcactaatgatatgcgtgagcagaacgtgtttgagactttaattgggaagcagcagcaaatcttactggcaacacaagttgtcaagatgatactgaaaatagatgatgttatttctccctctgatatctaaaaagtctgtgcggcttatgcttcgttttacctgggaatgaattttatgtaatttttgtggcttgattcggtattttgaccgacttggaacatattatattctcccttgaggaaacttgtttttagaatctggagtggttttcactggttgtagcatgatcactcctctgccttaatgcattgctgtttttgttgttcaacgtctgaatttttgggctaacttattactgcatcaatttgacatccggtcttaatgtgctgtatttgtctacctttaagttttattttgatggcaaaaat

SEQ ID NO: 1870 - DNA, 2244 bp, Aristolochia fimbriata
tatagcgctctacccgagtgcctccgccgcccttagctccgctcgcccgatccatttccggccatctcgacgccgagaactgtcgttttcttttcattttctttgctctctgattctcatttcttatctcggttaaaggatagggacattttttactgagttgccgtttaaaccctagtagcttctccctcctggtcttcgaccacaatctgttcaacgagtcacattgtcccggcgttagtcccgatcgaagtccgaactagaaatatcagtttccacttgcttctacattttctaaaacctttcaggagtagtccccagactttttccttctggtatcctcactggtggttcttccacttctctccgttcccaaatggcgttggcattcgatgagttcggtcgcccgtacatcatcatcaaagagcaggaacataagagtcgactgaggggtttggatgctcacaaagccaacatatccgcggccaaggccgtggctcgtatcctccgtacctcgctgggacccaagggcatggacaagatgctccagagcccagatggtgatgttaccataacgaatgatggggcaaccatattggagcagatggacgttgataaccacatcgcgaagctaatggtcgagttatcgcgaagccaggattatgaaattggtgatggaacgactggagtagttgttatggcgggtgcacttcttgaacaggctgagaaactactggaacgtggcatccatccgattcgtgtcgctgaaggatatgagatggcttccaggttggcagtggagaacttagagcgtatttctcagaaatttgagtttagttcaacaaacatcgagcccttggttcagacatgcatgaccactttatcttcaaaaattgtgaatcgatgtaagaggagcttagctgagattgctgtcaaagctgttctgtctgttgcagatctagaaaggaaagatgtaaacttggacttgattaaagtggagggaaagttggtggcaagttggaggatacagagcttattgacggaataattgttgacaaagacatgagtcatcctcaaatgcccaagcgaattgaaaatgctaaaattgccattttgacttgtccctttgagccacctaagcctaaaaccaagcataaggttgacattgatacagtggagaagttccagactttacgtctgcaagagcagaaatactttgatgagatggttaaaaaatgcaaggatgttggtgcaaccctagttatatgccaatggggtttcgatgatgaagccaatcatctcttgatgcatcgtgatttgcctgctgttcgatgggttggaggggtagagttggaactcatagctatagctacaggtggaaggatagtgccaagatttcaagagttgaccccggagaagctaggaaaggctgggcttgttcgagaaaaatcctttggaactacaaaggatcgtatgctatatattgagcaatgtgctaattcaagggctgtgacagtattcattcggggaggtaacaaaatgatgatagaagagacaaaacggagcctccatgatgccctttgtgtggcaagaaatctgatccgtaacaattctattgtatatggtggcggatctgctgaaatctcttgctccattgctgttgacgcagctgcagaaagatatcctggggttgaacagtatgccataagggcctttgcggatgctttagattcggtccccatggcattggccgagaacagtgggctccaaccaatagatacactttctgcagtcagggctcagcaaattaaggaggacaatccgatgtacggtatcgattgcaatgatgttggaacaaatgacatgcgcgagcaaaatgtgtttgagaccctcatcgggaagcagcaacagttattgctagctacccaggtcgtaaagatgatactcaagatcgatgatgtgatcagtccgtccgaatactgatgccttttttggtaattagaattgttttttttaatcaaagtgtgaccattattcagaaaagaatgtacggtagtttaccttggctgtcacttggttttcattttgtaaactagtcaatcctttttgagttcaggatccaacacttaaccgatcccattgtggtttttgtatttgaagttttgttagcaactgccctttacagaatgacaaacatgggtttgcctatttgatatgtaaactgagcgtcaacagagtagctct

SEQ ID NO: 1871 - DNA, 2148 bp, Eucalyptus grandis
accgcgcgcgacacttccatctctctccacttctacactcttccgattccatcactctcctctcgacctccgtctccatctccatctccatctccttcgctcgagcaccgggacgagcgcgatcctcggagagagctcgcgagctccggcacccgagtcgtcggcggcgagcggcggcggcggagggagcgagggggggagaaatggcgctggcgttcgacgagttcgggcggcccttcataatactgaaggagcaggagcagaagacgaggctccggggcctcgacgcccagaagaccaacatcgccgccggcaaggccgtcgcccgcatcctgcgcacctcgctcggtcccaagggcatggacaagatgctccagagccccgacggcgaagtcaccatcacaaatgatggcgcaacaattttagagcagatggatgttgacaaccaaatcgcaaaactgatggttgaactatctcgcagtcaagattatgaaattggtgatggcaccactggtgttgttgtcatggctggtgcacttcttgagcaggctgagaagttattggaccgtggaatccatccgattcggattgcagagggatatgaattggcttctaggattgcttttgaacatctagaacgtattgcccagaaatttgagtttggattatcaaacacggagtctcttgtgcaaacttgcatgactactttatcttcaaaaatcgttaaccgttgcaagcgggatttggctgagattgcagttcaagcagttcttgcggtagcagatttagagagaagagatgtgaacttggatttgataaaagtggaaggaaaagtgggagggaagcttgaagacacggagctcatatatggaattactttggacaaggacatgagccacccgcagatgcccaagagaattgaagatgcaaagattgctatcctgacgtgtccatttgagccacctaagccgaagacgaaacataaggtggacatcgatacagttgaaaagtttcagactttacgtgtgcaagagcagaagtatttcgatgacatggttcaaaagtgcaaggatgtgggtgcaaccttggtcatctgtcagtggggatttgatgatgaagcaaatcaccttttaatgcataggaacttacctgctgtccgctgggttggaggtgtggagttagagctcatagccatagccacaggcggaagaattgtgccaagattccaagagttgactccagagaagctgggaaaggctggactggtgcgagaaaaatcatttggtactacaaaggatcggatgctgtacattgagcattgtgcaaattcaagggctgttaccgttttcattcgaggaggtaacaagatgatgatagaggagactaagcgcagcatccatgatgcactttgtgtggccaggaatctcatacgcaataattctattgtgtatggtggtggttcagctgaaatctcatgctcaattgccgttgaggcagctgcagatagatatcctggtgtcgaacagtatgcaatcagaggattcgcggatgccttggatgcaattcccatggcactagctgagaatagtggtctacaacctattgagacattatctgctgttaaatctcaacaaattaaggagaacaatccattctgtggaattgattgcaatgacgtcggaaccaatgacatgtgcgagcaaaatgtctttgaggctttgattgggaagcaacagcagatcttgctggcaactcaagtggtcaaaatgattctgaaaattgacgatgtcatttcaccatccgacttctgatattaggtgcaaccattcccaagacggagcttattgtttttggcttgccgtgatgtgtggagtgtcattctggacactgcactttttgtcgttgattgctgatggtttgcaaattttcaactgtgtttaattgaacatatgtatgttttggtccattccggagtagtggattattctgccaccatgcatctttcctttctggtcgatcctttgttagaaatgattggaccctctaaagtatttgtttgaggtggggtaagaaccatttttgtaacaagccatcacggattaagatataagaaggttgaagttgccagttttagcaatgattccggcc

SEQ ID NO: 1872 - DNA, 2077 bp, Elaeis guineensis
ctggggccggagctcctggacgagaaatataatgaggtctcctcttttctggaacttaccactgcttccgcccactctcttcccccttgcggcggtcggtgttcctcttctccgttccaggttggaggaggaggacgagaatggcgttggcgttcgacgagtatgggaggccgttcatcatcctaaaggagcaggagcggaagagccggttgaggggcttggaggctcagaaggccaacatctcggccgggaaggccgtcgctcggatcctccgcacctccctcggtcctaagggcatggacaagatgctccagagccccgacggcgatgtcaccatcacaaatgatggggcaacaatcttggagcagatggacgttaacaaccagattgcaaagttgatggtggaattgtcccggagtcaggactgtgaaattggtgatggcaccacaggagttgttgttgtggctggtgcacttctagaacaggctgagaagcttctggaacgtggcattcatcctattaggattgcagagggttatgagatggcctctaggatagctgtggagcatcttgagcgaatatctcagaaatttgaattcagtgttagtaatattgaacctttggtgcagacctgcatgaccacattgtcttcaaagattgttaatcgatgcaagcgtatgctagctgagattgctgttaaggcggttctggcagttgcagatctcgaaaggaaggatgtaaaccttgatttgattaaaatagaaggaaaggttggaggtaagttggaagataccgagctcatctatggaataactgttgacaaggagatgagccaccctcagatgccaaagagaattgaagatgcgaaaattgctattctgacttgcccatttgaaccaccgaagccaaagacaaagcataaggttgacattgacactgtggagaaatttcagaccttacgtcagcaagagcagaagtactttgatgatatggttcaaaaatgcaaggatgttggagcaaccctcattatttgtcaatggggttttgatgatgaagcaaatcatcttttgatgcatcggaatttgcctgctgtcagatgggttggtggtgttgagttggaattgattgccattgctacaggtggaagaatagttcccagattccaagaactgacacctgaaaagctgggaagggctggactagttagagaaaaatcatttggaacaacgaaggatcggatgttgtatattgaacaatgcgcaaactcaagggctgtgaccatattcattcgtggtggtaacaaaatggtgatagaggaaactaagcgtagtcttcatgatgcgctatgtgtggcaaggaatctgatccgtaacaattccattgtttatggtggtggttcagctgagatatcttgctcgatcgccgtagaagccgctgcagatagataccctggagtcgagcaatatgctatcaggtcctttgctgaagctttagattctattccgatggctctggcagagaacagtggtctccaacttattgatactctcactgcagtcaaatctcagcaaatcaaggagaacaatccatattgtggcatagattgtaatgatgttgggacgaacaacatgcaagagcaaaatgtatttgagacgctgatcggcaagcagcagcagatcttgcttgcaacacaggtggtgaaaatgattttgaaaattgacgacgtgatcaccccttctgattattgattgtatttgagaggccaaaatttgtggcagagttatgcgttcatgagaatccatttagctatgtggaagagaaagttacagttgttagatgagtttggtgtctgaatctgttattcattttttgctttgggtgcaacttttgtgctgaggttatgatttgtagatggagttgtgactcaaaatttttctattgcgtttttggtggtttatttaactgatgttaaagccatctttgttttctactcagattctcgtatgagcttatcatgggattgtttgtaactacgaactggaggaagatatatggcacggcaagtagtatttaaatt

SEQ ID NO: 1873 - DNA, 1981 bp, Arachis hypogaea
gagggttagggctttttttcctccaaaaacggagagagaaacacaagaaccaccaaaagcaacttcacacacacacacacagagtaaccttctgcactgttcgcgtctcttcactctctccgccaaatctcgaagattcaaagaagatcgtgtgagagagagagagagagttgagaaatggcgctggctttcgacgagttcgggaggccgttcattatactgaaggagcaagaacagaagagcagactgagaggactcgatgcacagaaggccaacatctccgccggcaaagccgtcgcccgcatccttcgcacctcccttggccctaaaggcatggacaagatgctccagagccccgacggcgacgtcatcatcacgaatgatggagcaacaatcttggagcagatggatgttgacaaccagattgctaaactgatggttgagctgtcccggagtcaggattatgaaattggggatggaactactggagttgttgttatggctggagctcttctggagcaagctgagcggctcttggaacgtggaattcatccaattagggttgccgagggctatgaaatggcatcgaggattgctgttgaccacctggagaatattgctaaaaagtttgaatttgggcctacggatttggagcctttgattcaaacttgtatgactactttgtcctctaaaattgtgaatcggtgcaagcgcagcttggctgagattgctgtcaaagctgttcttgctgttgctgatctagaaaggaaagatgttaacttagatctaattaaagtagaagggaaagttggtggtaaattggaggatactgagttaatatatggaattgttgttgacaaggatatgagccatccacaaatgccaaagcgaattgaagatgctaaaattgcaatcttgacttgcccctttgagcctccaaagccaaagactaagcataaggtggacattgataccgttgagaagttccagacattaaggaaacaagagcaacagtattttgatgacatggttcaaaaatgcaaggatgttggtgcaaccctggttatctgccagtggggctttgacgatgaagcaaatcatctcttaatgcacaggaacttgcctgctgtcagatgggttggtggtgtagagttggaattgatcgcaattgcaacaggtggaagaattgtgcctaggttccaagagttgagtcctgaaaagctgggaaaggctggtgtggttcgtgaaaaatcctttggtacaacaaaagaccggatgctgtacattgagcattgtgcaaactcgagggctgtgacaatattcactcgtggaggtaacaaaatgatcatagaggagacaaagcgcagtcttcatgatgccttgtgtgtagctaggaatctcatccgcaacaattctatagtatatggtggtggttctgctgaaatttcctgctctattgctgtggaagctgctgctgatagataccctggagtagagcagtatgctatcagagcatttggagatgcattggaggccattccgatggcccttgctgaaaatagcggccttcaacctattgaaacgttatctgctgtgaagtcccagcaaataaaggacaataatcctaactttggcatcgactgcaatgatgttggcaccaatgacatgcgtgagcaaaacgtatttgaaactttgattggaaagcagcaacagatcttgcttgctactcaagttgtcaagatgattttgaaaattgatgatgttatttccccatcagagttctgaaactaaagttttcaactgatgttttccacatcaagatcatggattgctgatagttttgttttttatttggtattagtcagagttggtatgttcacagtttacctgttaagaatttaagaatttgacatgattttatattcgagttgagtgacttattctgtttgatgcatttatgtcatattaactagcggttcaa

SEQ ID NO: 1874 - DNA, 1844 bp, Phalaenopsis aphrodite
tgcgatcacttcactccctctcctgcttcctcctcgtcgttgtgcgggagggtaacgctgaagcagctcgatggcgctggcgttcgacgagtatggccgacctttcatcatcattaaagagcaggaacagaaaaggcggttgcggggacttgacgcgcagaaggccaacatcaatgccggcaaagccgttgcacgtatcctccgcacctccctcggccctaaaggcatggacaagatgcttcagagcccggatggtgatgtcaccatcacaaatgatggtgcgacaatattggagcagatggacgtggacaatcagatagcaaagctaatggtagaattgtcccggagtcaagactatgaaattggtgatggtactactggggttgttgtaatggctggtgcacttttagagcaagctgagaagctgcttgaacgtggcattcatcccgtcagagttgcagagggatatgaaatggcatcacggatagctgttgaacaccttgagcgcattgcacacaaatttgatttcagtgtgaccaatattgaacctcttgtgcaaacttgcatgacaacattatcatcaaagatagtcaatcgttgcaagaaaagtttagcagaaatagctgttaaagctgtactagcagttgcagatttagagagaaaagatgtcaatttggatctgattaaggtggaaggaaaagttggaggaaagctggaagatactgaacttatatatggaatcattgttgacaaggatatgagccatcctcagatgcccaaaagaattgaagatgcaaaaattgctattttgacctgcccatttgagccacccaagccaaagacaaagcataaggtggacattgacactgtggagaagtttcagactttaagacagcaagagcttaagtattttgatgacatggtccaaaaatgtaaggatgttggtgctactctggtgatttgtcaatggggttttgatgatgaggcaaatcacttattgatgcatcgcaacttgcctgctgttagatgggttggaggtgtagaattagaactgattgcaattgctacaggtggcaggattgttcctagattccaggagttgacaccagaaaagctgggaagggctggtctagttagagaaaagtcatttgggactacgaaggaccggatgttatatattgagcaatgtgcaaactccagagctgtgacaatattcattcgaggaggtaataaaatgatgatcgaggaaacaaagcgcagtctccatgatgcactttgtgtagcaaggaatctcattcgtaacaattccattgtatatggcggtggatctgctgaaatttcttgttcgattgctgttgatgctgctgcatatagatatccaggagtggagcagtatgcaattagatcctttgctgaagctctagatttaatcccaatggctcttgcggagaacagtggcctccaacctatagaaacggtgtccgcggtaaaatctcagcaaattaaggagaatactcctttctgtggcatcgactgcaatgatgttggtacgaacaacatgcaagaacaaaacgtctttgagacactgattgggaaacagcagcagatcttacttgcaacgcaggttgtcaagatgattctcaagattgatgatgtgatttctccttccgagtactaaccaaaccaaaaattttcctgcgtttcttcccgtttcatggctttccttatgttgctgtagtcttatttctgtgcggcctgcaagaattgtcttattgttacatttattttacattgttttggagaatgtgttatgctcatctcaaactaagcaagaatttcttttt

SEQ ID NO: 1875 - DNA, 2256 bp, Mimulus guttatus
attacggtactcccactctcactagggcaacttctccgccctcgaacccactctcaggcactctctcacttacatttcccagtcggatccagttgaggatccgattaacccgacccgtattcggcccgatggcgttggctttcgatgaatatggccggccgttcatcatactgagggagcaggaccagaaaaccagattgcggggcctcgatgcgcagaaggagaacattgccgccggtaaagcggtggctcggatcctccggacctcgctcggacccaaaggcatggataagatgcttcagagccccgacggcgacgtcaccatcacaaatgatggtgcaacgatcttggagctgatggatgttgacaatcagattggtaaactcatggttgaactttcacggagtcaagattatgaaattggtgatggaacaactggagttgttgtcatggctggttcacttctagaacaagcagaaaagctattagaacgtggaattcaccctattcgaattgcagaaggatatgagatggcttccaggatagcttttgagcatttggagcgtatatcacataagtttgagtttactgaagcagacatggaacctctgattcagccttgtatgactactttatcatccaagattgtgaataggtgcaagcgtgctatggctgagattgcagttaaagcggtccttgctgttgcagatttagagagaaaggatgttaatcttgacctaattaaagtagagggaaaagtaggaggaaagttggaggatactgaactaatttatggtattgtggttgacaaagatatgagtcacccacagatgccaaagcaaatcgaggatgccaaaattgccattttgacttgtccctttgagcctccgaagccaaagactaaacataaggttgacattgatacagtggaaaaattccaaacattacgtgaacaagagaggaaatactttgatgatatggtacaaaaatgcaaggatgttggggctaccttggttatctgccaatggggtttcgatgatgaggcgaaccacttattaatgcatagagagttacctgctgttcgatgggttggaggcgtggagctagaactgatagccatagctacaggagggagaatcgtgccaaggtttcaagagttgacgactgataaactaggcaaggctggaatagtacgagaaaaagcatttggaaccactaaagatcggatgatatatattgagcactgtgcaaattcaagggctgtgactatatttatacggggcgggaacaagatgatgatagaggaaaccaagcgcagcatacatgatgctttatgcgttgctaggaatcttattcgcaacaattctatagtatacggtggtggctctgctgaaatttcttgctcaatcgctgtcgaagcagctgcagataaacacccaggagttgagcagtatgcaattagggcatttgcagatgcattagatgctattccaatggctctggcagaaaatagtggtctccagccgatcgaaactttatctgccgttaaagctcaacaaattaaggaaaataactcgtgctgcggcatagactgcaacgacgtcggcacaaatgacatgcgtgagcagaatgttttcgagactttgataggaaaacagcagcagattctgctagcaacgcaagttgtgaagatgattctaaaaatcgacgacgtcatctcaccctctgattattgagtttttttgttttgttttcgataatcagacgcttgattgaaacaatttttgctgtctagaattgtgccgactatctatatcattttcttttgctgaaatggtagactcttaatatttttgagcttatgtggtgctactccctactaagtttatttgtaatggcttcattgattgtgtgtttgatagattttgatagcattatttttcattctggtaacaactctctctctctctctctcaaacaaacacacatgtacagtatggcctcgtttggttggcaagataagattagccaagataagattaaataatctaatgagacccaattattttattggagcttgaaaggtgcaacaaaaaaaactcaataaaagccaagataagccaagataaggcaagataagccatgattatataattttggcgggtcgacccggcaagttattgaggataccaaacatcaaattaagtccaactatttagttaatcttagcttatcttggcaaccaaacggggccta

SEQ ID NO: 1876 - DNA, 1935 bp, Amorphophallus konjac
ctagtgtctagcttcctctctgcctctctctagctttcttcgcctcctgcttcggcagcgtcggctgtggtgctggaggcggcggctgcgatcgcgagagggaggtattcgccatggcgctggcgttcgatgagtacgggcggcccttcatcatactgagggagcaggagcagaagacgcggctgcggggcctcgaggcccagaaggccaacatagccgccggcaaggccgtcgcccgcatcctccgcacctccctcgggcccaagggcatggacaagatgctccagtcccccgatggcgacgtcaccatcacgaatgatggggcgacgattctggaacagatggacgtcgacaatcagattgcaaagctgatggttgagttgtctcggagtcaggactatgagattggagatggtacgaccggggttgttgttttggctggtgcgctcctggagcagtctgagaaacttctggaacgtgggattcacccgatcagggtagccgagggctatgagatggcatccaggattgctgtggagcatttggaaaagatctctcagaagtttgagttcagtgtaacaaatatagagcctttagtgcagacttgttctactactttgtcttcaaaaattgtaagtcgacaaaagcacgatttagctggaattgctgttgaagcagttctagcagttgctgatttagagaggaaggacgtcaacttggatttaatcaaagtagaaggaaaggtaggaggaaaattggaagacacggagctaatccgtggaattgttgtagacaaggatatgagccatcctcagatgccaaagcgaattgaggatgccaaaattgctatattgacttgtccatttgagccaccaaagcctaagacaaagcataaggttgatattgacactgtggagaagtttcagactttgcgtcaacaggagcagaagtattttgatgacatggttcagaaatgcaaagatgttggtgcaacccttgtaatatgtcaatggggtttcgatgatgaagctaatcatttattgatgcatcggaacttgcctgcagttagatgggttggtggtgtggaactagagctaattgcaatagctacaggaggaaggattgtcccaaggttccaggagttgacaccagaaaagcttggaagggctggtctagttagagaaaaatcttttggcacgaccaaggatcggatgctatatattgaacaatgtgcaaactcgagggctgtcacaatatttattcgtggaggtaacaaaatgatgattgaggagaccaaacgcagcatccatgatgccctttgtgtggcaaggaacctgatccgtaacaactctattgtatatggtggtggctcagctgagatatcttgttcgattgctgtagaagcagctgctgatagatatcctggtgttgagcagtatgctattaggtcctttgccgaggctttggattctattccaatggcactagccgaaaacagtggtctccagcctattgacactttaactgcagtcaagtctcagcaaatcaaggagaagaatccctactgtggcatagactgcaacgatgttgggacaaatgacatgagagagcaagatgtgtttgaaacactgatcggaaaacaacagcaggtactgcttgcgacccaagttgtgaagatgatattgaaaattgacgacgtgatcacaccatctgatttctgatgtcaatgggtatatttttggattcatttagtttatgttctcatagaacttcatgatcatctggtcatctctttttgtggtggtggtgttgtaggatttttggcacgttgtttgacatgtaatttttccttgaaagctgagcatagaattccaaactcctgtttcatggatttgcaatcgcatccctttaactgaagtgtactattagttttgc

SEQ ID NO: 1877 - DNA, 1896 bp, Catharanthus roseus
gaacttctttctgcaaggttctagaccagagtgagcccattgggggagagggagagagttgtagaaattatctctttcattttctgtttggcagtcatttggatctgatcttcgagaaatggcgttagctttcgatgaatttggtcgcccattcataataataagggaacaagagcagaagactcggttgcgcggcctcgatgctcagaaagctaacatatcagccggcaaggcggttgctcgtattctacggacctctcttggacctaaagggatggataagatgctacagagccccgacggcgacgtcacaatcacaaatgatggtgctacaatcttggagcaaatggatgtcgacaatcaaattgcaaagctgatggttgaattatcacgaagtcaagattatgaaattggtgatgggacgactggtgttgttgtcatggctggtgctcttctggaacaggctgagagattacttgaacgcggaattcatcctattcgtattgctgaaggatatgaagtagcttcaagaatagcttttgaacatctggagcgtatagctcataagtatgaatttgatgcggcaaatccagagcctctgattcaaacttgtatgacaactttatcatccaagattgtgaatagatgcaaacgcagtttggcagagattgctgtcaaagcagttctggcagttgctgatttagagcgaaaggatgtcaatttggatttaatcaaagtggagggtaaagtaggtggaaagttggaggatacggagctaatatatggcattgttgttgacaaagatatgagtcatccacagatgccaaaggagataaaggatgctaatattgccatcttgacttgtccttttgaaccacctaagccaaagaccaagcataaggttgacattgacacagtggagaaattccaaacattaagagatcaagagcaaaagtattttgatgacatggttcaaaaatgcaaggatgtaggagctaccttggttatctgtcaatggggttttgatgatgaggcaaatcatctgctaatgcacagaaatctacctgctgtccgatgggttggaggtgttgagctagagctgatagcaattgccacaggtggaagaatcgtgccaaggtttcaagagttgactccagaaaagctaggcagagctggtttagttagagaaaaatcatttggtaccactaaagataggatgatctacattgagcattgtgcaaattcaagagctgtcactattttcattcgtggtggtaacaagatgatgattgaggaaacaaagcgcagcatccatgatgccctctgtgtagctaggaacctcatccgcaataattctattgtatatggtggtggttctgctgagatttcttgctcggttgctgtggaggctgctgcagataaatatcctggtgttgagcagtatgcaatccgggcatttgcagatgctttggactctatccccatggcacttgccgagaacagtggcctccaaccaattgagactctatcagctgtgaaatcccagcaaattaaggagaataatccatgctgtgggattgattgcaatgacgttgggacgaatgacatgcgcgagcaaaatgtctttgagactttaatcgggaagcagcagcagatattgctcgcaacacaagttgtgaagatgatcctcaagattgatgatgtgatctcgccatcagagtactaatttagttaaatcattcgtgccgcatttttcctcggcagcagatgtgcaaaaatgaatgtttgcctcaagaaatgacttggccactaggttatcatgtcataacatcatttctttgtagtgtgtgatcaacatttttgtgtccttgtaatggattagtttatggtctctca

SEQ ID NO: 1878 - DNA, 1977 bp, Flaveria ramosissima
ggatactccagaagcacacacacacactgtgtgccgatcgcactgttgttttcttatcatttcatcgatctaaaaccttaatctggtgtaagatctgcaacaatggcgttagccttcgatgaatacggtcggccgttcattatactgagggaacaagagagtaagagcagattaaggggtttagatgcccaaaaagccaacatcgccgctggtgttgctgtatctcgaatcctccgtacgtctcttggccctaaaggcatggataagatgcttcagagccccgacggcgacattaccatcactaatgatggtgcaacaatcttggagcaaatggacgttgacaatcaaatagggaaactcatggttgaactgtcacgtagtcaagattatgaaattggtgatgggactactggtgttgttgttatggctggtgcactcttagaacaagcagagaagcttttagaacgtggaattcatcccattcgagttgcagaaggatttgaaatttcttcaaggattgctgttgatcacttggaaaagatagcacataagtttgatttcagtgctacaaatatagaaccattggttcagacttgcatgactaccctgtcctccaaaattgtgaatcgatgcaagcgtagcttggctgagattgctgtaaagagtgtcatggctgttgctgatttagagagaaaagatgttaatcttgacttgattaaagtggagggaaaggttggtgggaaattagaggatacagaacttatttatggaattattgttgataaagatatgagccacccccaaatgccgaagcaaattgaagatgcaaaaattgctattttgacttgcccatttgagccaccaaagcctaagaccaaacataaggtcgacattgatacagttgaaaagtttcagactttaaggaagcaagaacagaagtactttgatgacatggttcagaaatgcaaggacgtaggtgccacgctggtaatttgtcaatggggctttgatgatgaagcaaatcacttattaatgcacagaaatctgccagctgtcagatgggttggtggtgtagaactggagctaatagcaatagctactggtggtagaattgttcccaggttccaggaactaacacctgaaaaactaggaaaggctggtttggttagggagaaggcatttggtaccacaaaagatcgaatgctttatattgagcactgtgcaaactcaaaggctgtaaccattttcattcgtggaggtaacaagatgatgatagaggagacaaaacgcagcatccatgatgcattgtgtgttgctagaaatctcattcgtaataactcgattgtttatggtggtggggctgcagaaatctcatgctcaattgcagttgaagctgctgctgataaatatccaggcgttgaacagtatgccatcagggcttttgcagacgccttggattctgtacccatggctcttgcagagaatagtggtctgcagcccattgaaactctatctgcagtgaaagcacaacaaattaaggaaaacaatccttgctgtggcattgactgcaacgatactggtacgaatgatatgcgtgagcaaaacgtatttgaaaccttaattggcaagcaacagcagatcttgcttgccacacaagtcgtgaaaatgatcttgaagatcgatgatgtcatctccccatcagactactgacagcatagcttctaccaaccttcaagttttgctcagctgtagaacactgcaaccaattaagtgttgaaaaacctagttttgtttgtactctgtttattcgtcttgctgtcaattgtttggtgtttgtgtcgtcttaactctttatgcgtacaattcttgtgtggcatctcatgtttctgtaatttttgttcctatttatgtatcacgtcttttgttagtaatacttatttgttaaactatagctagttggtagttcgactactgtta

SEQ ID NO: 1879 - DNA, 1865 bp, Flaveria ramosissima
gtgccgatcgcactgttgttttctcatcatttcatcgatctaaaccttaatctgttgaaagatctgcaacaatggcgttagccttcgatgaatacggtcggccgttcataatactgagggaacaagagagtaagagcagattaaggggtttagatgcccaaaaagccaacatcgccgccggtgttgctgtatctcgaatcctccgtacgtctcttggccctaaaggcatggataagatgctccagagccccgacggcgacattaccatcactaatgacggtgcaacaatcttggagcaaatggacgttgacaatcaaatcgggaaactcatggttgaactgtcacgtagtcaagattatgaaattggtgatggaactactggtgttgttgttatggctggtgcacttttagaacaagcagagaagcttttagaacgtggaattcatcccattcgagttgcagaaggatttgaaatttcttcaaggattgctgttgatcacttggaaaaaatagcacataagtttgatttcagtgctacaaatatagaaccgttggttcaaacttgcatgactaccctgtcctccaaaattgtgaatcgatgcaagcgtagcttggctgagattgctgtaaaaagtgtcatggctgttgctgatttagagagaaaagatgttaatcttgacttgattaaagtggagggaaaggttggtgggaaattagaggatacagaacttatttatggaattattgttgataaagatatgagtcacccacaaatgccaaagcaaattgaagatgcaaaaattgctattttgacttgcccatttgagccaccaaagcctaagaccaaacataaggtcgacattgatacagttgaaaagtttcaaactttaaggaagcaagaacagaagtactttgatgacatggttcagaaatgcaaggacgtaggtgcaacgctggtaatttgtcaatggggctttgatgatgaagcaaatcacttattaatgcacagaaatctgccagctgtcagatgggttggtggtgtagaactggagctaatagcaatagctactggtggtagaattgttcccaggttccaggaactaacacctgaaaaactaggaaaggctggtttggttagggaaaaggcatttggtaccacaaaagatcgaatgctttatattgagcactgtgcaaactcaaaggctgtaaccattttcattcgtggaggtaacaagatgatgatagaggagacaaaacgcagcatccatgatgcattatgtgttgctagaaatctcattcgtaataactcgattgtttatggtggcggggctgcagaaatctcatgctcaattgcagttgaagctgctgctgataaatatccaggcgttgaacagtatgccatcagggcttttgcagacgccttggattctgtacccatggctcttgcagagaatagtggtctgcagcccattgaaactctatctgcagtgaaagcacaacaaattaaggaaaacaatccttgctgtggcatcgactgcaacgatactggtacgaatgatatgcgtgagcaaaacgtatttgaaaccttaattggcaagcaacagcagatcttgcttgccactcaagtcgtgaaaatgatcttgaagatcgatgatgtcatctccccatccgactactgacatcatagcttctacccgccttcaagttttgctcaactgtagaacattgcaaccatttaagtgttgaaaaacctagttttgtttgtactctgtttatttgtcttgccgtcaattgtttggtgtttgtgtcgtcttaactctttatgcgtaaaattcttgtgtggcttctcatgttttcgtaatttt

SEQ ID NO: 1880 - DNA, 1943 bp, Mimulus guttatus
actcccactctcactagggcaacttctccgccctcgaacccactctcaggcactctctcacttacatttcccagtcggatccagttgaggatccgattaacccgacccgtattcggcccgatggcgttggctttcgatgaatatggccggccgttcatcatactgagggagcaggaccagaaaaccagattgcggggcctcgatgcgcagaaggagaacattgccgccggtaaagcggtggctcggatcctccggacctcgctcggacccaaaggcatggataagatgcttcagagccccgacggcgacgtcaccatcacaaatgatggtgcaacgatcttggagctgatggatgttgacaatcagattggtaaactcatggttgaactttcacggagtcaagattatgaaattggtgatggaacaactggagttgttgtcatggctggttcacttctagaacaagcagaaaagctattagaacgtggaattcaccctattcgaattgcagaaggatatgagatggcttccaggatagcttttgagcatttggagcgtatatcacataagtttgagtttactgaagcagacatggaacctctgattcagccttgtatgactactttatcatccaagattgtgaataggtgcaagcgtgctatggctgagattgcagttaaagcggtccttgctgttgcagatttagagagaaaggatgttaatcttgacctaattaaagtagagggaaaagtaggaggaaagttggaggatactgaactaatttatggtattgtggttgacaaagatatgagtcacccacagatgccaaagcaaatcgaggatgccaaaattgccattttgacttgtccctttgagcctccgaagccaaagactaaacataaggttgacattgatacagtggaaaaattccaaacattacgtgaacaagagaggaaatactttgatgatatggtacaaaaatgcaaggatgttggggctaccttggttatctgccaatggggtttcgatgatgaggcgaaccacttattaatgcatagagagttacctgctgttcgatgggttggaggcgtggagctagaactgatagccatagctacaggagggagaatcgtgccaaggtttcaagagttgacgactgataaactaggcaaggctggaatagtacgagaaaaagcatttggaaccactaaagatcggatgatatatattgagcactgtgcaaattcaagggctgtgactatatttatacggggcgggaacaagatgatgatagaggaaaccaagcgcagcatacatgatgctttatgcgttgctaggaatcttattcgcaacaattctatagtatacggtggtggctctgctgaaatttcttgctcaatcgctgtcgaagcagctgcagataaacacccaggagttgagcagtatgcaattagggcatttgcagatgcattagatgctattccaatggctctggcagaaaatagtggtctccagccgatcgaaactttatctgccgttaaagctcaacaaattaaggaaaataactcgtgctgcggcatagactgcaacgacgtcggcacaaatgacatgcgtgagcagaatgttttcgagactttgataggaaaacagcagcagattctgctagcaacgcaagttgtgaagatgattctaaaaatcgacgacgtcatctcaccctctgattattgagtttttttgttttgttttcgataatcagacgcttgattgaaacaatttttgctgtctagaattgtgccgactatctatatcattttcttttgctgaaatggtagactcttaatatttttgagcttatgtggtgctactccctactaagtttatttgtaatggcttcattgattgtgtgtttgatagattttgatagcattatttttcattctggt

SEQ ID NO: 1881 - DNA, 1959 bp, Quercus alba
gttagggctttttcaaaaaccccttgattcttctcagagcttctacacgctctctttcactcttttgctttgcatttttggttgagagatctggtacaaccgtgaagtgaaaccaaaaatggcgctcgctttcgacgagttcgggaggccattcataatcatcaaagagcaagagcagaagacgaggctgagaggactcgaagctcagaaggccaacatttccgccggaaaagccatcgctcgcatcctcaaaacctcgctcggtcccaaaggcatggacaagatgctccagagccccgacggcgacgtcactatcaccaacgatggtgcaacaatcttggagcagatggatgttgacaatcaaattgcaaagctgatggttgagttatctcggagtcaggattatgagattggtgatggcaccactggagttgttgtcatggctggtgcacttttagagcaggctgagctgcttttagaacgtggtattcatcccattcggattgcagagggttatgaaatggcctctaggatagcttttgagcatatggagaagatagctcagaagtttgattatggagtttcaaattttgagcctttggttcaaacttgcatgactactttatcctcgaagattgtcaatcgatgcaagcgcaatttggctgagattgctgtcaaagcagttcttgctgtggctgatttagagaggaaggatgttaacttagatttgataaaagttgaggggaaagtaggggggaagttggaggatactgagctaatctacggaattttggttgacaaggatatgagccatccacagatgccaaagcaaatagaagatgcaaaaattgctatcttgacttgcccctttgagccaccaaagccaaagactaaacataaggttgacattgatacggtagaaaagttccagaatttacggcagcaagagcacaagtattttgatgatatggttcaacaatgcaaggatgttggtgctaccttggttatctgccaatggggttttgatgatgaagcgaatcatttattgatgcacaggaacttgcctgctgtcagatgggttggtggtgtggagttagaactgatagcaatagccacgggtggaagaattgtgccaaggttccaagagttgactcctgaaaagttaggaaaggctggtttggttcgagaaaaagcgtttggtacaacaaaagatcggatgctatacattgaacattgtgcaaactcaagggctgtaaccatatttattcgtggaggtaacaaaatgatgatagaggagacaaagcgcagtatccatgatgccttgtgtgttgctaggaatctcattcgcaacaatagaattgtgtatggtggtggctcagctgagatttcttgctcaattgctgtggaggcagctgcagatagacacccaggagttgagcagtatgccatcagagcatttgcggatgctttggatgctgtacccatggcacttgcagagaatagtggcctccaacccattgaaacactatctgctgtgaagtcgcagcaaatcaaggagaacaatccctactgtgggatagattgcaatgatgttggcactaacgacatgcgtgagcaaaatgtgtttgagactctgattgggaagcagcagcagctcctgctggcaactcaagttgtcaagatgattttgaaaattgacgacgttatctcaccttctgaatattgatatgtccgggactaagatctatagttctgcttcacttgagctcatagtatcttgttagcttgattttgtgtattgagtgactccggagaccatatgaaacatgttgcttataaattttggagtgcctttgattgatattgtagtatgatttctcgtgtttaatatgttgttgattttgttgttatcctttgaaatgaaaatgatggctatttaccctgtgatctttagggtat

SEQ ID NO: 1882 - DNA, 1999 bp, Plantago ovata
aaaccagttcccaaatctccatttcccatctcaaatcggatcagtcacactgcgaagagatcctagttcctgcaacttatagttgcaaccatggcgttggctttcgacgaattcggtcggcctttcattataatacgggagcaggagcagaaatccagattgcgtggcctcgatgcacagaaggccaacatttccgccggcaaagctgttgctcggatcctccgtacctccctcggacccaagggcatggataagatacttcagagccccgacggtgacgtcaccatcacaaatgatggtgcgactatattggatctgatggacgtggacaatcaaattgctaagctcatggtagaattgtcacggagtcaagactacgaaattggtgatggaacaactggagtagttgtaatggctggtgcacttctagaacaagctgaaaagctacttgaacgtggaattcatcctattcgggttgcagaaggctatgaaatggcttcacggatagcttttgaacatttggagcgtattgctcacaagtttgaatttggaggcacaaatactgaaccattgattcagacttgcatgactactctatcctccaagattgtcaataggtgcaagcgaagtatggcagagattgcagttaaagcagtgcttgctgttgctgatttggagaggagggatgtgaacttggacttgatcaaagtggaagggaaagtgggtgggaagttggaggacactgaactgatatatgggatcgtggttgacaaagatatgagtcaccctcagatgccgaagcaaattgaggatgcgaaaattgcaattttgacctgtccttttgaacctccgaagccaaagaccaagcataaggttgatattgacagcgtggagaagttccaaacattacgtcaccaggagcagaaatatttcgatgacatggttcagcaatgcaaggatgttggagctaccttagttatctgccaatggggctttgatgatgaagctaaccatttattgatgcatagaaatttgcctgctgtcaggtgggttggaggtgtagagttggagttgattgccatagctacaggtgggagaattgtaccgagatttcaggaattgacatcagagaaacttggcaaagctggtttggtccgagaaaaagcatttggcacgactaaagaccgaatgatatatattgagcactgtgcaaattcaagggctgtaacaatattcatacgtggtggtaacaagatgatgatagaagagacgaagcgcagccttcacgatgctctatgtgttgctcggaacctcatccgcaacaactcaatcgtttatggtggtggttcagcggaaatctcttgctcattagccgttgaagcagccgctgacaagcacccgggagttgagcagtatgctattagggcattcgcagatgcgttagattctatcccgatggcactggcagaaaatagtggcctccagcctatagagactctgtctgctgttaaaagtcaacaaattaaggaaaacaacccatgctgtggtatcgattgcaatgatgttgggacgaatgacatgcgcgagcaaaatgttttcgagactttgatcgggaaacaacagcagattctgttggcaactcaagttgtgaagatgattcttaaaatcgatgatgtgatttctccatctgagtattaataatcatcaggtatcagctttttgctttaggaattgttttcaattgtgtacggtcccgaaaagtgtttgattctcaacatttggaccaatttgctaaatctgtaatgaattattctgactgaggacggatactgttgccatctagtgctctttatttgtgtgatctattcttctgtgaagtgcatttacagaagactaatttaggtgtcggttctgagagtggagggatttatcatccacttcagtgtcttggtggctgtcaatttcagttttggagtaatagtctaattgattgtgattc

SEQ ID NO: 1883 - DNA, 2106 bp, Triticum aestivum
agcacgaagaagaaagcaccacaaaccctcgcccccgcggcgcctcctccctccccccagaaacataccgccgcctcattccctcccaccacagcacccctcctcgtcctcgtccgatccgcccttccggaagcacctgggaggggcagcgccagcgctccggccgccatggcgctcgccttcgacgagtacggccggcccttcatcatcctccgggagcaggagaagaagtcgcgcctgcaggggctcgacgcgcagaaggccaacatcgccgccggcaagtccgtcgcgcgcatcctccgcacgtccctcgggcccaagggcatggacaagatgctccaatcccccgacggcgacgtcaccatcaccaacgatggggcgacgatcctggagctgatggatgttgacaaccagattgcgaagctcatggtggagttgtcccgcagtcaagactatgacattggagatggtaccaccggggttgtggtcctggctgggtcgctcctggagcaggctgagaagctgctggaacgtggtattcacccaataaggattgccgaaggttatgagatggcgtcgaggatagctgttgatcaccttgaaagcatctccacgaaatatgagttcagtgctacagacatagagcctttggtgcaaacctgcatgacaactttgtcctcaaagattgttagccgttggaagcggtctctagctgagattgctgtcaaagcagtccttgcggttgctgatttggaaaggaaggatgtaaatttggacttgattaaggttgaaggtaaggttggtgggaagctcgaggatactgagctagtacaaggaatcattgttgacaaagatatgagccacccccaaatgccaaagagaattgaggatgctcacattgccattctgacctgcccatttgagcccccgaagcctaagacaaagcataaggttgacattgacactgtagagaaattccagacactccgtgggcaagagcagaaatacttcgatgacatggttcagaaatgcaaggatgttggtgcaaccctagttatttgtcaatgggggtttgatgatgaagccaatcatttactcatgcaaagggagctgccggctgttagatgggttggtggtgttgaattagaattaattgccattgcgacaggagggaggatcgttccaaggttccaagagttgactaccgaaaagcttgggaaggctggattagtcagagaaaagtcatttggaacgacaaaagatcggatgctttacatcgagaagtgtgccaattccaaagctgtaactattttcatccgcggtggcaacaaaatgatgattgaagagaccaagcgaagtattcatgatgctctatgtgtggcaaggaatctgatcatcaacaactcaattgtgtatggtggtggctcagcagaaatatcttgctcaattgctgttgatgctgcagcagatcgtcatcctggagtcgagcagtatgcaatcagggcatttgctgatgctttggatgccattccactagctttagctgaaaacagtggtttgccgcctattgatactctcaccgtcgtaaaatcccaacatgtcaaggagaacaattctcgctgtggcatcgattgcaatgatgttggtaccaatgacatgaaagagcagaatgttttcgagactctgataggcaagcagcagcagatcttgctggcaacacaggtggtcaagatgatcctcaagattgatgatgtcataacgccttctgagtattgatgacgccttcaagaacggaatcgactgtgctaagtggcatgcactccattagtcagcatattttatatgggttgatttggatttgctcctagaattcttacatggagtggtcacttgttttatttgatgagctatctagttctgtgacgtgagttcacactttgtagagcttgagagacagtagcacatatcttgtcgataccagttttagcccttcgttgtgttgttcagatgcttaatgctatggttttggaccactaatttgtctgctttgtcgtaattgtttcattttttgtttactttgtctaaagtatctcaggtaaagttggt

SEQ ID NO: 1884 - DNA, 2141 bp, Musa acuminata
ggaacgcttgggtacgcgaagtctttatcttcgccaaccctaacggcatccgcgatcgagcgcttcactctgcgggagagagaacgccgaccacctccgccgcattctctgaaggggaggaggtagaaggagagagaggaggaggaggaggagaggggagatggcgctggcgttcgacgagtacgggcggcccttcatcatcataaaggagcaggggcagaaggcacggctgcgggggctcgacgcgcagaaggccaacatctccgcggggaaggcggtggctcggattcttcgcacctccctcggccctaagggcatggacaagatgctccagagtccagacggggacgtcgtcatcacaaacgatggggcaacaatcctggagcagatggatgttgacaatcagattgcaaagctaatggtggaactatcccgtagtcaggactatgaaattggtgatggtacaaccggagttgttgttttggctggtgcgcttcttgagcaggctgagaagctattggaacgtggtattcatcctattagaatctctgagggatatgaaatggcctctaagttatctgtggagcatcttgagagtatatcacagaagtttgaatttagtgttaccaatatagagcctttggtgcaaacttgcatgacaactttatcttcaaaaattgtcaatcgttgcaagcgtgcactagctgagattgctgttaaggcagttcttgcagttgctgatttagagaggaaagatgttaatttggaactaatcaaggttgaaggaaaggtcggaggaaaattggaagatacagagctcatatatggaattcttgttgacaaggacatgagccatccacaaatgccaaaacgaatcgaggatgcaaatattgctatcctgacatgcccatttgagccacccaagccaaagacaaagcataagattgacattgacactgttgagaaatttcaaactttacgccagcaggagcagaattactttgatgatatggtccaaaaatgcaaggatgttggtgcaacccttgttatctgtcaatggggttttgatgatgaagccaaccatttattaatgcatcggaatttgcctgctgttagatgggttggtggtgttgaattggaattgattgctatagctacaggtgggaggatagttccaaggttccaggagttgacaactgaaaagctgggaaaggctggattagttagagagaaatcatttggaactaccaaggatcggatgctgtatattgaacactgtgctaactccagagctgtaacaattttcattcgtggtggtaacaaaatgatgatagaagaaactaaacgtagtcttcatgatgcactttgtgtggcccgaaatctgatccggaacaattctattgtatatggtggtggctctgctgaaatttcttgctcaattgctgtagaagctgctgcagatagatatcctggggtggagcagtatgctatcaggtcctttgctgaagctttagattctattcctatggctcttgctgagaacagtggccttccacctattgatactcttactgcagtcaaatctcagcaaattaaggaaggtaatccatattgtggcatagattgcaatgatgttgggacaaacaatatgagagagcagaatgtctttgagacgctgattggcaaacaacaacagattttgcttgcaacacaagtcgtaaaaatgattttgaagattgatgatgtaatcactccggcagagtactgattttggtgatgaagattttgagcaaagaaatatctctatcataatttgctattgctaaatggtttaaatttacgtgttgcatctaagaactctaatggcttgatttttgtgctttcttcgttaatttgagtgacttttttttgcaatgattttgttataagtttatttatgggtctgatctgtatctgtatcatgttacacttcgatcaaggggaagatgggtgactgtttcctacgattggatagacatctgtagatctggatcagacattgcgagattcttggatgttgttttctcggaatttgatacctagcatttcttttttctctcatgattgtgaagctgttcatgcttgaatgaattcaaaaggtg

SEQ ID NO: 1885 - DNA, 2272 bp, Theobroma cacao
cttaatgggccatgcaagatttttctgtgaataatgggcctaacccaatacagacaggcaggcaagcccaaaaaaggagcaaaggaaacggcctgaaattacaaaaagagccactggttagggctttgaaaacaaagagaaaaaggtaaaccgagccaacattttactcaaaagcttccacgctcttcttctcacttccaactcttcaagggactgaaacattgaagaagagaagaagaagaagaagaatagatccgcgacgaaacagtaagaccaggagaaaatggcgttggcattcgacgagttcggtaggcccttcattataataaaagagcaagagcagaaaacaaggctgagagggatcgaagcccaaaaagccaacatttccgctggcaaggcggtggctcggatcctcagaacctctctcggacccaagggcatggataagatgctccaaagccccgacggcgatgtcaccatcacaaatgatggggctacaatattggagcagatggatgttgacaatcaaattgctaaattgatggttgaactgtctcggagccaggattatgaaattggtgatggaacaactggtgttgttgtcatggctggagcacttctagagcaggcagagcggctattagagcgtgggattcatcccattcgggttgcagagggctatgaactggcttcgagaatagctgttgagcatttggagcatatagctcagaagtttgattttggaccaacaaatatagagcctttggttcaaacttgcatgaccactctgtcctcgaaaattgtgaatcgatgcaagcgccctttggctgagatttctgttaaagcagttctttctgttgctgatctagagaggaaagatgtcaatttagatttgattaaggttgagggaaaagttggggggaaactggaagatactgagctaatatacggaatcactgttgacaaggacatgagtcatccacagatgccaaagcaaattgaagatgcaaaaattgctatattaacttgcccatttgagccacctaagccaaagactaaacataaggtggacattgatacagtggaaaagtttcagactttgcgtctgcaagagcaaaagtattttgatgacatggtccaaaagtgcaaggatgttggtgccaccttggttatctgtcaatggggttttgatgatgaggcaaatcatttattaatgcaccggaacttgcctgctgtgagatgggttggtggtgtggagttggagctcatagcaatagctacaggtggaaggattgtgccaaggttccaagagttgaccccagaaaagctgggaagggctggtttggtcagagagaagtcttttggaaccacaaaagataaaatgttgtacattgaacactgtgcaaattcaagagctgtaaccatatttattcgtggaggaaacaagatgatgatagaggagaccaagcgcagtatccatgatgcattgtgcgtggccaggaatctaatccgcaacaattctatagtctatggtggtggctcagctgagatttcttgctcaattgctgtagaggcagctgcagataaatatccaggagttgagcagtatgcaatcagggcatttgcagatgctttagatgcagtccccatggcactggctgagaatagtgggctccaacccattgagacactatcagcagtgaaatctgagcaaattaaggagaataatcctcactttggaattgactgcaatgatgttgggactaatgatatgcgcgagcaaaacgtatttgagacactgattgggaagcagcagcagatcttgctggcaacacaagttgttaagatgattttgaagatcgatgatgtcatttctccatcagactactgaggtctaatgtgatggatgggtttgtatggttcagctgagagaaacatgttgttggcttataatttttggactgccactcccttggttgatggaatgatatcactgttcttgctgatgtggttgcttgtttcttttctctagttactttcagtcacctatggattacccctgctggatgtaaaatttctagttaatgtgtaagtttgggttcaaaattttggtggtttccctctagtatttcatctctagttgttatgtttacattttgagagttaagaacgtagtaatctcttaaattattaatggttttacttgtaacttattaggcatagtttcgatataataattttttatcgtaatgtataaagcacaaaaagcaat

SEQ ID NO: 1886 - DNA, 1925 bp, Manihot esculenta
agccactactaaaactttctacacacttcagttccgccatttcgtttttggtttcaaaaagcattttcttcttgtttctaatagctgcgcagagatcgaacttgaagtggaaaagcaagagcaaaatcgaggagaaatggcgttagccttcgacgagtttggaaggcctttcattatcttaaaagagcaggagcagaagactcgattacggggtttagatgctcagaaagctaacatttctgccggaagagccgtagctcgcatccttcgaacctctctcggccccaagggcatggacaagatgcttcagagtcccgacggcgatgtcactatcacaaatgatggtgctacgatcttggagcagatggatgtggacaatcagattgccaaactgatggttgagctttcgcgaagtcaggattatgaaattggtgatggaacaactggtgttgttgttatggctggagcacttttggagcaggctgagaagctcttagagcgtggaattcatcccattcgtgtagcagagggttatgagatggcttctagaatagctgttgaaaatttggagcgcatagctaacaagtttgattttggagtgacaaatctagagcccttaattcaaacttgcatgactactctgtcctcaaagattgtgaatcgttgcaagcacagtttggctgagattgctgttaaagcagttcttgctgttgcagatttagagaggaaggatgttaatttggatttgataaaagttgaaggcaaagtaggaggcaaattggaagacactgaactaatatatggaatagtagttgacaaggatatgagtcatccacagatgccaaaacaaattgaagatgccaaaattgctatcttgacttgcccctttgaacccccgaagccaaagactaaacataaggtggatattgatacggtggaaaagtttcagactctacgtaagcaagaacagcagtattttgatgacatggttcagaagtgcaaggatgttggtgctaccctggttatctgtcaatgggggtttgatgatgaggcaaaccatttattaatgcaccggaacttgcctgctgttagatgggttggtggtgtggagttagagctgatagcaatagccacaggtggaagaatagtgccacgattccaggagttaacaactgaaaagctgggcaaggctggtttggttcgagaaaaatcttttggcacaacgaaagatcgaatgctttacattgaacactgtgcaaattcaagggctgttaccatatttattcgtggaggtaacaaaatgatgatagaagagacaaagcgtagtctccatgatgctctgtgtgtggccaggaatctcattcgcaacaattctattgtatatggtggtggctcagctgagatttcttgctcagttgcagtagaggcagctgctgatagatatcctggagttgaacagtatgccatcagggcatttgctgatgcattggattccatcccaatggcacttgcagaaaatagtggtcttcaacccattgagacactatctgctgtgaaatctcaacaaattaaggagaacaatcctcattatggtatagattgcaatgatgttggcacaaatgacatgtgtgaacaaaatgtctttgaggctctgatagggaagcaacagcagatcttgctggcaacacaagttgtcaaaatgatattaaaaattgacgatgtcatctcaccttctgatttttgaggtgtggtatttgttctattgcactgcttaaccagcattgaaactttgaaatacattgttgggccaatttggcatgacgaggccgtttgtttcgtgatagcttgtttagcttacaaattttggattggcgttcattggatatgggagtaatgaaaacacatactatatgctgatttgtgtg

SEQ ID NO: 1887 - DNA, 1944 bp, Castanea mollissima
ctttttcaaaaaccccttcgattcttctcagagcttcttctacgctctctctctctgtcactcatttgctgctttgcattttttggtttgagagagatctggtaaaaccgtgaagtgaaggccaaaaatggcgctcgctttcgacgagttcgggaggccattcataatcatcaaagagcaagagcagaagacgaggctgagaggactcgaagctcagaaggccaacatttccgccggaaaagccatcgctcgcatcctcaaaacctcgcttggtcccaaaggcatggacaagatgctccagagccccgacggcgacgtcaccatcaccaacgatggtgcaacaatcttggagcagatggatgttgacaatcaaattgcaaagctgatggttgagttgtcccggagtcaggattatgagattggtgatggcaccactggagttgttgtcatggccggtgcacttttagagcaggctgagctgctcttagaacgtggtattcatcccattcggattgcagagggttatgaaatggcctctaggatagcttttgagcatatggagaagatagctcagaagtttgattatggtgtgtcaaattttgagcctttggttcaaacttgcatgactactttatcctcgaagattgtcaatcgatgcaagcgcaatttggctgagattgctgtcaaagcagttcttgctgtggccgatttagagaggaaggatgttaacttagatttgataaaagttgaggggaaagtaggggggaagttggaggatactgagctaatttacggaatcttggttgacaaggatatgagccatccacagatgccaaagcaaatagaagatgcaaaaattgctatcttgacttgcccctttgagccaccaaagccaaagactaaacataaggttgacattgatacggtagaaaagttccagaatttacggcagcaagaacacaagtattttgatgatatggttcaacaatgcaaggatgttggtgctaccttggttatctgccaatggggttttgatgatgaagcgaatcatttattgatgcacaggaacttgcctgctgtcagatgggttggtggtgtggagttagaactgatagcaatagccacgggtggaagaattgtgccaaggttccaagagttgactcctgaaaagttaggaaaggctggtttggttcgagaaaaagcgtttggtacaacaaaagatcggatgctatacattgaacattgtgcaaactcaagggctgtaaccatatttattcgtgggggtaacaaaatgatgatagaggagacaaagcgcagtatccatgatgccttgtgtgttgctaggaatctcattcgcaacaatagaattgtgtatggtggtggctcagctgagatttcttgctcaattgctgtggaggcagctgcagatagatacccaggagttgagcagtatgccatcagagcatttgcggatgctttggatgctgtacccatggcacttgcagagaatagtggcctccaacccattgaaacgctatctgctgtgaagtcgcagcaaatcaaggagaacaatccctactgtgggatagattgcaatgatgttggcactaacgacatgcgtgagcaaaatgtgtttgagactctgattgggaagcagcagcagctcctgctggcaactcaagttgtcaagatgatattgaaaattgacgatgtcatctcaccttctgaatattgatatgtccgtgactgagatctatagttctgcttcacttgggctcatagtattttgttagcttgattttgtgtattgagcgactccggagaccatatgagcactgtggcttataaattttggagtgcctttgattgatattgtagtatgatttctcgtgtttaatatgttgttgattttgttgttatcctttgaaatgaaaatgatggcta

SEQ ID NO: 1888 - DNA, 1676 bp, Cirsium arvense
attcgtcgatctaagagcttaatcgagtgaaagatctacaaaaatggcgttagccttcgatgaatatggccggccgttcataatattgagggaacaagaaagtaagagtaggttaaggggtttagatgctcagaagtctaacatcgccgccggcgttgctgtttctcgcatcctccgtacatctctaggtcctaaaggcatggacaagatgctccagagccccgatggcgacatcactatcacaaatgatggcgcaacaatcttggagcagatggatgttgacaatcaaattggaaaacttatggttgaactctcccggagccaagactacgagattggtgatggaacaactggtgtagttgttatggctggtgcacttttagaacaggccgagaagctgttggaacgtggaattcatcccattcgtgttgcagagggattcgaaatatcttcaaggattgcagttgatcatttagaacaaatctcacataagtttgatttcagtgctacaaatatagaacctttggttcaaacttgcatgactaccttatcctctaaaatcgtgaaccgatgcaagcgtagtttggctgaaattgctgtaaagggagtcatggccgttgctgatctagagaggaaagatgttaacctagacctcattaaagtggagggcaaagtaggtgggaaattggaggatacagaacttatttatggaattatagttgacaaagatatgagtcaccctcagatgccgaagcaaattgaagatgcaaaaattgccatcttgacttgcccgtttgagcctccaaagcctaagaccaagcataaggttgacattgataccgttgagaagttccaaactttacgtgagcaagagaggaagtactttgatgacatggttatgagatgcaaggatgtaggggctacgttggttatttgccaatggggatttgatgatgaagcaaatcacttattaatgcacagaaacttgcctgctgtcagatgggttggtggcgtagaactggagcttatagcaatagcaactggtggtagaattgttcccaggttccaggaactaacacctgaaaagctaggaaaggctggtttggtcagggagaaggcatttggtaccacaaaagaccggatgctttatattgagcattgtgcaaattcaagggctgtgaccatatttattcgtgggggtaacaagatgatgatagaggagactaaacgcagcattcatgacgcattgtgtgttgctagaaatctcatccgtaataattctattgtttatggtggcggcgcagcagaaatttcatgttcaattgcagtggaagctgctgctgataaatatcctggagttgaacagtatgccatcagggcttttgctgatgctttggattctgtacccatggctcttgcggaaaatagtggtctgcaacccattgaaacactgtctgcagtgaaagcacagcaaattaaggagaagaatccctgctgtggtatagattgcaacgatgctggcacaaacgatatgcgtgaccaaaatgtatttgaaacgttaatcggaaaacaacagcagatcttgcttgctacacaagtcgttaagatgatcttgaagatcgatgacgtcatctcaccttccgagtattgacaaagttttggtctattatctctag

SEQ ID NO: 1889 - DNA, 2051 bp, Lactuca sativa
gttaaaagagctggttataattttagggcaaatataccaatcagatattcttctaagttccaagcacactctgtgtgccgatctcactctcgttttcgcttcatttgtcgatctaagagcttagtcgactgaagatctgcaaaaatggcgttagcgttcgatgaatatggaaggccgttcataatactgagggaacaagaaagtaagactaggttaaggggtttagatgctcagaaggctaatatcgccgccggcgttgccgtttctcgcatcctccggacatctcttggtcctaaaggaatggacaagatgctccagagtcccgacggcgacatcactatcacaaatgatggcgcaacgatcttggagcagatggatgttgacaatcaaattggaaaacttatggttgaactatcacgtagtcaagactatgagattggcgatggaacaaccggtgtagttgttctggctggtgcacttttagaacaagcagagaagcttctggaacgtggaatccatcccatccgagttgcagaaggattcgagatatcatcaaggattgctgttgatcatttagaacaaatagctcataagtttgatttcaatgccacaaacatagaacctttggttcaaacttgcatgaccaccttatcctccaaaattgtgaatcgttgcaagcgaagtttggctgagattgctgtaaaggcagtcatggctgttgctgatttagagaggaaagatgttaacctagaccttattaaagtggaggggaaagtaggtgggaaactggaagatacagaactcatctatggaatcattgtcgacaaagatatgagtcacccacaaatgccaaagcaaattgaagatgccaaaattgccatcttgacttgcccatttgaacccccaaagcccaagaccaaacataaggttgacattgacactgttgagaagtttcaaaccttacgtaagcaagaacaaaaatactttgatgacatggttcaaagatgcaaggatgttggggctacattggtaatttgccaatggggatttgatgacgaagcaaatcacttgctaatgcacagaaacttgcctgctgtgagatgggttggtggtgtagaacttgagcttatagcaatagcaactggtggtagaattgttcccaggttccaagaactaacaactgaaaaactaggaaaggctggtttggttagagaaaaggcgtttggtaccacaaaggatcgtatgctttatattgagcattgtgcaaactcaagggctgtaactgtatttatccgtggtggtaacaaaatgatgatagaggagacaaagcgcagcattcatgatgcattatgtgttgctagaaatctgatccgtaacaactccattgtatatggtggtggggcagctgaaatttcatgttcaattgcagtagaagctgctgctgataaatatcctggtgttgaacagtatgcgatccgggcttttgcggatgcgttggattctgttcccatggctcttgcggagaatagtggtttgagttgcattgaaacactatcagcagtgaaagcacaacaaattaaggagaacaatccttgctgtggtattgattgtaatgacacggggacaaatgatatgcgtgagcagaatgtgtttgaaaccttgattgggaagcaacagcagatgttgcttgcgacacaagttgtgaagatgattttgaagatcgatgatgtcatctctccatctgagtattgagatatgatatatggaggtattatgattattattatgatgtagcttttgaaattttggtccatgttatgtagaacattgcaaactgattttatttggtttgattggagaacttttttcatgcattttggttttgtagtgtgttatgttttgagaaacaaaaagtacacgttttacttgctgtttaagcaacaacttttgaggagggtttgtattgtcaagatcatcatggttttcgtgtgctaaacatgtctttttattttctttaatgattatgggttatcgacttatttctaagctga

SEQ ID NO: 1890 - DNA, 1920 bp, Prunus persica
tttcgagcagtcaaaatctcaaaacccaaaccctaaagcaaatgctttaaacagagagaaggtcctagacctaagaggaagcagagagtgggaagtagaggagaagagaagcgaagtgcgattgtgaagttgagagtgtgttggtggaaatggcgctcgcattcgatgagtatgggcggccattcataatactgagggagcaggagcagaagacccgattgagaggcctcgatgctcagaaagccaacatttcggctggcacagccgtcgctcggatcctccggacctctctcggacccaagggcatggacaagatgctccagagccccgatggtgaagtcacagtcacaaatgatggcgcaacaattctggagcagatggatgtcgacaatcaaattgcaaagttgatggttgaactatcgcagagtcaggactatgaaattggtgatgggacaactggagtcgttgtgttggctggtgcacttttagagcacgctgagcggctattggagcgtggtattcaccccatacgggttgcagagggatatgaaatggcatctagaatagccttcgatcatttgcagcatatagcacaaaaatttgaatttgggctggataacatagagcctctagttcgaacttgcatgaccactttatcatccaagattgtgaatcggtgcaagcgcgaccttgctgagattgctgtgaaagcagttcttgctgttgcagatttagagaggaaggatgtgaatctagatctgataaaagtagaggggaaagtagggggtaagttggaagatactgagctggtatatggtattcttatcgacaaggatatgagccatccacaaatgccaaagcgaattgaaaatgcaaaaattgctatcttgacttgcccatttgagccaccgaagccaaagacaaaacataaggttgatattgatacagtggaaaagtttcagactctacgtctgcaagaacagaagtactttgatgacatggtccaacaatgcaaggatgtgggtgctaccttggtcatctgtcaatggggatttgatgatgaagcaaatcacctattgatgcacaggaacttgcctgctgtcagatgggttggtggtgtagagttggaactaattgcaatagctacaggcggaagaattgtgcccaggtttcaagaattgacacccgataagctaggaaaggccggtatagttcgtgaaaaatcatttggcacaacaaaagatcgaatgctgtacattgaacactgtgcaaattcaagggctgtgaccatattcatccgtggaggtaacaaaatgatgatagaggagactaaacgcagcatccatgatgccctgtgcgttgctaggaatctcatccgcaacaactcgattgtctatggtggtggctcagcagagatatcttgctctgttgctgtagaggcagctgccgataaatacccaggagttgaacaatatgccattagagcatttgcagatgctttggattctgtccccatggcacttgcagagaacagtggccttcaacccattgaaacactatctgcagtgaaatcccagcagattaaggagaacaatccccactgtggaatagactgcaatgatgttggcactaatgatatgcgcgagcagaacgtgtttgagactttaattgggaaacagcagcaaatcttactggcaacacaagttgtcaagatgatactgaaaatagatgatgttatttctccctcagatttctgatagtctgtgcggcttatgctttgttttacctgggaatgaattttatgtaatttttgtggcttgattcggtattttgacgaaacttgtttgtagaatctggagtggttttcactggttgtagcatgatcactcctctgccttaatgcattgctgtttttgttca

SEQ ID NO: 1891 - DNA, 1699 bp, Panicum virgatum
gaaactccaccacactcggctcctccttccccgcccgcactccaccccccgccgccgccgcccctccgatccaccgggcgccggccatggcgctcgccttcgacgagttcgggcgccccttcatcatcctccgggagcaggagaagaagacgcgcctgcgcggcctcgacgcgcagaaggccaacatcgccgccggcaaggccgtcgcgcggatcctccgcacctcgctcggacccaagggcatggacaagatgctccagtcccccgacggcgacgtcaccataacaaatgatggggcaaccatcctggagcagatggatgttgacaaccagattgcaaagctgatggtggagctgtcccgcagtcaagactatgaaatcggggatggtaccactggggttgttgtcatggcgggggctctcctggagcaggctgagaagcttctggaacgtggtattcacccaattagggtggctgaaggctatgagatggcgtcaaggatagcttttgaacacctagagcgcatctcccacaagtttgagttcagtgcagacaatatcgagccactggttcagacctgcatgacaactctatcgtccaagattgttaaccgttgcaagcgggcactagcagagattgctgtgaaagcagtccttgcggttgccgatttggagaggaaggatgttaacttggatttaattaaagtagaaggcaaggttggtggtaagctggaggacactgaactcatatatggaattgttgttgacaaagatatgagccacccgcaaatgccgaagagaattgaggatgctaagattgccatcctgacgtgcccattcgagcccccgaagccgaagacaaagcataaggttgacattgacactgtagagaaattccagacgctgcgcgagcaagagcagaaatactttgatgaaatggttcagaagtgcaaggatgttggtgcgaccctggttatttgtcaatggggtttcgatgatgaagccaatcatttgttgatgcacagaaatctgccagctgtcagatgggttggtggtgttgaattggagttgattgccattgctacaggaggacggattgttccgagattccaagagttgagtccggaaaagcttggaaaggctggattagtccgagagaagtcctttggaactacaaaggaccggatgctttacattgagcagtgtgtcaattccagagctgtaactattttcattcgtggtggaaacaaaatgatgattgaggagaccaagcgcagtcttcatgatgctctttgtgtggcaaggaatttgatccgcaataactcaattgtgtatggtggcggttcagcagagatatcttgttcaattgctgttgaaactgctgcagatcggcatcctggagttgagcagtatgctatcaggtcatttgctgatgcattagatgctgttccactagccttggctgaaaatagtggtttgccaccaattgataccttaactgcagtgaaagctcagcaagttaaggagagcaacccccactgcgggatagactgcaacgacgtcggcaccaacgacatgaaaggaacagaacgtgtttgagactctgatcggcaagcagcaacagatgctgctcgccactcaggtggtgaagatgatactcaagattgatgatgtcatctcaccatccgagtactgatgaa

SEQ ID NO: 1892 - DNA, 2239 bp, Ricinus communis
atacagccactactaaaactttctacacacttcagttccgccatttcgtttttgttcaaaaagcattttcttcttgtttctaatagctgcgcagagatcgaacttgaagtggaaaagcaagagtagaatctgtagaaatggcgttagcgttcgatgaatacgggaggccatttataatactcaaagaacaagaggcaaagagtcgattgaggggtcttgatgctcaaaaagctaacatttctgctggtaaagccgttgctcgtattctccgtacatctctcggccctaaaggcatggacaaaatgcttcaaagccctgacggtgacgtcactataacaaatgatggagctacaatattggagcagatggatgtggacaatcagattgcgaagctaatggttgagctttcacggagtcaggattatgaaattggtgatggaacaactggtgttgtcgtaatggctggatcacttttggagcaggctgagaagttattagaacgtggaattcaccctattcgtgtggctgagggttatgagatggcttctaaaatagctgtggagcacttggagcatatatccgagaagtttgactttgggctgaatgatatagagcctttggttcaaacttgcatgaccactctgtcatcgaagattgtgaatcgatgcaagcgcagtttggctgagatttctgttaaagcagttcttgctgttgcagatttagagaggaaggatgttaatttggacttgataaaagttgagggaaaagtaggaggcaagttggaagatactgaactgatatatggaatagtagttgataaggatatgagccatccgcagatgccaaaacatattgaagatgctaaaattgctatcttgacttgcccctttgaaccaccaaagccaaagactaaacataaggtggatattgatagcgtcgaaaagtttcagactctacgtaagcaagagcagcagtattttgatgacatggttcagaaatgcaaggatgctggtgctaccttggtcatctgtcagtgggggttcgatgatgaggcaaatcatttgttgatgcacaggaatctgcctgcagttagatgggttggtggtgtagagttagagctgattgcaatagccacaggtggaagaatagtaccgcgattccaggagttgacgcctgaaaagctcggaaaggctggtatggttcgagaaaagtcttttgggacaacaaaagatagaatgctgtacattgaacactgtgcaaattcaagggctgttaccatatttattcgtggaggtaataaaatgatgatagaagagacaaagcgtagcatccatgattcgctctgtgtggccaggaatctcattcgcaacaattctatagtatatggtggtggctcagctgagatttcttgctcaattgccgtggaggctgctgctgataaatatcctggagttgaacagtatgccataagggcatttgctgattctttagatgccattccgatggcgcttgcagaaaatagtgggctccaacccattgagacactatctgctgttaaatctcaacaaattaaggagaacaatccacactgtggaatagattgtaatgatgctggtacaaatgacatgcgcgaacaatatgtcttcgagactctgatagggaagcaacaacagatcttgctcgcaacacaagttgtcaaaatgatactaaaaattgacgatgtcatctctccttctgagtattgatgtgtggtgtttgttctattgctgcttaaccaacaacgaaactttgaaatacattgttgggccaatttggcatgacgaggccgtttgtttcgtgatagcttgtttagcttacaaattttggattggcgttcattggatatgggagtaatgaaaacacatactatatgctgatttgtgtgttatttccttttttgtgcttttacccttctttgatcaggcggactgccttgtgcttgttgtacaagggaggaggccacatgttcaggatagaacaaaccggactagaagcttgtatttactgatttttgggtatgaggtatctatcaaggaagggcaagtggccccccattgttcagcccagttggtgtcatatccctcaataatgcaatctttaatttgggttcgtcagagttccttcttcccccttttgattaaaaatatgggttaaggggttaaccaatgccattttacagtatcaataatgacacaagtat

SEQ ID NO: 1893 - DNA, 1861 bp, Artemisia annua
atttcatcatcgatctgacaaaagatggcgttagcgttcgatgaatacggtcggccgtttattatcttacgagaacaagagagcaagagcaggttaagaggaatagacgcgcagaaagcgaatatagcggcgggggttgctgtgtcaaggatattaaggacttctcttggtcctaaaggcatggataagatgcttcaatcccctgatggcgacattactattacaaatgatggtgcaacaatcttggagcagatggacgttgacaaccaaattggaaagcttatggttgaactatcacggagtcaagactacgagatcggtgatggaactactggtgtggttgttatggctggtgcacttctggaacaagctgagaagctcttggaacgtggaattcatcccattcgtgttgcagagggttttgaaatttcttcaaggattgctgttgatcatctagaatcaatagcagataagtttaatttcactgccaccaatatcgagcctttggttcaaacttgctcgactaccttgaactctaaaatcgtgaaccgatgcaagcgtagtttggctgagattgccgtaaaggcagtcatggccgttgctgatttagagaggagagatgtaaacttagaccttattaaagtcgaggggaaagttggtgggaaattggaggataccgaacttatctatggaatccttgttgacaaagatatgagtcacccacaaatgccaaagcaaattcaagatgcacatatcgcgatcttgacttgcccatttgagcccccaaagcctaagaccaagcataaggttgacatcgatactgttgagaagttccagactctacgtaagcaagagcagcagtactttgatgaaatggttcagaagtgcaaggacgtaggggcaacattggtaatctgccaatggggatttgacgatgaagcaaatcacttgctgatgcacagaaacttgcctgctgtcagatgggttggtggtgtagaactggagcttattgctatcgcaactggtggtagaattgttcccaggttccaggaactaacacccgaaaagctaggaaaggctggtttggttagagagaaggcatttggtaccacaaaagaccggatgctatatatcgagcattgtgcaaactcaagggctgtaaccatatttattcgtgggggtaacaagatgatgatcgaagagactaaacgtagcatccacgatgcattgtgtgttgctagaaatctcatccgcaataactctatcgtatatggtggtggtgcagctgaaatttcatgctccattgctgtagaagctgctgctgataaatatcctggagttgaacagtatgccatcagggcttttgccgatgctttggatgctgtacccatggctcttgcggagaatagtggtctgtcacccattgaaacattatctgcagtgaaagcacaacaaattaaggaaaacaatcattgctgtggcatagactgcaacgatactggtaccaacgacatgcgtgagcaaaatgtattcgagaccttaatcggaaagcaacagcagatcttacttgccacacaagtcgtgaagatgatcttgaagatcgatgacgtcatctccccatcagagtattgatattgaggtacctacaagttttggtctatgtagaacattgcaaccaattaaattgctggaaaatctttttcatgcatttaagctggtggtttagtattgttttgtactttggtcgggtgtgtttctgtcgattgttttctgctcgtggctagtgtttgtgttggtattttatcttgagacaaagaatgttttactgcttacgcaaacaagtttttaggatttttcttca

SEQ ID NO: 1894 - DNA, 1907 bp, Manihot esculenta
tggagcttctacactcttccttcatttccacattccgattcctctgattgcagagtttgtgagccaagtagagaaaaatcagtgaagagaagatcagaatccaagagaaatggcgttagccttcgatgagttcggaaggccattcattatattaaaagagcaggagcagaagactcgattgcgaggtttagatgctcaaaaagctaacatttcagctggacgaactgttgctcgcatccttcgtacctctcttggccccaagggcatggacaagatgcttcagagtcctgacggcgacgtcaccatcacaaatgatggtgctacgatcttggagcagatggatgtggacaatcagattgccaagctgatggttgagctttctcggagtcaggattatgaaattggtgatggaacaactggtgttgttgttgtggctggagcacttttggagcaggctgagaagcttttagaacgtggaattcatcctattagaatagcagagggctatgagatggcttctagaatagctgttgaacatttggagcatatagcacagaagtttgattttggagtgacgaatctagagccattaattcaaacttgcatgaccactctgtcctcaaagattgtgaatagatgcaagcgcagcttggctgagatttccgtcaaagcagttattgccgttgcagatttagagagaaaggatgttaatttggatttgataaaagttgaagggaaagtaggaggcaaattggaagacactgaactaatatatggaatagtagtcgacaaggatatgagtcatccacagatgccaaaacaaattgaagatgcaaaaattgctatcttgacttgcccatttgaaccacctaagcccaagactaaacataaggtggatattgatacagtggaaaagtttcagactctgcgtaagcaagaacaacagtattttgatgacatggttcagaaatgcaaggatgttggtgctaccttggttatatgtcaatgggggttcgatgatgaggcaaatcatttattaatgcacaggaacttgcctgcagttagatgggttggtggtgtggagttagagctgatagcaatagccacaggtggaagaatagttccgcggttccaggagttaacacctgaaaagctgggcaaggctggtttggtccgagaaaagtcctttgggacaacaaaagatcgaatgctttacattgaacactgtgcaaattcaagggctgttaccatattcattcggggaggaaacaaaatgattatagaagagacaaaaagaagcatccatgatgctctgtgtgtggccaggaaccttattcgcaacaattctattgtatatggtggtggctcagctgagatttcttgctcaattgcagtagaggctgctgctgatagatatcctggagttgagcagtatgccatcagggcttttgcagatgctttggattccatcccaatggcacttgctgaaaatagtggccttcaacctattgagacgctatctgctgtgaaatctcagcaaattaaggagaataatcctcattgtggaatagattgcaatgatattggcacaaatgacatgagtgaacaaaatgtcttcgagaccctgatagggaagcaacagcagattttgcttgcaacacaagtagtcaaaatgatattaaaaattgacgatgtcatctcaccttctgattattgagttgtgatctttatgatctttgttttattgcactgcttaaccaacattggaactcataatacattgttggcttgattggtatgatgagtctcttgaagatgttcattttatgggagcttgttttagcttataaattttgtactggcgttcattggatatgtggtatgaaaattcttacgtagttgaactc

SEQ ID NO: 1895 - DNA, 5529 bp, Ricinus communis
tgaaatagaacgatccatacagccactactaaaactttctacacacttcagttccgccatttcgtttttgttcaaaaagcattttcttcttgtttctaatagctgcgcagagatcgaacttgaagtggaaaagcaagagtagaatctgtagaaatggcgttagcgttcgatgaatacgggaggccatttataatactcaaagaacaagaggcaaagagtcgattgaggggtcttgatgctcaaaaagctaacatttctgctggtaaagccgttgctcgtattctccgtacatctctcggccctaaaggcatggacaaaatgcttcaaagccctgacggtgacgtcactataacaaatgatggagctacaatattggagcagatggatgtggacaatcagattgcgaagctaatggttgagctttcacggagtcaggattatgaaattggtgatggaacaactggtgttgtcgtaatggctggatcacttttggagcaggctgagaagttattagaacgtggaattcaccctattcgtgtggctgagggttatgagatggcttctaaaatagctgtggagcacttggagcatatatccgagaagtttgactttgggctgaatgatatagagcctttggttcaaacttgcatgaccactctgtcatcgaagattgtgaatcgatgcaagcgcagtttggctgagatttctgttaaagcagttcttgctgttgcagatttagagaggaaggatgttaatttggacttgataaaagttgagggaaaagtaggaggcaagttggaagatactgaactgatatatggaatagtagttgataaggatatgagccatccgcagatgccaaaacatattgaagatgctaaaattgctatcttgacttgcccctttgaaccaccaaagccaaagactaaacataaggtggatattgatagcgtcgaaaagtttcagactctacgtaagcaagagcagcagtattttgatgacatggttcagaaatgcaaggatgctggtgctaccttggtcatctgtcagtgggggttcgatgatgaggcaaatcatttgttgatgcacaggaatctgcctgcagttagatgggttggtggtgtagagttagagctgattgcaatagccacaggtggaagaatagtaccgcgattccaggagttgacgcctgaaaagctcggaaaggctggtatggttcgagaaaagtcttttgggacaacaaaagatagaatgctgtacattgaacactgtgcaaattcaagggctgttaccatatttattcgtggaggtaataaaatgatgatagaagagacaaagcgtagcatccatgattcgctctgtgtggccaggaatctcattcgcaacaattctatagtatatggtggtggctcagctgagatttcttgctcaattgccgtggaggctgctgctgataaatatcctggagttgaacagtatgccataagggcatttgctgattctttagatgccattccgatggcgcttgcagaaaatagtgggctccaacccattgagacactatctgctgttaaatctcaacaaattaaggagaacaatccacactgtggaatagattgtaatgatgctggtacaaatgacatgcgcgaacaatatgtcttcgagactctgatagggaagcaacaacagatcttgctcgcaacacaagttgtcaaaatgatactaaaaattgacgatgtcatctctccttctgagtattgatgtgtggtgtttgttctattgctgcttaaccaacaacgaaactttgaaatacattgttgggccaatttggcatgacgaggccgtttgtttcgtgatagcttgtttagcttacaaattttggattggcgttcattggatatgggagtaatgaaaacacatactatatgctgatttgtgtgttatttccttttttgtgcttttacccttctttgatcaggcggactgccttgtgcttgttgtacaagggaggaggccacatgttcaggatagaacaaaccggactagaagcttgtatttactgatttttgggtatgaggtatctatcaaggaagggcaagtggccccccattgttcagcccagttggtgtcatatccctcaataatgcaatctttaatttgggttcgtcagagttccttcttcccccttttgattaaaaatatgggttaaggggttaaccaatgccattttacagtatcaataatgacacaagtatctgtagagaagaccctttgggtccgccaagttgtttgtagtgtggttcattgtgtaattactgattcctctttgtagcatgttttgttcttttccttcctgaaaattatcaaataaaaatgattccttcctgaaaattgtgctcaaatggcagattagtgagagcagtcggcacaaaaacgaatgcctttttcttcaaaatggtaaaccgggaacgagtcattcactttattgaagctaaaatatctttatgtctatttatgttttgaatatagtaattttgtttttataatattgatatatcttattaattaattatattagaatggtgtatgctttacctttatacaacctgtaacaaaaataattaaattaataaaattttatgaaaatatatctctgttaaatcataactttcttataataataaaattagttcgagtcgaagaaaagtatgtttatagagactttcctgtgcttatttttccttttgatttatggaatcttgaattagctgtggcctgactgtagggcaacagctaatcagctttttatattcatcaacagtcaaatacaaagaaaagaaagctccaatgtctcttctaaaacataaaatatatatttgcaaaatttgagcaaatgctcaagtggcagaaaggtatttattagcttgttggcctgtagggttttgcattcttcaattttcccttcacataagggttggtaccaactataatttcttgaatatgagaaagatggaggacaccaaatctaataatttcccttaataataatatagttacaaagaatggttacctaattagacgggaaagaaaacagttatttatttctacctctgccgactctctaattctattttggatgggatggatattggatagtgctatttatggcaactgtaactgtcggagacatgagctttaataatgaaagcatttgttgtttatgtgatgactgaatggtcgaacagaaattaaattctattttacccattgttttacaaacaggacagtagcattagatgccattgcaacgtttgtcaaacagacaagaacatgtctttgcaatcacttccacacaaccaaaatggtcccatttcatttgggaactgccatctgcaatttcttccatactgttttttttttttttttttttttcttttctgggttagttttcaataccactcttattgtgcctagagagaaagatggatttatatacctttttacattggaaaatcttattattatgattctttctttttttctgcattatgtatgtatatgaggatgatattaacgtacgacgagctaaaaataatataagatttctatttcatattcttaatttaggtacacatgatgatctgtcttggactacccgattctaggggtgaaaccatcagtgtcgaagagtaaacaaaattagtaagtattatacaagaagatcaatcctaattcccttgtaattaattacaattggctttattctttaaccttcttttttttttttttttttttttttttttggttttcaccatttatcccttttcttgattcttgggcttctgctgcaactaattagcatcagcaacgtgaacccttcttgcaaacaagtgaacctgctcctgctgtaattgaactcactagagaagatggtcttgcacctaagctggatgctcttgcataactagaagaagctccaaagccagatgctgtaaagaatgcaccatttagcaacaggtctccttcggacctccaattccagtgcttccattcattctgtgctgcatcctcatgtttagtcacctgcaattggttaacaagtctcttattttattttatatatatgttaaacttaactggtaattcctgtggaccataacccaataattttctcagcttcactcgatggtacaataaccgtttatataaaactgtgaggctttaagttcgaacccagttggacccagtttaaaaataataaaagaatcatacagtgttcttacctctttgttaaatctatcattgggagcaagaaatctgttgccttggctatttattgtaggattagcactgccaccaattgcatacatttcccaatgtgtgtagtcattgttcaccacatgaaaatatccatgtctacatctgcaaatgtcaataaaagaaaaaaaaaacatattaaaaaaagggtcccagtctctcagtagttttaaaacaatttaagatgtttttttcattaattcttttttcttggatttatggagtttttaccttggcattctctggacaagcccttctccaaaatggttgaaggcaatggtgacctgcatgttcttgtcttgagtaaaactatcactatgacccaataacataaccttgttatgatgggtcatataattgtttgagatggtaatggctgtggaaccatgaatagcatcaatcaacccatcattacagttagacaaagagcaatgatcaacccacacatagctccctccgaagatggacactccatcgccgtccgatatggtcctccacccataatggctaggcgagtccctaacataagcgttccctcctctcttacagtcatgaatgtttataccatgaattataatgttagtaacatattgtacagtaatacatggaccgccagcaatatgtacactggctcctcttccatcaatagtcttgaaagaattcatgatcagctcttctttcaacttgatcaccatgtcacgagcgaagattatccacaaaggttcctcttggataacagcatgtcttaaagttcctggcttgggattaacaggatcatcattccctgaatctgtaacaacatatatcttaccatctctaccaccaatggcatgttttccaaatccgattgcgcaatctgctagtctctgccggttcttctcccagttggggtcgcaccgccagcagtcatcgatcggattccctgtgccgcaggaaagataacccaactttctccttgatgcattgatgctcctgaaatcaataaaaaaagatgttacattcttccttttctgtaatagtgcatgtattaaaagggtaatgcataaaagaaagtacctgtgcacttcttctactacaagttcaggatcttgaacaggtgaagaggaggcaatgcggtttggggctacaaggagcaagaagaatattaaaagtaagaaaggaattgccattgctcacaggcacacttcttttagtgtagagagaaggatacgg

SEQ ID NO: 1896 - DNA, 1883 bp, Euphorbia peplus
ggcacgaggcggaattccttgagattctgttcaagtgaagaaaaaaattaagttgaagtggatcaaaggttgagcaaaaatggcgttagccttcgacgagtacgggaggccatttataatcataaaagagcaagaacagaagactcgattgagaggtcttgaggctcagaaatctaacatttccgccggtagagctgttgctcggattctccgtacttctcttggccctaaaggcatggacaagatgcttcagagccccgacggcgatgtcactattacaaatgatggtgctacaatcttggagcagatggatgtggacaatcagattgccaagttgatggttgagctttctaggagtcaggattatgaaattggtgatggtacaactggtgttgttgtgttggctggatcactcttggagcaggctgagaagctcctagaacgtggaattcatcccattcgtattgcagagggctatgaaatggcttccagaatagcttttgaccatttggagcatatatcacataagtttgattttgaagcagccaatatagagcccctagttcaagtttgcatgaccactctttcatcaaagattgttaatcgatgtaagcgcagcttggctgagattgctgttaaagcagttcttgctgttgcagatttagagaggaaagatgttaatttggatttgataaaagttgagggaaaagtaggaggcaagttggaggatactgaactagtatacggaataatagttgacaaagatatgagccatccacagatgccaaagcaaattgaagatgcaaaaattgccatcttgacttgcccctttgagccaccaaagccaaagactaaacataaggtggacattgatacagtagaaaagtttcagactttgcgaaagcaggagcagcagtattttgatgacatggttcagcaatgcaaggatgttggtgctaccttggtcatatgtcaatgggggttcgatgatgaggcaaatcatttgctaatgcacagaaacttacctgctgtcagatgggttggtggtgtggagttagagctgatagcaattgccacaggtgggagaatcgtgcctagattccaggaattaacaaccgagaaactggggaaggccggtttggttcgagaaaaggcctttggtaccacaaaagatagaatgctgtatattgaacactgtgcaaattcaagggctgtcactgtatttatccgcggaggtaacaaaatgatgatagaagagacaaaacgtagcatccatgatgcactctgtgtagcaaggaatctcattcgcaacaattctattgtttatggtggtggctcagccgagatatcgtgttcaattgctgtgcaggcagctgctgagagacaccctggagtcgagcagtatgcaatcatggcatttgctgatgctttagaggccgtcccaatggcacttgctgaaaatagtggcctccaaccaattgagacactatctcttgtgagatctcagcaatttaaggagaacaatcctcactatggaatagattgcaatgatgttggtacaaacgacatgcgcgaacagaacgttttcgagactctaatcggaaagcaacagcagatcttgctcgcaacacaagtcgtgaagatgatattgaaaatcgatgatgtgatctccccttctgagttctgatatgtggtctgtgttctttttgtgctgtttaactgacaattaaatccatagtacctaccttgttggcctaattagcgcatatgattattctccaccttgaattttattgcttggcttacaaattttgactctatttgatgtggtgtgaaaaactctttatttggtagaactgttgtgttaatttcatgcagtattt

SEQ ID NO: 1897 - DNA, 1875 bp, Flaveria ramosissima
ctagaagcacacacgcacactgtgtgccgatcgcactgttgttttctcatcatttcatcgatctaaaaccgtaatccggtgaaagatctgcaacaatggcgttagccttcgatgaatacggacggccgttcataatactgagggaacaagagagtaagagcagattaaggggtttagatgcccaaaaagccaacatcgccgccggtgttgctgtatcccgaatccttcgtacgtctcttggccctaaaggcatggataagatgctccagagccccgacggcgacattaccatcacaaatgacggtgcaacaatcttggagcaaatggacgttgacaatcaaatcggaaaacttatggttgaactatcacgtagtcaagattatgaaattggtgatggaactactggtgttgttgttatggctggtgcacttttagaacaagcagagaagcttttagaacgtggaattcatcccattcgtgttgcagaaggatttgaaatttcttcaaggattgctgttgatcacttggaaaaaatagcacataagtttgatttcagtgctaaaaatatagaaccgttggttcaaacttgcatgactaccctatcctccaaaattgtgaatcgatgcaagcatagcttggctgagattgctgtaaaaagtgtcatggctgttgctgatttagagagaaaagacgttaatcttgatttgattaaagtggagggaaaggttggtgggaaattagaggatacagaacttatttatggaattgttgttgataaagatatgagtcacccccaaatgccaaagcaaattgaagatgcaaaaattgctattttgacttgcccatttgagccaccaaagcctaagaccaaacataaggtcgacattgatacggttgaaaagtttcaaactttaaggaagcaagaacagaagtactttgatgacatggttcagaaatgcaaggacgtaggtgcaacgctggtaatttgtcaatggggctttgatgatgaagcaaatcacttattaatgcacagaaatctgccagctgtcagatgggttggtggtgtagaactggagctaatagcaatagctactggtggtagaattgttcccagattccaggaactaacacctgaaaaactaggaaaggctggtttggttagggaaaaggcatttggtaccacaaaagatcgaatgctttatattgagcactgtgcaaactcaaaggctgtaaccattttcattcgtggaggtaacaagatgatgatagaggagacaaaacgcagcatccatgatgctttatgtgttgctaggaatctcattcgtaataactcaattgtatatggtggcggggctgcagaaatctcatgctcaattgcagttgaagctgctgctgataaatatccaggcgttgaacagtatgccatcagggcttttgcagacgccttggattctgtacccatggctcttgcagagaatagtggtctgcagcccatcgaaactttatctgcagtgaaagcacagcaaattaaggaaaacaatccttgctgtggcattgactgcaacgatactggcacgaatgatatgcgtgagcaaaacgtatttgaaaccttaattggcaagcaacagcagatcttgcttgccacacaagttgtgaaaatgatcttgaagattgatgatgtcatctccccatcagactactgacatcattgcttctacccgccttcaagttttgctcagctgtagaacattgcaaacacttaattgctggaaaacctagttttgttttgtactttgtttatttgtcttgccgtcagttgtttgctgtttgtgacgtcttaactctttatgcgtacaatgtttgtttgtcttctca

SEQ ID NO: 1898 - DNA, 2130 bp, Gossypium raimondii
ggggaaaaaggttagttgggtgggatcttaatgggccaagcagtgacgaatggatttaccgaaacagtcaggggtgttagggctttggaaacactgtgaaaaacgaaaacatttacctcacaatcttccacattcttcctctcagtctcacttaactctagaaagcccaggacatgaaacactagacaacaagcaagcaagcaagaagcgtagatcgtgtgaggaaacagtaaaggccagagaaaatggcgttggcattcgacgagtatgggaggccgttcattatactaaaagagcaagagcagaaaaccaggctgagagggatcgaagctcaaaaagccaacatttccgccggaaaagctgtcgcccggattctccgcacctccctcggacctaaaggcatggataagatgctccaaagtcccgacggcgatgtcaccatcacaaatgatggggcaacgatattggagcagatggatgttgacaatcaaattgctaagttgatggttgaactgtcccggagtcaagattatgaaataggtgatggaacgactggtgttgttgtcatggctggagcacttcttgagcaggcagagcggctattagaacgtgggatacatcccattcggattgctgagggttatgaaatggcttctagaatagctgttgagcatttggagcatatagctcagaagtttgattttggaccaacaaatatagaacttctggttcaaacttgtatgaccactctatcctccaaaattgtgaaccgatgcaagcgccctttggctgagattgctgttaaagcagttctctctgttgctgatctagagaggaaggatgtcaatctagatctgattaaggtagaggggaaagttggggggaaattggaagatactgagcttgtatatggaatcactgtcgacaaggacatgagtcatccacagatgccaaagaaaattgaagatgcaaaaattgccatactaacttgcccatttgagccacctaagccgaagactaaacataaggtagacattgacacagtggaaaagtttcagactttgcgtcagcaagagcaaaagtattttgatgacatggttcagaagtgcaaggatgttggtgccaccttggttatttgtcaatgggggtttgacgacgaggctaatcatttattaatgcaccgtaacttgcctgctgtcagatgggttggtggtgtggagttggagctcatagcaatagctacaggtggaaggattgtgccaaggttccaagagttgaccccagaaaagctgggaagggctggtttggtcagagagaagtcttttggcaccacaaaagataaaatgttgtacattgaacactgtgcaaattcaagggctgtaactatatttattcgcggagggaacaagatgatgatagaggagacaaagcggagtatccatgatgcactgtgtgtggccaggaatctcattcgcaacaattctattgtctatggtggtggatcagccgagatttcttgctcaattgctgtagaggctgctgcagataaatatcccggcgttgagcagtatgcaatccgggcatttgctgatgctttagattctgtctccatcgccctggccgagaatagcggccttcaacctattgagacactatcagcagtgaaatctcagcaaattaaggagaataaccctcactttggaatagattgcaatgatgtcggaactaatgacatgcgcgagcaaaacgtgttcgagacgctgatcgggaagcagcagcagatcttactggcaacacaggttgttaagatgattttgaaaattgatgatgttatttccccatccgacttctgaggtttaatataaactggttcatcgagaggttaacccattttcatggttttgatatggttcaatctggagagggaaaaaaaggagaatttatttgcttataaatttttgaactgccactccgtttgatttgtagaatgatcaccactttttgttgatgtggatttttttatcattatatattttttaagttctcgaaaaacatatcaaaaggctaaatacctttttttttaatgttacaatttttagttaatttcctatacttttaattagcatttat

SEQ ID NO: 1899 - DNA, 1991 bp, Vitis vinifera
ccggaaccctccaaagcttttataaataaaagtggagtgagagaggtgttttagggcgactctgagtctggaaggaggaggaagaggaaaatggcgttagcgttcgacgagttcgggagaccattcataatactaaaggagcaagaacagaagagcagattaagaggtttggatgcgcagaaagctaacatttccgctggaaaagcggtggctcgcatcctccgcacctctcttggccccaagggcatggacaagatgcttcagagtcctgacggcgatgtcaccatcaccaatgatggcgcgacaatattggagcagatggatgttgacaatcaaattgcaaaactggtggttgagttatctcggagccaggattatgaaattggtgatggtacaactggagttgttgttatggctggtgcacttctagagcaggctgaacggctacttgaacgaggtattcatcctattcggatttcagagggctatgaaatggcttctaggattgctgttgaacatttggagcatattgctcaaaagtttgattttggcgtaacaaatatagaacctttggttcaaacctgcatgactactctatcatcaaagattgtgaatcgatgcaagcgcagtttggctgagattgctgtcaaagctgtgatgtcagttgctgatttagagagaaaggatgttaacttagatttaattaaagtagagggaaaagtggggggaaagttggaagatactgagctaatctatggaatccttgtagacaaggatatgagccatccacaaatgccaaagcaaattgaagatgcaaagatagctatattaacttgtccctttgagccacctaagccaaaaactaagcataaggttgacattgatactgtagaaaaattccagactttacgtcaacaagagcagaagtactttgatgacatggttcaaaaatgcaaggatgttggtgctaccttggttatctgtcaatgggggtttgatgatgaagcaaaccatttgttgttgcacaggaacttgcctgctgtccgatgggttggtggtgtagagttagagttgatagctatagcaacaggtggaagaattgtgccaaggttccaagaattgacacaagaaaagctggggaaggctggtttggttcgtgaaaaatcatttggtaccactaaagatcgaatgctgtatattgaacactgtgcaaattcaagggctgtaactatatttattcgtggtggtaacaaaatgatgatagaggagacaaagcgtagcatccatgatgcgttgtgtgtggctagaaacctcattcgcagcaattctattgtgtatggtggtggctctgctgagatttcttgctcaattgctgtagaggcagctgctgatagatatccaggagttgagcagtatgctatcagagcatttggagatgctttggattcaatccccatggcgcttgctgagaatagtggcctccaacccattgaaacactatcagcagtgaagtctcagcaaattaaggaggacaatccctattgtgggatagactgcaatgatgttggcacaaatgacatgcaagagcaaaatgtctttgagactctgattgggaagcagcagcagatcttgctagcaacacaagttgtcaagatgattctaaagatcgatgatgtcatcagcccctctgaatactgatatatcaggtacttgattgtacttctttctaatatttgcttcacccatattggtgcttgtagtattatgttggcttgggatggcattccatatcactcaagagaccatatattcactggacagataagttgttacttgttgcttacaaattttggacctgctgcattgggttttgtagtctgtcctgttttgtggttaatatattcttgattttgtttttcctattgaatatttatggattgcttgatggacagtaccacttctttttatctttgtgcacatggaaatgaaat

SEQ ID NO: 1900 - DNA, 2053 bp, Glycine max
ggaagcataatagaaggttgtggggttagggctttagagtgtcttttcttctttttcttcttcttcttcttcgttgaatcgcgattgttctgttgtgcgactgaaagaagagagatcgaaaatggcgttggctttcgacgagttcggaaggcctttcataatcctgaaggaacaggagcagaagagcagacttcgaggtttggacgctcagaaagccaacatctccgccggcaaagccgtcgctcgcatcctccgaacctccctcggccccaaaggcatggacaagatgctccagagccccgacggcgacgtcactatcacgaacgacggtgccacgatccttgaccagatggacgtggacaaccaaatcgcgaagctgatggtggagctctcgcggagtcaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtccaatttggagcccctcattcaaacttgcatgaccaccctctcctccaaaattgtgaatcggtgtaagcgtagcttggctgagattgctgttaaggctgttcttgctgttgctgatctggcgaggaaggatgttaatttggatctaattaaagtggaagggaaagttgggggtaaattggaggataccgagttgatctatgggattgttgtggacaaggatatgagtcatcctcaaatgcctaagcaaattgaggatgctaaaattgctatcctcacatgcccctttgagcctcccaagccaaagactaagcataaggttgacattgatacagtggagaagttccagacgttgaggttgcaggaacagaagtattttgatgacatggttcagaaatgcaaggatgtgggtgcaacccttgtcatttgccaatggggttttgacgatgaagcaaatcatctcttaatgcacaggaacttgccagctgttagatgggttggtggtgtagagttggaattgatagctatagcaactggtggaagaattgttcctaggtttcaggagttatctccagaaaagttgggaaaggctggtatggttcgagaaaagtcctttggtacaacaaaagaccgaatgctgtacattgaacattgtgcaaactcaagggctgtaactatattcattcgtggaggtaacaaaatgatcattgaggagacaaagcgcagccttcatgatgccttgtgcgtggctaggaatcttatccggaacaactctattgtctatggtggtggttcagctgagatttcttgctctatagctgtggaggcagctgctgatagataccctggagtagaacagtatgcaattagagcatttggggatgctttggaggccatcccaatggcccttgctgaaaatagtggcctgcaaccaattgaaacattatctgctgttaagtctcagcaaataaaggataataaccctcactttggcattgattgtaatgatgttggcactaatgacatgcgtgagcaaaatgtctttgaaactttgatcggaaagcagcaacagctcctactcgctactcaagttgtcaagatgatactgaaaattgatgatgtcatctccccatctgagtactgatatttttaaactcagtcatggtctacgtcaagatgctgaattggtgatactattttgtttcgatcggtttggttgtagtaagagtccgtacgttcacttgaaatgcaagattttggcccggtttgtatcggagttgggcgattgtttttgttttgtttaatgcaattgcaatgcttttgatatttaacattacggattagttattttttttatagacgttttaatcttagtttgttgacagtgaaaatttgtcttagtatgtgtttgcataagtgttatcaaaattgattttgaagtgatgatttatgttttaatgtttttatt

SEQ ID NO: 1901 - DNA, 2129 bp, Glycine max
tctgtaattgaaatatcagaaaaaggtgggaaggaaggaagcataatagaaggttgtggggttagggctttagagtgtcttttcttctttttcttcttcttcttcttcgttgaatcgcgattgttctgttgtgcgactgaaagaagagagatcgaaaatggcgttggctttcgacgagttcggaaggcctttcataatcctgaaggaacaggagcagaagagcagacttcgaggtttggacgctcagaaagccaacatctccgccggcaaagccgtcgctcgcatcctccgaacctccctcggccccaaaggcatggacaagatgctccagagccccgacggcgacgtcactatcacgaacgacggtgccacgatccttgaccagatggacgtggacaaccaaatcgcgaagctgatggtggagctctcgcggagtcaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtccaatttggagcccctcattcaaacttgcatgaccaccctctcctccaaaattgtgaatcggtgtaagcgtagcttggctgagattgctgttaaggctgttcttgctgttgctgatctggcgaggaaggatgttaatttggatctaattaaagtggaagggaaagttgggggtaaattggaggataccgagttgatctatgggattgttgtggacaaggatatgagtcatcctcaaatgcctaagcaaattgaggatgctaaaattgctatcctcacatgcccctttgagcctcccaagccaaagactaagcataaggttgacattgatacagtggagaagttccagacgttgaggttgcaggaacagaagtattttgatgacatggttcagaaatgcaaggatgtgggtgcaacccttgtcatttgccaatggggttttgacgatgaagcaaatcatctcttaatgcacaggaacttgccagctgttagatgggttggtggtgtagagttggaattgatagctatagcaactggtggaagaattgttcctaggtttcaggagttatctccagaaaagttgggaaaggctggtatggttcgagaaaagtcctttggtacaacaaaagaccgaatgctgtacattgaacattgtgcaaactcaagggctgtaactatattcattcgtggaggtaacaaaatgatcattgaggagacaaagcgcagccttcatgatgccttgtgcgtggctaggaatcttatccggaacaactctattgtctatggtggtggttcagctgagatttcttgctctatagctgtggaggcagctgctgatagataccctggagtagaacagtatgcaattagagcatttggggatgctttggaggccatcccaatggcccttgctgaaaatagtggcctgcaaccaattgaaacattatctgctgttaagtctcagcaaataaaggataataaccctcactttggcattgattgtaatgatgttggcactaatgacatgcgtgagcaaaatgtctttgaaactttgatcggaaagcagcaacagctcctactcgctactcaagttgtcaagatgatactgaaaattgatgatgtcatctccccatctgagtactgatatttttaaactcagtcatggtctacgtcaagatgctgaattggtgatactattttgtttcgatcggtttggttgtagtaagagtccgtacgttcacttgaaatgcaagattttggcccggtttgtatcggagttgggcgattgtttttgttttgtttaatgcaattgcaatgcttttgatatttaacattacggattagttattttttttatagacgttttaatcttagtttgttgacagtgaaaatttgtcttagtatgtgtttgcataagtgttatcaaaattgattttgaagtgatgatttatgttttaatgtttttattatagaatgaagattagaagtaaaacttattataaaatttt

SEQ ID NO: 1902 - DNA, 1911 bp, Olea europaea
cctttaatctcagtcggatccagcgaaagatccgatcttgacctgaatactggcatctcccaccaactaccgctaaaaatggcattggcgttcgatgaatatggtcggccgttcattatactaaaagagcaggatcagaagactcggttgcgaggtctggatgcacagaaggccaatatttcagccggaaaagctgtggctcggatccttcggacctcactcggacccaaaggcatggacaagatgctccaaagccccgacggtgacgtcacgatcacaaatgatggtgcgacaatcttggagcagatggacgttgacaatcagattgcgaagctaatggttgaattatcccgaagtcaagactatgaaattggtgatggaacaactggagttgttgtcatggctggttcacttctagaacaagctgaaaagttattagaacgtggtattcatcctatccggattgcagaaggatatgaaatggcttctaggatagcttttgaacatctggagaacgtagcccataaattcgaatttgatgctacaaatatggaacctctgattcaaacttgcatgactactttatcatccaagcttgtgaatagatgcaagcgtagtttggcagagattgctgtcaaagcagtgctagctgttgcagatttagagaggaaggatgttaacttagatctaattaaagtagaagggaaggtaggtgggaagttagaggatactgaactgatatatggaattgttgtcgataaagatatgagtcatccacagatgccaaagcaaattgaggatgcaaaaattgctattttgacgtgtccttttgagccaccgaagccaaaaactaagcataaggttgacattgatacagttgaaaaattccaaacactacgtcgacaggagcagcagtactttgatgacatggttcaaaaatgcaaggatgttggtgctaccttggttatctgccagtggggttttgatgatgaggcaaatcacttactgatgcatagaaacttgcctgctgttcgatgggttggtggtgttgagttagagctgatagccatagccactggtgggaggattgtgccaaggtttcaagagttgaccccagaaaaactaggcagagctggtttggttcgagaaaaagcatttggtactactaaagatcgaatgatatacattgagcattgtgcaaattcaagggctgtgaccatatttatacgtggtggtaacaagatgatgatagaggaaacaaaacgaagtcttcatgatgctttatgtgttgctcggaatctgattcgcaacaactccatagtatatggtggtggatcatctgagatttcttgctcaattgcagtggaagcggctgctgataaatacccaggagttgagcagtatgcaatcagggcttttgcagatgctttagatgcaattcccatggcactggctgagaatagtggtctccaacccattgaaactctttctgccgttaaatctcaacagattaaggaaaacaacaactgctgtggtattgattgcaatgatattggaacaaatgacatgcgcgagcaaaatgtctttgagacgttgattgggaaacaacagcagattcttcttgcaactcaagttgttaaaatgattctgaagattgatgatgttatctcatcatctgattattaaattatccagtattttatacaaaattttgcttgttcttaaaaaattgtctacgctacatggtttgcttgaacattgggcaattttagtattttacattcctttggtgaattccttgtagagtggctttgtatttgtaatgaattgttatgtttgatgaacatgtctaatctttaattatggtaggaatattgaccattatgttttcttttgtgaacaaaaaatgcg

SEQ ID NO: 1903 - DNA, 2019 bp, Malus domestica
ttcaaacagtcaaaatctcaaaccccaaaccctagaagcagatgcttaaacagagacgaagatcctcgacctaaacggaagagggaaaagcagtgagggtttgaggaacaagtgaatcggatttggtaagagagtggtggtgcagcaatggcgttggcgttcgacgagtacgggcgcccgttcataatactgagggagcaggagcagaagtctcgattgcgcggcctcgatgctcagaaggccaacatttctgccggcaaggccgtcgctcgcatcctccggacgtccctcggacccaagggcatggacaagatgctccagagccccgatggcgaaatcactgtcacaaatgatggtgcaacgattctggagcagatggatgtcgacaatcagattgcgaagctgatggttgaactatcccggagccaggactatgaaattggtgatgggacaactggagttgttgtgttggctggtgcacttctagagcacgctgagcgactgttggagcgcggtattcaccccatccgtgttgctgagggatatgaattggcatctagaatagcatttgaccatttgcagcatatatcacacaaatttgaatttgatctggataatatagagcctcttgttggaacttgcatgaccactttatcgtccaagattgtgaatcggtgcaagcgtgaccttgctgagattgctgtgaaagcagttatggctgttgcagatttagagaggaaggatgtgaacctagatttgataaaagtagaggggaaagttgggggtaagttggaagatactgagctggtatatggtattcttattgacaaggatatgagccatccacaaatgccaaagcatattgaagatgcaaaaattgctatcttgacttgtccctttgagccaccaaagccaaagacaaaacataaggttgatattgatacagtggagaaatttcagactctacgtttgcaagaacagaagtactttgacgacatggtccaaaaatgcaaggatgtcggtgctaccttggtcatctgtcaatgggggtttgatgatgaagcaaatcacctgttgatgcacaggaacttgcctgctgtcagatgggttggtggtgtggagttggaactaattgcaatagctacaggaggaagaattgtgcccaggttccaagaattgacacccgagaagttaggaaaggccggtatagttcgcgaaaaatcatttggcacaaccaaagatcgcatgctgtacattgaacactgtgcaaattcaaaggctgtgaccatatttatccgtggtggtaacaaaatgatgatagaggagactaagcgcagcatccacgatgccctctgtgttgctaggaatctcatccgcaacaattctattgtctatggtggtggatcagcagagatatcttgctccgttgctgtagaggcagcggcagaccgatacccaggagttgagcaatatgccattagagcatttgcagatgctttggatgctgtccctatggcacttgcagagaatagtggccttcaacccatcgaaacactatctgcagtgaaggccgagcagattaaggagaacattccctactacggaatagactgcaacgatgttggcacgaatgatatgcgcaaacagaatgtcttcgagactttgatcgggaagcagcagcaaatcttattggcaacacaggtggtgaagatgatactaaaaatcgatgatgttatttccccctctgactactagttggttttacctggggacgaatttctgtaattttgatagcttgattcagaattttgaatgactctttaagaacgtactgttcgcttgtggaaacttgtgtgtagaatttggagtggtttgtagcatggtcactcttctttccctttgtttaattggtgtgaggtaggccaagtgattggtgaagaattggaagaaaattggcatcaacttgtatcgcttcatctatttgtgggaatcataacggataagtttccttcacgatca

SEQ ID NO: 1904 - DNA, 1953 bp, Citrus clementina
agtctgttcattgttcactaagcgaaaaaagcactgaaagttctacactcttcttgtgaagagaagtggaagggggagaggaagcagcagctgtgagaatcaaggataggagaaaatggcgttagcgttcgacgagttcggtcgaccgttcatattattaaggcagcaagaagagaagtccagattgcgcggactcgatgctcagaaagccaacgtttcggccggcaaagcagtggctcggatcctccgaacctccctcggacccaaaggcatggacaagatgctccaaagccccgacggtgacgtcaccattacaaatgatggtgccacaatcctggagcagatggatgttgacaatcaaattgcaaagctgatggttgaattgtctcggagtcaggactatgaaattggtgatggtacaactggcgttgttgttatggctggttcacttttagagcaagctgagaagcttttggaacggggaattcatcctattcggattgcagagggctatgaaatggcttctagaatagctgttgaacatttagaacgtatagctcagaagtttgagttcgggttgaatgacttggagcctttggttcaaacttgcatgactactttaaattcgaaaatggtgaatcgttgcaagcgcagattggctgagattgctgtcaaagcagttcttgctgtggcagacttagagaggaaggatgtcaatttagatttgattaaagttgagggaaaagtagggggaaggttggaggacactgagctaatatatggaattactgttgacaaggatatgagccaccctcagatgccaaaacgaattgaaaatgcaaaaattgccatcttgacctgcccctttgagccccctaagccaaaaacaaaacataaggtggacattgataccgtggaaaagttccagactttacgtcagcaagagcaaaaatactttgatgacatggttcaaaagtgcaaggatgttggtgctaccttggtcatctgtcaatggggtttcgatgatgaggctaatcacttattaatgcacaggaacctgcctgctgtccgctgggttggtggtgtagaattggagctgattgccatagccacaggtggaagaattgttccaaggtttcaggagttgacaccagaaaaacttggaaaggctggtttggttcgagaaaagtcttttggtactacacaagatagaatgctgtacattgaacactgtgcaaattctagggctgtaaccatttttatccgtggaggtaacaaaatgatgatagaggagaccaagcggagcatacatgatgccttgtgtgtggctaggaatctgattcgcaacaattctattgtgtatggcgggggtgcagctgagatagcttgctcaattgctgtagatgcagctgcagatagatatccgggagttgaacagtatgctatcagggcatttgcagatgcgttggatgctatcccgatggcacttgcagaaaatagtggtctccaacctattgagacgctatcggctgtgaaaaatcagcaaattagggagaataatccaaactgcggaatagactgcaatgatgttggaaccaatgacatgcgtgagcaaaatgtctttgagactttgattgggaagcagcagcagattcttctcgcaacacaagttgtgaagatgattttgaaaattgatgatgtcatttccccctctgaatattgattcattgtaaggtctaagtttctgtttgattttgcttcaccaagaatgcatttcatgtattttgttggcttggtatcgaccctgtccacttgataatgactgactttaaaggttatgggttggtttttgttaaaattgtaccgtgagttactttttctggtagtgagaattgatgattttgcttgtttaattttagatttgcaacttacttgattcctctttactctctt

SEQ ID NO: 1905 - DNA, 1982 bp, Gossypium hirsutum
ctctttctcaccctcaactcttcaaagaagcagcagcaactaaagctttgaggaaatggcgttggctttcgatgagtacgggagacccttcattatactcaaagagcaagaccagaaaaccaggctgagagggatcgatgcccaaaaagccaacatttccgctggcaaagccgttgcccggatcctccgaacctctctcggacccaagggcatggataagattctccaaagccccgatggcgatgttaccatcacaaatgacggggcaacaatattggagcagatggatgttgacaaccaaattgctaagttgatggttgaactatctcggagtcaggattacgaaattggtgatggaacaactggtgttgttgtcatggctggagcacttctagagcaggcagagcggttattagaacgtgggattcatcccatacgaattgcagaggggtatgaaatggcttcaagaatcgccgttgagcatttggagcacatatctcagaagtttgattttggagcatcaaatatagagcctttggttcaaacatgcatgaccactttgtcctcaaaaattgtgaaccgatgcaagcgccatttggctgagatttctgttaaagcagttctttctgttgctgatctagagaggaaagatgtcaatttagatatgattaaggttgaggggaaagttgggggaaaattggaggatactgagctaatatatggaatcactgttgataaggacatgagtcatccacagatgccaaagcaaattgaagatgctaaaattgccatattaacttgcccatttgagccccctaagccaaagaccaaacataaggtagacattgatacggtggagaagtttcaaactttgcgtctgcaagagcaaaagtattttgatgacatggttcagaagtgcaaggatgttggtgccaccttggttatctgtcaatgggggtttgatgatgaggcaaatcatttattaatgcaccggaacttgcctgctgtcagatgggttggtggtgtggagttggagctcatagcaatagctacgggtggaaggattgtaccaaggttccaggagttgaccccagaaaagttgggaagggctggtttggtgagagagaagtcttttggcaccacaaaagataaaatgttgtacattgaacattgtgcaaattccagggctgtaaccatatttattcgtggaggaaacaagatgatgatagaagagacaaagcgcagtatccatgatgcattgtgtgtggccaggaatctcattcgcaacaattctattgtctatggtggtggctcagctgagatttcttgctcaattgctgtggaggcagctgcagataaatatccaggagttgagcagtatgcaatccgggcatttgctgatgctttagactcagtccccatggccctggctgagaatagcggactccaacccattgagacactatcagcagtgaaatctcagcaaattaaggacaataatccacactatggaatagactgcaatgatgttgggactaatgatatgcgggagcaagacgtctttgaaacactgatcgggaagcagcaacagatcttactggcaacgcaagttgtaaagatgattttgaaaattgatgatgtcatttctccatcggactactgaggtataatttctgtactgcttcactctgaaggttaccgtgttttgattgttttgtatggttcactccagaacaattgttcacttgtgaggaacatgttttgcttatgtatttttcaactgccaagctctttgttggttggaaatagaatgataaacccttcgtattgacaacggttgtttatgttttttttaatctttagtttctactttcaatagctgatttcaattcctatacttcacattctgctgttgatagtgcttgttctttgttcgagaagtcgactgtcttagcggcagcttcatgtttgtcgctggcgtc

SEQ ID NO: 1906 - DNA, 1934 bp, Citrus sinensis
agtctgttcattgttcactaagcgaaaaaagcactgaaagttctacactcttcttgtgaagagaagtggaagggggagaggaagcagcagctgtgagaatcaaggataggagaaaatggcgttagcgttcgacgagttcggtcgaccgttcatattattaaggcagcaagaagagaagtccagattgcgcggactcgatgctcagaaagccaacgtttcggccggcaaagcagtggctcggatcctccgaacctccctcggacccaaaggcatggacaagatgctccaaagccccgacggtgacgtcaccattacaaatgatggtgccacaatcctggagcagatggatgttgacaatcaaattgcaaagctgatggttgaattgtctcggagtcaggactatgaaattggtgatggtacaactggcgttgttgttatggctggttcacttttagagcaagctgagaagcttttggaacggggaattcatcctattcggattgcagagggctatgaaatggcttctagaatagctgttgaacatttagaacgtatagctcagaagtttgagttcgggttgaatgacttggagcctttggttcaaacttgcatgactactttaaattcgaaaatggtgaatcgttgcaagcgcagattggctgagattgctgtcaaagcggttcttgctgtggcagacttagagaggaaggatgtcaatttagatttgattaaagttgagggaaaagtagggggaaggttggaggacactgagctaatatatggaattactgttgacaaggatatgagccaccctcagatgccaaaacgaattgaaaatgcaaaaattgccatcttgacctgcccctttgagccccctaagccaaaaacaaagcataaggtggacattgataccgtggaaaagttccagactttacgtcagcaagagcaaaaatactttgatgacatggttcaaaagtgcaaggatgttggtgctaccttggtcatctgtcaatggggtttcgatgacgaggctaatcacttattaatgcacaggaacctgcctgctgtccgctgggttggtggtgtagaattggagctgattgccatagccacaggtggaagaattgttccaaggtttcaggagttgacaccagaaaaacttggaaaggctggtttggttcgagaaaagtcttttggtactacacaagatagaatgctgtacattgaacactgtgcaaattctagggctgtaaccattttcatccgtggaggtaacaaaatgatgatagaggagaccaagcggagcatacatgatgccttgtgtgtggctaggaatctgattcgcaacaattctattgtgtatggcgggggtgcagctgagatagcttgctcaattgctgtagatgcagctgcagatagatatccgggagttgaacagtatgctatcagggcatttgcagatgcgttggatgctatcccaatggcacttgcagaaaatagtggtctccaacctattgagacgctatcggctgtgaaaaatcagcaaattagggagaataatccaaactgcggaatagactgcaatgatgttggaaccaatgacatgcgtgagcaaaatgtctttgagactttgattgggaagcagcagcagattcttctcgcaacacaagttgtgaagatgattttgaaaattgatgatgtcatttccccctctgaatattgattcattctaaggtctaagtttctgtttgattttgcttcaccaagaatgcatttcatgtattttgttggcttggtatcgaccctgtccacttgataacgactgactttaatggttatgggttggtttttgttaaaattgtaccgtgagttactttttctggtagtgagaattgatgattttgcttgtttaattttagatttgcagcttactt

SEQ ID NO: 1907 - DNA, 1988 bp, Glycine max
gaaggtgtgtggagttagggctttacagtgtttctcttccttcttcttcttcttcttcttcttcttcgttgaatcgcgattgttctgtgcgagagaaagaagagagagatcgaaaatggcgttggctttcgacgagttcggaaggccgttcataatcctgaaggagcaggagcagaagagcagactccgaggattggacgctcagaaagccaacatctccgccggcaaagccgtggctcgcatcctccgaacctccctcggccccaaaggcatggacaagatgctccagagccccgacggcgacgtcaccatcacgaacgatggagccacgatccttgaccagatggacgtggacaaccaaatcgcgaagctgatggtggagctctcgcggagccaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtctaatttggagcccctcattcaaacttgcatgaccacactctcctccaaaattgtgaatcgctgcaagcgtagcttggctgagattgctgttaaggctgttcttgctgttgctgatctggcgaggaaggatgttaatttggatctgattaaagtggaagggaaagttgggggtaaattggaggataccgagttgatctatggaattgttgtggacaaggatatgagtcatcctcaaatgcctaagcaaattgaggatgctaaaattgctatcctcacttgcccctttgagcctcccaagccaaagaccaagcataaggttgatattgatacagtggagaagtttcagacgttgaggttgcaggaacagaagtattttgatgacatggttcagaaatgcaaggatgtgggtgcaacccttgtcatttgccaatggggttttgacgatgaagcaaatcatctcttaatgcacaggaacttgcccgctgtcagatgggttggtggtgtagagttggaattgatagctatagcaactggtggaagaattgttcctaggttccaggagttatctccagaaaagttgggaaaggctggtatggttcgagaaaagtcctttggtacaacaaaagaccgaatgctgtacattgaacattgtgcaaattcaagggctgtaaccatattcattcgtggaggtaacaaaatgatcatagaggagacaaagcgcagccttcacgatgccttgtgcgtggctaggaatcttatccgcaacaattctattgtatatggtggtggttcagctgagatttcttgctctatagccgtggaggcagctgctgatagataccctggagtagaacagtatgctattagagcatttggggatgctttggaggccatcccaatggcccttgctgaaaatagtgggctgcaaccaattgaaacattatctgctgttaagtctcagcaaataaaggataataaccctcactttggcattgattgtaatgatgttggcactaatgacatgcgtgagcaaaatgtcttcgaaactttgatcggaaagcagcaacagctcttacttgctactcaagttgtcaagatgatactgaaaatcgatgatgtcatttccccatatgagtactgatatttttaaactcagtcatgttatacgtcaagatgctaattggtgatagtattttgtttcaattggtttgtttgtagtcagtccgtacgctcacttgaaatgtaagattttggcccggtttgtatcggaattgggtgtttttgttttgttgcaattgctatgcttttgatattgatcattatggattagttgtttttgtagatgttttaatctttgtttgtaggcggaatgaaaatttgtcttagttcgtagtcttattttgggc

SEQ ID NO: 1908 - DNA, 2145 bp, Glycine max
ggtgagccctatgttggtttcgggttggggttctgtaattgaaatatcagaaaaaggtgggaagcataatagaaggtgtgtggagttagggctttacagtgtttctcttccttcttcttcttcttcttcttcttcttcgttgaatcgcgattgttctgtgcgagagaaagaagagagagatcgaaaatggcgttggctttcgacgagttcggaaggccgttcataatcctgaaggagcaggagcagaagagcagactccgaggattggacgctcagaaagccaacatctccgccggcaaagccgtggctcgcatcctccgaacctccctcggccccaaaggcatggacaagatgctccagagccccgacggcgacgtcaccatcacgaacgatggagccacgatccttgaccagatggacgtggacaaccaaatcgcgaagctgatggtggagctctcgcggagccaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtctaatttggagcccctcattcaaacttgcatgaccacactctcctccaaaattgtgaatcgctgcaagcgtagcttggctgagattgctgttaaggctgttcttgctgttgctgatctggcgaggaaggatgttaatttggatctgattaaagtggaagggaaagttgggggtaaattggaggataccgagttgatctatggaattgttgtggacaaggatatgagtcatcctcaaatgcctaagcaaattgaggatgctaaaattgctatcctcacttgcccctttgagcctcccaagccaaagaccaagcataaggttgatattgatacagtggagaagtttcagacgttgaggttgcaggaacagaagtattttgatgacatggttcagaaatgcaaggatgtgggtgcaacccttgtcatttgccaatggggttttgacgatgaagcaaatcatctcttaatgcacaggaacttgcccgctgtcagatgggttggtggtgtagagttggaattgatagctatagcaactggtggaagaattgttcctaggttccaggagttatctccagaaaagttgggaaaggctggtatggttcgagaaaagtcctttggtacaacaaaagaccgaatgctgtacattgaacattgtgcaaattcaagggctgtaaccatattcattcgtggaggtaacaaaatgatcatagaggagacaaagcgcagccttcacgatgccttgtgcgtggctaggaatcttatccgcaacaattctattgtatatggtggtggttcagctgagatttcttgctctatagccgtggaggcagctgctgatagataccctggagtagaacagtatgctattagagcatttggggatgctttggaggccatcccaatggcccttgctgaaaatagtgggctgcaaccaattgaaacattatctgctgttaagtctcagcaaataaaggataataaccctcactttggcattgattgtaatgatgttggcactaatgacatgcgtgagcaaaatgtcttcgaaactttgatcggaaagcagcaacagctcttacttgctactcaagttgtcaagatgatactgaaaatcgatgatgtcatttccccatatgagtactgatatttttaaactcagtcatgttatacgtcaagatgctaattggtgatagtattttgtttcaattggtttgtttgtagtcagtccgtacgctcacttgaaatgtaagattttggcccggtttgtatcggaattgggtgtttttgttttgttgcaattgctatgcttttgatattgatcattatggattagttgtttttgtagatgttttaatctttgtttgtaggcggaatgaaaatttgtcttagttcgtagtcttattttgggctcttgtaaaatggttgtttgattggttgtgcgactgagcggttgtagtctaggcgaaagtgttaagggcgttaaagtccttttgtt

SEQ ID NO: 1909 - DNA, 2158 bp, Amborella trichopoda
gttcgggacaatttcgtcatttccaaaaaggaagcttttgcaggcgggagctctgcctataatgcaaagcacaaatctagggcttcaaatgttcaaaacttcgtcttgctcttcttcttctctctactctttaactcttcaggcacggtcttaatctctctctctctaaaaagtccatttttcagcacgttctcgctcctaagcatggcgcttgccttcgatgaatatggaaggcccttcatcatcctcaaggagcaggagcagatgaacaggctgaggggcctcgatgcgcaaaaggccaacatttcggctggaaaagcagttgctcggattctgaggacttctcttgggcctaagggcatggacaagatgctccagagccctgatggcgaagtcaccatcacaaatgatggggctactatcttggagcaaatggatgttgacaatcaaattgcaaagctgatggtagagttatcacgaagccaggattatgagattggtgatggtaccactggtgttgttgttatggctggtgcacttctcgagcaggcagagagactattagaatgtggtatccatcccattagaatcgcagagggctatgagatggcttccagaatggctgtggaccatcttgagaaaatctcgaagacgtttgagtttagtttgacgaacattgagtcactggttcagacttgcatgaccactttgtcttctaagattgttaatcgatgcaagcggagtttagctgagattgctgttaaagcagtgcttgctgtagcagatttggatagaaaggatgtcaatttggatttaattaaagttgagggaaaagtgggcggaaagttagaggacactgagctagtttatggtatcactgtcgacaaggacatgagccatccacagatgcctaagcgtattgaaaatgctaaaattgccattttgacttgcccgtttgaacccccaaagcccaagacaaagcataaggtggacattgacacagttgaaaaattccagacactacgcaaacaagaacaacagtattttgatgacatggttcaaagatgcaaagatgtaggtgcgaccttggttatttgtcaatggggttttgatgatgaagctaaccatctgttaatgaatcggggattgcctgcagttcgatgggttggaggtgtggagttagagttgattgcaattgctacagggggaaggattgtgccaagatttcaagagttgactcctgaaaagctagggaaggcgggtatagttagagaaaaatcatttggaacaaccaaagaccgcatgctgtatatagagcaatgtgcaaattcaagggcagtaactatattcattcgtggcggcaataaaatgatgatcgaggagacaaaacgtagtctccatgatgccctttgtgttgcaaggaatttgatccgcaataattcaattgtctatggtggtggatcagcggaaatctcttgctccattgctgtggaagcagctgctgatagaattcctggagtagagcagtatgcgattagggctttcgcggatgctttggactcaatcccaatggctttggcagagaacagtggcctccaacccattgaaactctaactgctgtgaagtctcaacaagtcaaggagggtaacccacattatgggatagattgcaatgatattggaacaaacgacatgcttcagcaagatgtgtttgagactctgattggaaagcagcagcaaatattgcttgctacacaggttgtgaaaatgatactcaaaattgatgatgtcatctcccctgccgactactgattattgggcatgaattttggttttgaaattgtggtcaaattcaagtcgctgctctgtgattgagtggtttctcctgctcattgacttttaactgagttatattatgcattaggtttgagttaatgagtggatagttaagtcttactgaagttccatttatctggcattgatttcttcggctacgattagtgaagcatggagcatgcatgaatccgttttgtaatgaagttatgcatattagagcgatgtgatgttttacgactgttatatctaaaaacttgcatataaaattgtagaatttcgagaaaggcaaagtaatagggcttaaaagtgctctattttgaaa

SEQ ID NO: 1910 - DNA, 1927 bp, Amsonia hubrichtii
aaatccagttagggcttgcgagcttccttaaggttctagagtagagtgtgcacactcacacacacagtgttgcagagatcatctcttttactctctgtttagcagtctctcggatctgatctccgagaaatggcgttggcgttcgatgagtttggtcgccccttcataataataaaggagcaagagcagaagacgcgattgcgcggcctcgatgcccagaaagctaacatttccgctggcaaggcgattgcacgtattctccggacctctcttgggcctaaaggcatggacaagatgctccagagccccgacggcgacgttacaatcacaaacgatggtgcaaccatcttagagcagatggatgttgataatcaaattgcaaagctgatggttgaattatcacgaagtcaggattatgaaattggggatggaacaactggtgttgttgtcatggccggtgcacttttggatcaggctgagaggttacttgagcgcggcattcatcctattcgagttgctgaaggatatgaagtggcttcaaggatagcttttgaacatctggagcgtatagcacataagtatgaatttgatgcaaacaatgtagaaccgttgattcaaacttgtatgacgactttatcctccaagattgtgaatagatgcaagcacagtctggcagaaattgctgtcaaagcagttttggcagttgctgatttagagcggaaggatgtcaacttggatctaatcaaagtagagggtaaagtaggtgggaagctggaggacacggagttaatatatggtattgttgttgacaaagatatgagtcatccacagatgccaaaggagatacaagatgcaaaaattgccattttgacttgcccctttgagccacctaagccaaagactaagcataaggtcgacattgacacagtggaaaaattccaaactttacgacatcaagagctgaagtattttgatgacatggttcaacaatgcaaggatgttggtgctaccttggttatctgtcaatggggttttgatgatgaagcaaatcaccttttaatgcatagaaatctgcctgctgttcggtgggttggtggcgtcgagctagagttgatagcaatagccacaggtggaagaattgtgccaaggtttcaagaattgacaccggaaaagctaggcaaagcgggtcttgttcgagaaaagtcttttggtaccactaaagaccggatgatctacatagagcattgtgccaattcaagagctgtcactattttcattcgtggtggtaacaaaatgatgatagaggaaacaaagcgcagcatccatgatgctctctgtgtcgccaggaaccttatccgtaataattctatagtatatggtggtggttctgctgagatttcttgctcagttgctgtggaggctgctgctgataaatattctggtgttgagcagtatgcaatccgggcatttgcggatgctttggattctatccccatggcacttgctgagaacagtggcctccaacctatcgagactctatcagctgtaaaatcccagcaaattaaggagaataatccatgctgtggaattgattgcaatgacgttgggacaaatgacatgcgtgagcaaaatgtctttgagactttaattgggaagcagcaacagattttacttgcaacacaagttgttaagatgatcctaaagattgatgatgtcatcagtccatcagagtactgattttaggtacaggccaagtttttcgtcggctgcaagtgtgccacaacatgatttgttgcctcaagaagtgactatgaacacttgattccacctactcttcattatgacaatatgcatctttggtttgtagtgtgattaacatttttgtgtctgcagcatgtaatgacatccaaccttttactggagtttc

SEQ ID NO: 1911 - DNA, 1882 bp, Malus domestica
ctcaaaccccaaaccctaagagcagatgctttaaacagagaaggtggtagagctagtccgaagagggaagaagagaagtgagagtgaggggaacaagtgaatcgagaagcatcgcggttcgatttgggaagagggtgttggtgcagcaatggcgctggcattcgacgagtacgggcggcccttcataatactgagggagcaggagcagaagtctcgattgcgcggcctcgatgctcagaaggccaacatttccgccggcaaggccgtcgctcgcatcctccggacctccctcggacccaagggcatggacaagatgctccagagccccgatggtgaaatcactgtcacaaatgatggtgctacgattctggagcagatggatgtcgacaatcagatcgcgaagctgatggtcgaactatcccagagtcaggactatgaaattggtgatgggacaactggagtcgttgtgttggctggtgcacttctagagcatgctgagcggctgttggagcgcggtatccaccccatacgtgttgcagagggatacgaattggcatccagaatagcggtcgaccatttgcagcatatatcacacaaatttgaatttggtctggataatatagagcctctggttggaacttgcatgaccactttatcgtccaagattgtgaatcggtgcaaacgtgcccttgctgagattgctgtgaaggcagttttggccgttgctgatttagagaggaaagatgtgaacctagatttgataaaagtagaggggaaagttgggggtaagttggaagatactgagctggtatatggtattcttattgacaaggatatgagccatccacaaatgccaaagtacattgaaaatgcaaaaattgctatcttgacttgcccctttgagccaccaaagccaaagacaaaacataaggttgatattgatacagtggaaaagtttcagactctacgtatgcaagaacagaagtactttgacgacatggtccaaaaatgcaaggatgttggtgctaccttggtcatctgtcaatgggggtttgatgatgaagcaaatcacctattgatgcacaggaacttgcctgctgtcagatgggttggtggtgtagagttggaactaattgcaatagctacaggaggaagaattgtgcccaggttccaagaattgacacccgagaaattaggaaaggctggtatagttcgcgaaaaatcattcggcacaacaaaagatcgaatgctgtacatcgaacactgtgcaaattcaagggctgtgaccatatttatccgtggaggtaacaaaatgatgatagaggagactaagcgcagcatccacgatgccctctgtgttgctaggaatctcatccgcaacaattctattgtgtacggcggtggctcagcagagatatcttgctccgttgccatagaggcagcagcagaccgatacccaggagttgagcaatatgccattagagcatttgcagatgctttggatgctgttcctatggcgcttgcagagaatagtggccttcaacccatcgaaacactatctgcagtgaaagctgagcagattaaggagaacattccctactatggaatagactgcaacgacgtcggcactaatgatatgcggaagcagaatgtctttgagacattgatcgggaagcagcagcaaatcttactggcaacacaagtcgtgaagatgatactaaaaatcgatgatgttatttccccctctgattactagcctgttttacctggggatgattttgtgtaattttgttggcttgtttcagaattttgagtgacttgtttacaacatatggttcggttgttggaaacttgtttgtagaatttggagttgcttttttca

SEQ ID NO: 1912 - DNA, 2051 bp, Aquilegia formosa
cacacacacacactttcagtttttctacttgacgaagactgtagagtagaatagagaagagaagagaacagagaactttttgttcttcttcgtcactcattcgatctctccatcaatcgaatcgatctactcgtttaatttatatgtgattgaaaggtagtttgaatcgaagaaaatggcgttggcgttcgatgagtacggacgtccattcattatactaagagaacaagagcagaagagtagattgagaggtttagatgctcagaaagctaacatttctgctggtaaagctgttgctcgtattcttagaacttcacttggtcctaaaggcatggacaagatgcttcaaagtccagatggcgatgttactatcacaaatgatggtgcaacaatcttggatcagatggatgttgacaatcaaattgcaaaattgatggttgaattgtctcgtagtcaagactatgaaattggtgatggtacaactggagttgttgtcttggctggtgctcttctggagcaggctgagagactattagagcgaggtgtacacccgattcgagtagcagaaggctatgagatggcttctagaatagctgttgatcatttggagcatatcgctcagaagtttgagtttgatgctgcaaacattgagcctttggttcagacttgcatgacgacgttatcttctaagattgtgaatcgatgcaagcggagtttagctgagattgctgttaaagcagttgtgtcagttgcagacttagagaggagggatgtcaacttagatttgattaaagtggagggtaaagtaggggggaagttggaagatactgagctaattaatggaattattgttgacaaagatatgagccatccccagatgccaaagcaaattcaaaatgctaaaattgccatcttgacttgcccatttgagcccccaaagcccaagactaagcataaggttgacattgacagtgttgagaagtttcaaactttgcgtttacaggagcagaaatacttcgatgatatggtccaaaagtgcaaggatgttggggcaacccttgtgatttgtcaatggggttttgatgatgaagcaaaccatttgttaatgcacaggaacttacctgctgtccggtgggtcggtggagtagaactggaactgattgcaattgctacaggaggaaggattgtgccaaggttccaagaattgacaacggaaaaattaggaaaggctggactagttagggaaaagtcatttggaacaacaaaagaaaggatgttgtacattgaggaatgtgctaattcaagggctgtaacaatatttattcgtggaggtaacaaaatgatgatagaggaaacaaagcgcagtgtccacgacgctctgtgtgtggccaggaatctaatccgtaacaactctattgtgtatggtggtgggtcggctgaaatctcttgctcaatcgctgtagaagcagctgctgataaatatcctggagtcgagcagtatgctatcagggcctttgcagatgctctcgaagctgtccctatggcacttgcggagaacagtggactacaacccattgaaacagtttctgcagttaaatctcaacaagtcaaggaaaacaactcctactgtgggattgactgtaatgatgttgggacaaatgacatgcgtgagcaaaatgtgtttgaaactttgattgggaagcaacagcaactcttactggctacgcaggttgttaagatgatactcaaaattgatgacatcatcagcccctcagagtactgatcgtgcaggtagaggttttgatcttttacttgaaaggttttgtctaccttgaaacctttttgtgtaaaatatggatgtttgaacacgcctgtcatttttccttttcactctgccctccactttttaatagactataagctctttcatagaaaaggaaagtgtcttgctcgaaagcaaaggcctcccctatttgaatttgaaagtattgtgttgtgatgagcatatggtttatgtagtcttttttagtggaatgcttgtggtttttcct

SEQ ID NO: 1913 - DNA, 1992 bp, Centaurea maculosa
  misc_feature (721)..(721): n is a, c, g, or t
  misc_feature (790)..(790): n is a, c, g, or t
gccggggtcgctaagggttttagggcataaaacccattcgaactctctctcaccttcttccatttccatcaccaccgtcgtcactctctgtgtcgatctcgccgtcatcttccaccttcatatgtcgatctaagacctaaatcaagcttttagatcagtaacaatggcgttggcgttcgatgaatacgggcggccgttcataatcctaagggaacaggaaagtaaaagtaggttaagaggtttagatgctcagaaggccaacatctccgccggcgtggccgtcgctcgcatcctgaggacctctcttggtcctaaaggcatggacaagatgctccagagccccgatggcgatatcaccataacaaatgatggtgcaacaatcttggagcagatggatgttgacaatcaaattggtaaattgatggtggagctttcaaggagtcaggactatgagattggtgatggaacaacaggagttgttgttatggctggtgcgctgctagaacaggctgagcggttattggaacgtggtattcatccaatccgtgttgcagagggctatgagatagcttcaaagattgctgttgatcatttgcaacaaatagctcacaagtttgagttcactgctacacatatagaacctctggttcaaacttgcatgactaccttatcctctaagattgtgaaccgttgcaagcgcagtttggccgaaattgctgtnaaggcagtcatggcagttgcagatttggagaggaaggatgtaaacttagacctcattaaagtggagggnaaagtaggtgggaaattggaggataccgagcttatttatgggattcttgttgacaaagatatgagtcacccacagatgccaaagcaaatcgaggatgcgaaaattgccattttgacttgcccctttgagccaccaaagccaaagaccaagcataaggttgacattgatacagttgagaagttccaaacattgcgccaacaagagcagaagtactttgatgacatggttcagcaatgcaaggatgttggagctacgctggtgatttgccaatggggttttgatgatgaagcaaatcacttgttgatgcacagaaatttgcctgctgtcagatgggttggtggtgttgaattagagcttatagccatagccacaggtggaagaattgttcccaggttccaggaattaacacctgaaaagctaggcaaggctggcttggttagagagaaggcgtttgggaccacaaaagatcggatgctatatattgagcattgtgcaaattcaagagctgtaactattttcattcgtgggggtaacaagatgatgattgaggagaccaaacggagcctccatgatgcgttatgtgttgcaagaaatctcatccgcaataacaacattgtctatggtggcggtgcagcggaaatttcatgctcaattgccgttgaagcagctgctgataaatacccaggagttgagcagtatgccgtcagggcttttgcggatgcgttggattctgttcccatggctcttgctgagaatagtggcctacagcccattgaaacactatctgcagtgaaatctcaacaaataaaggacaacaaccctttttgtggcatcgactgcaatgatgctggcacaaacgacatgcgtgaacaaaacgtattcgagacacttatcggaaagcaacaacagctgttgcttgccacacaagtcgtcaagatgatcttgaagattgacgacgtcatctctccaaccgagtattaagtttctcaggtacttgacttccatgtttcttttcgtgttaaaaaaacgtttttgtagtgtgttttctgcctagatatttccgtttttggattattattattcgagtaagattgtcgaaaagtgctcatttttgtgttgtgctagcctttgaaaccgtcgagcagcagaatattatttgtatttctatttgcaaaggtgaaagggatttgctatctttctcc

SEQ ID NO: 1914 - DNA, 1930 bp, Cichorium intybus
gaactctttcagttccagcacactctctttgtgccgatctaattgttgttttcgcttcattcgtcgatctaagagcttagtctactgagagatctgcaaaatggcgttagcgttcgataaatacggtcggccgttcataatattgagggaacaagagagtaagagtaggttaaggggtttagatgctcagaaggctaacatcgccgccggcgttgccgtttctcgcatcctccgtacatctcttggacctaaaggcatggacaagatgctccagagccccgacggcgacatcactatcacaaatgatggcgcgacaatcttggagcagatggatgttgacaatcaaattggaaaacttatggttgagctatcacggagtcaagactatgagatcggcgatggaacaaccggtgtagttgttttggctggtgcacttttagaacaagcagagaagcttttagaacgtggaatccatcccatccgagttgcagaaggatttgaaatatcatcaaggattgctgttgaccacttagaacaaatatcacataagtttgatttcaatgccacaaacatagaacctttggttcaaacatgcatgaccaccttatcttccaaaattgtgaatcgatgcaaacgtagcttggctgagattgctgtaaaggcagtcatggctgttgctgatttagagaggaaagatgttaacctagacctcattaaagtggaaggaaaagtaggtgggaaactggaagatacagaacttatctatggaatcattgttgacaaagatatgagtcacccacagatgcctaaacaaatagaagatgctaaaattgcaatcttgacttgcccttttgaacccccaaagccaaaaaccaaacataaggttgacattgataccgttgaaaagtttcaaactttacgtaagcaagaacagaagtactttgatgacatggttcaaagatgcaaggatgtcggggctacattggtcatttgccaatggggatttgatgatgaagcaaatcacttgctaatgcacagaaacttgccagctgtcagatgggttggtggtgttgaacttgagcttatagcaataaccactggtggtagaattgttcccaggttccaggagctaacaactgaaaaactaggaaaggctggattggttagagaaaaatcattcggtaccacaaaagatcggatgctttacatcgagcattgtgcaaattcaagggctgtaaccgtatttattcgtggtggtaacaagatgatgatagaggagactaaaagaagcatacatgatgcattatgtgttgctagaaatttgatccgtaataattccattgtatatggtggtggggcagctgaaatttcatgctcaattgctgtagaagctgctgctgataaatatccaggagttgaacagtatgctattcgggcatttgcggatgcattggattccgtacccatggctcttgcggaaaatagtggtctgagttgcattgaaacattatccgcagtgaaagcacaacaaattaaggagaataatcattgctgtggtatcgactgtaatgatacggggacgaatgatatgcgcgagcagaatgtgtttgaaaccttgatcggcaagcaacagcagatattgcttgcgacacaagtcgtgaagatgattttgaagattgatgatgtcatatctccatctgagtattgatatttttgaggtaatgtagtttgaagttttggtctatgtacaacttttgaaaactgattgattggtggaaaacttttatatgtttgttttgttttgagaaaagaacgttttatggtttatgcaaccaacttttgaggacggtttgttgagattatggctttgtgtttttatattttggatccaaggaactgtctgaatgtgactagatgatgatttttcctt

SEQ ID NO: 1915 - DNA, 1936 bp, Cirsium arvense
gtaacaatggcgttggcgttcgatgaatacgggcggccgttcataatcctaagggaacaggaaagtaaaagtaggttaagaggtttagatgctcagaaggccaacatctccgccggcgtggccgtcgctcgcatcctgaggacctctcttggtcctaaaggcatggacaagatgctccagagccccgatggcgacatcaccataacaaatgatggtgcaacaatcttggagcagatggatgttgacaatcaaattggtaaattgatggtggagctttcaaggagtcaggactatgagattggtgatggaacaacaggagttgttgttatggctggtgcgctgctagaacaggctgagcggttattggaacgtggtattcatccaatccgtgttgcagagggctatgagattgcttcaaagattgctgttgatcatttgcaacaaatagctcacaagtttgagttcactgctacacatatagaacctctggttcaaacttgcatgactactttatcctctaagattgtgaaccgttgcaagcgcagtttggccgaaattgctgttaaggccgtcatggcagttgcagatttggagaggaaggatgtaaacttagacctcattaaagtggagggcaaagtaggtgggaaattggaggatacagagcttatttatgggattcttgttgacaaagatatgagtcacccacagatgccaaagcaaatcgaggatgcgaaaattgccattttgacttgcccctttgagccaccaaagccaaagaccaagcataaggttgacattgatacagttgagaagttccaaacattgcgccaacaagagcagaagtactttgatgacatggttcagcaatgcaaggatgttggagctacgctggtgatttgccaatggggttttgatgatgaagcaaatcacttgttgatgcacagaaatttgcctgctgtcagatgggttggtggtgttgaattagagcttatagccatagccacaggtggaagaattgttcccaggttccaggaattaacacctgaaaagctaggcaaggctggcttggttagagagaaggcgtttgggaccacaaaagatcggatgctatatattgagcattgtgcaaattcaagagctgtaactattttcattcgtgggggtaacaagatgatgattgaggagaccaaacggagcctccatgatgcgttatgtgttgcaagaaatctcatccgcaataacaacattgtctatggtggcggtgcagcggaaatttcatgctcaattgccgttgaagcagctgctgataaatacccaggagttgagcagtatgccgtcagggcttttgcggatgcgttggattctgttcccatggctcttgctgagaatagtggcctacagcccattgaaacactatctgcagtgaaatctcaacaaataaaggacaacaaccctttttgtggcatcgactgcaatgatgctggcacaaacgacatgcgtgaacaaaacgtattcgagacacttatcggaaagcaacaacagctgttgcttgccacacaagtcgtcaagatgatcttgaagattgacgacgtcatctctccaaccgagtattaagtttctcaggtacttgacttccatgtttcttttcgtgttgaaaaaacgttttttgtagtgtgttttctgcctagatatttccgtttttggattattattattcgagtaagattgtcgaaaagtgctcatttttgtgttgtgctagcctttgaaaccgtcgagcagcagaatattatttgtatttctatttgcaaaaaagaaaaaagtggtacttttctacgaatgtgatcaattatccaaaataatacatgggttcatcaaatatttacatattcaaataactttgtaatattgtttttttaaagcaaggccagactttgtt

SEQ ID NO: 1916 - DNA, 2160 bp, Vigna unguiculata
tcgcgatctccaactaggttagggcttaagagtgtttttgctctttcttcttcttccatttcttctttgcgattgttcgttctgtgcaagagtgaagaagagatcgatcgataaaaatggcgttggctttcgacgagttcggaaggccgttcataatcttgaaggaacaggagcagaagagcagactccgaggtttggacgctcagaaatcgaacatctccgccggcaaagccgtcgcgcggatcctccgtacctccctcggtcccaaaggcatggacaagatgctccagagccccgacggcgacgtcaccatcaccaacgacggcgccaccatcctcgagcagatggacgtggacaaccaaatcgcgaagctcatggtagaactttcgaggagccaggactacgagattggcgatggcaccaccggcgtcgtcgtcatggccggcgcgcttctcgagaaggcggagcgcctcctggagcggggaattcaccctatcaggatcgccgagggttacgaaacagcgtctagaatcgcggttgagcatctcgagcgcgtggccaacaagttcgagttcggggagtccaatttggagcctctcattcaaacctgcatgaccacactctcctctaagattgttaatcggtgcaagcgtagcttggctgagatcgctgttaaggctgttcttgctgttgccgatctggagaggaaggatgttaatttggatctaattaaggtggaagggaaagttgggggtaaattggaggacaccgagttgatctatggcatagttgttgataaggatatgagccatcctcaaatgcctaagcaaatcgaggatgctaaaattgctatcctgacctgcgcctttgagcctcccaagccaaagactaagcataaggttgatattgatacagtggagaagttccaaacgttgaggttgcaggaacagaagtattttgatgacatggttcaaaaatgcaaggatgtgggtgcaacccttgtcatctgccaatggggttttgacgatgaagcgaatcatctcttaatgcacaggaacttgcctgctgtcagatgggttggtggtgtagagttggaattgatagctatagcaactggtggaagaattgttccaaggttccaggagttatctacagaaaagttgggaaaggctggcatggttcgtgaaaaatcttttggtacgacaaaagaccgaatgctgtacatcgaacattgtgcaaactcaagggctgtaacaatattcatccgtggaggtaacaagatgatcatagaggagacaaagcgcagccttcatgatgccttgtgcgtggctaggaatcttatccgtaacaattctattgtatatggtggtggttctgctgagatttcgtgctctatagctgttgaggctgctgctgataaataccctggagttgaacagtatgctattagagcatttggggatgctttggaagccatcccaatggccctcgctgaaaacagtggcctccaaccaattgaaacattatccgctgttaagtctcagcaaataaaggataataaccctcactttggcattgattgtaatgatgttggcactaacgacatgcgtgagcaaaatgtcttcgaaactttgatcggcaagcagcaacagatcttactcgctactcaagttgtcaagatgatattgaaaattgatgatgtcatttccccatctgagtactgatatttttagactcagtcacgttctacatcaagattctgaatgttgcttatagtattttgtttgatcggtctgattgtagtcacagtccgtatgtttacttggaatgtaagattttggcccggtttgtatcggagttgggcggctgtttttgtttttttaatgcaattgttatcttttgatttttaaaacattatggattagttgtttttgtttttagacattttaacctctgtttgtaggccgagtgaaattttgttatctcagtcttattttgggccctaaatgattggttattgagagtgaatgtagtctgggcgaaagtgtttagagctttaaagtcctagattttgttgtagtagtgcaattttatttgaggaagaagttcttgacataattaattggagctggaatgactaataagaagtttgaaactgat

SEQ ID NO: 1917 - DNA, 1843 bp, Eschscholzia californica
ctctagaaactctctctgagttagtgagagttgtagtagtagtagtcgactgaaagtgaaaagatggcgttggccttcgatgattacgggagaccattcataatattaagggaacaagaacagaagagtagattgaaaggtttagatgcacaaaaagctaacatttctgctggtaaagccgtcgctcgtatcctcaggacttctctcggtcctaagggtatggacaagatcctccagagccccgacggcgatgtcaccattacaaatgatggtgcaacaatcttggagctgatggatgttgacaatcaaatagcaaagttgatggttgatttatcccagagtcaggactatgagattggtgatggcacaaccggagtcgtcgttatggctggtgcacttttggaacaagctgagcatctattagaacgtggtattcatcctgtccgagtcgcagagggctatgagatggcttccagggtagctgttgagcatttggagcgtatctctaacaagttcaattttagtgcttcagacatagaacctttggtccagacttgcatgaccactttatcctcaaagattgtaaatcgatgcaagcgcagtttagctgagattgctgttagggctgttctggctgttgcagatttagaaaggaaggatgtcaatctggacatgatcaaagtagaggggaaagttggcggaaagttggaagacactgagctaatttatggaattaccgtggacaaggatatgagccatccccaaatgcccaaggaaattcgagatgcaaacattgctatcttgacttgcccatttgagccaccgaaacccaagactaagcataaggttgacattgactccgtggagaaattccaaactttacgtctgcaagagcagaagtacttcgatgatatggttcaaaagtgcaaggatgttggtgcaaccctagttatctgtcaatgggggttcgatgatgaagcaaatcatttattgatgcaccgcaatttgcctgccgtgagatgggtcggtggagtagaactagagttgattgcaatagctactggtggaaggattgtgccaaggttccaagagttaacaacagaaaagctggggaaggctggtttagttagagagaaatcatttgggacaaccaaagaccggatgctatacattgaacactgtgcaaattctagggctgtaactatatttatccgtggtggtaacaaaatgatgatagaggaaacaaaacgcagtcttcacgatgctctctgtgttgctagaaatctaatccgcaacaactctattgtttatggtggtggatcggctgagatctcttgctccattgctgtagaggcagctgcagacaagtatcctggagttgagcagtatgctataagggcatttgcagatgctttggattctatccccatggcattagcagagaatagtggacttcaacccatcgaaactctttctttagttaaagctcagcagatcaaggaaaacaacccatgctgcggaattgactgcaatgatgttggtactaatgacatgcgtgaacagaatgttttcgaaacactgataggaaagcaacaacagatcttactggccacacaagtcgtcaagatgattctcaagatcgacgatgttatcagcccatcagagtactgattaatctcttgagcaacttttgttcttcaatcaaaagtagctttaatctctgttacttaaagagattgccacccgcccaggcaacgatacgttgttaggtatttccagtcattcagagtgcttcaagttgaattttgcaagagtgaatagtttattagttctagggttctta

SEQ ID NO: 1918 - DNA, 1801 bp, Eschscholzia californica
ctttctctctctgaaaactctggtatactgagagtggatttggaagagaaacaatggcgttagccttcgacgattatggaaggccgttcataatactaagggaacaagaaaagacgagcagattgaaaggtttggatgcacagaaagccaacatttctgccggaaaggcagttgctcgaatcctccgtacttcacttggtcccaaaggaatggataagatccttcaaagtcccgatggcgatgtcacaatcacaaatgatggtgcaacaatcttggagttgatggatgtcgataatcaaatagcaaagcttatggtggatttatcccaaagtcaggactatgaaatcggtgatggcacaactggagttgttgttatggctggtgcgcttctagaacaggctgagcatctactagaacgtggtattcatcctgttcgggtagccgagggatatgagatggcttctagagttgctgtcgagcatttggaacatatttctaataagttcaattttagtgctacagatattgaacctttggttcagacctgcatgactactttatcttcaaagattgtgaatcgatgcaagcgcagtttagccgaaattgctgttaaggcagttctggctgttgcagatttagaaaggaaggatgtcaatctagacttgattaaagtcgaggggaaagtagggggtaaattggaagacactgagcttatcaatggaattattgttgacaaggatatgagccatccccaaatgccaaagcaaattcaagatgcaaaaattgctatattgacttgcccatttgagccaccgaaacccaagactaagcataaggttgacattgacacggtagagaaatttcaaactctacgtctgcaagagcggaagtacttcgatgatatggttaaacaatgcaaggatgttggcgcaaccctagttatttgtcaatggggttttgatgatgaagcaaatcatttgttgatgaaccacaatttgcccgctgtaagatgggttggtggagtagaactagagcttatcgcgatagctacaggtggaagaattgtgccaagattccaagagttgacaccagagaagctggggaaggctggtttagttagagagaagtcatttgggacaaccaaagatcgaatgctgtacattgagaagtgtgcaaattcaagggccgtaactatatttatccgtggtggtaacaaaatgatgatagaggagacaaagcgtagtcttcatgatgctctctgtgtagcaagaaatctaatacgaaacaactctatcgtatatggtggtggatcagctgagatttcttgctccattgctgtagaggcagctgcagataagtatcctggagttgaacagtatgctataagggctttcgcagatgctttggattctattccaatggcactagcagaaaacagtggactccaacccattgaaactctttccgctgtcaaatctcagcagatcaaggagagcaacccgtgctgcggaatcgactgcaatgatgttggaacaaatgatatgcgtgaacagaatgttttcgagaccttgattgggaagcaacaacaaattttactcgccacacaggttgtcaaaatgattctcaagattgatgatgttattagcccatcagaatactgattaatcacttcggaagaaatgtcattctgttactagagtttaagcgatcgttcactttgttcttgttttctcaccgtgcttaggttagtcggtaggacgggctttacgatatggttttgcggtgggcggtgttatttttt

SEQ ID NO: 1919 - DNA, 2124 bp, Cajanus cajan
ggaagcataatagaaggtggagggttagggcttaagagtgaacaagtggttccttcttctacactctcttcttcttcttcttgtcgaatcgcgattgttctgtctgcaagagaaagcagagatcgaaaatggcgttggctttcgacgagttcggaaggcctttcataatcctgaaggagcaggaacagaagagtagactcagaggcttagacgctcagaaatcaaacatctccgccggcaaagccgtcgctcgcatcctccgaacctccctcggccccaaaggcatggacaagatgctccaaagccccgacggcgacgtcacaataacgaacgatggcgccacgattctcgagcagatggacgtggacaaccaaatcgcgaagctgatggtggagctttcgaggagtcaggactacgaaatcggcgacggcaccaccggcgtcgtcgtcctcgccggcgcgcttctcgagaaggcggagcgcctcctcgagcgcggaattcaccccatcaggatcgccgagggttacgaaatggcgtcgaggatcgccgtcgaacacctcgagcgcgtcgccaacaagttcgagtttgatgacaccaatttggagcctctcattcaaacttgcatgaccaccctctcctcaaagattgtgaatcggtgcaagcgtagcttggctgagatcgctgtgaaggcggttctcgctgttgctgatctggagaggaaggatgttaatttggatctgattaaagtggaagggaaagttggtgggaagttggaggatactgagttgatttatggcattgttgttgataaggatatgagtcatccccagatgcctaagcagattgaggatgctaaaattgctatcctcacttgcccctttgagcctcccaagccaaagactaagcataaggttgatatcgatacggtggagaagtttcagacgttgaggttgcaggaacagaagtattttgatgacatggttcaaaagtgcaaggatgtgggtgcaacgctggtcatttgccaatggggttttgacgacgaagcaaatcatctcctaatgcacaggaacttgccagccgtcagatgggttggtggtgtagagttggaattgatagctatagcaacaggtggaagaattgtgcctaggttccaagagttatctacagaaaagttgggaaaggctggtatggttcgagaaaagtcatttggtacaacaaaagaccgaatgctatacattgaacattgtgcaaactcaagggctgtaacaatattcattcgaggaggtaacaaaatgatcatagaggagacaaagcgcagccttcacgatgcattgtgtgtggctaggaatcttattcgcaataagtctattgtatatggtggtggttcagctgagattgcctgctctatagctgtggaggcagctgctgatagataccctggagtagaacagtatgctattagagcatttggggatgctttggaggccatcccaatggcccttgctgaaaatagtggcctccaaccgattgaaacattatccgctgtcaaggctcagcaaataaaggataataaccctcactttggcattgattgtaatgatgttggcactaatgacatgcgtgagcaaaatgtctttgaaactttgattggaaagcagcaacagctcttgctcgctactcaagttgtcaagatgattctgaaaattgatgatgtcatttccccatctgagtactgatatttttaaaatcatgttttacatcaagatgatgaattggcgatagtattttgttccattgattttgttgtagtcagagttggtatgttcacttggaatgtaagattttggcacggtttgtatcggagttgggtgacttttcttttgtttaatgcaattgtcatgcttttgatatttaacatcatggatgaattattttttataggccttttgcttttaacctctgtttgtaggccgtggttggaaaattgtgatcttactttttagtcctattttgggcccttttcaaatggttgtttaattggttgtgcaactgagcgattgtaggctagacgaaagtgtttagggctttaggaaaacccttgattgtcttggagttatggacatt

SEQ ID NO: 1920 - DNA, 1941 bp, Secale cereale
ctcccccggtgcgatccgacccttctagaagcgccgcgcgctcgtcccgtccatcggcggcgccggccatggcgctggcgttcgacgatttcggacggcccttcatcatcctgagggagcaggagagcaagtcccgcctgcgggggctcgacgcgcacaaggccaacgtcgccgccggcaaggccatcgcgcgcagcctccgcacctccctcggccccaagggcatggacaagattctccagtcccccgacggcgacgtcaccatcacaaatgacggggctacgatcctggagcaaatggatgttgacaaccagattgcaaagctgatggtggagctttcccgtagtcaagactatgaaattggggatggtactactggggtggtggtcctggcagggtcgctcctggagcaagctgagaaactgctagagcgtggtattcacccgataagaattgccgaaggatatgagatggcctccaagttagcttttgatcaccttgaacgtatctccactaggtttgagttcactgctgcaaatatagagcccttggtacagacctgcgtgacaactctgtcctcaaagatagttaaccgttgtaagcggatgcttgctgagattgctgtcagggcagtccttgctgttgctgatctggaaaggaaggatgtaaacttggacttgattaaagtagaaggtaaagttggtgggaagctagaggacactgagctaatatacggaatcgctgttgacaaagatatgagccacccacaaatgccaaagagaatcgaggatgctaatattgccatccttacctgcccatttgagcctccaaagcccaagacaaagcataaggttgacattgacactatagaaaaattccagacgatgcgtggacaagagcaaaaatactttgatgaaatggttcagaaatgcaaggatgttggtgcaaccttagttatctgtcaatggggttttgatgatgaagccaatcatttgcttatgcaaagaaatctgcccgctgtcagatgggttggtggtgttgaattggaattgattgccatagctacaggggggcgcattgttcctagattccaagagttgactcctgataagcttgggcaggctggattggttagagagaagtcatttggaacaacaaaggatcgaatgctttatattgagaggtgcgcaaattccagagctgtaactatcttaatccgtggcggcaacaaaatgatgattgaggaggccaagagaagtattcatgacgctctctgtgtggctagaaatctgatccggaataactctattgtttatggtgggggctcagctgagatatcttgctcaattgctgttgaagctgctgcagatcgatatgctggagccgagcagtatgcaatcaggtcgtttgctgatgcgttggatgggattccactagccttggctgaaaacagtggtttgccacctattgatacgttgactgcagtaaaatatcagcaaattcaggagaacaatccttactgtggcatcgactgcaatgacgtcgggaccaatgatatgagagaacagaacgtctttgagaccctgattggcaagcaacaacagatattgttggcgacgcaggttgtgaagatgattctcaagatcgacgatgttatcacgccgtcagagttctgagtactgatgatgttacaagcatggggaactgtgctggataacaagccatcattgtaacttgcagcattgctgaagcaattggattggccacttgcttgtaccttaggcctgtattctgcttgtgacgcttgatgaacatgaataatgatcaatctctctctttttctgtattttcggatgcttagtgctttagtctgagtgacttttactcccttagtaaagaaatctctgatgtacgtataagtataagtataagtatttagat

SEQ ID NO: 1921 - DNA, 1914 bp, Triphysaria pusilla
cccactccgcacttcgatttcaaattcggatccataataagatccgacccatatccaccacagcccggagctatggcgctggccttcgatgagtatggtcggccgttcattattctaagggagcaggagcagaaaaccagattgcgcggcctcgatgcgcagaagtcgaatatctccgccggcaaagcggtggctcggatcctccgaacctcactggggccgaaaggcatggataagatgcttcagagtcctgacggtgatatcaccataacgaatgatggtgcaacaatcttggagcagatggatgttgataaccagattggtaagctcatggttgaattgtctcggagtcaagactatgaaatcggtgatgggacaactggagttgttgttatggctggtgcgcttctagaacaagctgagaaacttctggaacgtgggattcatcctatccggattgcagaaggatatgaagtggcctccaggattgcttacgaacatttggagaatatatcacataagtttgtatttggcgcaactgatatcgagcctttgattcagacttgcatgacaactttatcctccaagattgtgaacagatgcaagcgtagtttggctgagattgcggttaaagcagtggttgctgttgcagatttggagaggaaggacgttaatcttgacttgattaaagtggagggaaaagtaggtggaaagctggaggataccgaactgatatatgggattgtggttgacaaagatatgagccatcctcagatgccaaagcaaattcaggatgcgaacattgccattctgacctgcccctttgagcctccgaaaccaaagactaaacataaggttgacatcgacaccgtggagaaattccaaaccttacgcgaacaagaacgcaagtactttgacaatatggttcaacaatgcaaggatgttggtgctacactggttatctgccagtggggcttcgacgacgaggcgaaccacttattgatgaatagaaacttgcctgctgtgcgatgggtcggtggcgtggagttagagctgatagctattgccacaggtgggagaattgtgccaagatttcaggagttgacaccagagaaactaggcaaggctggtttggttcgagaaaaagcttttggaaccactaaagatcgaatgatatacattgagcactgtgcaaattcaagggccgtaaccatatttatacgtggaggtaacaagatgatgatagaggaaacaaaacgcagcattcacgatgctctatgtgttgcccgtaatcttattcgcaacaactccattgtctatggtggtgggtccgctgaaattgcttgctcgattgctgtggaagcagctgctgacaagcaccctggagttgagcagtatgcaattagggcgtttgcagatgcattagatgctatcccaatggccctggcagaaaatagtggtctccagcctattgaaacattatctgccgtcaaatctcagcaaattaaggagaacaatagctgctgtggaattgattgcaatgatgtgggcacaaacgacatgcgcgagcagaatgttttcgagactttgatcgggaaacagcagcagctgttgcttgccacacaagtcgtcaagatgattctgaaaatcgatgatgtcatctcaccatccgagtattgatttttagtttttattttaccaggtactttgttgcaagaattttggtatccagaatagtttttagttttctgaatttggttgttattttaatcgttccaagcctattcgatactttttcttggtaatgcctttttttgtgtgtgtattgaattgatgtatggttgattatcatgtcacctttttattgtgcaagatatgatttagcattttcactaaaaaaaaaaaaaaaaaaag

SEQ ID NO: 1922 - DNA, 2063 bp, Mimulus guttatus
gccactactagggctaaagtatctgttctcaaactcttccccaaagctcacatcactctctccttccttgaactcttcatttcaattttcctcgtcggatccatataaagatccgctactttttctaccggcgccggaacaatggcgctggcgttcgatgagtacggccgaccgttcattattctaagggagcaggaccagaaaaccagattgcgcggcctcgatgcgcagaaggcgaatatcgccgccgggaaagcggtggcgcggatccttcgcacctctctagggccgaaaggcatggataagatgcttcagagccctgacggtgaagtcaccataacaaatgatggtgcaacgatcttggagcagatggatgtggacaatcagattggtaagctaatggttgagttgtcgaggagtcaagactatgaaatcggtgatggaacgactggagttgttgttatggccggttcacttctagaacaagctgagaagctattggagcgtggtatccacccgatacgaatcgctgaaggatatgaagttgcttcgaggattgctttcgaacatttggagcagattgctaataagtttgaattcagcgcagcaaatgttgagcccttgattcagacttgtatgactactttatcctccaagattgtgaataggtgcaagcgcagtttggcggagattgcagttaaagcagtgcttgctgttgcagatttagagaggagggatgtcaatctagacttaattaaagtcgaggggaaagtgggaggaaagctggaggacactgaactaatatatgggattattgtcgacaaagatatgagtcatccgcaaatgccgaagcaaattgtggatgcaaatattgctattctaacttgcccctttgagcccccgaagcccaagactaaacataaggttgatattgatactgtggaaaaattccagactttacgtcaacaagagcagaagtacttcgacgatatggttcaaaaatgcaaggatgttggggctactttagtcatctgccaatggggtttcgatgacgaggcaaaccacttgttaatgaacagagatctgcctgctatcagatgggttggtggtgtggagttagagctgatagctatagccacaggtgggagaattgtaccgagatttcaggagttgacaacagaaaagctaggcaaagctggtttggttcgagaaaaagcctttgggactactaaagatcgaatgatatacatcgagcactgtgcaaattcaagggcggtaaccatatttatacgtggtggtaacaagatgatgatagaggaaacaaaacgcagcattcacgatgctctatgtgttgctcgaaatcttatccgtaataaatcaatcgtatatggtggtggctcagctgaaatttcttgctcaattgccgtggaagcagctgcagataagtacccaggagttgagcagtatgcaataagggcatttgcagatgcattagatgctataccaatggcactggccgaaaatagtggacttcagcctatcgaaactctatccgctgtcaaatctcagcaaattaaggagaacaacagctactgtggtattgattgcaacgacgtggggacaaacgacatgcgcgagcagaatgttttcgagacgttgatagggaaacaacagcagattctacttgctacccaagttgttaagatgattctaaagatcgatgatgtcatctcaccgtctgattattgatttccttctagttttcatgcaaaaaattttgatgtttagaaatagcttgcgagaatatttatgtagttaaatctgaatcgattgactgttatcgtttgattctctaaagccgctttgggtgaaattatttgtgatgggttttattttgtaatgaattctgtttttatggttttatcaacagctgttgtgttgttttcatttttttcaactatttttatggtattatgtttgtaatgaattctatttttcttcgatcaattgctttcgatttgtgaaatacagcaattgaagaataaaaaattcttaaaatgatt

SEQ ID NO: 1923 - DNA, 1913 bp, Ambrosia trifida
cacacacacacagtgtgccgcgatctaacctaactttgtgaaagaaagagagatctggtgctgctacaacaacacaatggcgttagccttcgacgaatacggtcgaccattcataatacttagggaacaagaaagcaagaccaggttacgaggcatagatgctcaaaaagccaacatctctgccggtgttgctgtctctcgtatcctccgtacgtctctcggccctaaaggcatggataagatgcttcagagccccgacggtgacatcaccatcacaaatgacggcgcaacaatcttggaacaaatggacgttgacaaccaaattgggaaacttatggttgagctgtcacgtagtcaagattatgaaattggtgatggaacaactggtgtagttgttctggctggtgcacttttagaacaagctgagaagcttttggaacgtggaattcatcccattcgagttgcagaaggatttgaaatttcttcaaagatggctgttgaccatttggaaaagatatcacataaatttgatttcagtgcttcgaatatcgaaccgttggttcaaacttgcatgactaccttatcctccaaaattgtgaatcgatgcaagcgtagcctggctgagattgctgtaaaaggtgtcatggctgttgctgatttagagagaaaagatgttaatttggatttgatcaaagtggagggaaaggttggtggaaaattagaggatacagaacttatttatggaattgttgttgataaagatatgagtcacccacaaatgccaaagcaaattgaagatgcaaaaattgctattttgacctgcccatttgagccaccaaagcctaagaccaaacataaggttgacattgatacggttgaaaagtttcaaactttgaggaagcaagaacagcagtactttgacgaaatggttcagaaatgcaaggatgtaggggccacactggtaatttgtcaatggggctttgatgatgaagcaaatcacttattaatgcacagaaatttgcccgccgtcagatgggttggtggtgtagaactggagctaatagcaatagctactggtggtaggattgttcccaggttccaggaactaacaactgaaaaactaggaaaggctggtttggttagagaaaaggcatttggtaccacaaaagatagaatgctttatattgagcattgtgcaaactcaaaggctgtaaccatttttattcgtggaggtaacaagatgatgattgaagagacaaaacgcagcatccatgatgcattatgtgttgctagaaatctcattcgtaataactcgattgtatatggtggcggggctgcagaaatttcatgctcaattgcagttgaagctgctgctgataaatatccaggtgttgaacagtatgccatcagggcttttgcggacgccttggactctgtacccatggctcttgcagagaatagtggtctgcaacctatcgaaacagtatctgcagtgaaagcacaacaaattaaggaaaacaatcattgctgtggcattgactgcaacgataccggtaccaatgatatgcgtgagcaaaacgtatttgagaccttaatcggcaagcaacaacagatcttgcttgccacacaagtcgtgaaaatgatcttgaagatcgatgatgtcatctccccgtcagagtactgacatcgtagcttctaccaactttcaagttttggtacgtagaacactgcagctaattatttgcttaaaaacctagtcttgttttgtactcttttcatgtgtgttgctgttatttgtttggtgttgatgtttgttttattttgagaacactaccgttttactttgtgtatgattccttgagcgttttctcaagtcccaaaatctcggttcatacaacaaacaaaaaaagaaa

SEQ ID NO: 1924 - DNA, 1780 bp, Ambrosia trifida
atagcagcatactctagaaccccacacacacacacagtgtgccgcgatctaacctaactgtgtgaaagaaagagagatctggtgcttcaacaagacaatggcgttagccttcgacgaatacggtcgaccattcataatacttagggaacaagaaagcaagaccaggttacgaggcatagatgctcagaaagccaacatctctgctggtgttgctgtctctcgtatcctccgtacgtctctcggccctaaaggcatggataagatgcttcagagccccgacggtgacatcaccatcacaaatgatggcgcaacgatcttggaacaaatggacgttgacaatcaaattgggaaacttatggttgagctgtcacgtagtcaagattatgaaattggtgatggaacaactggtgtagttgttctggctggtgcacttttagaacaagctgagaagcttttggaacgtggaattcatcccattcgagttgcagaagggtttgagatttcttcaaagatggctgttgaccatttggaaaagatatcacataaatttgatttcagtgcttcaaatatcgaaccattggttcaaacttgcatgactaccttatcctccaaaattgtgaaccgatgcaagcgtagcttggctgagattgctgtaaaaggagtcatggctgttgctgatttagagagaaaagatgttaacctagatttgatcaaagtggagggaaaggttggtggaaagctagaggatacagaacttatttatggaattattgttgataaagatatgagtcacccacaaatgccaaagcaaattgaagatgcgaaaattgctattttgacctgcccatttgagccaccaaagcctaagaccaaacataaggttgacattgatactgttgaaaagtttcaaactttgaggaagcaagaacagcagtactttgatgacatggttcagaaatgcaaggatgtaggggccacactggtaatctgtcaatggggctttgatgatgaagcaaatcacttattaatgcacagaaacttgccagctgtcagatgggttggtggcgtagaactggagctaatagcaatagctactggtggtaggattgttcccaggttccaggaactaacaactgaaaaactaggaaaggctgggttggttagagaaaaggcatttggtaccacaaaagatcgaatgctttatattgagcattgcgcaaactcaaaggctgtaaccgtttttattcgtggaggtaacaagatgatgatcgaagagacaaaacgcagcatccatgatgcattatgtgttgctagaaatctcattcgtaataactcgattgtgtatggtggcggggctgcagaaatttcatgctcaattgcagttgaagctgctgctgataaatatccaggagttgaacagtatgccatcagggcttttgcagacgccttggactctgtacccatggctcttgcagagaatagtggtctgcaacccatcgaaacactatctgctgtgaaagcacaacaaattaaggaaaacaatcattgctgtggcattgactgcaacgataccggtacaaatgatatgcgtgagcaaaacgtatttgagaccttaatcggcaagcaacaacagatcttgctcgccacacaagtcgtgaaaatgatcttgaagatcgacgatgttatctccccgtcagagtactgacgtggtagcttcaaccaacgttctagttttgctacgtagaacactgcagcttattatttgctggaaaacctagtc

SEQ ID NO: 1925 - DNA, 1900 bp, Arnica chamissonis
aaaagtatcagcatcctctggaagcacacacactgtgtgccgatctaactgttgttttcgcatcatttcgtcgatcttagagcttaatcgggtgaaagatctgcaaaaatggcgttagcgttcgatgaatacggacggccgtttataatacttagggaacaagaaagtaagagtagattaaggggtttagatgctcaaaaggctaacatcgccgccggcgttgctgtatctcgcattctccgtacttctcttggtcctaaaggcatggataagatgctccagagccccgacggcgacatcaccatcacaaatgatggtgcaacaatcttggagcaaatggatgttgataatcaaattggaaaacttatggttgaattgtcacgtagtcaagattatgaaataggtgatggaacaactggagtagttgttatggctggctcacttttagaacaagcagagaagcttttagaacgtggaattcatcccattcgagttgcagaaggatttgaaatctcttcaaggattgctgttgatcatttagaacaaatagcgcataagtttaatttcagtgctactgatatagaacctttggttcaaacatgcatgaccaccttatcctccaagatcgtgaatcgatgcaagcgtagcttggctgagattgctgtaaaaagtgtcatggctgtagctgatttagagagaaaagatgttaatcttgatttgattaaagtggagggaaaggtcggtgggaagttagaagacacagaacttatttatggaattattgttgataaagacatgagtcacccacaaatgccaaagcaaattgaagatgcaaagattgctattttgacctgcccttttgagccaccaaagcctaagaccaaacataaggttgacattgatacagttgaaaagtttcaaactttaaggaagcaagaacaaaagtactttgatgacatggttcagaaatgcaaggatgtaggtgcaacactggtaatttgtcaatggggctttgatgatgaagcaaatcacttattaatgcacagaaatttgccagctgtcagatgggttggtggtgtagagcttgagctaatagcaatagctactggtggtagaattgttcccaggttccaggaactaacacctgaaaagctaggaaaggctggtttggttagagagaaggcatttggtaccacgaaagaccgaatgctttatattgagcattgtgcaaactcaaaggctgtaaccgtttttattcgtggaggtaacaagatgatgatagaggagacaaaacgcagcattcatgatgcattatgtgttgctagaaatctcattcgtaataactcgattgtatatggtggtggggctgcagaaatctcatgctcaattgcagttgaagctgctgctgataaatatccaggtgttgaacagtatgccatcagagcttttgcagatgccttggattctgtacccatggctcttgcagagaatagtggtctgcaacccatcgaaacactatctgcggtgaaagcacagcaaattaaggaaaaaaatgattgctgtggcattgactgcaacgatactggtacaaacgatatgcgtgcacaaaacgtatttgaaaccttaatcggcaagcaacaacagatcttgcttgcaacccaggtcgtgaaaatgatcttgaagatcgacgatgtcatctccccatcagactactgatattgtggttcttataccaaccttccaagttttgctcagatgtagaacattgcaaccgtttaattgctggaaaacttagtctcgttttgtaccctttgtttaggtgtccttgctctcggttgtttggtgtttgtgtttgttttattttgagaacagtacatcatactctttactcgtacaattc

SEQ ID NO: 1926 - DNA, 2477 bp, Musa acuminata
cgcgtgggtcgagctccatgccagaaacccccaaccctagtggcttccgctgccccggttgttgtttccctgcggaaatataagtgcctccgcccaccgcctcctcctcaaggacctccttgcttcctcctgacacaaccattctttggaagtagtagaagaagggcaaaggaagagaagaagtataaggggggcagaatggcgctggcgttcgacgagtacggccggcccttcatcataatcaaggagcaggggcagaaggcgcggctgcggggcctcgaggcgcagaaggccaacatctccgccgggaaggccgtcgctcgtatccttcgtacctcgctcggccccaagggcatggacaagatgctgcagagccccgatggcgacgttatcgtcacaaatgatggggccactatcttggagcagatggatgttgataatcagattggcaaactgatggtggaattatctcgtagtcaggactatgaaattggtgatggtaccactggggttgttgttttggctggtgcacttctcgaacaggctgagaagcttttggaacgtggtattcatcctattagaattgctgagggctatgaaatggcctctaggctagctgtggatcatcttgagcacatatcacagaaatttgaatttagtgttaccaatatagagcctttggtgcaaacttgcatgacaacattatcttcaaaaattgttaaccgttgcaagcgtgcgttagctgagattgctgttaaggcagttcttgcagttgcagatttggagaggaaagatgttaacttggaattaattaaggttgaaggaaaggtcggaggaaaattggaagacacagaactcatttacggaattgttgtcgacaaggatatgagccacccccaaatgccaaaaagaattgaagaagcaaagattgctattcttacatgcccatttgaaccacccaagccaaagacaaagcataagattgacattgacactgttgaaaaatttcaaactctacgccagcaagagcagaaatactttgatgatatggtccaaaaatgcaaggatgttggtgcaaccctagttatctgtcagtggggttttgatgatgaggcaaatcatttattgatgcatcgaaatttgcctgctgttagatgggttggtggtgttgaattagaattaattgcaatcgctacaggtgggagaatagttccgaggttccaggacttgacagatgaaaagctgggaaaggctggattagttagagaaaaatcatttggaacaactaaggaccggatgttgtatattgaacattgtgctaactccagagctgtaacaattttcattcgtggcggtaacaaaatgatgatagacgaaactaagcgtagtcttcatgatgcactttgtgtggcaaggaatctgatccgtagcaattcaattgtttatggtggtggctctgcagaattatcttgctcaattgctgtagaagctgctgcagacaaatatcctggggttgagcagtatgctatcaggtcctttgctgaagctttagattttattccgatggctcttgctgagaactgtggcctcccacctattgatactgttacagctgtcaaatctcagcaaattaaggaaaataatccttattgtggtatagattgcaacgatgttgggacaaataacatgatggagcagaatgtatttgagacgctgattggcaaacaacaacagatcttgctggcaactcaagtagtgaaaatgattttgaagattgatgatgtgatcactccatccgcctattgattttggaggataagttcctaagctaagatctatttgtcagaatttgctatggctaagtgggatataagcattatccttgcatccaaagactctcattgcatctcttttgtgctttcttaatgatttatgagtgtacaatgtcagtcttgcgacaattttgtcaccggccaatctatcggcatcatatgtatttcgtttcatttggttctttccaaatgggaaattggaaaagaagactgactgtatgcacttgaagtctggatttgatacactgcaactcttgatgttctaggaatctgggtagctagaatttctttcagggcctgacataagtatctttcttgattggaaagctttgatgcttgaatgatgcaaatattagctgtccgatagattggacagcagtatcaatttgcctttcggataggttgtggaatcaatttgcctttcggataggttgtggaattttaacatagtgaccgatgatggccttcggctcatcaatatcaattctagggaagctagtttgaacttcaaacttttcgccagaaagctggtcagtttaagcttatttactgtttccatgtagtgaaaattaattgtgagattatatatgacatgtatatttgtatctttcacttatgataattggaaacagtatctatttccac

SEQ ID NO: 1927 - DNA, 1902 bp, Vaccinium corymbosum
gcggtcgtgtcgtccggcgatctgggcgttatcggtggaagagagtaaacagaagcggtggagaaatggcgttggctttcgacgagtatgggaggccgttcataataatcaaggagcaggagcagaaaaccagactaagaggaatcgacgctcagaaagccaacatttccgctggaaaatcagtagctcgtatcctacgtacctccctcggccccaagggcatggacaagatgctacagagccccgatggcgaagtcaccatcacaaatgatggtgcaactatattggagcagatggatgttgacaatcaaattgcaaaattgatggtcgaattatcacgaagtcaagactatgaaattggtgacggaacaaccggagttgttgtgatggctggcgcacttctggaacaggctgagcggctcttggaacgtggtattcatcctattcgagttgcggaaggctatgaaatggcttccaggatagctgttgaacatttggaacggattgctaataagtttgaatttagttccacaaatgttgagcctttggttcaaacttgcatgactactttatcatctaagattgtgaatagatgcaagcgtagtttggcagaaattgctgtgaatgcagttttggcagttgccgatttagacaggaaggatgtcaacttggagctaattaaggtggagggaaaagttggtgggaaattggaggatacagagctaatcaaaggaattattgtcgacaaagatatgagccatccacagatgccaaagcatattgaggatgcaaaaattgcaattttgacttgcccatttgagccaccaaagccaaagacaaagcataaggttgacattgacacagttgagaagttccagaatttacgtgggcaagagcagaagtactttgatgatatggttcagaaatgcaaggatgttggcgctaccttggtcatctgccaatgggggtttgatgatgaagcaaatcacttgttaatgcataggaacttacctgcagtccgatgggttggtggagtagagttggagctgatagcaatagcgacaggtggtaggatcgtgccgaggttccaagagttgacccctgaaaagctgggcaaggctggtttggtgcgagaaaaatcatttggaaccaccaaagatcgaatgatttatatcgaacattgtgcgaattcaagggccgtaaccatattcattcgtggtggtaacaaaatgatgatagaagaaaccaagcgaagtatccacgatgctttgtgtgtggctcgaaatctgattcgcaacaactccatagtgtatggcggtggtgcggctgaaatttcttgttcacttgccgtggaggcagctgctgatagacatccaggagttgaacagtatgccatcagggcatttgcagaagctttagattctatccccatggcactcgcagaaaatagcggtctccaacccattgaaacattatctgctgtgaaatctcagcaaattaaggagaacaatacctgctgtggcatagactgcaatgatgttggcacgaatgacatgcgtgagcaaaatgtctttgagacgctaattgggaagcagcagcagatattgctagcaacacaagttgtcaagatgattctgaagattgatgatgtcatctctccttctgaatactgatgtacgtgagtacttaatttgaattgaaaaagttttgattcgccgagaatgttagccacattgtattatcagatcaaatggtgactcaaagtaactcattctacatgttccgttgggttgggtgagatctaccgatgtttggtttgttttctggttggcagactgcttaatgttgttgcttagcttttgaacattttgtggattttgttgcgttaaaattggttttgct

SEQ ID NO: 1928 - DNA, 1955 bp, Mimulus guttatus
gccactactagggctaaagtatctgttctcaaactcttccccaaagctcacatcactctctccttccttgaactcttcatttcaattttcctcgtcggatccatataaagatccgctactttttctaccggcgccggaacaatggcgctggcgttcgatgagtacggccgaccgttcattattctaagggagcaggaccagaaaaccagattgcgcggcctcgatgcgcagaaggcgaatatcgccgccgggaaagcggtggcgcggatccttcgcacctctctagggccgaaaggcatggataagatgcttcagagccctgacggtgaagtcaccataacaaatgatggtgcaacgatcttggagcagatggatgtggacaatcagattggtaagctaatggttgagttgtcgaggagtcaagactatgaaatcggtgatggaacgactggagttgttgttatggccggttcacttctagaacaagctgagaagctattggagcgtggtatccacccgatacgaatcgctgaaggatatgaagttgcttcgaggattgctttcgaacatttggagcagattgctaataagtttgaattcagcgcagcaaatgttgagcccttgattcagacttgtatgactactttatcctccaagattgtgaataggtgcaagcgcagtttggcggagattgcagttaaagcagtgcttgctgttgcagatttagagaggagggatgtcaatctagacttaattaaagtcgaggggaaagtgggaggaaagctggaggacactgaactaatatatgggattattgtcgacaaagatatgagtcatccgcaaatgccgaagcaaattgtggatgcaaatattgctattctaacttgcccctttgagcccccgaagcccaagactaaacataaggttgatattgatactgtggaaaaattccagactttacgtcaacaagagcagaagtacttcgacgatatggttcaaaaatgcaaggatgttggggctactttagtcatctgccaatggggtttcgatgacgaggcaaaccacttgttaatgaacagagatctgcctgctatcagatgggttggtggtgtggagttagagctgatagctatagccacaggtgggagaattgtaccgagatttcaggagttgacaacagaaaagctaggcaaagctggtttggttcgagaaaaagcctttgggactactaaagatcgaatgatatacatcgagcactgtgcaaattcaagggcggtaaccatatttatacgtggtggtaacaagatgatgatagaggaaacaaaacgcagcattcacgatgctctatgtgttgctcgaaatcttatccgtaataaatcaatcgtatatggtggtggctcagctgaaatttcttgctcaattgccgtggaagcagctgcagataagtacccaggagttgagcagtatgcaataagggcatttgcagatgcattagatgctataccaatggcactggccgaaaatagtggacttcagcctatcgaaactctatccgctgtcaaatctcagcaaattaaggagaacaacagctactgtggtattgattgcaacgacgtggggacaaacgacatgcgcgagcagaatgttttcgagacgttgatagggaaacaacagcagattctacttgctacccaagttgttaagatgattctaaagatcgatgatgtcatctcaccgtctgattattgatttccttctagttttcatgcaaaaaattttgatgtttagaaatagcttgcgagaatatttatgtagttaaatctgaatcgattgactgttatcgtttgattctctaaagccgctttgggtgaaattatttgtgatgggttttattttgtaatgaattctgtttttatggttttatcaacagctgttgtgttgttttcatttttttc

SEQ ID NO: 1929 - DNA, 1992 bp, Trigonella foenum-graecum
atagcaatagcaactttcagtgtcattgtttagggttctacacttctctttacaccactcttctcatttttccgatcgcagtttctagcgaaaacaacaaaatagggttttggatcgtgatcgtgtagatcaaaatggcgctggctttcgacgagttcggaagacctttcattatcctcagagaacaagaatcgaagaaccgacttcgtggtctcgatgctcagaaagctaacatctccgccggtaaagccgtcgctcgtattctccgtacctctctcggtcctaagggtatggacaagatgcttcaaagccccgacggtgacgtcatcatctcgaatgatggagcgacgatattggagcagatggatgtggacaaccagattgcgaagctgatggtggagttgtcgaggagtcaggactatgaaatcggtgatggaaccactggagttgttgtgttggctggatctcttcttgagcaagctgagaggcttttggaacgtgggattcatcccattaggattgccgagggatatgaaatggcttccaggattgctgttgagaatctggagaagattgcgaataagtttgagtttggtgaaactattttggagcctttgattcagacttgtatgactactttgtcatcgaaaattgtgaatcggtgcaagcgtagcttggctgagattgctgtgaaagctgttcttgccgttgctgatctacagaggaaagatgttaacttggatctaattaaagtagaaggaaaggttggtgggaaattggaagatactgagttggtatatggaatcattgttgataaggatatgagccatcctcaaatgccaaagcaaattgaagatgctaaaattgctattctgacttgcccatttgagcccccgaagccaaaaaccaagcataaggttgatattgatacagtggagaagtttcagacattgaggaaacaagaacaaaaatattttgatgacatggttcaacaatgcaaggatgtaggtgcaacccttgttatttgccaatggggttttgacgatgaagcaaatcatctcttgatgcacaggaacttgccagctgttagatgggttggtggtgttgagttggaattgattgccatagcaacaggtggaagaattgttcctaggttccaggagttaactgcagaaaagttgggaaaggctggcatcgttagggaaaaagcatttggaacaactaaagatcgaatgctgtatattgagcattgtgcaaactcaagggctgtaacaatattcattcgtggaggcaacaaaatgatcatcgaggagacaaagcgcagtattcacgatgcattgtgcgtggctaggaatcttattcgcaataattcaattgtgtatggtggcggttcagctgagattgcttgctctattgccgtggaggcagctgctgatagataccctggagtagaacagtacgcgattagagcatttggggatgctttggagtctatccctatggcccttgctgaaaatagtggtctccaaccaattgaaacattatctgctgtgaagtctcagcaaataacggagaaaaatcctcactttggaattgattgcaatgatgttggcaccaatgacatgagggagcaaaatgtcttcgaaactttgatcggaaagcagcaacagatcttgcttgctactcaagttgttaagatgatattgaaaatcgatgatgttatttccccatctgagtactaatatatcttttcttgaactcttgttgcatgtcaagatgcaaaattgctgctggtattttgtttgggtcgtatgattttagtcagtttgtattttaacttgaagtataattatgttaagattttggcacgtttttgtattggagtttgggtgactgttttccttttttctgataaagggcgatagttcttttgtttgatgcatttttgtagttgaatattatgaattcgtttatggtagtcctcggaagttg

SEQ ID NO: 1930 - DNA, 1702 bp, Triphysaria pusilla
cccactccgcatttcgatttcaaattcggatccataaaagatccgatccatttccaccacaaccggagctatggctttggccttcgatgagtatggtcggccgttcattattctaagggagcaggagcagaaaaccaggttgcgcggcctcgatgcgcagaaatcgaatatctccgccggcaaagccgtggctcggatcctccgaacctcactgggaccgaaaggcatggataagatgcttcagagtcctgacggtgatatcacaataacgaatgatggtgcaacaatcttggagcagatggatgttgataaccagattggtaagctcatggtcgaattgtcacgtagtcaagactatgaaatcggtgatggtacaactggagttgttgttctggctggtgcgcttctagaacaagctgagagacttctggaacgtgggattcatcctatccggattgcagaagggtatgaagtggcctccaggattgcttttgaacatttggagaatatatcccataagtttgtatttggcgcaacagatattgagcctttgattcagacttgtatgaccactttatcctccaagattgtgaacagatgcaagcgtaatttggctgagattgcggttaaagcagtggttgctgttgcagatttggagaggaaggatgtcaatcttgatttgattaaagtggaggggaaagtaggtggaaagctggaggataccgaactaatttacgggatagtggttgacaaagatatgagccatccacagatgccaaagcaaattcaagacgccaaaattgccattctaacatgcccctttgagcctccgaagccaaagactaaacataaggttgacattgatactgtggagaaattccaaactttacgtgaacaagagcgcaagtactttgacaatatggttcaactatgcaaggatgttggggctacattggttatctgccagtggggctttgatgacgaggcgaaccacttattgatgaatagaaacttgcctgctgtgcgatgggtcggtggtgtggagttagagctgatagctattgccacaggtggtagaattgtgccaagatttcaggagttgactccagagaaactaggcaaggctggtttggttcgagaaaaagcttttggaaccactaaagatcgaatgatatatatcgagcactgtgcgaattcaagggctgtaaccatatttatacgtggaggtaacaagatgatgatagaggaaacgaaacgcagcattcacgatgctttatgtgttgctcgtaatcttattcgcaacaattccatcgtgtatggtggtggatccgctgaaattgcttgctcgattgctgtcgaagcagctgccgacaagtaccctggagttgagcagtatgcaattagggcgtttgcagatgcattagatgctatcccgatggccctggcagaaaatagtggtctccagcctattgaaacattatctgccgtcaaatctcagcaaattaaggagaacaatagctgctgtggaattgattgcaatgatgtgggcacaaacgacatgcgcgagcagaatgttttcgagactttgatcgggaaacagcagcagctgttgcttgccacacaggtcgtcaagatgattcttaaaatcgatgatgtcatctcaccatccgagtattgatttttagtttttatttttccaggt

SEQ ID NO: 1931 - DNA, 1807 bp, Arnica chamissonis
ctgttgttttcgcatcgtttgatttggttgatctatgagcttaatcaggtgaaagagctgcaaaaatggcgctagcttttgatgaatacggcaggccgtttataatactgagggaacaagaaagtaagagtaggttaagaggtttagatgctcaaaaagctaacatcgccgccggcgttgccgtgtctcgaatcctccgtacatctcttggccctaaaggcatggacaagatgctccagagccccgacggcgacatcaccatcacaaatgatggagcaacgatcttggagcaaatggatgtcgacaatcaaattggaaaacttatggttgaactgtcacgaagtcaagactatgaaattggtgatggaacaactggtgtagttgttatggctggtgcacttttagaacaagccgagaagcttctagaacgtggaattcatcctattcgagttgcagaaggatttgaaatatcttcaaggattgctgttgatcacttagaacaaatagcacataagtttgatttcagtggcacaaatatcgaacctctggttcaaacttgcatgactaccttatcctccaaaattgtgaatcgatgcaagcgtagtttggccgagattgctgtaaaaagtgtcatggctgttgctgatttagagagaaaagatgttaacttagatcttattaaagtggagggaaaagtcggtgggaaattggaagacacagaacttatttatggaattattgttgataaagatatgagtcacccacaaatgccaaaacaaattttagatgcaaaaattgctattttgacttgcccttttgagccaccaaagcctaagaccaagcataaggttgacatcgatactgttgaaaagtttcaaactttacgtaagcaagagcagaagtactttgatgacatggttcagaaatgcaaggatgtaggggcaacattggtaatttgtcagtgggggtttgatgatgaagcaaatcacttattaatgcacagaaatttgccggctgttagatgggttggtggggtagaactcgagcttatagcaatagcaacgggtggtcgaattgttcccaggtttcaggaactaacacctgaaaaattaggaaaggctggtttggttagagaaaaggcatttggcaccacaaaagaccgaatgctttatattgagcattgtgcaaactcaaaggctgtaaccatttttattcgtggaggtaacaagatgatgatagaggagactaaacgcagtatccatgatgcattgtgtgttgctagaaatctcattcgtaataactcgattgtatacgtgggggggctgcagaaatttcatgctcaattgcagttgaagctgctgctgataaatatccaggagttgaacagtatgccatcagggcttttgccgatgctttggattctgtccccatggctcttgctgagaatagtggtctgcaacccattgaaacactgtctgcagtgaaagctcagcaaattaaggacaagaatgattgttgtggcatagactgcaacgatgctggcacaaacgatatgcgtgagcaaaacgtatttgaaaccttaattggcaagcaacagcagatcttgcttgctacgcaagttgtgaaaatgatcttgaagattgatgatgtcatctctccatcagaattttgacatctgggattcctaccttcagtttttgctcgttggaaaacctattctatctttcgtactacggttttatgtccatttgttttggattagtgcttgtttcatttattttaagaaaaatacgttttagtgttttag

SEQ ID NO: 1932 - DNA, 2096 bp, Orobanche aegyptiaca
tatgaaataatacttgtatttaaacgacgagaaaggcaccatattacgacgcactgcctgctagggcaaggtttctcaaccctctctggcaaccctcacatcactctcttttctctactcgtcatttcaatatcaaattcggatctatagagagatcctaccgtaacccgtgacaatggctttggccttcgatgaatatggccggcctttcattataataagggagcaggagcacaaaaccagattgcgcggcctcgatgctcagaagtcgaatatctccgccgggaaagccgtggctcggatcctccgcacctctttgggacccaaaggcatggataagatgcttcaaagccctgacggtgatgtcaccataacgaatgatggtgcgacaatcctggagcagatggatgtcgacaatcagattgctaagctcatggttgaattgtcccgaagtcaagactatgaaatcggagatggaactactggagtagttgttatggcaggtgcacttctagaacaagctgagaaacttttggaacgtgggattcatcctatcagaatagcagaaggatatgaagttgcttccaggattgcttttgaacatttggagcggatagcgaataaatatgaatttgatgcagcaaatattgagcctctgattcagacttgtatgaccacactatcctccaagattgtgaatagatgcaagcgcagtttgggggagattgctgttaaagcagtgcttgctgttgcagatttagagaggaaggatgttaatctggagttaattaaagtagatggaaaagtagggggaaagctggaggatactgaattgatatatgggattgtggttgacaaggatatgagtcatccgcaaatgccaaagcaaattgaggatgcaaaaatcgctattttaacatgtccttttgagccaccgaagccaaagactaaacataaggttgacattgatactgtggaaaaattccagactttacgcgaacaagagcggaagtactttgatgatatggttcaacaatgcaaggatgctggggccacattggtaatctgccaatggggttttgatgatgaggcaaaccacttgttgatgaatagaaacttgcctgctgttcgttgggtcggtggcgtggagttagagctgatagccatagccacaggtgggagaattgtgccaagatttcaggagttgacaccagagaaacttgggaaggctggtttggttcgagaaaagcttttggaaccactaaagatcgtatgatatatattgagcattgtgcaaattcaaaggctgtaaccatatttatacgtggtggtaacaagatgatgatagaggaaacaaagcgcagcattcacgatgctttatgcgtcgctcggaatcttattagaaacaattccattgtgtacggtggtgggtccgctgaagttgcttgctcgattgctgtagaagcagctgctgataagtaccctggagttgagcagtatgcaattagggcatttgcagatgcattagatgccatcccaatggctctggcagaaaatagtggtctccagcccatagaaactctatctgcagtcaaatcccagcagattaaggagaacaacagctactatggtatcgattgcaatgacgtagggacaaacgacatgcgagagcaaaatgtttttgagactttgatcgggaagcaacagcaaattctgctcgccacacaagttgtcaagatgattctaaaaattgatgatgtcatctcaccagctgaatactgatttttattctagctggttcttgatgcaagaactttggtgtccaggacagtgtcgagggtatgtagtattctggaccgatcggcttttatcatttttagcgtgtttggtatttctggttcgtctcttcgttattgacttcgcttcatagccgattgatctgtggtttgaggatcgatcatatgatatttttgttgtgcaagacatgagttcactactccataaatgtcatttttcagttcagtgtacttcgtaggctgtgattttcttcttttttttgggataataacagtttacctcataatgtttagtgatta

SEQ ID NO: 1933 - DNA, 1919 bp, Ambrosia trifida
gcagcagcatactctagaacctcacacacacagtgtgccgcgatctaactgtagtgaaagaaagaaagaagagagagatctggtttcacacaatggcgttagccttcgacgaatacggtcgccccttcataatactcagggaacaagaaagcaagaccaggttaagaggcatagatgctcagaaagccaacatctctgccggtgttgctgtctctcgtatcctccgtacatctctcggccctaaaggcatggataagatgcttcagagccccgacggcgacatcaccatcacaaatgacggcgcaacgatcttggaacaaatggaagttgacaatcaaattgggaaacttatggttgagctgtcacgtagtcaagattatgaaattggtgatggaacaactggtgtagttgttctggctggtgcacttttagaacaagctgagaagcttttggaacgtggaattcatcccattcgagttgcagaagggtttgagatttcttcaaagatggctgttgaccatttggaaaagatatcacataaatttgatttcagtgcttcgaatatcgaaccgttggttcaaacatgcatgactaccttatcctccaaaattgtgaatcgatgcaagcgtagcttggctgagattgctgtaaaaggagtcatggctgttgctgatttagagagaaaagatgttaacctagatttgatcaaagtggagggaaaggttggtggaaagctagaggatacagaacttatttatggaattattgttgataaagatatgagtcacccacaaatgccaaagcaaattgaagatgcaaaaattgctattttgacctgcccatttgagccaccaaagcctaagaccaaacataaggttgacattgatactgttgaaaagtttcaaactttgaggaagcaagaacagcagtactttgatgacatggttcagaaatgcaaggatgtaggggccacactggtaatctgtcaatggggctttgacgatgaagcaaatcacttattaatgcacagaaacttgccagctgtcagatgggttggtggcgtagaactggagctaatagcaatagctactggtggtaggattgttccccggttccaggaactaacaactgaaaaactaggaaaggctggtttggttagagaaaaggcatttggtaccacaaaagatcgaatgctttatattgagcattgcgcaaactcaaaggctgtaaccgtttttattcgtggaggtaacaagatgatgattgaagagacgaaacgcagcatccatgatgcattatgtgttgctagaaatctcattcgtaataactcgattgtgtatggtggcggggctgcagaaatttcatgctcaattgcagttgaagctgctgctgataaatatccaggtgttgaacagtatgccatcagggcttttgcggacgccttggactctgtacccatggctcttgcagagaatagtggtctgcaacctatcgaaacactatctgcagtgaaagcacaacaaattaaggaaaacaatcattgctgtggcattgactgcaacgataccggtaccaatgatatgcgtgagcaaaacgtatttgagaccttaatcggcaagcagcaacagatcttgcttgccacacaagttgtgaaaatgatcttgaagatcgatgatgtcatctccccgtcagagtactgacatcgtagcttctaccaactttcaagttttggtacgtagaacactgcagctaattatttgcttaaaaacctagtcttgttttgtactcttttcatgtgtgttgctattatttgtttggtgttgatgtttgttttattttgagaacactaccgttttactttgtgtatgattccttgagcgttttctcaagtgttacaaaatctcggttcatgaactaaa

SEQ ID NO: 1934 - DNA, 2100 bp, Euonymus alatus
ggggagggttttaattcgcgtagggaagttcacagtttggtctctctcagtgcttctacgctcttcgtcgctattggcatacatagagcactgtctctgaatctgttattcaaagagacaaggaagaggagatcggaagtgtaaaactccgacgccgtcagaagaggaggagggaaaatggctttggctttcgacgagttcggaaggccgttcataataataaaggaccaggagcaaaagtcgagattgagaggcatcgatgcgcagaagtccaatatttctgcagggaaagcggtggctcgtatcctccgcacttccctaggtcccaagggcatggacaagatgctccagagccccgacggcgacgtcaccatcacaaatgatggtgcaacaatcttggagcagatggatgtagacaaccaaattgctaagctgatggttgaactatcccggagtcaggattatgaaattggtgatggtacaactggtgttgttgtattggctggtgcgcttctggagcaggctgagcggttattggagcgtggaatacatccaattagggttgctgagggctatgagatggcttctagaatagcctttgaacatttggggcatatagctgagaaatttgaatttgaattgtcgaatctggagcctttgattcaaacttgtatgactactttgtcttcaaagatagtgaatcgcaacaagcgcagtttggctgagattgcagttaaggcagttactgctgttgcagatttagagaggaaggatgttaatctggatttaatcaaggttgaagggaaagttgggggtaagcttgaagatactgagctaatatatggcattatcgtggacaaggatatgagccatccacagatgccaaagcagattgaagatgcaaaaattgccatcttgacttgtccttttgagccaccaaagccaaagacaaagcataaggtggacattgatacagttgaaaagttccagactctacgtcagcaagagcagaagtattttgatgacatggttcaacagtgcaaagatgttggtgctacattggtgatctgtcaatggggatttgatgacgaggccaaccaccttttaatgcatagaaacttacctgctgtccgatgggttggtggggtggagttagagctgatagccatagccacaggtggaagaattgtgccaaggttccaggaattgaccccggagaaactgggaaaggctggtttggttcgtgagaagtccttcggtacaacaaaagatagaatgctgtacattgaacattgtgcaaattcaagggctgtgactatatttattcggggaggtaacaaaatgatgatagaagagacaaagcgaagtatccatgatgcactctgtgttgctagaaatcttataatcaacaattccattgtatatggtggtgggtcagctgagattgcttgctcaattgctgtggaggctgcctctgataggcatccaggagttgagcagtatgccattagggcatttgcggatgctctggattctgttcccatggcccttgcagaaaacagtggcctccaacccattgagacattatctgctgtgaaatcccagcaaatcaaggagaacaacccctactgtggaatagattgtaatgatgttggtacgaatgacatgcgtcagcaaaacgtcttcgagactttgatagggaagcaacagcagatcttgttggctacacaggtcgtaaagatgatattgaaaattgatgatgtgatttccccttctgatttctgaatggtagtataatcttattttggggtgcttggagtcgcaacttgaatttgtttttgagagctttgtttttgctttaagattttggtgtggtggttggacgtgtaagacggttgctcgtcttttgttaaattattgtttcttagtctttcatcacggatcatctgtccttgtactagcgcaacgtttgtatgcaagccggctaaacctatccctgcttttttggtattaagaaaattgacgacaatgtaagaaagaaagcctgtttaggttattgcggaggacgcgtattgtgtaggcttgttgcagtgttaaaga

SEQ ID NO: 1935 - DNA, 2113 bp, Gossypium raimondii
cagtagaaaaaaaaactactagtaggtcaataaattttttttcaagcccactaattagggctttgaaaaccttccacactcttctcatttccaaagggctgagcactgaagaagaaaaagtagcatagatcggcaacgtaacagtgaaactcgggggaaatggcgttggcgttcgacgagtacggtaggccattcattatacttaaagaacaagagcagaaaacgaggctgagcgggctcgaagctcaaaaagccaacatttccgcaggcagagcggtctctcggatcctccgaacctctctaggacccaaaggcatggataagatgctccaaagccccgacggcgatgtcaccatcacaaacgatggggcaacaatattggagcagatggatgttgacaatcaaattgctaagttgatggttgagctgtctcggagtcaggattatgaaattggggatggaacgactggtgttgttgtcatggctggagcacttctagagcaggcagagcggctattggaacgtgggattcatcccatccgtattgcagagggttatgaaatggcttctagaatagctgttgagcatttggagtgtatagcccagaagtttgattttggaccaacaaatatagagcctttggttcaaacatgcatgaccacactatcctcaaaaattgtgaaccgatgcaagcgtgctttggctgaaatttctgttaaagcagttctttctgttgctgatctagagaggaaagatgtcaatttagatctgattaaggttgagggaaaagttggaggaaaattggaagacactgagctaatatatggaattactgttgataaagacatgagtcatcctcagatgccaaagcaaattgaagatgcaaaaattgccatattaacttgtccatttgagccacctaagccaaagactaaacataaagtagacattgatacggtggaaaagtttcagactctacgtcagcaagaacaaaagtattttgatgacatggttcagaaatgcaaggaggttggtgccacattggttatctgtcaatggggatttgatgatgaggcaaatcatttattaatgcaccagaacttgcctgccgtcagatgggttggtggtgtggaattggaattgatagcaatagctacaggtggaaggattgtgccaaggttccaggagttgaccccagaaaagttgggaagggctggtttggtcagagagaggtcttttggcactacaaaagataaaatgttatacattgagcactgtgcgaattcaagggctgtaaccatatttattcgtggaggaaacaagatgatgatagaggagacaaagcgcagtatccatgatgcactttgtgtggccaggaatctaattcgcaacaattttatcgtctatggtggtggcgcagctgagatttcttgctcaattgctgttgaggcagcggcagataaatatccaggagttgagcagtatgcaatccgagcattcgcggatgctttagatgctgtccccgtggctctggccgaaaatagtgggctccaacccattgagacgctatcagcagtgaaatctcaacaaattaaggagaataatcctcactttggaatcgactgcaatgatgttgggactaatgatatgtgtgagcaaaatgtctttgaaacgctgattgggaagcagcagcagatcttgcttgcaacacaagttgttaagatgattttgaagattgatgatgtcatttccccatctgactactgagcttcacggtcagctggaggttagcctaatttgatggttttgtattttcttggaaccatgtgttcactttagactttggagagaacatgttttgcttctaatttttgaactgccagtcccttggttggaattatcacactcttattgttaaatgtggttgcttgttccctttttgagtcactggaattacctacggatcattggtactagttcttcccctgtatgtaaaaatgctggacaagaaaaaactgcaatttaatgtgcaattttaattttggttgtttctctctaacatatccgtcttcgtagtagttataacatgtataagcttttcaaagttctataa

SEQ ID NO: 1936 - DNA, 2065 bp, Medicago truncatula
taaggaaccagttaggagcataatagcaacttcacactctcacattctttagggttctacatttctcttacacaccactctcatttttccgatcgcagtttcgaaccaaaacaccgccatagggttttggatcgtgaccgtgtaaaccaatatggcgctggctttcgacgagtacggaaggcctttcattattctcagagaacaagaatcgaagaaccgtcttcgtggtctcgatgctcagaaagctaacatctctgccggtaaagccgtcgctcgtattctccgtacctccctcggtccgaagggtatggataagatgcttcaaagccccgacggtgacgtcatcatctcaaatgatggagcaacgatattggagcagatggatgtagataaccagattgcgaagctgatggtggagttgtcgaggagtcaggactatgaaatcggtgatggaactactggagttgttgtgttggctggatctcttcttgagcaagccgagaggcttttggaacgtggtattcatccgattaggattgctgaagggtatgaaatggcgtcgagaattgctgttgagaatctggagaagattgctaataagtttgagtttggtgaaactattttggagccgttgattcagacttgtatgactactttgtcatccaaaattgtgaatcgctgcaagcgtagcttagctgagattgctgtgaaagctgttcttgctgttgcggatctagagaggaaagacgttaatttggatcttattaaagtagaaggaaaggttggtgggaaattggaagatactgagttggtatatggaatcattgttgacaaggatatgagccatcctcaaatgccgaagcaaattgaagatgctaaaattgctattctgacttgcccatttgagcccccgaagccaaaaaccaagcataaggttgatattgatacagtggagaagtttcagacattgaggaaacaagaacagaaatattttgatgacatggttcaacaatgcaaggatgtaggtgcaacccttgttatttgccaatggggttttgacgatgaagcaaatcatctcttgatgcacaggaacttgccagctgttagatgggttggtggtgttgagttggaattgattgccatagcaactggtggaagaattgttcctaggttccaggagttaactgcagaaaagttgggaaaggctggcatcgttagggaaaaagcatttggaacaactaaagaccgaatgctgtacattgagcattgtgcaaactcaagggctgtaacaatattcattcgtggaggtaacaaaatgatcattgaggagacaaagcgcagtattcatgatgcattgtgtgtggctaggaatcttattcgcaataattcaattgtgtatggtggcggttcagctgagattgcatgctctattgccgtggaggcagctgcggatagataccctggtgtagaacagtatgcaattagagcatttggggatgctttggagtcgattcccatggcccttgctgaaaatagtggtctccaaccaattgaaacattatcttctgtgaagtctcagcaaataacggagaaaaatcctcactttggcattgattgcaatgatgttggcaccaatgacatgagggagcaaaacgtctttgaaactttgatcggaaagcagcaacagatcttgcttgctactcaagttgtcaagatgatattaaaaattgatgatgttatttccccatctgagtactaatatatcttttcttgaactcatgttgcatgtcaagatgcagaattgctgatggaattttgtttgatttgtatgattttagtcagagtttgtattttaacttgaagtatatttatgttaagattttggcacgcctttgtattggagttgggtcaccgttttcctttttcatgataaaggctgactgttcttttgtttgatgcattttcgtagttaatttgaatattatgaattcgtgaactattgttgtcaagattgagttacatcgcaggatcctgtgctggataaaccgtaacattgtgcaatgtg

SEQ ID NO: 1937 - DNA, 2252 bp, Picea glauca
ggtaaaaagatgggcgttaattttgctttacaaaacccctcccccaacccctatttcgtttacgttctagaacagggaggaggtgctcgcttatcgcagggcgggagcaaaaacgagcctacacagagttgcgaactagggttttaccagtagcagacccgatatcgaaacccacatcggatcttcagtccattgacggcgccaagggatggcgttggcatttgatgagttcgggaggccatttatcataataagggagcaggagcagaaaacccgaataagaggcttagatgctcagaaggccaacatttcggccgccagggccgttgcgagaatcctccgcacctccctcggccccaagggaatggacaagatgctccagagccccgacggcgatgtcaccatcaccaatgatggtgcaacgatattggagcaaatggatgtggaaaatcaaattggaaagctgatggtagaattatcacggagtcaggattatgagattggagatgggacaacaggggtggttgttacagcaggtgcacttttggagcatgcagagcaacttttagaacggggaattcaccctataaggattgcagaaggttatgaaatggcttcaaagatagcagtagagcatttggatcgtatttctcagaagtttgagtttagcttgaacaatattgaatctctggtgcagacgtgcatgactacactctcttcaaaaattgttaatcgatgcaaacacatgctagctgagattgctgtcaaagctgtgcttgctgttgcagatttggagagaaaagatgttaacttggatttgattaaagtggaaggaaaagttggtggaaagctggaagatacagaactggtttatggtattattgttgacaaagatatgagtcatccacagatgcccaagagaattgaggatgtaaacatagctattttgacttgtccctttgagccacctaagccaaagacaaagcataaggttgacattgatagcgtagaaaagtttgaagctttacgtgaacaagaaaagcattactttgatgaaatggtcaagaagtgcaaggatgtaggtgcaacacttgtaatctgtcaatggggttttgatgatgaggccaatcatttattgatgcaccgtggtttgccagcagttcgatgggttggtggggttgagctagagttgattgcgattgccacaggtggacggatagtcccccgtttccaggaattgacacccgagaagctagggaaggctggacttgtgagggagaaagcgtttggcacaactaaggatcgaatgttatacatagaacagtgtgcgaattcaagggcagtgaccatttttattcgtggtggaaacaagatgatgatagaggagacaaagcgaagccttcatgatgcactttgtgtagcccggaacttgattcgtgataattcgattgtatatggtggtggatctgcagaaatttcttgttcacttgctgttgaagctgctgctgacaagattcctggagtggagcagtatgcagttcgcgcatttgcagatgctctagatgctgtaccaatggcgcttgcagaaaatagtggactccaacctattgatactttgacagcagtaaaggctcaacagatcagggaaagcaacccacatttaggaatagattgtaatgatgttggtactaatgacatgaaggcgcaaaatgtctttgaaactctgatgggcaaaaaacaacagttgttgcttgccacacaggtggttaagatgattctgaaaattgatgatgttatcacaccatccgggtattagtttctacgttatctctttcaatactaaatttctctttcaaagattctgtgagaaccctttgacgctttaatatgcatactgtgaagcatcttgaggatgggagctgagaagccgttatactgaaatccgtgtttgttgtgcatgtagtttgtaagcatgaatttgaggatttttccgctgtctaaaatccgagatgattccaggaaggtgcatattcaacttgggatttgcttttcccaattttatgggttgataaaaagtatgttgtagaggtgctagaatctgtagtgatgtctgtgaagcctctctatagaaaaatatattataacattcagtaaactatacacatttatctacaactgcttaaatcaaggtatattatctgagagatacaatgtaattttgatcaattaagttactactatcgaggatttct

SEQ ID NO: 1938 - DNA, 2192 bp, Picea glauca
ttctagaacagggaggaggtgctcgcttatcgcagggcgggagcaaaaacgagactacacagagttgcgaactagggttttaccagtagcagacccgatatcgaaacccacatcggatcttcagtccattgacggcgccaagggatggcgttggcatttgatgagttcgggaggccatttatcataataagggagcaggagcagaaaacccgaataagaggcttagatgctcagaaggccaacatttcggccgccagggccgttgcgagaatcctccgcacctccctcggccccaagggaatggacaagatgctccagagccccgacggcgatgtcaccatcaccaatgatggtgcaacgatattggagcaaatggatgtggaaaatcaaattggaaagctgatggtagaattatcacggagtcaggattatgagattggagatgggacaacgggggtggttgttacagcaggtgcacttttggagcatgcagagcaacttttagaacggggaattcaccctataaggattgcagaaggttatgaaatggcttcaaagatagcagtagagcatttggatcgtatttctcagaagtttgagtttagcttgaacaatattgaatctctggtgcagacatgcatgactacactctcttcaaaaattgttaatcgatgcaaacgcatgctagctgagattgctgtcaaagctgtgcttgctgttgcagatttggagagaaaagatgttaacttggatttgattaaagtggaaggaaaagttggtggaaagctggaagatacagaactggtttatggtattatagttgacaaagatatgagtcatccacagatgcccaagagaattgaggatgtaaacatagctattttgacttgtccctttgagccacctaagccaaagacaaagcataaggttgacattgatagcgtagaaaagtttgaagctttacgtgaacaagaaaagcaatactttgatgaaatggtcaagaagtgcaaggatgtaggtgcaacacttgtaatctgtcaatggggttttgatgatgaggccaatcatttattgatgcaccgtggtttgccagcagttcgatgggttggtggggttgagctagagttgattgcgattgccacaggtggacggatagtcccccgtttccaggaattgacacccgagaagctagggaaggctggacttgtgagggagaaagcgtttggcacaactaaggatcgaatgttatacatagaacagtgtgcgaattcaagggcagtgaccatttttattcgtggtggaaacaagatgatgatagaggagacaaagcgaagccttcatgatgcactttgtgtagcccggaacttgattcgtgataattcgattgtatatggtggtggatctgcagaaatttcttgttcacttgctgttgaagctgctgctgacaagattcctggagtggagcagtatgcagttcgcgcatttgcagatgctctagatgctgtaccaatggcgcttgcagaaaatagtggactccaacctattgatactttgacagcagtaaaggctcaacagatcagggaaagcaacccacatttaggaatagattgtaatgatgttggtactaatgacatgaaggcgcaaaatgtctttgaaactctgatgggcaaaaaacaacagttgttgcttgccacacaggtggttaagatgattctgaaaattgatgatgttatcacaccatccggtttgtaagcatgaatttgaggatttttccgctgtctaaaatccgagatgattccaggaaggtgcatattcaacttgggatttgcttttcccaattttatgggttgataaaaagtatgttgtagaggtgctagaatctgtagtgatgtctgtgaagcctctctatagaaaaatatattataacattcagtaaactatacacatttatctacaactgcttaaatcaaggtatattatctgagagatacaatgtaattttgatcaattaagttactactatcgaggatttctgttacatgttcactgaggtcgtcgtgttaatgggttcatgatagttgctagagcatgctgttttagactatctcatgtgtagatcatatactgtcatttacagattttatgagcaggtgctgttcattgtctacattgttactatttgataatttgca

SEQ ID NO: 1939 - DNA, 2028 bp, Picea glauca
tagaacagggaggaggtgctcgcttatcgcagggcgggagcaaaaacgagactacacagagttgcgaactagggttttaccagtagcagacccgatatcgaaacccacatcggatcttcagtccattgacggcgccaagggatggcgttggcatttgatgagttcgggaggccatttatcataataagggagcaggagcagaaaacccgaataagaggcttagatgctcagaaggccaacatttcggccgccagggccgttgcgagaatcctccgcacctccctcggccccaagggaatggacaagatgctccagagccccgacggcgatgtcaccatcaccaatgatggtgcaacgatattggagcaaatggatgtggaaaatcaaattggaaagctgatggtagaattatcacggagtcaggattatgagattggagatgggacaacgggggtggttgttacagcaggtgcacttttggagcatgcagagcaacttttagaacggggaattcaccctataaggattgcagaaggttatgaaatggcttcaaagatagcagtagagcatttggatcgtatttctcagaagtttgagtttagcttgaacaatattgaatctctggtgcagacgtgcatgactacactctcttcaaaaattgttaatcgatgcaaacgcatgctagctgagattgctgtcaaagctgtgcttgctgttgcagatttggagagaaaagatgttaacttggatttgattaaagtggaaggaaaagttggtggaaagctggaagatacagaactggtttatggtattatagttgacaaagatatgagtcatccacagatgcccaagagaattgaggatgtaaacatagctattttgacttgtccctttgagccacctaagccaaagacaaagcataaggttgacattgatagcgtagaaaagtttgaagctttacgtgaacaagaaaagcattactttgatgaaatggtcaagaagtgcaaggatgtaggtgcaacacttgtaatctgtcaatggggttttgatgatgaggccaatcatttattgatgcaccgtggtttgccagcagttcgatgggttggtggggttgagctagagttgattgcgattgccacaggtggacggatagtcccccgtttccaggaattgacacccgagaagctagggaaggctggacttgtgagggagaaagcgtttggcacaactaaggatcgaatgttatacatagaacagtgtgcgaattcaagggcagtgaccatttttattcgtggtggaaacaagatgatgatagaggagacaaagcgaagccttcatgatgcactttgtgtagcccggaacttgattcgtgataattcgattgtatatggtggtggatctgcagaaatttcttgttcacttgctgttgaagctgctgctgacaagattcctggagtggagcagtatgcagttcgcgcatttgcagatgctctagatgctgtaccaatggcgcttgcagaaaatagtggactccaacctattgatactttgacagcagtaaaggctcaacagatcagggaaagcaacccacatttaggaatagattgtaatgatgttggtactaatgacatgaaggcgcaaaatgtctttgaaactctgatgggcaaaaaacaacagttgttgcttgccacacaggtggttaagatgattctgaaaattgatgatgttatcacaccatccggtttgtaagcatgaatttgaggatttttccgctgtctaaaatccgagatgattccaggaaggtgcatattcaacttgggatttgcttttcccaattttatgggttgataaaaagtatgttgtagaggtgctagaatctgtagtgatgtctgtgaagcctctctatagaaaaatatattataacattcagtaaactatacacatttatctacaactgcttaaatcaaggtatattatctgagagatacaatgtaattttgatcaattaagttactactatcgaggatt

SEQ ID NO: 1940 - DNA, 2009 bp, Phaseolus vulgaris
gaagcatagtagaaggttggggttagggcttaagagtgtttttgctctttcttattcttcttccatttcttcttcttcttcttcgcgatcgttcgttctctgcaagagataaagaagagatcgatcgatcgaaatggcgttggctttcgacgagttcggaaggccgttcataatcctgaaggagcaggagcagaagagcagactccgaggtttggacgctcagaaatcgaacatatccgccggcaaagccgtcgcgcggatcctccgcacctccctcggcccgaaaggcatggacaagatgctccagagccccgacggcgacgtcaccatcaccaacgacggcgccaccatcctcgagcagatggacgtggacaaccaaatcgcgaagctcatggtggagctttcgaggagtcaggactacgaaatcggcgacggcaccaccggtgtcgtcgtcatggccggcgcgcttctcgagaaggcggagcgcctactggagcggggaattcaccccatcaggatcgccgagggttacgaaacggcgtctagaatctcggtcgagcatctcgatcgcgtggccaacaagttcgagttcggcgagtccaatttggagcctctcattcaaacctgcatgaccacactctcctccaagattgttaatcggtgcaagcgtagcctggctgagatcgctgttaaggctgttcttgccgttgctgatctggagaggaaggatgttaatttggatctgattaaggtggaagggaaagttgggggtaaattggaggacactgagttgatctatgggatagttgttgataaggatatgagccatcctcaaatgcctaagcaaatcgaggatgctaatattgctatcctgacttgcccgtttgagcctcccaagccaaagactaaacataaggttgacattgacacagtggagaagttccagacgttgagggtgcaggaacagaagtattttgatgaaatggttcaaaaatgcaaggatgttggtgcaacccttgtcatttgtcaatggggttttgacgatgaagcaaatcatctcttaatgcacaggaacttgccagctgtcagatgggttggtggtgtagagttggaattgatagctatagcaactggtggaagaattgttcccaggttccaggagttaactacagaaaagttgggaaaggctggcattgttcgtgaaaagtcttttggtacaacaaaagaccgaatgctgtacattgaacattgtgcaaactcaagggctgtaacaatattcatccgtggaggtaacaaaatgatcatagaggaaacaaagcgcagccttcatgatgccttgtgcgtggctaggaatcttatccgtaacaattctattgtatatggtggtggctcagctgagatttcctgctctatagctgtcgatgctgctgctgatagataccctggagtggaacagtatgctattagagcatttggggatgctttggaggccatcccaatggccctcgctgaaaatagtggcctccaaccaattgaaacattatccgctgttaagtctcagcaaataaaggataataaccctcactttggaattgattgtaatgatgttggcactaatgacatgcgtgagcaaaatgtctttgaaactttgatcggaaagcaacaacaaatcttactcgctactcaagttgtcaagatgatattgaaaattgacgatgtcatttccccatctgattactgatattagtcagtcacgttctacatcaagattctgaattttgcttgtattttgtttgatcggtttgattgtagtcacagtccgtatgtgcacttgaaatgtaagattttagcccggtttgtatcggagttggactgctgtttttgtttatttaaagcaattgttttcttttgatctttagaacattatggattagttgtttttgtttatagacattttaacagttgtttttaggccgactaaaattttgtgatctcagtcttatttttgg

SEQ ID NO: 1941 - DNA, 2093 bp, Phaseolus vulgaris
gaagcatagtagaaggttggggttagggcttaagagtgtttttgctctttcttattcttcttccatttcttcttcttcttcttcgcgatcgttcgttctctgcaagagataaagaagagatcgatcgatcgaaatggcgttggctttcgacgagttcggaaggccgttcataatcctgaaggagcaggagcagaagagcagactccgaggtttggacgctcagaaatcgaacatatccgccggcaaagccgtcgcgcggatcctccgcacctccctcggcccgaaaggcatggacaagatgctccagagccccgacggcgacgtcaccatcaccaacgacggcgccaccatcctcgagcagatggacgtggacaaccaaatcgcgaagctcatggtggagctttcgaggagtcaggactacgaaatcggcgacggcaccaccggtgtcgtcgtcatggccggcgcgcttctcgagaaggcggagcgcctactggagcggggaattcaccccatcaggatcgccgagggttacgaaacggcgtctagaatctcggtcgagcatctcgatcgcgtggccaacaagttcgagttcggcgagtccaatttggagcctctcattcaaacctgcatgaccacactctcctccaagattgttaatcggtgcaagcgtagcctggctgagatcgctgttaaggctgttcttgccgttgctgatctggagaggaaggatgttaatttggatctgattaaggtggaagggaaagttgggggtaaattggaggacactgagttgatctatgggatagttgttgataaggatatgagccatcctcaaatgcctaagcaaatcgaggatgctaatattgctatcctgacttgcccgtttgagcctcccaagccaaagactaaacataaggttgacattgacacagtggagaagttccagacgttgagggtgcaggaacagaagtattttgatgaaatggttcaaaaatgcaaggatgttggtgcaacccttgtcatttgtcaatggggttttgacgatgaagcaaatcatctcttaatgcacaggaacttgccagctgtcagatgggttggtggtgtagagttggaattgatagctatagcaactggtggaagaattgttcccaggttccaggagttaactacagaaaagttgggaaaggctggcattgttcgtgaaaagtcttttggtacaacaaaagaccgaatgctgtacattgaacattgtgcaaactcaagggctgtaacaatattcatccgtggaggtaacaaaatgatcatagaggaaacaaagcgcagccttcatgatgccttgtgcgtggctaggaatcttatccgtaacaattctattgtatatggtggtggctcagctgagatttcctgctctatagctgtcgatgctgctgctgatagataccctggagtggaacagtatgctattagagcatttggggatgctttggaggccatcccaatggccctcgctgaaaatagtggcctccaaccaattgaaacattatccgctgttaagtctcagcaaataaaggataataaccctcactttggaattgattgtaatgatgttggcactaatgacatgcgtgagcaaaatgtctttgaaactttgatcggaaagcaacaacaaatcttactcgctactcaagttgtcaagatgatattgaaaattgacgatgtcatttccccatctgattactgatattagtcagtcacgttctacatcaagattctgaattttgcttgtattttgtttgatcggtttgattgtagtcacagtccgtatgtgcacttgaaatgtaagattttagcccggtttgtatcggagttggactgctgtttttgtttatttaaagcaattgttttcttttgatctttagaacattatggattagttgtttttgtttatagacattttaacagttgtttttaggccgactaaaattttgtgatctcagtcttatttttgggccctaaatggttctgagtgaatgtagtctaggcgaaagtgtttagagctttgaagttctcgattttattggagaatgaacctt

SEQ ID NO: 1942 - DNA, 1869 bp, Fagus grandifolia
aaaaaccctcttctcaaagcttctactacgctcttcactctttcaaactcaccatcgcacaacgctgtgtacatttggtatcagaaagagagagtgaaagatctggtgagtggaaatggcgctcgctttcgacgagttcggaaggccgttcataataataaaggagcaggagcagaagaccagattgagaggcattgaagctcagaaggccaacatttccgctgccaaagccatctctcgcatcctccgtacttctctcggacccaagggcatggacaagatgctccagagccccgacggtgacgtcactatctcgaatgatggtgcaacaatcttggagcagatggatgttgacaatcaaatcgcgaagctgatggtcgacctgtctcggagtcaggattatgagattggtgatggaacaactggagttgttgtcttggccggtgcacttttggagatggctgagcagctattagagcgcggtattcatcccattcggattgcagagggatatgaaatggcttctaagatagcttttgaccatttggagaaaatatctcagaagtttgagtttggagtgccggattttgagcctttggttcaaacttgcatgactactttatcctcgaagattgttaatcgatgcaagcgcagtttggctgagattgctgttaaagcagttcttgctgtggctgatttagagaggaaggatgttaacttagatttaataaaagtcgaggggaaagtcggggggaagttggaggatactgagctaatatatggaattgtggttgacaaggatatgagccatccccagatgccaaagcaaattgaagatgcaaaaattgctatcttgacttgcgcctttgagccaccaaagccaaagactaaacataaggttgacattgatacggtagaaaagttccagactttacggctgcaagaaaagaagtattttgacgatatggttcaaaaatgcaaggatgttggtgctaccttggttatctgtcaatgggggtttgatgatgaagcgaatcatttattgatgcacaggaacttgcctgctgtcagatgggttggtggtgtggagttagaactaattgcaatagccacgggtggaagaattgtgccaaggttccaagagttgactactgaaaagttgggaaaggctggcttggttcgagaaaaatcgtttggtacaacaaaagatcgaatgctgtacattgaacactgtgcaaactcaagggctgtaaccatatttattcgtggaggtaacaaaatgatgatagaggagacaaagcgcagcattcatgatgccttgtgtgttgctaggaatctcattcgcaacaattctattgtctatggtggtggctcagctgagattgcttgttcagttgctgtggaggcagctgcagatgtccagccaggagttgagcagtatgccatcagagcatttgcggatgctttggatgctgttcccatggcacttgcggagaatagtggcctccaacccattgaaacactatctgcagtgaaggcgcagcaaatcaaggagaacaatccttactatgggatagattgcaacgatgttggcactaacgacatgtgtgagcaaaatgtgtttgagactctgattgggaagcagcagcagatcctgctggcaactcaagttgtcaagatgatattgaaaattgatgatgttatctcacctgctgagtattgatatgtccaggactgatctatagttgtacttcacttgagctctcagtatttttttgacttgatttgatgtctctgagtgactctgagaccttatgttaacttgttgcttataaattttggagtgccttcgattgaaattgtagtgtg

SEQ ID NO: 1943 - DNA, 1902 bp, Chelidonium majus
agcactagtagaagagatggctttggcctttgatgattacgggagaccgttcatcatcatcagagagcaggagcagaagagtagattaagaggtttagatgctcaaaaggccaacatttctgctggaaggggtattgctcggatcctcagaacctctcttggtcccaaaggcatggacaagatgctccaaagtcccgatggggatgttactatcacgaatgatggagcaactatcttggagctgatggatgtcgacaatcaaatagcaaaactgatggttgaattatcccggagtcaggactatgaaattggtgatggaaccacaggagttgttgttttggcaggtgcacttctggagcaggctgagagactattagagcgtggtattcatcctattcgcgttgctgagggatatgagatggcttccaggattgctgttgaacatttggagtctatttctcataagtttgattttagtgcatctaacatggaacctttagttcggacttgcatgactactctatcctccaaaattgtgaatcgatgcaagcgcactttagccgagattgctgttaaagcagttctggctgttgcagatttggagaggaaggatgtaaacttagacctgatcaaaatagagggaaaggtaggaggcaaattggaagataccgagctaatctatggaatcatcgttgacaaggatatgagccacccacagatgccaaaaagaattgaagatgcaaacatcgcaattttgacttgcccatttgagccaccgaagcctaagacaaagcataaggttgacattgacactgtggagaagttccagactttgcgtcaccaagagcagaaatacttcgacgatatggttcaaaagtgcaaggatgttggtgcaactctggttatctgccaatgggggtttgatgatgaagccaatcatttattaatgcaccggaacttacctgccgttagatgggtcggcggtgtagaactggagctgattgcaatagctacaggtggaaggattgtgccaaggttccaagaattgacacctgaaaagttgggaaaggctggtttagttcgagaaaaatcatttggaacgacaaaagatcgaatgctgtacattgagaaatgtgcaaattccagggcagtgactatatttatccgtggtggtaacaaaatgatggtagaagagacaaagcgcagtatccatgatgctctgtgcgtggcgaggaatcttattcgcaacaaatctatagtttatggtggtggttctgctgagatttcttgttcaattgctgtagaggcagcttctgatagatatcctggagtcgagcagtatgctatcaggggattcgctgatgctttagattctatccccatggcgttggcagagaacagtggtctccagcccattgaaacactatctgcagtcaaatctcagcaaatcaaggagaataacccatgttgtgggattgactgcaatgatgttgggacaaatgacatgcgcgaacagaacgtctttgagactctcattggaaagcagcaacagctaatgctggccacgcaagttgtcaagatgattctcaagatcgatgacgtaatcagtccttcaaattactaattgatcaggtagtagctgtcttggttccaattcacagttttgcttcccacgaaaaacatccgctacatttatgttcatcatgtatagcttgatactgctggactgagtttgaagacctgtgtgttgtgtttcctcattatgtttttgcttctattgacagttttaagcatgcttattgtggtgtctatcagaccttgcaaagactctgcaagttgagtgtttttttactgtctatgtaatgcttccttagttggcacaagttttcttgtttaaatcag

SEQ ID NO: 1944 - DNA, 2021 bp, Gossypium hirsutum
cccactaattagggctttgaaaaccttccacactcttctcatttccaaacggctgagcactgaagaagaaaaagtagcatagatcggcaacgtaacagtgaaactcgggggaaatggcgttggcgttcgacgagtacggtaggccattcattatacttaaagaacaagagcagaaaacgaggctgagcgggctcgaagctcaaaaagccaacatttccgcaggcagagcggtctctcggatcctccgaacctctctaggacccaaaggcatggataagatgctccaaagccccgacggcgatgtcaccatcacaaacgatggggcaacaatattggagcagatggatgttgacaatcaaattgctaagttgatggttgagctgtctcggagtcaggattatgaaattggggatggaacgactggtgttgttgtcatggctggagcacttctagagcaggcagagcggctattggaacgtgggattcatcccatccgtattgcagagggttatgaaatggcttctagaatagctgttgagcatttggagtgtatagcccagaagtttgattttggaccaacaaatatagagcctttggttcaaacatgcatgaccacactatcctcaaaaattgtgagtcgatgcaagcgtgctttggctgaaatttctgttaaagcagttctttctgttgctgatctagagaggaaagatgtcaatttagatctgattaaggttgagggaaaagttggaggaaaattggaagacactgagctaatatatggaattactgttgataaagacatgagtcatcctcagatgccaaagcaaattgaagatgcaaaaattgccatattaacttgtccatttgagccacctaagccaaagactaaacataaagtagacattgatacggtggaaaagtttcagactctacgtcagcaagaacaaaagtattttgatgacatggttcagaaatgcaaggaggttggtgccacattggttatctgtcaatggggatttgatgatgaggcaaatcatttattaatgcaccagaacttgcctgccgtcagatgggttggtggtgtggaattggaattgatagcaatagctacaggtggaaggattgtgccaaggttccaggagttgaccccagaaaagttgggaagggctggtttggtcagagagaggtcttttggcactacaaaagataaaatgttatacattgagcactgtgcgaattcaagggctgtaaccatatttattcgtggaggaaacaagatgatgatagaggagacaaagcgcagtatccatgatgcactttgtgtggccaggaatctaattcgcaacaattttatcgtctatggtggtggcgcagctgagatttcttgctcaattgctgttgaggcagcggcagataaatatccaggagttgagcagtatgcaatccgagcattcgcggatgctttagatgctgtccccatggctctggccgaaaatagtgggctccaacccattgagacgctatcagcagtgaaatctcaacaaattaaggagaataatcctcactttggaatcgactgcaatgatgttgggactaatgatatgtgtgagcaaaatgtctttgaaacgctgattgggaagcagcagcagatcttgcttgcaacacaagttgttaagatgattttgaagattgatgatgtcatttccccatctgactactgagcttcacggtcagctggaggttagcctaatttgatggttttgtattttcttggaaccatgtgttcactttagactttggagagaacatgttttgcttctaatttttgaactgccagtcccttggttggaattatcactcttattgttaaatgtggttgcttgttccctttttgagtcactggaattacctacggatcattggtactagttcttcccctgtatgtaaaaatgctgcacaagaaaaaactgcaatttaatgtgactaaattttaaaaaagaaaaaagtaaccgaactagacg

SEQ ID NO: 1945 - DNA, 1965 bp, Lactuca sativa
gagaggtttgtcgcaactctcaaacccttgggccagggtttttagggtataaccactcatttgaactcgcagcttcggtaaccaccttctcaacgttgtcgtgtgtgtggctttcgatcaaaccatttttgatttatatgtcgatctaagagcttaagcaagtgcaagatcaacaaaaatggcgttggcgttcgacgaatatgggcggcccttcataatcttaagggaacaagaaagtaagagcaggctaagaggtttagatgctcagaaagccaacatttccgccggcaccgccgttgctcgcatcctccggacttctcttggtcctaaaggcatggacaagatgctccagagccccgacggcgacatcaccatcacaaatgatggtgcaacaatcttggagcaaatggatgttgacaatcaaattggtaaactgatggttgaactctcaaggagtcaagactatgagattggtgatggaacaacaggagttgttgttatggctggagcacttctagaacaagctgaacgactattagaacgtggtattcatccaattcgtgttgcagaaggctatgagattgcttcaaagattgctgttgatcatttgcaacaaatctcacacaagtttgagttcaatcctacaaatatagaaccccttgttcaaacttgcatgactaccttatcctccaagattgtgaaccgttgcaaaagaagtttggctgagattgctgtgaaggcagtaatggcagttgctgatttagagaggaaggatgttaacttagatctgattaaaattgagggaaaagttggtggaaaattggaagatacagagcttatttatgggattcttgttgacaaagatatgagtcaccctcaaatgccaaagcatattgaggatgctaaaattgccattttgacttgcccctttgagcctccaaagccaaagactaagcataaggttgatattgatacagttgaaaagtttcaaactttacgtgagcaagaaaggaaatactttgatgacatggttcaacaatgcaaggatgttggggctacattggtaatttgccaatggggttttgacgatgaagcaaatcacttattaatgcacagaaacttacctgctgtgagatgggttggtggtgttgaattagagcttatagcaatagccactggtggaagaattgtccctaggtttcaggaattaacagcagaaaagctaggcaaggctggtttggttagagagaaatcatttggcaccacaaaagatcggatgctatatattgagcattgtgctaattcaagggctgtaaccatatttattcgtgggggtaacaagatgatgatagaggagacaaaacgcagcattcatgatgcattatgtgttgcaagaaatctcatccgcaataactctattgtatatggtggtggggcaccagaaatttcatgctcaattgcagttgaagcagctgctgataaatatccaggagttgagcagtatgctgtgagggcttttgcagatgctttggattctgttcccatggctcttgcagagaacagcggtctgcaacccattgagacactatctgcagtcaaatctcagcaaataaaggagaagaacgcgtgttgtgggatagattgcaatgatgctggcacaaacgacatgcgtgagcaaaatgtattcgaaaccctaattggaaagcaacaacagctcttgcttgctacacaagtcgtgaagatgatcttgaaaatcgatgatgtcatctctccctccgagtattgatttgatttctaggtatttgacctttttaccctttttttcgaagtcctaaattttgtggtatgtcatagaaaactagaagtatggtatggtgtgaattgaacttgtttgtattgttaatccttaaaaccattaaacaatttattattattattaatttttttatctgtatttgatattta

SEQ ID NO: 1946 - DNA, 1955 bp, Papaver somniferum
ggtgcagtctccatttactgaagccccgatagacaagagctgaatcttcgtaaagatggctttggccttcgatgattatgggaggccattcataatcttgagagaacaagaacagaaaagtagattaaaaggtttggatgcacagaaatctaacattgctgctggtaaagctattgcacgtatactaagaacttctcttggtcctaaaggcatggataaaatcatgcaatctcccgatggagatatcaccatcacaaatgatggagctacaatcttgcaaatgatggacgttgacaatcaaatagcaaaactgatggttgaattatcccagagtcaggactatgaaattggtgatggaacaactggagttgttgtgatggctggtgcacttttggaacaagctgagaagttattagagcgtggtattcatcctgttagggttgcagagggttatgagatggcatctaaagttgctgttgagcatttggaacatatatctcacaagtttacttttggtgctaacaacattgaacctttggtgcagacttgcatgactaccttatcatcgaaaattgtgaatcgctgcaaacgaagtttagccgagattgctgttaaagcagttttggctgttgcagatctggaaaggaaggatgtcaatttagacttgattaaaatagaggggaaggtaggggggaagctggaagacactgagctaatttatggaattatagttgacaaggatatgagccatccccagatgccaaaacaaattcaagatgcacacattgctatcttgacttgtccgtttgagcctccaaaacccaagactaagcataaggttgacattgacacggtggagaagttcgaaactttgcgtctacaggaaaagaaatactttgatgatatggtccaaaaatgcaaggatgttggtgcaacactagttatctgccaatggggttttgatgatgaggcaaatcatttattgatgaatcggaacttgcctgctgttagatgggttggtggagtagaactagagctcattgcaatagctacaggtggaaggattgtgccaaggttccaagagttaacaattggaaaattggggaaggctgggttagttagagagaaatcctttggtaccaccaaagatcgaatgctctacattgagcagtgtgcaaattcgagggcggtcactatcttcatccgtggtggtaacaaaatgatgatagaggagacgaaacgtagcattcatgacgctctatgtgtggcgaggaatctaattcgcaacaactcaattgtatacggaggtggatcagcagagatatcctgctctgtcgcagtagaggcagctgcggataagtaccctggagttgagcagtatgctataagggcatttgcagatgctttggatgctgtccccatggcattggcagagaatagtggactccaacccattgaaactcttactgcagtcaaatctcagcagatcaaggagaacaatccatgctgtgggatagactgcaatgatgtcggaacaaatgacatgcgcgaacagaatgtttttgagacactgattggtaaacaacaacagctcttacttgctacccaggttgtcaagatgattctgaagattgatgatgtcattagtccgtcggagtattgatttatcaatctcaattatagatctccaaccatagcttggcgttacctcaattatagatcacacaactctgttgttactaatagattttgaagagaagaactctttacaggcttttcttcattgttaggtttttgagttgtttattagttgtagtcgtagacgtaattaatatggttttgtgtggtatggaatgttcacttccgattttgtgctttttaacccttatcctatcctttctttcccattcgggtaaataaattagtatatagaggagtgatcccctctcattttt

SEQ ID NO: 1947 - DNA, 1868 bp, Tripterygium wilfordii
gcactgcttccacactcttcgttgctgttggtaccttcgtgcactgcatctgaatctgttcttcaaaggacaaagaagaggagatcagaagtgttaaattccggctccggtggaaaacgtggaggaggaaaaatggcattggctttcgacgagttcggaaggcagttcataatactaagggagcaggagcaaaagacgagattgagaggcctcgatgcacacaagtctaacatttctgcagggaaagcggtggctcgcatcctccgcacttcactaggtcccaagggcatggacaagatgctccagagccccgacggagacgtcacaatcacgaatgatggtgcaacaatcttggagcagatggatgttgacaaccaaattgcaaagctgatggttgaactatcccggagtcaagattatgaaattggtgatggtacaactggtgttgttgtattagctggtgcacttctggagcaggctgagcggttattggagcgtgggatacatccaattaggattgcagagggctatgagatggcttctagaatagcctttgaacatttggagcatatagctgaaaattttgaatttgattcatcgaatctggagcctttgattcaaacttgcatgactactttgtcctcaaagatagtgaatcgcagcaagcgcagtttggctgagattgcagttaaagcagttattgctgttgctgatttagagaggaaggatgttaattttgatttgatcaaggttgaagggaaggtgggtggtaagctagaagatactgaactaatttatggcattcttgtggacaaggatatgagccatccacagatgccaaagcagattgaagatgcaaaaattgctatcttgacttgtccatttgagccaccaaagccaaagacaaagcataaggtggacattgatacagtggaaaagtttcagattttacgtcagcaggagcagaagtattttgatgacatggttcagaagtgcaaagatgttggtgctacattggtcatctgtcaatggggatttgatgatgaggccaaccacctgttaatgcatagaaacttgcctgctgttcgatgggttggtggtgtggagttagagctgatagccatagccacaggtggaagaattgtgccaaggtttcaggagttgaccccggagaaactgggaaaggctggtttgattcgtgagaaggcctttggtacaacaaaagatcgaatgctgtacattgaacattgtgcaaattcaagggctgtgactatatttattcggggaggaaacaaaatgatgatagaagagacaaagcgaagtatccacgacgcactatgtgttgctagaaatcttatacgcaacaattccattgtatatggtggtgggtcagctgagattgcttgctcaattgctgtggaggctgcctctgataagcatccaggagttgagcagtatgccattagggcatttgcggatgctctggattccgttcccatggcccttgcagaaaatagtggcctccaacccattgagacattatccgctgtgaaatctcagcaaatcaaggagaacagcccctactgtggaatagattgcaatgatgttggtacgaacgacatgcgacagcaaaacgtctttgagactttgatagggaagcaacagcagatcttgttggcaacacaggtcgtcaagatgatattgaaaattgatgatgtgatttccccatctgatttctgaaaagtctagtcaatcggaatgaactcatgtgagctttgtttttgctcagatttttgaacacgtaatacgattgcccatcttttgttaagttattgcagattttgcttaatacttgaacaaagttttac

SEQ ID NO: 1948 - DNA, 2119 bp, Cicer arietinum
ctgtaattgaaaaatctgagaaaaaggtgggaagcataaggaaggagttagaagcatagcaatagcaagttgagagagtgtcgttgtttagggttctactccttcaactatacactcttgtcacttttccgatcgcgagcgaaaataacaacatagggttagggtttgggatcgtgatcttacagaacaaaaaatggcgttggcttttgacgattacggaaggccttacataatcctgaaagagcaagagtcgaagaacagacttagaggtctcgatgctcagaaagccaacatctccgccggtaaatccgtcgctcgtattctcagaacttctctcggtcctaaaggcatggacaagatgcttcagagtcccgacggtgacgtcatcatctcaaatgacggggcaacgatattggaacagatggatgttgataaccagattgcaaagctgatggtggagttgtcgaggagtcaggactatgaaatcggcgatggtactacaggagtggttgtgttagctggatctcttcttgagcaagctgaacgacttttggaacgtggaattcaccccatcaggattgctgagggatatgaaatggcgtccaggattgctgttgaaaatcttgagcgaattgcgaataagtttgagtttggagaaactattttggagcctttgattcagacttgtatgacaactctgtcgtcgaaaatagtaaatcggtgcaagcgtagcttggctgagattgctgtcaaagctgttcttgctgttgctgatctagagagaaaagacgttaacttggatttaattaaagtagaaggaaaagttggtggaaagttggaagataccgagttgatatatggaatcgttgttgacaaggacatgagccatcctcaaatgccaaagcaaattgaggatgctaaaattgccatcctgacttgcccatttgagccaccgaagccaaaaaccaagcataaggttgatattgatacagtggagaagttccagaccttaaggaaacaagaacagaaatattttgatgacatggttcaacaatgcaaggatgtaggtgcaacccttgttatctgccaatggggttttgatgatgaagcaaatcatctcttgatgcacaggaacttaccagctgttagatgggtcggtggtgttgagttggaattgattgccatagcaacaggtggaagaatcgttcctcggttccaggagttaactccagaaaagttgggaaaggctggtatcgttagagagaaagcatttggcacaactaaagaccgaatgctgtacattgagcattgtgccaactcaagggctgtaacaatattcattcgtggaggtaacaaaatgattattgaggagacaaagcgcagtattcacgatgcactgtgtgtggctagaaatcttattcgcaataattcaattgtctatggtggtggttcagccgagatatcttgctccattgccgtggaggcagctgctgatagatatcctggagtagaacagtatgctattagagcatttggggatgctttggagtctatccctatggcccttgctgaaaatagcggtctccaaccaattgaaacgttatctgctgtgaagtctcagcaaataaaggataataatcctcactttggcattgattgcaatgatgttggcaccaacgacatgcgggagcaaaatgtctttgaaactttgattggaaagcagcaacagatcttgctcgctacccaagttgtcaagatgatattgaaaattgatgatgttatttccccatcagagtactaatatatttatttttgtaatcattgcatgtcaagatgcagaatagctgatggtatttggttcggtggtatgattttggtctgagtttgaattttagcttgaagtaaatttatgtaagattttggcatgtttttgtattagaattgggcgactgtcgcatgtattatgatacagcgactgttctttgtttgatgcatttatcttaatttgaatacgatgaattcgttttactgtatcaggctactgtcatttgaaatccgagcgtgatcgtgcaagcagcagctatatcatttaatattcctgaaaaaaattcatttccac

SEQ ID NO: 1949 - DNA, 2233 bp, Abies balsamea
catttcccatatgtacgttttagagaacaaggaggcggtgcttgcttttcacagagttgcaaactagggttttatcagaagcagacctgatatcagaatccatcatctgatcttctgtccgttgacagcgcctagggatggcgttggcctttgatgagttcggaaggccatttatcataataagggagcaggagcagaagacccgaataaggggcttagatgctcagaaggccaacatttcggccgccagggccgttgcgagaatcctacgcacgtccctcggccccaagggaatggacaagatgctccagagccccgacggcgatgtcaccatcaccaatgatggtgcaacgatattggagcaaatggacgtggaaaatcaaattggaaagctgatggtagaattatcgcgtagtcaggattatgagattggagatgggacaacaggtgtggttgttacagcgggggcacttttggagcacgcagagcaacttttagagcgaggaattcaccccataaggattgcagaaggttatgaaatggcttcaaagatggcagtagagcatttggatcatatttctcagaagtttgaatttagcttgaacaatatggaatctctcgtgcagacatgcatgactacactctcttcaaagattgtaaatcgatgcaaacgcatgctagctgagattgctgtcaaagcagtgcttgctgttgcagatttggaaagaaaggatgttaacttggatttgattaaagtcgaaggaaaagttggtggaaagctggaagatacagaactggtttacggtattatagttgataaagatatgagtcatccacaaatgcccaagagaattgaggatgtaaacatagctattttgacttgtccttttgagccacccaagccaaagacaaagcataaggttgacattgatagtgtagaaaagtttgaagctttacgtgaacaagaaaggcaatactttgatgaaatggtccagaagtgcaaggatgtaggcgcaacacttgtaatctgtcaatggggttttgatgatgaggctaatcatttattgatgcaccgtggtttgccagcagtccgttgggttggtggggtcgagctggagttgattgcaattgccacaggtgggcggatagtccctcgatttcaggaattgacccctgagaagctggggaaggctgggcttgtgagggagaaatcatttggcacaactaaggatcgaatgctttatatagaaaagtgtgcaaattcaagggcagtgacaatatttattcgtggtggaaacaagatgatgatagaagagacaaaacgaagccttcatgatgcactttgtgtagcccgaaacttgattcgggataattcaattgtatatggtggaggatctgcagaaatttcttgttcacttgcaattgaagctgctgctgacaagattcctggagtggagcagtatgcagttagggcatttgcggatgctttagatgctgtaccaatggctcttgcagaaaatagtggactccaacctattgatactttgacagcagtaaaggctcaacaaatcaaggaacacaacccacatttaggaatagattgtaatgatgttggtactaatgacatgaaggagcaaaatgtcttcgaaactttgatgggcaaaaaacagcaattgttacttgccacacaggtggttaagatgattctgaaaattgatgatgtgatcacaccatctgggtattagtttctacattatcttgctcttccaaagattctttaaagagttgaatctcataagaaaactgacttttttatatgcgtattgcgaagcattcttcaggatgggagctgagaagcaattatactgaaatctgtttgttgtgcatgtagtttgtaagcatgaattttaggttttttctgctgatgattactgaaaggtgcatattcattttgggatttgcttttcccacttcatgggatgatataaagtattttgtataggtgctccgatccatagtgatgtctgtgaagcctctccatagaaagacattatatcatagaaattgacaactgcttaaatgaaggtagattattagagagatgatctaattgtgacctcttagttttacacagtttaggatttctgtcacatgttcactgaggtcttcgtgtcattgtatatcatatactgtcatgcgcaggtaattgcatgagcaggtgctgtttattgtc

SEQ ID NO: 1950 - DNA, 2147 bp, Vitis vinifera
gttggcccaacccaactctattccaaatctgtccttccaacaaaaccctaaaccctacatctatctcatcgtttgctcgtagcacgaactgatattgaagtgcttggaatctcccaccaaaaccctaaccctagaaaaagggtttggtaaattaagaagaaaatggccttagcattcgatgagttcggaaggccattcataatactgagggggcaagagcaaaagagcagattgagaggtttggatgctcagaaagccaacatttctgccggaaaagcggtggctcggatcctccgcacctcccttggccccaagggaatggacaagatacttcagagccccgacggtgatgtcaccattacgaatgatggtgcaacaatattggagcagatggatgttgacaatcaaattgcgaagctgatggttgagctatctcgaagccaagattatgaaattggtgatggcacaacaggagttgtagttttggctggtgcacttctagagcaggctgaggggctacttgaacgtgggattcatcctattcgggttgcagagggctatgaaatggcttgtaggatagctgttgaacatttggaacacattgctcaaaagtttgagtttggagtaacaaatatagaacctttagttcaaacttgcatgaccactctatcatccaagattgtgaatcgatgcaagcgcagtttggctgaaattgctgttaaagcagttatggcagttgcagatttggagaggagggatgttaacttagatttaattaaagtagaggggaaagtaggtggaaaactggaagatactgagttaatacatggaattgttgttgacaaggatatgagccatccacaaatgcccaagcatattgaagatgcaaaaattgctattttgacatgcccctttgagccacctaagccaaaaactaagcataaggttgatattgatacagtggaaaaattccagactttacgtctccaagagcagaaatactttgatgacatggttcaaaaatgcaaggatgttggtgctaccttggttatctgccaatgggggtttgatgatgaagcaaatcatttattaatgcacaggaatttgcctgctgtccggtgggttggaggtgtggagttagagctgatagcaatagccacaggtggaagaattgtgccaaggttccaagaattgacaccagaaaagctgggcaaggctggtttggttcgagaaaaatcatttggtaccactaaagaccgaatgctgtatattgaacgctgtgcaaattcaagggctgtaaccatatttgttcgtggtggtaacaaaatgataatagaggagacaaagcgtagcatccatgacgcactgtgtgtggctaggaatatcattcgcaataattctattgtgtatggtggaggctcagctgagatttcttgctctattgctgtagaggcagctgctgataaatatccaggagttgagcagtatgctatcagggcatttggagatgctttggattcaattcccatggcacttgcagagaatagtggcctccaacccatcgaaaccctatctgcagtgaaatctcagcaaattaaggataacaatgcctactgtgggattgactgcaatgatgttggcacatatgatatgcgtgagcaaaatgtctttgagactctcatagggaagcagcagcaaatcttgctggcaacacaagttgtcaagatgattttaaagatcgatgatgtcatctcccctactgattactgagatatgggtacatcattcaaagttttgcttcacctagatgtgtgtgctcacggtaccaatggtggcttgggatggcatctcaatcacaagggatgatatggccactggacgcagactttcttatttattttggactctgtttttggttttgtactatcgtcatcgtttttggttaatatcttgttgattttgttgtttctttttgaaaggtttcatggtttgcttgatggccatgacccatttccttatccttgtgcacatggaaacaagaaaatgagcaaaaattgttgtatgaaagtatttttccatctgacattttaggtttgagtttattcaaatcatatcatacatctaatgaccaaactcagttgaaatgg

SEQ ID NO: 1951 - DNA, 2392 bp, Pinus taeda
cggccggggcccaacccaaacttcgtttacgttctagaacaaggaggatctgttcgcttttcgcagggcgggagcaaaacgtgattgcagagatttgcgaattagggtttcaccagtagcagacactcgaacccaaccatcggttcttcagtccattgacggcgccaagggatggcgttggcatttgatgagtacgggaggccatttatcataataaaggagcaggagcagaagacccgaatcagaggcttagatgctcagaaggcgaacattgcggccgccaggtccgttgcgagaatcctgcgcacctcgctcggccccaagggaatggacaagatgctccagagccccgacggcgatgtcaccatcaccaatgatggtgcaacaatattagagcaaatggatgtggaaaatcaaatcggaaagctgatggtagaactatcacgcagtcaggattatgagattggagatgggacaacgggggtggttgttacagcaggtgcacttttggagcatgcagagcaacttttagaacggggaattcaccccataaggattgcagaaggttatgaaatggcttcaaagttagcagtagagcatttggatcgcatttcacagaagtttgagtttagcttgaacaatattgaatctctggtgcagacgtgtatgactacactctcttcaaagattgttaatcgatgcaagcgtatgctagctgagattgctgtcaaagcagtgcttgctgtcgcagatttggaaagaaaggatgtgaacttggatttgattaaagttgaaggaaaagttggtggaaagcttgaagatacagagctggtttatggtattatagttgacaaagatatgagtcatccacagatgcccaagagaattgaggatgtaaatatagctattttgacttgcccctttgagccacctaagccaaagacaaagcataaggttgacattgatactgtagaaaagtttgaagctttacgtgtacaggaaaggcaatactttgatgaaatggtcaaaagatgcaaggatgtaggtgcaacacttgtaatctgtcaatggggttttgatgatgaggccaatcatttattgatgcaccgtggtttgccagcagtccgatgggttggtggggttgagctggagttgatcgcaattgccacaggtggacggatagtaccacgatttcaggagttgacacctgagaagctagggaaggctggacttgtgagggagaaatcatttggcacaactaaggatcggatgttatacatagaacagtgtgcaaattcaagggcagtgacagtttttattcgtggtggaaacaaaatgatgatagaagagacaaagcgaagccttcatgatgcactttgtgttgcccggaacttgattcgtgataattcaattgtatatggtggcggatctgcagaaatttcatgttcacttgctgtcgaagctgccgctgacaagattcctggagtggagcagtatgcagttcgggcatttgcagatgctctagatgctgtaccaatggctcttgcagaaaatagtggactccaacctattgatactttgacagcagtaaaggctcaacagataagggaaagtaacccacatttgggaatagattgtaatgatgttggtacaaatgacatgaaggagcaaaatgtcttcgaaactctgatcggcaaaaaacaacagttgttacttgccacacaagtggttaagatgattctgaaaattgatgatgttataacaccatccgggtattaatttctacattatcactttcgacattaaatttatcctccaaagattctttaaagagttgattctcagaagaaaactatgacatttttgtatgcatgctgcaaagcttcttcaggacgggagctgaaaagcagttatgctgaaatccgtttttgttgtgcatgtagtgtctaagcacgaatttgaggatttttctgctgtctaaaacacaagatgattccaggatggtgcatattcaatttgggatttgcttttcccacttttatgggatggtaaaaagtatgttgtagtctgtaaagcctctctttacaaaaatatattataaacatacactaaacaatacacatttattgatgagtgtttaaatcaaggtagattatctgagatataatctatttttgatctattaggttcctacaatctagggtttttgttacatgttcattggggtcctaatgttcatgggttcattatagttgctagagcatgatattttaaactatctcatttgttgaggtgctgtttattgtctacgttagtaccatttgataatttgcattttggttttgaaaggacactacttgttctctgtataaaaataagccagatttatatt

SEQ ID NO: 1952 - DNA, 2264 bp, Pseudotsuga menziesii
ctttacaaaagccctcccaaccccatttgctgatgttctaaacgacaaggaggtgcttgcttttaacagggctggactacacagagttgcgaactagggttttaccagtagcagagtcgatatcgaaatacaccatcggatcttcggtctgttgagggcgccaaggaatggcgttggcgtttgatgagtttgggaggccatttatcataataagggagcaggagcagaagacgcgaataagaggcttagatgcccagaaggccaacatttctgccgccagggccgttgcgagaatcctccgcacctccctcggccccaagggaatggacaaaatgctccagagtcccgacggcgatgtcaccatcaccaatgatggtgcaactatattggagcaaatggatgtggaaaatcaaatcggaaagctgatggtagaattatcacggagtcaggattatgagattggagatgggacaacaggggtggttgttacagcgggtgcacttttggagcatgcagagcaacttctagaacggggaattcaccccataaggattgcagaaggttatgaaatggcttcaaagttagcagtagagcatttggatcatatttctcagaagtttgagtttagcttgaacaatattgaatctctggtgcagacatgcatgactacactctcttcaaagattgttaatcgatgcaaacgcatgctagctgagattgctgttaaagcagttcttgctgttgcagatttggaaagaaaggatgttaacttggatctgattaaagttgaaggaaaagttggtggaaagcttgaagatacagaactggtttatggaattatagttgacaaggatatgagtcatccacaaatgcccaagagaattgaggatgtaaacatagctattttgacctgcccttttgagccccctaagccaaagacaaagcataaggttgacattgatagtgtagaaaagtttgaagctttacgtcaacaagaaaggcattactttgatgaaatggtcaagaagtgcaaggatgtaggtgcaacacttgtaatctgtcaatggggttttgatgacgaggccaatcatttattgatgcaccgtggtttgccagcagtccgatgggttggtggggtcgagttggagttaattgcaattgctacaggtggacggatcgtcccacgatttcaggaattgacacctgagaagctagggaaggctggactagtgagggaaaaagcttttggcacaactaaggatcgtatgttatacatagaacagtgtgcaaactcaagggcagtgacaatttttattcgtggtggaaacaagatgatgatagaagagacaaagcgaagccttcatgatgcactttgtgtagcccggaacttgattcgtgataattcaattgtatatggtggtggatctgcagaaatttcttgttcagttgctgttgaagctgctgctgacaagattcctggagtggagcagtatgcagttcgggcatttgcagatgctctagatgctgtaccaatggctcttgcagaaaatagtggactccaacctattgatactttgacagcagtaaaggctcaacagatcaaggaaaacaacccacatttaggaatagattgtaatgatgttggtacaaatgacatgaaggatcaaaatgtcttcgaaactctaatgggcaaaaaacagcagttcttacttgccacacaggtggttaagatgattctgaaaattgatgatgtgatcacaccttctcgtttctgaacatgaatttgaggatttttctgctggataaacttggaaatgatttgaggaaggtgcatattcaattggggttttgcttttcccacttttatgggacgataaaatgtattttgtagaggttctctgatctatagtgaagtctgtgaagcctccctatagaaagatacttacgctaaactatacacacatttatcgacaactgcctaaatcaagatagattatcagagatataatctaattttgatctattaagttcatccaatctaggatttctgttacatgttcactgaggtccttgtgttaatggggttcatgatttttgctagagaatgctgttttagaccatctcattgcatgagcaggtgctgttcattgttgacattgtctctatctggtaatttgcattttggttttgaaaggacacagtctacttgttttctgtataataaaagtttgcagttaccgttgtccaaggttgataaaagtaac

SEQ ID NO: 1953 - DNA, 1864 bp, Carthamus tinctorius
  misc_feature (1152)..(1152): n is a, c, g, or t
  misc_feature (1156)..(1156): n is a, c, g, or t
cgcgggaggcataaccctttcgactctcgcaccttccatttccacaccaccaccaccaccgtcatcatcatcctcactctttctgtatcgatctcgccgtcatcttcgaccttatatgtcgatctaagaccttaatccaaccctaaggatctgcaacaatggcgttggcgttcgatgaatacgggcggccgttcataatcttaagggaacaggaaagcaagagtaggttaagaggtttggatgctcagaaggccaacatttccgccggcgtggccgtcgctcgcatccttcggacctcccttggtcctaaaggcatggacaagatgctccagagccccgatggcgatatcaccataacaaatgatggtgcaacaatcttggagcagatggatgttgacaatcaaattggtaaattgatggttgagctttcacggagtcaagactatgagattggtgatggaacaacaggagttgttgtcatggctggtgcactgctagaacaggctgagcggttattggaacgtggtattcatccaatccgtgttgcagagggctatgagatagcttcaaagattgctgttgatcatttgcaacaaatagctcacaagtttgagttcactgctacacatatagaacctctggttcaaacttgcatgactaccttatcctctaagattgtgaatcgttgcaagcgcagtttggccgagattgctgtgaaggcagtcatggcagttgcagatttggagaggaaggacgtaaacttagacctcattaaagtggaggggaaagtaggtgggaaattggaggataccgagcttatttatgggattcttgttgacaaagatatgagtcatccacagatgccaaagcaaattgaggatacgaaaattgccattttgacttgcccctttgagccgccaaagccaaagaccaagcataaggttgacattgatacagttgagaagttccaaacactacgccaacaagagcagaagtactttgatgacatggttcagcaatgcaaggatgttggagccacgctggtgatttgccaatggggttttgatgatgaagcaaatcacttgttgatgcacagaaatttacctgctgtcagatgggttggtggtgttgaattagagcttatagcaatanccantggtggaagaattgttcccaggttccaggaattaacacctgaaaagttaggcaaggctggcttggttagagagaaggcatttggtaccacaaaagatcggatgctatatattgagcattgtgcaaattcaagagctgtaactattttcattcgtgggggtaacaagatgatgattgaggagaccaaacgcagtctccatgatgcattatgtgttgcaagaaatctcatccgcaataacaacatcgtctatggtggtggtgcagcggaaatttcatgctcgattgccgttgaagcagctgctgataagtacccaggagttgagcagtatgccgtcagggctttcgcggatgcgttggattctgtccccatggctcttgccgaaaatagtggtctacaaccgattgaaacactatctgcagtgaaatctcaacaaataagggacaacaaccctttttgtggcatagactgcaatgatgctggcacaaacgacatgcgtgaacaaaacgtattcgagacacttatcggaaaacaacagcagctgttgcttgccacacaagtcgtcaagatgatcttgaagattgatgacgtcatctctccagccgagtattaagtttcaggtactttcttttttctaccgaatttgtgttgaaaaaacatttttgtagtgtgttttctgcttaaatatttcccgtattggatcattgttat

SEQ ID NO: 1954 - DNA, 1880 bp, Helianthus annuus
cgcggggatctctggagccgcacacacactcactgtgtgcagatctcactcacagttgttcttcgatctgcaaaaatggcgttagcgttcgatgaatacgggcggccgttcataatacttcgggaacaagaaagcaagagcaggttaagaggtatagatgctcagaaagccaacatttccgccggcgttgctgtttctcgcatcctccgtacatctctcggtcctaaaggcatggataagatgctccagagccccgacggcgacatcaccatcacaaacgatggtgcaacaatcttggaacaaatggatgtcgacaatcaaattgggaaacttatggttgaactgtcacgtagtcaagattatgaaatcggtgatggaacaactggtgtagttgttctggccggtgcacttttagaacaagctgagaagcttctagaacgtggaattcatcccattcgagttgcagaaggatttgaaatttcttcaaagatggctgttgaccatttggaaaagatatcacataaatttgatttcagtgctaccaatatcgaaccgttggtccaaacttgcatgaccaccttatcctccaaaattgtgaatcgatgcaagcgtagtttggcggagattgcggtaaaaggtgtgatggctgttgcggatttagagagaaaagatgttaacctagatttgatcaaagtggagggaaaggttggtgggaaattagaggatacggaacttgtatacggaatcattgttgataaagatatgagtcacccacaaatgccaaaacaaattgaagatgcaaaaattgcgattttgacctgcccgtttgagccaccgaagcctaagaccaaacataaggttgacattgatacggtcgaaaagtttcaaactttgaggaagcaagaacagcagtactttgatgacatggttcagcaatgcaaggatgtaggggccacactggtaatttgtcaatggggcttcgatgacgaagcaaatcacttgttaatgcacagaaatttgccagctgtcagatgggttggcggtgtagaactggagctaatagcaatcgctactggcggtagaattgttcccaggttccaggaactaacaactgaaaaactaggaaaggctggtttggttagagaaaaggcatttggtaccacaaaagatcgaatgctttatattgagcattgtgcaaactcaaaggctgtaaccgttttcatccgtggaggtaacaagatgatgatcgaggagacaaaacgcagcatccatgatgcattatgtgttgctagaaatcttattcgcaataactcgattgtatatggtggcggagctgcagaaatttcatgctcaattgcagttgaagctgccgctgataaatatccaggtgttgaacagtatgccatcagggcgtttgcagatgcattggactccgtacccatggctcttgcagagaatagcggtctgcaacccatcgaaacagtatctgcagttaaagcacagcaaattaaggaaaacaatcattgctgtggcattgactgcaacgatactggtacgaatgatatgcgtgagcaaaacgtatttgaaaccttgattggcaagcaacagcagatcttgcttgccacacaagtcgtgaaaatgattttgaagatcgatgatgtcatctctccaacagaatactgagtttgtggatggatcctactgactttcaagttttggtcaaacgtagaacattgcgactagttatttgtcggaaaacctagcgttgtttggtactctgtttatgtgacttgctgtcatttgtttggtgttggtgtttgttttattttgagaacgctacgatcttactctttatgtttacggttcttgagcgttttctc

SEQ ID NO: 1955 - DNA, 1903 bp, Vinca minor
agggcaagcaaaagaagatcattctctcttcttctagaaccaccatcgcggtgtaaatctagagagagaaacaaagagagtttcttcaatctctctctcggatctgatcatctccggagatcagaaatggcgttagctttcgatgaattcggtcgtccattcattataataaaggaacaagaatcgaaatctcgattgcgcggcctcgatgctcataaatccaacatctccgccggaaaagctattgctagaattctccggacttctcttggtcctaaaggcatggataagatgcttcagagccctgacggcgacgttactataacaaatgacggtgctaccatcctggagcagatggatgttgacaatcaaattgcaaagttgatggttgaattatcacgaagtcaagattatgaaattggggatggaacaactggtgttgttgtcatggctggtgctcttctagaacaggctgagaggttacttgaacgcggcattcatcctattcgaattgccgaaggatatgaagtggcttcaagaattgcttttgaacatctggagcgtataagacacaagtatgaatttgatgcaacagatattgagcccctggtgcaaacctgtatgacaactttatcctccaagattgtgaatagatgcaagagaagcttggcagagattgctgtcaaagcagtattagcagttgctgatttagagcggaaggatgtcaacttggatctaattaaagtagatggtaaagtaggtggaaagctggaggatacagagctaatatacggaattgttgttgataaagacatgagtcatccacagatgccgaaggagataagggatgctaaaattgccattttgacctgcccttttgagcctcccaagccaaagactaagcataaggttgacattgacacagtggagaagttccaaaccttaagacagcaagagcagaagtactttgatgacatggtacaacaatgcaaggatgtaggtgctagcttggttatctgccaatggggttttgatgatgaagcaaatcatctattattgcacagaaatctgcctgctgttagatgggttggtggtgttgagctggagctgatagcgatagctacaggtggaagaattgtgccgaggtttcaagagttgacagcagaaaagcttggcaaagcgggtttggtcagagaaaaagcatttggtaccaccaaagataggatgatctacatagagcactgtgcaaactctagagctgtcacaatttttattcgtggtggtaacaagatgatgattgaggaaacaaagcgcagcatccatgatgctctttgtgtggctaggaaccttatccgcaataattctatagtatatggtggtggttctgctgagatttcttgctccgttgctgtggatgctgctgcagataaacatcctggtgttgagcagtacgcaatacgggcatttgcagatgctttggatgctattcccatggcactcgctgagaacagtggcctccaaccaattgagactttatcagctgtaaaatcccagcaaattaaggagaataatccatgctgcgggattgattgcaacgatgttggtacaaacgacatgcgtgaacaaaatgtgtttgagactttaattgggaagcagcagcagattttgcttgcaacacaagtcgtgaagatgatcctcaagattgatgatgtgatcacgccatcagatttctagtttagttaaatgatgctgcattttttccctcggctgcacgaaaacaatcggtttagtgtgtgggattaacaattgtgtccttgtaatgaatgattagtttatggtctcttggatttgcaacattttaccggtttttatgagctttcttcgaatctgattttttgtttgt

SEQ ID NO: 1956 - DNA, 1925 bp, Solanum phureja
tagaagtgaagggtttagcaatgaactcaacttagggttctgaaaccttatagacagactatagtatcgtctccaacttttttctcaacctgtggagagtgaatcaaaagaatggcgctggcgtttgatgagtttggtaggccattcataataatcaaggaacaagagcagaaaacccgattaagaggccttgatgctcaaaaagccaatatttcctctggcaaagcggtagctcgcattctccgtacttctcttggtcctaagggcatggataagatgcttcagagccctgaaggcgatgtcactatcacaaatgatggtgcaactatcctggagcagatggatgttgacaatcagattgcaaagttgatggttgagttgtcacgaagtcaagattatgaaattggtgatggaactactggagttgttgtcatggctggggcacttctagaacaagcagaaaagttgttagaacgtggtattcaccctattcgagttgcagaaggatatgaaatggcttctcggatagcagtggagcacttggagcgtattgcaaataagtttgaatttggtgtgaatgagtttgagcctttgattcaaacctgcatgactactttgtcttctaagattgtgaacagatgcaaacgtagcatggctgagatcgctgtcaaagcagttctagctgttgcagatctagagaggaaggatgttaatctggacttaatcaaagtcgagggaaaagttggtggaaaattagaggatacagagctaatctacggaattgtagttgacaaagatatgagtcatcctcagatgccaaagcaaatccaggatgcaaatattgccattttgacttgtccttttgagcctccaaaaccaaaaaccaagcataaggttgacattgatactgtggaaaaatttcagactttacgcctacaggagcagaagtattttgatgacatggttcagaaatgcaaggatgttggtgccactttagttatttgtcagtggggtttcgatgatgaagcaaaccacttactaatgcatagaaatctgcctgctgttagatgggtaggtggtgtggagttggagctgatagcaattgctacaggtgggagaattgtgccgaggtttcaagagttgacacctgaaaaacttggccgggctggtctggttagagagaaatcatttggaacaacaaaggacaggatgatttacattgaacattgtgcaaattcaagggccgtgacaatatttatccgtggtggtaacaagatgatgattgaggagacaaaacgtagtatccatgatgctttgtgtgtggctagaaatcttattcgcaacaactccattgtgtatggtggcggttcagctgagatctcttgctcaattgctgtggaagcagcagctgataaacacccaggactaagcatcaaaaccttctatctgcagtatgctatcagggcatttgctgatgctttggattctatcccaatggcacttgctgagaatagtggtctccaacccattgaaactctatctgctgtcaaatctcagcaaattaaggaaaacaatccttggtgtgggatagattgcaatgatgttggaacaaatgacatgcgtgagcaaaatgtctttgagacactgattgggaagcaacagcagattttgcttgcaacacaggttgttaagatgattttaaagattgacgatgtcattagtccgtctgaatattaatttatgtttacataaaccaaagtcttgtgaagatggacattttagctttggtaatgccactccaagtagtgttagttctatgtggtaattgagttcatttttggtggttgacgaattgatatgatttttggattgaagacgttgatttaactaatttaaattagggaggatttttccgccgctcaaaa

SEQ ID NO: 1957 - DNA, 2436 bp, Pinus pinaster
tttctagaacaaggaggaggatctgttcgcttttcgcagggcgggagcgaaaacgagattgcagagatttgcgaattagggtttcaccaatagcagacactcgaaacccacgatcggttcttcagtccattgacggcgccaagggatggcgctggcatttgatgagtacgggaggccatttatcataataaaggagcaggagcagaagacccgaatcagaggcttagatgctcagaaggccaacattgcggccgccaggtccgttgcgagaatcctccgcacctcactcggccccaagggaatggacaagatgctccagagccccgacggcgatgtcaccatcaccaacgatggtgcaacaatattagagcaaatggatgtggaaaatcaaatcggaaagctgatggtagaactatcacgcagtcaggattatgagattggagatggcacaacgggggtggttgtaacagcaggtgcacttttggagcatgcagagcaacttttagaacgggggattcaccccataaggattgcagaaggttatgaaatggcttcaaagttagcagtagagcatttggatcgcatttcacagaagtttgagtttagcttgaacaatattgaatctctggtgcagacgtgtatgactacactctcttcaaagattgttaatcgatgcaagcgtatgctagctgagattgctgtcaaagcagttcttgctgttgcagatttggaaagaaaggatgtaaacttggatttgattaaagttgaaggaaaagttggtggaaagcttgaagatacagagctggtttatggtattatagttgacaaagatatgagccatccacagatgcccaagagaattgaggatgtaaatatagctattttgacttgcccctttgagccacctaagccaaagacaaagcataaggttgacattgatactgtagaaaagtttgaagctttacgtgtacaggaaaggcagtacttcgatgaaatggtcaaaagatgcaaggatgtaggtgcaacacttgtaatctgtcaatggggttttgatgatgaggccaatcatttattgatgcaccgtggtttgccagcagttcgatgggttggtggggtcgagctggagttgattgcaattgccacaggtggacggatagtaccacgatttcaggaattgacacctgagaagctagggaaggctggacttgtgagggagaaagcatttggcacaactaaggatcggatgttatacatagaacagtgtgcaaattcaagggcagtgacagtttttattcgtggtggaaacaaaatgatgatagaagagacaaagcgaagccttcatgatgcactttgtgttgcccggaacttgattcgtgataattcaatcgtatatggtggtggatctgcagaaatttcatgttcacttgctgtcgaagctgccgctgacaagattcctggagtggagcagtatgcagttcgggcatttgcagatgctctagatgcagtaccgatggctcttgcagaaaatagtggactccaacctattgatactttgacagcagtaaaggctcaacagataagggaaaataacccacatttgggaatagattgtaatgatgttggtacaaatgacatgaaggagcaaaatgtcttcgaaactctgatcggcaaaaagcaacagttcttacttgccacacaggtggttaagatgattctgaaaattgatgatgttataacaccatccggtgtctaagcacaaatttgaggatttttctgctgtctaaaactcgagaggattcctggatggggcatattcaatttgggatttgcttttcccacttttatgggatggtaaaaagtatgttgtagtctgtaaagcctctctatacaaaaatatattataaacatacactaaacaatacacatttattgatgagtgtttaaatcaaggtagattatatgagatataatctatttttgatctattagattcctacaatctagggtttttgttacatgttcaatggggtcctcatgttcatcggttcattatagttgctagagcatgatattttgaactatctcatttgttcaggtgctgtttattgtctacattagtaccatttgataatttgcattttggttttgaaaggacactactttttctctgtataaaagtaagccagatttatatttgtctgaggtttacaaatgaaacaagaaaggtttatggtgtgcctctactccataaatattttgttctttggggattgtgttaatatttcgaaggttctcgtcttcgaacagtatttctccattgtgctttaaaatccaaaacaacagcgacttgttttgaacctttctggacttgacctggtaattgtggctttgtgctgatttctattactagttgctattatagattggaattaagtt

SEQ ID NO: 1958 - DNA, 2107 bp, Papaver somniferum
ctatcttctcttctcgatctgcaacttctacagttcttccccgtcctttaatctctccctctctctcttctttctctcggtgcagtctccatttactgaagctctgatagacaagagctgaatcttcgtgaagatggctttggccttcgatgattatgggaggccattcataatcttgagagaacaagaacagaaaagtaggttaaaaggtttagatgcgcagaaatctaacattgctgctggtaaagctattgcacgtatactaagaacttctcttggtcctaaaggcatggataaaatcatgcaatctccagatggagatatcacaatcacaaatgatggagctacaatcttgcaaatgatggacgttgacaatcaaatagcaaaactgatggttgaattatcccagagtcaggactatgaaattggtgatggaacaactggagttgtcgttatggctggtgcacttttggaacaagctgaaaagttattagagcgtggtattcatcctgttagggttgcagaaggttatgagatggcatctaaagttgctgttgagcatttggaacatatatctcacaagtttacttttggtgctaacaacattgaacctttggtgcagacttgcatgactaccttatcatcgaaaattgtcaatcgctgcaaaggaagtttagccgagattgctgttaaagcagttttggctgttgcagatctggaaaggaaggatgtcaatttagacttgattaaaatagaggggaaggtaggggggatgctggaagacactgagctaatttatggaattatagttgataaggatatgagccatccccagatgccaaaacaaattcaagatgcacacattgctatcttgacttgcccgtttgagcctccaaaacccaagactaagcataaggttgacattgacacggttgagaagttcgaaactttgcgtctacaggagaagaaatactttgatgatatggtccaaaaatgcaaggatgttggtgcaacactagttatctgccaatggggttttgatgatgaggcaaatcatttattgatgaatcggaacttgcctgctgttagatgggttggtggagtagaactagagctcattgcaatagctacaggtggaaggattgtgccaaggttccaagagttaacaactgaaaaattggggaaggctgggttagttagagagaaatcctttggtacaaccaaagatcgaatgctctacattgagcagtgtgcgaattcgagggcggtcactatcttcatccgcggtggtaacaaaatgatgatagaggagacgaaacgtagcattcatgacgctctatgtgtggcgaggaatctaattcgcaacaactcaattgtatacggtggtggatcagcagagatatcctgctctgttgcagtagaggcagctgcggataagtatcctggagttgagcagtatgctataagggcatttgcagatgctttggatgctgtccccatggcattggcagagaatagtggactccaacccattgaaactcttacttcagtcaaatctcagcagatcaaggagaacaacccatgctgcgggatagactgcaatgatgtcggaacaaatgacatgcgcgaacagaatgtttttgagacactgattggtaagcaacaacagctcttacttgccacccaggttgtcaagatgattctgaagattgatgatgtcattagcccgtcagagtattgatttatcaatctctattatagatctccaaccatagcttgcgttaccttagataactttttgtgggagatagaattcatgagttttcaacttcacacaactctgttactaatagattttgatgagaaccactccttacaggcttttcttcattatgcccattgttaggtttttgagttgtttattagttgtagaagtacttaatatggctttgtgtgccgtggaatgttaacttccgattttgtggtttttagcccttttctatttgtaactattctctcttgagagtttccacgtctgcttttaaacctttcattgaacaccgagaaacttaagtttaggttgtgccaagtataagctgtagaaact

SEQ ID NO: 1959 - DNA, 1936 bp, Raphanus sativus
gtgaggagagaaaaaaaaacaagatctgtacttcgatctgatcgaggaaagttcgaaacctcgaaaaaatggcgctagcgttcgatgagttcgggcgtccgttcataatactgagggagcaggatcagaagacgcgtctcagaggcatcgatgctcagaaagccaatatcgccgccggcaaagcggtggctcggatcctccgctcctctctcggacctaaaggaatggacaagatgcttcaaggacctgacggagacgtcaccatcacgaatgatggagcaacgatcttggagcagatggatgtggacaaccagattgcgaaacttatggtcgagctgtctcggagtcaggattatgagatcggtgacggcacgacgggtgttgttgtcatggctggtgcgcttctggagcaagctgaacgtcagctagatagggggattcatcctatccgtgttgctgagggatatgagatggcttctagagttgcggttgagcatttggagcgtatatctcaaaagtttgaattcgacaatgataactacgagccgttggttcaaacatgcatgactactctctcctctaagattgtgaatcgatgcaagcgcagtttagctgagattgctgtgaaagcagttcttgctgttgctgatctagagagaaaggatgttaacttagatctgataaaaatcgagggcaaagtcgggggaaacttggaggacactgagcttatatatggaatactggttgacaaagacatgagtcatcctcagatgccaaagcagattgaagatgcccacattgccattttgacttgcccgtttgagccaccgaagcccaagactaagcataaggtggacattgacacagtggagaagttcgagacattacgcaagcaagagcagcaatacttcgatgagatggtccagaaatgcaaggatgttggtgcaacactggttatttgccaatggggattcgatgatgaggcaaaccatcttttgatgcacaggaatttgcctgctgtcagatgggtcgggggtgttgaattagagcttatcgcaatagccacaggcggcagaattgttccaagattccaggagttgaccgcagagaagctagggaaggctggtatggtgcgtgaaaaatcatttggcacaacaaaagaacgaatgctgtacattgagcactgtgcgaactcaaaagctgtcactattttcatccgtggaggtaacaaaatgatgatagaagaaacgaagcgaagtatccacgatgctttgtgtgtggcaaggaatctcatccgcaataagtcaattgtatatggaggtggtgcagctgaaatcgcatgctcacttgcagttgacgcagctgcagataaataccctggcgtcgagcagtatgcaataagggcatttgcagaagccttggactctgtccctatggctcttgcagagaacagtgggttgcagcccattgagactctctctgcggttaaatctcagcaacttaaggagaatattcctttctatgggatagattgcaatgacgtgggaacaaacgatatgagggagcaaaatgtgtttgaaacattgatcgggaagcagcagcagatcttgcttgcaactcaagtcgttaagatgattctaaagatcgacgatgtcatctccaattctgaatactgatgatgttctgctaaaaaaccttggtgctagctaccctttggcctcttgtttttttgtgtttgctttagcttttgatactattcaacaacgttgttcccctcttgcaagcgttttttttaaaagaaatgtcctcatcgtgtgttcgttattttaaatctatcctactgttttttggagattggaccaaacagcattcagaaaggatattgtcaaactttaactgtctatcgagtttgcagagaaaatcatctattaggaga

SEQ ID NO: 1960 - DNA, 1889 bp, Valeriana officinalis
aggtaagtccgtattcttaattttttgtcgtattcttgtcttcttgctactcaactccgagtacaactggtgaagtgcgaaaatggcgttggccttcgatgagtttgggaggccgttcattatcataaaggaacaagagcagaagagtcgattgagaggactcgatgctcagaaatccaacatctccgccggaaaggctgttgctcgtatactacgaacatctctcggtcccaagggcatggataagatgctccaaagtcccgacggcgacatcaccatcacaaatgacggtgcgacaatcttagagcagatggattgtgacaatcaaattggaaagctgatggttgaattatcaagaagtcaagattacgaaatcggtgatggaactactggagtagtggttttggctggtggactcttagaacaagctgaacgtttgttagaacgtggtatccatcctatcagggttgctgagggatttgaaatggcttcaaggatcgccgttgaacatttggagagtatatcacacaaatttgattttagtcagacaaacattgagcctttggttcaaacttgcatgacaactttatcttccaagattgtgaatagatgcaagcggagtttggctgagatagctgtgaaagcagttatgtctgttgcagatttggaaaggaaagacgttaacctagacctcattaaagtggaggggaaagtaggcggaaagctggaggacacagaactcatacatggaattcttgttgacaaagatatgagtcatccacaaatgccaaaacaaattcaagatgcaaaaattgccattttgacctgcccctttgagcctccgaagccaaagaccaagcataaggttgacattgatacagttgaaaagttccagactttacgcgttcaagaacagaagtactttgatgacatggttcagaaatgcaaggatgttggagccactttggttatctgtcaatggggttttgatgacgaggcaaatcacttgctaatgcacagaaacttgccagccgttcgatgggttggtggtgttgagctagagctgattgctattgctactggtggaagaattgtaccaaggtttcaagagttgacgactgaaaagctgggcaaggctggtctggttcgagaaaaagcatttggtaccactaaagatcgaatgctctatattgaacattgtgcgaattcaagggctgtaactatattcatccgtggtggtaacaagatgattatagaggagacaaaacgcagcatccatgatgcgctgtgtgttgcaaggaacttaatccgaaacaattctatcgtatatggtggtggcgctgctgagatttcatgttcaattgctgtcgagacagcagctgacaaatttccaggagttgagcaatatgctattagggcatttgccgatgcattggattctgttcccatggctcttgcagaaaatagtggtctccaacctattgaaacattgtctgccgtcaaatcgcagcaaatcaaggataacaatccttgctgcgggatagactgcaatgatactggaacgaatgacatgcgtgagcagaatgttttcgagaccctaattgggaagcagcagcagattttgcttgcaacacaagttgttaagatgattctaaagatcgatgatgtcatctctccttctgaattttgatttttcaggtccctcctctctacgcatctcttgcctttaaacttacatataaattgtagcttgccggttgcctttatattgctttcaagtctttagtttttgtcgttgatcgttttgtttcgagtttctgaatgtcttagaatatttatggatcaatgaattgcctttttgtcttaatatagattatgtttttgtttag

SEQ ID NO: 1961 - DNA, 1648 bp, Cirsium arvense
atacaaacaacaagtggcgttggctttcgatgaatacggtcggccgttcataatcttaagggaacaagaaagtaagagtaggttaagaggtttagatgctcagaaagccaatatttccgccggcgtcgccgtggctcgcatcctccggacgtctcttggtcctaaaggcatggataagatgcttcagagccctgacggcgatatcaccataacaaatgatggcgcaacaatcttggagcagatggatgttgacaatcaaattggtaaattgatggttgagctatcacggagtcaagactatgagattggtgatggaacaacaggagttgttgttatggctggtgcactgctagaacaggctgagcggttgttggaacgtggtattcatccaattcgagttgcagagggttatgagatagcttcgaagattgctgttgatcatttgcaacaaatatcacacaaatttgagttcagtgctacacatatagaacctctggttcaaacttgcatgactaccttatcctctaagattgtgaatcgttgcaagcgcagtttggctgagattgctgtgaaggcagtcatggcagttgcagatttggagaggaaggatgtaaacttagacctcattaaagtggagggaaaagtaggtgggaaattggaggatactgagcttatttatgggattcttgttgacaaagatatgagtcacccgcagatgccaaagcaaatcgaggatgcgaaaattgccattttgacttgcccctttgaacccccgaagccaaagaccaaacataaggttgacattgatacagtcgagaagttccaaacattacgcgtgcaagagaagaagtactttgatgacatggttcagcaatgcaaggatgttggagctactttggtgatttgccaatggggttttgatgatgaagcgaatcacttgttgatgcacagaaatttacctgctgtcagatgggttggtggtgttgaattagagcttatagcaatagccactggtggaagaattgttcccaggttccaggaattaacacctgaaaagctaggcaaggctggtttggttagagagaaggcatttggtaccacaaaagatcggatgctatatattgagcattgtgcaaattcaagagctgtaaccgtatttattcgtgggggtaacaagatgatgatagaggagaccaaacgcagcatccatgatgcactttgtgtcgcaagaaatctcattcgcaataattctatcgtctatggtggcggctcagcagaaatttcatgctcaatcgcagtggaagcagctgctgacaaatatccaggagttgagcagtatgccgtcagggcttttgcagatgccttggattctgtccccatggcccttgcagaaaatagtggtctgcaaccaatcgaaacactatctgcagtaaaatctcaacaaataaaggacaacaacccatgttgtggtatagactgcaatgatgctggcacaaacgacatgcgtgaacaaaatgtattcgaaacgcttatcggaaagcaacagcagctgttacttgcaacacaagtcgtcaagatgatcttgaagatcgatgatgtcatctctccaactgagtattaagtttcaggtaacttgacttccaagttc

SEQ ID NO: 1962 - DNA, 1920 bp, Brassica rapa
ggagctactagggtttcacactcaaaccattttcgctctcaaatccactctccttctctttgttattttttgagcagtgagaataaaaaaaaaacaagatctgaacttggatcggatcgaggaaagtttgaagctccaaaatggcgctagcgttcgatgagttcgggcgtccgttcataatactgagggagcaggatcagaagacgcgtctcagaggcatcgatgctcagaaagccaatatcgccgccggcaaagcggtggctcgtatcctccgttcctccctcggacctaaaggaatggacaagatgcttcagggacctgacggagacgtcaccatcacgaatgatggtgcaactatcttggagcaaatggatgttgacaaccagattgcgaaacttatggtcgagctgtctcggagtcaggattatgaaatcggtgacggcacaacaggcgttgttgtcatggctggtgcgctactggagcaagctgaacgtcaactagatagggggattcatcctatccgtgtcgctgagggatatgagatggcttctagagttgcagttgagcatttggagcgtatatctcaaaagtttgagttcgacgttgataattttgagccattggtcaaaacatgcatgactactctctcctcgaagattgtgaatcgatgcaagcgcagtttagctgagattgctgtcaaagcagttcttgctgttgctgatttggagagaagggatgttaacttagatctgataaaagtagagggcaaggtcgggggaaacttggaggacactgagcttatatatggaatactagttgacaaagacatgagtcatccacagatgccgaagcaaattgaagatgctcacattgccattttgacttgcccgtttgagccaccgaagcccaagactaagcataaggtggacattgacacagtggagaagtttgagacattgcgcaagcaagagcagcaatatttcgatgagatggttcagaagtgcaaggatgttggtgctacattggttatttgccaatggggattcgatgatgaggcaaaccatctattgatgcacaggaatttgcctgctgtcagatgggtcgggggtgttgaattagaactcatcgcaatagccacaggcggcagaattgttccaagattccaggaattgaccacagagaagttagggaaggctggtatggtgcgtgaaaaatcatttggcacaacaaaagaacgaatgctgtatattgagcactgcgcaaactcaaaagctgtcactattttcatccgtggaggtaacaaaatgatgatagaagaaactaagcgtagtatccacgatgctttgtgtgtggcgaggaatctcatccgcaataagtcaattgtatatggaggtggtgcagctgaaatcgcatgctcacttgcggttgatgcagctgcagataaataccctggcgtcgagcagtatgcaataagggcatttgcagaagctttggactccgtccctatggctcttgcagagaacagtgggctacaaccaattgaaacactctctgcggttaaatctcagcaacttaaggagaatattcctttctatggaatagattgcaatgacgtgggaacaaacgatatgagggagcaaaacgtgtttgaaacattgatcgggaagcagcagcagatcttgcttgcaactcaagtcgttaagatgattctaaagatcgacgatgtcatctctaattctgaatactgatcatgttgtgcttaaaacttttgtactaccctttggtctctttgtttcttgtttgctctctattagattttgatactattcatcaacgttgttctcctcttgcaagcttttattgaacaccctcattctgcattctttattccactctgtttttccaacactgaaccaaaca

SEQ ID NO: 1963 - DNA, 1928 bp, Brassica napus
tttaacacaaccattttcgctctcaaatcttctctccactctccttctccccccaagatctgtatttcgatcggatcgaagaaagcttaaacctcgaaaatggcgctggcgttcgacgagttcgggcgtccgttcattatactgagagagcaggatcagaagacgcgtctcagaggcatcgatgctcagaaagccaatatcgccgccggcaaagcggtggctcggatcctccgttcctctctcggacccaagggaatggacaagatgctccagggacctgacggagacgtcaccatcactaacgatggtgcgacaatcttggagcaaatggatgttgacaaccagattgcgaagcttatggttgagctgtcacggagtcaggattatgagattggtgacggcacaacgggtgttgttgtcatggctggtgcgcttctggagcaagctgagcgtcaattggatagagggattcatcctattcgtatcgctgagggatatgagatggcttctagagtggctgttgagcatttggagcgtatatctcagaagtttgagttcgatgttaataattacgagcctttggttcaaacatgcatgactactctgtcctcgaagattgtgaaccgatgcaagcgcagtttggctgagattgctgtgaaggcagttcttgctgttgctgatttggagaggagggatgttaacttggatctgatcaaagtagagggtaaagttggggggaacttggaggacactgagcttatatatggaatactggttgacaaagacatgagtcatccacaaatgccgaagcaaattgaagatgcccacattgctattttgacttgccccttcgagccaccgaagccgaagactaagcataaggtggacattgacacagtggagaagtttgagactctgcgcaagcaagagcagcaatatttcgatgagatggttcaaaaatgcaaggatgttggagctacacttgttatttgccaatggggattcgatgatgaggcaaaccatctattgatgcacaggaatttgcctgctgtcagatgggtcgggggtgttgaattagaacttatcgcaatagctacaggcggcagaattgttccaagattccaggagttgaccccagagaagttagggaaggctggcatggtccgtgaaaaatcatttggcacaacaaaagaacgaatgctgtatattgagcactgtgcgaactcaaaagctgtcactatattcatccgtggaggtaacaagatgatgatagaagaaacaaagcgtagtatccacgatgctttgtgtgtggcaaggaatctcatccgcaataagtcaattgtatatggaggtggtgctgctgaaatcgcatgctcacttgcggtcgatgcagctgctgataaataccctggcgtcgagcagtacgcaataagggcatttgcagaagcgttggactctgtacctatggctcttgcagagaacagtggattacagcccattgagacactctctgcggttaaatctcagcaacttaaggagaacattcctttctatgggatagattgcaatgacgtgggaacaaacgatatgagggagcaaaatgtgtttgaaacattgatcgggaagcagcagcagattttacttgcaactcaagtcgttaagatgatcctaaagatcgacgatgtcatctccaattctgagtactgatgatgtactgtgtcgaccttagtactatccttcggcttattgtgtctttattttgtttgctttctattagcttttgacactattcgacaacaatggtttgttcccctcttggcaagcttttattgtaagaacatcctcattttgtgttcaaggttttgattctatcccactctgtatttttcaatactgaaccaaaaagatacggagtgttgtttgccttt

SEQ ID NO: 1964 - DNA, 2169 bp, Brassica napus
tagagaaacaaaaactaacacaatagacgacaaaacgaaagtagaaataataatctaaaacaactagtacaaggttacggtcacataatgaacgaacttactgatatcactcggacgtctagactagaccacgcacgagaagagaggatgatacacaatgagacgtacaggcgaagtagctctagcaaagaatgagaatcaaatacattcccacaaacaagctttggtctgttgtgcattcgctctaacacggtccccactcctttcttctctccatcgcagtgagagagagagagagagaggaaagcgaagatctgtacgtggatcggatcgagaaaagctaaggctcgaaaatggcgctggcgttcgatgagttcgggcgaccgttcattatactaagggagcaggatcaaaagacgcgtcttagaggcatcgatgctcagaaagccaatatcgccgccggcaaagcggtggctcggatcctccgttcctccctcggacctaaggggatggataagatgctccagggacctgacggagacgtcaccatctcaaacgacggtgcgaccatcttggagcaaatggatgttgacaaccagattgcgaagcttatggtcgaactgtcgcgtagtcaggattatgaaattggtgacggcacaacaggtgttgttgtcatggctggtgcacttctggagcaagctgaacgtcagttagatagagggattcaccctatccgtatcgctgaaggatacgagatggcttctagagtagctgttgaacatttggagcgtatagctcagaagtttgaattcgacgttaataactacgagccgttggttcagacatgcatgactactctttcctcgaagattgtgaaccgatgcaagcgcagtttagctgagattgcggtgaaagcagttcttgctgttgctgatttagagagaagggacgtcaacttagatttgataaaagtagagggcaaagtcgggggaaagttggaggatactgagcttatatatggaatactggttgacaaagacatgagccatccacaaatgccaaagcatattgaagatgcccacattgccattctgacttgcccctttgagccaccgaagccgaaaactaagcataaggtggacattgacacagtggagaagtttgagacgttgcgtaagcaagagcagcaatatttcgatgagatggttcaaaagtgcaaggatgttggtgctacactggttatttgccaatggggtttcgatgatgaggcaaaccacctattgatgcataggaatttgcctgctgtcagatgggttgggggtgttgaattagaacttatcgcaattgccacaggcggcagaattgttccgagattccaggagctgaccccagagaagttagggaaggctggcatggtccgtgaaaaatcatttggcacaacgaaagaacgaatgctgtatattgagcactgtgcgaactccaaagctgttactattttcatccgtggaggtaacaaaatgatgatagaagaaacgaagcgtagtatccacgatgctctgtgtgtggcaaggaatctcatccgcaataactcaattgtatatggaggtggtgcagctgaaatcacatgctcacttgctgttgatgcagctgctgataaataccctggcgtcgagcagtacgcaataagggcattcgctgaagctttggactctgtccccatggctcttgcagagaacagtggactacagcccatcgagacactctctgcggttaaatctcagcaaattaaggagaatattccattctatgggatagattgcaacgacgtgggaacaaacgatatgagggagcaaaatgtgtttgaaacattgataggaaagcagcagcagattctgcttgcaacacaagtcgttaagatgattctaaagatcgacgatgtcatctctaattctgaatactgatgatgtactgctgcaacctttttagttctttccttttttgcctcttttagtcttttgtttgctttctattagcttttgatactattcaacaattcttttcctctcttgttgtaagcttttattttaagaaaatcctcatttgtgttcctgattttgaatttgtttcactttttcgacactgaaccaaacagcatgaaagcttccatga

SEQ ID NO: 1965 - DNA, 3606 bp, Brassica napus
atctgaacttggatcggatcgaggaaagtttgaagctcgaaaaatggcgttggcgttcgacgagttcgggcgtccgttcataatactgagggagcaggatcagaagacgcgtctcagaggcatcgatgctcagaaagccaatatcgccgccggcaaagcggtggctcggatcctccgctcctctctcggacctaagggaatggacaagatgcttcagggacctgacggagacgtcaccatcacgaacgatggtgcaactatcttggagcaaatggatgttgacaaccagattgcaaaacttatggtcgaactctctcggagtcaggattatgaaatcggtgacggcacaacaggcgttgttgtcatggctggtgcgcttctggagcaagctgaacgtcaacttgatagggggattcatcctatccgtgtcgctgagggatatgagatggcttctagggtagcagttgagcatttggagcgtatatctcaaaagtttgagttcgacgttaataatttcgagccactggtccaaacatgcatgactactctgtcctcgaagattgtgaatcgatgcaagcgcagtttagctgagattgctgtcaaagcagttcttgctgttgctgatttggagagaagggatgtcaacttagatctgataaaaatagagggcaaagttgggggaaacttggaggacactgagcttatatacggaatactggttgacaaagacatgagtcatccacagatgccaaagcaaattgaagatgcccatattgccattttgacttgcccgtttgagccaccgaagcctaagactaagcataaggtggacattgacacagtggagaagtttgagacattgcgcaagcaagagcagcaatatttcgatgagatggttcagaagtgcaaggatgttggtgctacattggttatttgccaatggggattcgatgatgaggcaaaccatctattgatgcacaggaatttgcctgctgtcagatgggtcgggggtgttgaattagaacttatcgcaatagccacaggcggcagaattgttccaagattccaggaattgaccccagagaagttagggaaggctggtatggtgcgtgaaaaatcatttggcacaacaaaagaacgaatgctgtatattgagcactgcgctaactcaaaagctgtcactattttcatccgtggaggtaacaaaatgatgatagaagaaactaagcgtagtatccacgatgctttgtgtgtggcgaggaatctcatccgcaataagtcaattgtatatggaggtggtgcagctgaaatcgcatgctcacttgcggttgatgcagctgcagataaataccctggcgtcgagcagtatgcaataagggcatttgcagaagctttggactccgtccctatggctcttgcagagaacagtgggctacagccaattgaaacactctctgcggttaaatctcagcaacttaaggagaatattcctttctatggaatagattgcaatgacgtgggaacaaacgatatgagggagcaaaacgtgtttgaaacattgatcgggaagcagcagcagatcttgcttgcaactcaagtcgttaagatgattctaaagatcgacgatgtcatctctaattctgaatactgatcatgttgtgcttaaaacttttgtactaccctttggtctctttgtttcttgtttgctctctattagattttgatactattcatctctttgtttcttgttgtgcgaaaatcattctaaagtttctgtatgcattattcaaaatttaataacagatgaagacaagtgtcatagtgtaggcttctagagtaaaaccattgtcgtatgagagcaaaaccttctgtttatacataagaatatgtaaggaacgtgaagtaagcttccacgacttacaaaaaaccatttggccatttctttctgcacaaatactaaaacctgaaacatcacttttcctcaatccgcctttaggtgtttgttaaccacttctatgtttcatgagaatgttgtttctctgcatcatggccaacgccgagtttcccattagtagtctcgtccttttgaatggaaggcttcccattcacagcggcagagccatcacctgtttcttccgcgcctgtgtcagattttccctcatgttcctctgcgctgtctgtattttgatttgacagagctgcttcagctttctgcctctcctcttctttctctcgacgtctctttgcttcttgctctttgagcagcctaaacctttcaccaggtttgggcccttctgaggtcactttttcactacccttgtctcttggtattttcagctctgagacagacttctgaactagaggttgtgagatagacttgtcaactttttgagttttgtcttccttggttaccaaattagtgagcttctccatcggatttttggcaccaccatatttttgaagccatacttgctgtgctgtgctcaaaatgttgttggtcaaccagtaaagacttagaccagaaggaactgatagtgcaaaatagccaatcatcagcgggagaaacttcgtcactgcttgtgagctcttcatggctggatcatcactctgcggctgagaggattgcataatctgaatggagagatactgagagaagatgagtaatagaggtaagacaagatatgctaatgtgtctgaccatccgagtggtgggtgtccctcaatgaacgggaagagccatgatattccactgccactctgtcttgcggcaacagttgttggaccggcaagagaaggaatccagaaaaagccttccgtcaagagtccctcatccgcaacatttgaaagggctctatataggccaatccagactggtatggtagctagtgtggggagacagcctgcaaaaggattgattccagcaagtttatacaatctggcagtttcaagttgaattttctcctgatcaccagcataccgttcctggattgccttaatctgaggctgcaaagatttcatagccatagtagattctacctgcttcttggtcaacgggaaggtagcagccttaacaagcacggtgagtagaatgatagcgaaaccataagaataaggaacgtttacagttgataacccatctttcaaaaccttgaggatagtttccatgtaattggcgataccagtgaaccaatcactgttctggtttgtggtggtggtagtggtagtgccggaaaaagaatcaaaagtctcggaggacgagacggctgcatcagcgatcgtgtagagtagactctcgacatgttctttgatcaaatcgagagaaacggggcctggactgaacccgaattgagccaccagggtccgacgacaagacgaagacggcgacggtctgtggctgaaacgggaacggcggagatggaggactttgccggttgagaaagacgagaggagaaggttcgtcggcttcagtgatatcgaagtggccatcttcagcgacaagaaaggtaagaacttggttttggattcagaaaggatttggatttttgtcaagtattgtttcttgcttcacgtctagtctcgtgcgcgagacaccgaccgtgaagtgtc

SEQ ID NO: 1966 - DNA, 2014 bp, Populus trichocarpa
tgctaaactactactagctcttcatttcactgaatcacttccttccttctacactcttctcgcctaccactccctcccttagaaaccaaagttggaaaaaaaatcttcttttttttatttcgattttagtagatttttttgttgcttgaaacacagagagagagatggcgttagcgttcgatgaattcggtagaccatttgtaataataaaagaacaagaccagaaggttcgattgagaggtctcgatgctcaaaaagccaacattgcttctggtatggccgtctctcgcatccttcgcacctctctcggtcccaaaggtatggataagatgctccagagtcccgacggcgacgtcaccatcacaaatgatggtgctacgatattggagcaaatggatgtggacaatcagattgcaaaactgttggttgagctttcgaggagtcaggattatgaaatcggtgatgggactactggtgttgttgttttggctggtgctcttttagagcagtctcagaagcttttggagcgcgggattcaccctattcgtgttgctgagggttatgagactgcttctagaattgctgtggagcatttggagaagatctctcagaagtatgattttggagttaataatatggagcccttggttcaaacttgcatgactactttgtcctccaaaattgtgaatcggtgcaagcgcagtttagcagagatttcagttaaagcagttcttgctgttgcggatttagagaggaaagatgttaatttagatttgataaaagttgaagggaaagtaggaggcaagttggaagatactgaactaatatatgggatacttgttgacaaggaaatgagtcatccgcagatgccaaagcaaattgaagatgcaaaaattgctatcctgacgtgcccctttgaaccacctaagccaaagactaaacataaggtggacattgatacagttgaaaagtttcaaacattgcgcaagcaagagcagcagtactttgatgtcatggttcagaaatgcaaggatgttggcgcaaccttggttatctgtcaatgggggtttgatgatgaggcaaatcatttattaatgcacaggaacttgcctgctgtccggtgggttggtggtgtagagttagagctgatagcaatagctacaggtggaagaattgtgccaaggttccaggagttgacacctgaaaagctgggaaaggctggtttggttcgagaaaaggcttttggcacaaccaaagatagaatgctgtatgttgaacactgtgcaaattcgagggctgtaaccatatttattcgtggaggtaacaaaatgataattgaggagacaaagcgtagcatccatgatgcgttgtgtgtggcaaggaatcttattcgcaacaactctattgtatatggtggtggctcagctgagatttcctgctcagttgctgtggaggctgcagctgatagatatccaggagttgagcagtatgccatcagggcatttgctgatgctttagattctgtccctatggcgctagcagaaaatagcggcctccaaccaattgagacattatctgcagtgaaatctcagcaaattaaggagaacaatcattactgcggaatagattgcaatgatgctggtacaaatgacatgcgcgagcaaaacgtctttgagactcttattggaaagcagcagcagatttttcttgcaacacaagttgtcaaaatgatattaaaaattgatgatgtcatctctccttccgagtactgatcttgtaaaggtcggatatcacactgcttaaccatcaactgaggccatattgttttactggcctgatgcagcatttcgagcctctcggagacagacatttgtttcatgagagcttgttttggttgcagattttgtattgctcgttggattttaatcggttttccttgcgtgtttgaagtggttgatttttattgcttgttttctttgattagtgatattacatgatgtttttactttgatac

SEQ ID NO: 1967 - DNA, 2054 bp, Populus trichocarpa
tgctaaactactactagctcttcatttcactgaatcacttccttccttctacactcttctcgcctaccactccctcccttagaaaccaaagttggaaaaaaaatcttcttttttttatttcgattttagtagatttttttgttgcttgaaacacagagagagagatggcgttagcgttcgatgaattcggtagaccatttgtaataataaaagaacaagaccagaaggttcgattgagaggtctcgatgctcaaaaagccaacattgcttctggtatggccgtctctcgcatccttcgcacctctctcggtcccaaaggtatggataagatgctccagagtcccgacggcgacgtcaccatcacaaatgatggtgctacgatattggagcaaatggatgtggacaatcagattgcaaaactgttggttgagctttcgaggagtcaggattatgaaatcggtgatgggactactggtgttgttgttttggctggtgctcttttagagcagtctcagaagctgttggagcgcgggattcaccctattcgtgttgctgagggttatgagactgcttctagaattgctgtggagcatttggagaagatctctcagaagtatgattttggagttaataatatggagcccttggttcaaacttgcatgactactttgtcctccaaaattgtgaatcggtgcaagcgcagtttagcagagatttcagttaaagcagttcttgctgttgcagatttagagaggaaagatgttaatttagatttgataaaagttgaagggaaagtaggaggcaagttggaagatactgaactaatatatgggatacttgttgacaaggaaatgagtcatccgcagatgccaaagcaaattgaagatgcaaaaattgctatcctgacgtgcccctttgaaccacctaagccaaagactaaacataaggtggacattgatacagttgaaaagtttcaaacattgcgcaagcaagagcagcagtactttgatgtcatggttcagaaatgcaaggatgttggcgcaaccttggttatctgtcaatgggggtttgatgatgaggcaaatcatttattaatgcacaggaacttgcctgctgtccggtgggttggtggtgtagagttagagctgatagcaatagctacaggtggaagaattgtgccaaggttccaggagttgacacctgaaaagctgggaaaggctggtttggttcgagaaaaggcttttggcacaaccaaagatagaatgctgtatgttgaacactgtgcaaattcgagggctgtaaccatatttattcgtggaggtaacaaaatgataattgaggagacaaagcgtagcatccatgatgcgttgtgtgtggcaaggaatcttattcgcaacaactctattgtatatggtggtggctcagctgagatttcctgctcagttgctgtggaggctgcagctgatagatatccaggagttgagcagtatgccatcagggcatttgctgatgctttagattctgtccctatggcgctagcagaaaatagcggcctccaaccaattgagacattatctgcagtgaaatctcagcaaattaaggagaacaatcattactgcggaatagattgcaatgatgctggtacaaatgacatgcgcgagcaaaacgtctttgagactcttattggaaagcagcagcagatttttcttgcaacacaagttgtcaaaatgatattaaaaattgatgatgtcatctctccttctgagtactgatcttgtaaaggtcggatatcacactgcttaaccatcaactgaggccatattgttttactggcctgatgcagcatttcgagcctctcggagacagacatttgtttcatgagagcttgttttggttgcagattttgtattgctcgttggattttaatcggttttccttgcgtgtttgaagtggttgatttttattgcttgttttctttgattagtgatattacatgatgtttttactttgatacttaaattcgttaattgctggatcatttgattcagctcata

SEQ ID NO: 1968 - DNA, 1952 bp, Eutrema halophilum
tagggttttacacaatcattttcgctcttaaagcttcgagacactccttcttctcggttttcccccatttcaaccagtgcagtgagaaaaaaaacccaagatctgtaacttggatcagatcgaggaaagttgaagctctaaaatggcgctggcgttcgatgagttcgggcgtccgttcattatactgagggagcaagatcaaaagacgcgtcttagaggcatcgatgctcagaaagccaatattgctgctggcaaagcggtggctcggatccttcgatcctctctcggacctaagggaatggacaagatgcttcagggacctgacggagacgtcaccatcacaaacgatggtgcaaccatcttggagcaaatggatgttgacaatcagattgcaaaacttatggttgagctgtcacggagtcaggattatgagattggtgatggcacaacaggtgttgttgtcatggctggtgcacttctggagcaagctgaacgtcaattagataggggaattcatcccatccgtatcgctgaaggatatgagatggcttctagagtcgcagttgagcacctggagcgtatagctcaaaagtttgaattcgacgttaacaatttcgagccacttgttcaaacatgcatgactactctatcctcgaagattgtgaatcgatgcaagcgcagtttagctgagattgccgtaaaagcagttcttgctgttgctgatttagagaggagggatgttaacttagatctgatcaaagtagagggtaaagtcgggggaaagttggaggacactgagcttatatatggaatactggttgacaaagacatgagccatccacaaatgccaaagcaaattgaagatgcccacattgccattttgacttgcccctttgagcctccgaagccgaagactaagcataaggtggacattgacacagtggagaagtttgagacattgcgcaagcaagagcagcaatattttgatgagatggttaaaaagtgcaaggatgttggtgctacactggttatttgccaatggggattcgatgatgaggcaaaccatctattgatgcacaggaatttgcctgctgtcagatgggttgggggtgttgaattagaacttatcgcaatagccacaggcggcagaattgttccaagattccaggagttgaccccagagaagttaggaaaggctggcttggttcgtgaaaaatcatttggcacaactaaagaacgaatgctgtatattgagcactgtgcgaactcgagagctgtcactgttttcatccgtggaggtaacaaaatgatgatcgaagaaacgaagcgtagtatccacgatgctctgtgtgtggctaggaatctcatccgcaacaaatcaattgtatatggaggtggtgcagctgaaattgcatgctcacttgcggttgatgcagctgctgataaataccctggcgttgagcagtatgcaattagggcatttgcagaagctttggactctgtccctatggctcttgcagagaacagtggattacagcccattgagacactctctgcggttaaatctcagcaaattaaggagaatattcccttctatgggatagattgcaatgacgtgggaacaaacgatatgagggagcaaaatgtgtttgaaacattgatcgggaagcagcagcagattttactcgcaactcaagtcgttaagatgattctaaagatcgacgatgtcatctctaattctgaatactgatgtgctgctgcaacctttgtacttcactttgacctcttgggtgttttggtttgctattttttattagcttttgacactgtttaacatcattttccctttctcttgcaagcttttattttatgaacatcctcgatcttttttgcgtcgtgattttgattttatcccactttgtgtgtttttcgacactgaaccaaatagcatt

SEQ ID NO: 1969 - DNA, 1765 bp, Vinca minor
agaacactctgcttccactgtaaatctacagagagagaaacagataatttcttggatccgatctccgagaagaagaaaaatggcgttagctttcgatgaatttggtcgtccatttatagtaataaaggaacaagaatccaagactcgattgcgcggtctcgatgctcataaatcgaacatctccgccggaaaagctgttgctaggattctccggacttctcttggacctaaaggcatggataagatgctccagagtcccgacggcgatgtcactatcacaaatgatggtgctacaatcttggagctgatggatgttgacaatcaaattgcaaagcttatggttgaattatcaagaagtcaagattatgaaattggggatggaacaactggtgttgtcgtcatggctggtgctcttctagaacaggctgagaggttacttgaacgaggcattcatcctattcgaattgccgaaggatatgaagtggcttcaagaattgcttttgaacatctggagcgtataacgcataagtatgaatttgatgcaacagatattgagcccctggttcgaacctgtatgacaactttatcctccaagattgtgaatagatgcaagcgaagcttggcagagattgctgtcaaagcagttgtagcagttgctgatttagagcggagggatgtcaacttggatctaatcaaagtagagggtaaagtaggtggaaagctggaggatacagagctaatatacggaattgttgttgataaagacatgagtcatcctcagatgcccaaggagatacagaatgcaaaaattgccattttgacttgcccttttgagcctccgaagccaaagactaagcataaggttgacattgacacagtggagaagttccaaaccttaagacagcaagagcataagtactttgatgacatggttcaacaatgcaaggatgtaggtgctagcttggttatctgtcaatggggttttgatgatgaagcaaatcatctattaatgcacagaaatctgcctgcggttcgatgggttggtggtgttgagctggagctgatagcaatagccacaggtggaagaattgtgccaaggtttcaggagttgaccgcagaaaagctaggaaaagcaggtttggtcagagaaaaagcatttggtactaccaaagataggatgatatacatagagcactgtgcaaattcaagagctgtcactattttcattcgcggtggtaacaagatgatgatagaggaaacaaagcgcagcatccatgatgctctctgtgtggctaggaatcttatccgcaataattctatagtatacggtggtggttctgctgaaatttcttgctcagttgctgtggaggctgctgcagataaacatcctggtgttgagcagtatgcaatccgagcatttgcagatgctctggatgctatccccatggcacttgctgagaacagcggcctccaacccatcgagactctatcagctgtaaaatcccaacaaattaaggagaataatccgtgttgcgggattgactgcaacgatgttggcacaaacgacatgcgcgagcaaaatgtcttcgagactttaattgggaagcagcagcagattttgctcgcaacacaagtcgtgaagatgatcctcaagatcgacgatgtgatcacaccatcagatttctagtttagttaaattatgccgcactttttcctcggctgcgcgaaaaactaatggttatatcaagagtgccttgagagctag

SEQ ID NO: 1970 - DNA, 1622 bp, Brassica juncea
tcgaaaatggcgcttgcgttcgatgagttcgggcgtccgttcattatactgagggagcaggatcagaagacgcgtctcagaggcatcgatgctcagaaagccaatatcgccgccggcaaagcggtggctcggatcctccgttcctctctcggacccaagggaatggacaagatgcttcaaggacctgacggagacgtcaccatcactaacgatggtgcgactatcttggagcaaatggatgttgacaaccagattgcgaagcttatggttgagctgtcgcggagtcaggattatgagattggtgatggcacaacgggtgttgttgtcatggctggtgcgcttctggagcaagctgaacgtcaattagatagggggattcatcctatccgtatcgctgaaggatatgagatggcttctagagtagcagttgagcatctggagcgtatagctcaaaagtttgaattcgacgttaataactacgagccgttggttcagacatgcatgactactctttcctcgaagattgtgaatcgatgcaagcggagtttagctgagattgctgtgaaggcagttcttgctgttgctgatttagagaggagggatgttaacttggatctgatcaaagtagagggcaaagtcggggggaacttggaggacactgagcttatatatggaatactggttgacaaagacatgagtcatccacaaatgccgaagcaaattgaagatgcccacattgctattttgacttgccccttcgagccaccgaagccgaagactaagcataaggttgacattgacacagtggagaagttcgagacgttgcgcaagcaagagcagcaatatttcgatgagatggttcaaaagtgcaaggatgttggagctacacttgttatttgccaatggggattcgatgatgaggcaaaccatctattaatgcacaggaatttgcctgctgttagatgggtcgggggtgttgaattagaacttatcgcaatagccacaggcggcagaattgttccaagattccaggagttgaccccagagaagttagggaaggctggcatggtccgtgaaaaatcatttggcacaacaaaagaacgaatgctgtatattgagcactgtgcgaactcaaaagctgtcactatattcatccgcggaggtaacaagatgatgatagaagaaacaaagcgtagtatccacgatgctctgtgtgttgcaaggaatctcatccgcaataagtcaattgtatatggaggtggtgcagctgaaatcgcatgctcacttgcggttgatgcagctgctgataaataccctggcgtcgagcagtatgcaatcagggcatttgcagaagcgttggactctgtacctatggctcttgcagagaacagtggattacagcccattgagacactctctgcggttaaatctcagcaacttaaggagaacattcctttctatgggatagattgcaatgacgtgggaacaaacgatatgagagagcaaaacgtgtttgaaacattgataggaaagcagcagcagattttgcttgcaacacaagtcgttaagatgattctaaagatcgacgatgtcatctccaattctgaatactgatgatgtac

SEQ ID NO: 1971 - DNA, 3190 bp, Brassica rapa
atgttagggttttaacacaaccattttcgctctcaaatcttctctccactctccttctccccccaagatctgtatttcgatcggatcgaagaaagcttaaacctcgaaaatggcgctggcgttcgacgagttcgggcgtccgttcattatactgagagagcaggatcagaagacgcgtctcagaggcatcgatgctcagaaagccaatatcgccgccggcaaagcggtggctcggatcctccgttcctctctcggacccaagggaatggacaagatgctccagggacctgacggagacgtcaccatcactaacgatggtgcgacgatcttggagcaaatggatgttgacaaccagattgcgaagcttatggttgagctgtcacggagtcaggattatgagattggtgacggcacaacgggtgttgttgtcatggctggtgcgcttctggagcaagctgagcgtcaattggatagagggattcatcctatacgtatcgctgaaggatacgagatggcttctagagtggctgttgagcatcttgagcgtatatctcagaagtttgagtttgatgttaataattacgagcctttggttcaaacatgcatgactactctgtcctcgaagattgtgaaccgatgcaagcgcagtttagctgagattgctgtgaaggcagttcttgctgttgctgatttggagaggagggatgttaacttggatctgatcaaagtagagggcaaagtcggggggaacttggaggacactgagcttatatatggaatactggttgacaaagacatgagtcatccacaaatgccgaagcagattgaagatgcccacattgctattttgacttgccccttcgagccgccgaagccaaagactaagcataaggtggacattgacacagtggagaaatttgagactttgcgcaagcaagagcagcaatacttcgatgagatggttcaaaagtgcaaggatgttggagctacacttgttatttgccaatggggattcgatgatgaggcaaaccatctattaatgcacaggaatttgcctgctgttagatgggtcgggggtgttgaattagaacttatcgcaatagccacaggcggcagaattgttccaagattccaggagttgaccccagagaagttagggaaggctggcatggtccgtgaaaaatcatttggcacaacaaaagagcgaatgctgtatattgagcactgtgcgaactcaaaagctgtcactatattcatccgcggaggtaacaagatgatgatagaagaaacaaagcgtagtatccacgatgctctgtgtgttgcaaggaatctcatccgcaataagtcaattgtatttggaggtggtgcagctgaaatcgcatgctcacttgcggttgatgcagctgctgataaataccctggcgtcgagcagtacgcaataagggcatttgcagaagcgttggactctgtacctatggctcttgcagagaacagtggattacagcccattgagacactctctgcggttaaatctcagcaacttaaggagaacattcctttctatgggatagattgcaatgacgtgggaacaaacgatatgagagagcaaaacgtgtttgaaacattgatcgggaagcagcagcagatattgcttgcaactcaagtcgttaagatgatccttaagatcgacgatgtcatctccaattctgaatactgatgatgtactgccggaacctttgtactatcctttggcctcatgtgtctttttttttgttagctttctattggcttttgacactactcgacaacactgttttgttcccccttggcaagcttttattttaagaacatcaattttgtgttcctgattttggttttatcccactgtttgtttttgacacgtaaacaaacagttttcagaaagatcactgtgaaactgcatatcaagttttcagagaaaatcatccattaggatacggggtgagttgcctatgatctacacaaaatttacagacaatttggaaaaaatactcttcccgatattgtttgtattttctaagattctaaccatatctcagtcagagattcagccaagtctcataattaagagttcgaaccagtgtcgtattagagcaaaacctgtggattaacgtatttagaacatgaactaaacttccatgacttacaaaacccatttgactatttcctaaggtcttcctgcacacgtctaaacagtaaagaccactgtccccgcactcctaagatcttccaactttgttgcatatgggctaaaaggccaaataccgagattcctcctcttgtcttattcaaatctcacttcctctttctttgttcagcttccacctttagtgttaccctcttctattcttcatgagaatggtgttgttctgtatcatggccaacgccatgaatggatggcttcccattcacagcgacagagccatcagctgtttctcccactgctgaaagtttggctctctcattatttcctacagcgacatcagctgtatcagatttatcctcctgttcctgtacgctgcctatattttgatttgacagagctgcttcagctttctgcctagcctcttccttttctcgtcgtctctttgcttcttgctctttaagcagcctaaacctgttgaattacatcgacatgttaaagaacaaataacttctagtaatgaatgagacgcttcagaaatttttagtcacctttcaccaggtttgggcccttctgaggtcactttttcacctcccttctcttttggtactttcagttctgaaacagacttcttaactagcggttctgagatagacttctcaaccttttgagttttatcttccttcatgaccaaattagttagcttctccatcggatttttggcaccaccatatttttgaagccatacttgctgcgctgtgctcaaaatgttattggtcaacctgcaaaatcacacttcaaaagtgagattgagagacaaagtggaaagttgaatccccaccaaaaaacacaaaactagttgctgctcctcaccaatagagacttagacccgaaggaactgatagtgcaaaataaccaatcatcaggggaagaagcttcgtcaccgcttgtgagctcttcattgctggatcattactctgagaaaagacacgatgattataaatgtca

SEQ ID NO: 1972 - DNA, 1823 bp, Brassica napus
atcgccagtgagagagaggaaagcgaagatctgtacttggatcggatcgagaaaagctaagactcgaagatggcgctggcgttcgatgagttcgggcgaccgttcattatactaagggagcaggatcaaaagacgcgtcttagaggcatcgatgctcagaaagccaatatcgccgccggcaaagcggtggctcggatcctccgttcttcactcggacctaaggggatggataagatgctccagggacctgacggagacgtcaccatctcaaacgacggtgcgaccatcttggagcaaatggatgttgacaaccagattgcaaagcttatggtagaactttcgcggagtcaggattatgaaattggtgacggcacaacaggtgttgttgtcatggctggtgcacttctggagcaagctgaacgtcagttagatagaggaattcaccctatccgtattgctgaaggatatgagacggcttctagagtagctgttgaacatttggagcgtatagctcagaagtttgaattcgacgttaataactacgagccattggttcagacatgcatgactactctatcctcgaagattgtgaatcgatgcaagcgcagcttagctgagattgctgtgaaagcagttcttgctgttgctgatttagagagaagggacgttaacttagatttgataaaagttgagggcaaggtcgggggaaagttggaggacactgagcttatatatggaatactggttgacaaagacatgagccatccacagatgccaaagcagattgaagatgcccacattgccattctgacttgcccctttgagccaccgaagcccaagactaagcataaggtggacatcgacacagtggagaagtttgagacattgcgcaagcaagagcagcaatatttcgatgagatggttcaaaagtgcaaggatgttggtgctacactggttatttgccaatggggattcgatgatgaggcaaaccatctgttgatgcacaggaatttacctgctgtcagatgggtcggcggtgttgaattggaacttattgcaatagccacaggcggcagaattgttccaagattccaggagttgaccccagagaagctagggaaggctggcatggtccgtgaaaaatcatttggcacaacaaaagaacgaatgctgtatattgagcactgtgcgaactcaaaagctgtcactattttcatccgtggaggtaacaaaatgatgatagaagaaacgaagcgtagtatccacgacgctctgtgtgtggcaaggaatctcatccgcaataattcaattgtatatggaggtggtgcagctgaaatcacatgctcacttgcagttgatgcagctgctgataaataccctggcgtcgagcagtatgcaataagggcattcgcagaagcattggactctgtccctatggctcttgcggagaacagtggactacagcccattgagacactctctgcggttaaatctcagcaaattaaggagaatattcctttctatgggatagattgcaacgacgtgggaacaaacgatatgagggagcaaaatgtgtttgaaacattgatagggaagcagcagcagatattgctcgcaacacaagtcgttaaaatgattctaaagatcgacgatgtcatctctaattctgaatactgatgatgtactgctgcaacctttgtacttcttcccttttgcctcttttgtttgctttttctattagcttttgatactattcaaccatttttttcctctcttgtaagcttttattttaagatcatcctcatttgtgttcctgattttga

SEQ ID NO: 1973 - DNA, 1859 bp, Raphanus sativus
  misc_feature (161)..(161): n is a, c, g, or t
  misc_feature (703)..(703): n is a, c, g, or t
  misc_feature (953)..(953): n is a, c, g, or t
  misc_feature (1418)..(1418): n is a, c, g, or t
ctctcctctctcagatctgtactccgatcagatcgaggaaagttaaggatctgaaaatggcgttggcgttcgatgagttcgggcgtccgttcatcattctaagggagcaggatcaaaagacgcgcctcagaggcatcgatgctcagaaagccaacatcgcngccgggaaagccgtggctcggatcctccgctcctccctcggacctaagggaatggataagatgcttcagggacctgacggagacgtcaccatctcaaacgatggtgcaaccatcttggagcaaatggatgttgacaaccagattgcgaagcttatggtcgaactgtcccggagtcaggattacgaaattggtgacggcacaacaggtgttgtcgtcatggctggtgcacttctggagcaagctgaacgtcagttagataggggaatccatcctatccgtatcgctgaaggatacgagatggcttctagagtagcagttgaacatttggagcgtatagctcagaagtttgagttcgatgttgataactacgagccgttggttcaaacgtgcatgactactctatcctcaaagattgtgaatcgatgcaagcgcagtttagctgagattgctgtgaaagcagttcttgctgttgctgatttagagagaagggacgttaacttggatttgataaaagtagagggcaaagtcgggggaaatttggnggacactgagcttatatacggaatacttgttgacaaagacatgagccatccacaaatgccaaagcaaattgaagatgctcacattgcaattctgacttgcccctttgagccaccgaagccgaagactaagcataaggtggacattgacacggtggagaagtttgagacattgcgcaagcaagagcagcagtatttcgatgagatggttcaaaagtgcaaggatgttggtgctacactggttatttgccantggggattcgatgatgaggcaaaccatctattgatgcacaggaacttgcctgctgtcagatgggtcggaggtgttgaattagaacttatcgcaatagccacaggcggcagaattgttccaagattccaagagttgaccccagagaagttaggcaaggctggcatggtccgtgaaaaatcatttggcacaacaaaagaacgaatgctgtatatcgagcactgtgcgaactcaaaagctgtcactattttcatccgtggaggtaacaaaatgatgatagaagaaactaagcgtagtatccacgatgctctgtgtgtggcgaggaatctcatccgcaataattcaattgtatatggaggtggtgcagctgaaatcacatgctcacttgctgttgatgcagctgctgataaataccctggcgtcgaacagtacgcaataagggcattcgcagaagctctggactctgtncccatggctcttgcagagaacagtggattacagcccatagagacactctctgcggttaaatctcagcagattaaggagaacattcctttctatgggatagattgcaatgacgtgggaacaaacgatatgagggagcaaaatgtgtttgaaacattgataggaaagcagcagcagatcttgcttgcaactcaagtcgttaagatgattcttaagatcgacgatgtcatctctaattctgaatactgatgatgtactgacatttgcacttctttccttttccctcttttgtttgctttctattagcttttgatactattcatcaattttttcctctcttgtaagcttttattgtaaccttgggcctgtacttgggtttgtgtactttcggtgtttggacttggtatctgtttggaccttgttctttcgtaataatatagacga

SEQ ID NO: 1974 - DNA, 1772 bp, Tabernaemontana elegans
ctttcataataataaaggagcaagagcagaagacgcgattgcgtggcgtcgatgcacagaaagctaacatttccgctggtaaggctgttgctcgtattctccggacctctcttggacctaaaggcatggataagatgctccagagccccgacggcgatgttacaatcacaaatgatggcgcaaccatcttagagcagatggatgttgataatcaaattgctaagctgatggttgaactatcacgaagtcaggattatgaaattggggatggaacaactggtgttgttgttatggctggtgctcttctggaacaggctgagaggttacttgagcgcggcattcatcctattcgaattgctgaaggatatgaagtggcttcaaggatagcttttgaacatctggagcgtatagcacataagtttgaatttgatgcaacaaatgtagaacctttgattcagacttgtatgacaactctatcctccaagattgtgaatagatgcaaacgcagtttggcagaaattgctgtcaaggcagttttagcagttgctgatttagagcgaaaggatgtcaacttggatctaatcaaagtagagggtaaagtaggtggaaagctggaggatacagagttaatatatggaattgttgttgacaaggatatgagtcatccacagatgccaaaggagatacaagatgcaaaaattgccattttgacttgtccctttgagccacctaagccaaagactaagcataaggttgacattgacacggtggaaaaattccaaactttaagacagcaagagcagaagtattttgatgacatggttcaaaaatgcaaggatgttggtgctaccttggtcatctgtcaatggggttttgatgatgaagcaaatcaccttttaatgcatagaaatctgcctgctgttcgatgggttggtggtgtcgagctagagttgatagcaatagccacaggtggaagaattgtgccaaggtttcaagagttgacaccagaaaagctaggcaaagccggtttggttcgagaaaaatcttttggtaccactaaagatcggatgatctacatagagcattgtgcaaattcaagagctgtcactattttcattcgtggcggtaacaagatgatcatagaggaaacaaagcgcagcctccatgatgctttgtgtgtggccaggaaccttatccgcaataattctatagtatatggtggtggttctgctgagatttcttgctcagttgctgtagaggctgctgctgataaatatcctggtgttgagcagtatgccatccgggcatttgcagatgctttggactctatccccatggcacttgctgagaacagtggcctccagcctattgaaactctatcagctgttaaatcccagcaaataaaggagaataatccatgctgtgggattgattgcaatgacgttgggacaaataacatgcgggagcaaaatgtctttgagactttaattgggaagcagcagcaaattttgcttgcaacacaagttgttaagatgatcctcaaaattgatgatgtcatcagcccatcagagtactgattttaggtatatgatgccaagttttaccttggctgcaagtgtacctaaatgaattgttgcctcaagaagtgagctggacacttagttccgactagtcttcgtttcatatgcatctttggtttgtagtgtgattaacaattttgtttccagaacatgcaatgaattagttatgggctcattgacttccaacatttt

SEQ ID NO: 1975 - DNA, 2037 bp, Tripterygium wilfordii
cgccattaggcatctatcgtgcagtagacctctgaatctagttcttcaaaatcgacaaggaagaggagatcggaagtgtaaaagtccggccccggccgaatacgaggaggagggaaaatggctttggctttcgatgagttcggaaggccgttcataataataaaggatcaggagcaaaagacgagattgagaggactcgatgcgcagaaggccaatatttctgcagggaaagcggtggctcgcatcctccgcacttccctaggccccaagggcatggacaagatgctccagagccccgacggcgacgtcactatctcgaatgatggtgcaacaatcttggagcagatggatgttgacaaccaaattgctaagctgatggttgaactatcccgaagtcaggattatgaaattggtgatggtacaactggtgttgttgtattggctggtgggcttctggagcaggctgagcggttattggagcgtgggatacatccaattaggattgcagagggctatgagatggcttctagaatagcctttgaacatttggagcatatatctgagaaatttgaatttgaatcgtcgaatctggagcctttgattcaaacttgcatgactactttgtcttcaaagatggtgaatcgcaacaagcgcagtttggctgagattgcagttaacgcagttgttgctgttgcagatttagagaggagggatgttaatctggatttaatcaaggttgaagggaaagtagggggtaagctggaagatactgagctaatatatggcattgttgtggacaaggatatgagtcatccacagatgccaaagcagattgaagatgcaaaaattgccatcttgacttgtccatttgagccaccaaagccaaagacaaagcataaggtggacattgatacggttgaaaagttccagactctacgtcagcaagagcataagtattttgatgacatggttcagaagtgcaaagatgttggtgctacattggtgatctgtcaatggggatttgatgatgaggccaaccacctgttaatgcatagaaacttacctgctgtccgatgggttggtggtgtggagttagagctgatagccatagccacaggtggaagaattgtgccaaggttccaggagttgaccacagagaaactgggaaaggctggtgtggttcgtgagaagtcctttggtaccacgaaagatagaatgctgtacattgaacattgtgcaaattcaagggctgtgactatatttattcggggaggtaacaaaatgatgatagaagagacaaagcgaagtatccatgacgcactatgtgttgctagaaatctcatacgcaacaagtctattgtatatggtggtgggtcagctgagattgcttgctcaattgccgttgaggctgcctctgataggcatccaggagttgagcagtatgccattagggcatttgcggatgctctggattctgttcccatggcccttgcagaaaatagtggcctccaacctattgagacattatctgctgttaaatctcagcaaatcaaggagaacaacccctactatggaatagattgcaatgatgttggtacaaatgacatgcgtcagcaaaacgtcttcgagactttgatagggaagcaacagcagatcttgttggctacacaggttgtcaagatgatactgaaaatcgatgatgtgatttccccgtctgatttctaaattagtagtctgatgtgcgtcttcacgactattacttgtaggcctgatttgggtgtttggagttgcaacttgaatttgcttttgtgagcattgtttttgcttacggattttggtgtggttgttggacatgtaaaatacgattgctcatcttttgttaaattatcatttcttagtcttctttgctctcggatcaccagtctatgcactcgcaccaggaaaaacctatgcctgcttatttgttattaagaatattaagaaacttgatgactatgtaagaaagtctgtttaggttatcgcagaggacctcggtat

SEQ ID NO: 1976 - DNA, 1694 bp, Ambrosia trifida
acacacacacacagtgtgccgcgatctaactgtgtgaaagaaagaaagagagaaagatctggtttcacacaatggcgttagccttcgacgaatacggtcgccccttcataatactcagggaacaagaaagcaagaccaggttaagaggcatagatgctcagaaagccaacatctctgccggtgttgctgtctctcgtatcctccgtacatctctcggccctaaaggcatggataagatgcttcagagccccgacggcgacatcaccatcacaaatgacggcgcaacgatcttggaacaaatggaagttgacaatcaaattgggaaacttatggttgagctgtcacgtagtcaagattatgaaattggtgatggaacaactggtgtagttgttctggctggtgcacttttagaacaagctgagaagcttttggaacgtggaattcatcccattcgagttgcagaagggtttgagatttcttcaaagatggctgttgaccatttggaaaagatatcacataaatttgatttcagtgcttcaaatatcgaaccattggttcaaacttgcatgactaccttatcctccaaaattgtgaatcgatgcaagcgtagcttggctgagattgctgtcaaaggagtcatggctgttgccgatttagagagaaaagatgttaacctagatttgatcaaagtggagggaaaggttggtggaaagctagaggatacagaacttatttatggaattattgttgataaagatatgagtcacccacaaatgccaaagcaaattgaagatgcaaaaattgctattttgacctgcccatttgagccaccaaagcctaagaccaaacataaggttgacattgatactgttgaaaagtttcaaactttgaggaagcaagaacagcagtactttgatgacatggttcagaaatgcaaggatgtaggggccaccctggtaatctgtcaatggggctttgacgatgaagcaaatcacttattaatgcacagaaacttgccagctgtcagatgggttggtggcgtagaactggagctaatagcaatagctactggtggtaggattgttcccaggttccaggaactaacaactgaaaaactaggaaaggctgggttggttagagaaaaggcatttggtaccacaaaagatcgaatgctttatattgagcattgcgcaaactcaaaggctgtaaccgtttttatcgtggaggtaacaagatgatgatcgaagagacaaaacgcagcatccatgatgcattatgtgttgctagaaatctcattcgtaataactcgattgtgtatggtggcggggctgcagaaatttcatgctcaattgcagttgaagctgctgctgataaatatccaggtgttgaacagtatgccatcagggcgtttgcagacgccttggactctgtacccatggctcttgcagagaatagtggtctgcaaccaatcgaaacactatctgcagtgaaagcacaacaaattaaggaaaacaatcattgctgtggcattgactgcagcgataccggtacaaatgatatgcgtgagcaaaacgtatttgagaccttaattggaaaacaacaacagatcctgcttgccacacaagtcgtggaaatgatatgaagatcgatgatgtcatctccccgtgagagtactgacatcgtagcttctaacc

SEQ ID NO: 1977 - DNA, 1951 bp, Arabidopsis lyrata
gctctcaaatcttccagacattcttcttctcgtttttttccccatttctacttttttttttcctctctagtgtagtaggaaaaaaaaacccaagatctgtagttcgatcagatcgagaagagctcgaaaatggcgctggcgttcgatgagttcgggcgtccgttcattatactaagagagcaagatcaaaagacgcgtcttagaggaatcgatgctcagaaagccaatatcgccgccgggaaagccgtggctcggatccttcgatcttctcttggacccaaaggaatggacaagatgcttcaaggacctgacggagacatcaccatcacaaacgatggtgctaccatcttggagcaaatggatgttgacaaccagattgctaaacttatggtggaactgtcgcggagtcaggattatgaaattggtgatggaacaacaggtgttgttgttatggctggtgcacttctggagcaagctgaacgtcagttagatagaggaattcatcccatccgtattgctgaaggctatgagatggcttctagagtcgctgttgaccatttggagcgtattgctcaaaagtttgaattcgacgttaataatttcgagcccctggttcagacatgcatgactactctctcctctaagattgtgaatcgatgcaagcgtagcttagctgagattgctgttaaagcggttcttgctgttgctgatttagagaggagggatgttaatttagatctgatcaaagtagaagggaaagttgggggaaagttggaggacactgagcttatttatggaatactgattgacaaagacatgagtcatccgcaaatgccaaagcagattgaagatgcccacattgccattttgacttgtccctttgagccaccgaagccgaagactaagcataaggtggacattgacacagtggagaagtttgagacattgcgcaagcaagagcagcaatatttcgatgagatggttcaaaagtgcaaggatgttggtgctacactggttatttgccaatggggatttgatgatgaggcaaaccatctattgatgcacaggaatttgcctgctgtcagatgggtcgggggtgttgaattagaacttattgcaatagccacaggcggtagaattgttccaagattccaggagttgactccagagaagttaggcaaggctggcgtggttcgtgagaaatcatttggcactacaaaagaacgaatgctgtatattgagcactgtgcgaattcgaaagctgtcactgttttcatccgtggaggtaacaaaatgatgatagaagagacgaagcgtagtatccacgatgccctgtgtgtggctaggaatctaatccgcaacaaatcaattgtatatggaggtggtgcagctgaaatcgcttgctcccttgcggttgatgccgctgctgataaataccctggcgttgagcagtatgcaattagggcgtttgcagaagctttggactctgtccctatggctcttgcagagaacagtgggttgcagcccattgagacactctctgcggttaaatctcagcaaattaaggagaatattcccttctatgggatagattgcaatgacgtgggaacaaacgatatgagggagcaaaatgtgtttgaaacattgattgggaaacagcagcaaattttgctagctacgcaagtcgttaagatgattctaaagatcgacgatgtcatctccaattctgaatactgatgtgttgctacctctgtaaactctttggcttcttgggtgttttttagtttgctttctgttagcttttggtaccaccttgacaatcagtatctttcactctttccctttgtttagcaagcttttgtttaagaacatcgtcacatctttatttttgtgtctttgcccacagatgaaaacactcgtttgctttttcttttcaatttggtagcagatg

SEQ ID NO: 1978 - DNA, 1928 bp, Brassica rapa
cactcgaaccactttcacagtcactctcctctcagatcagatcgagggacgttaaggctcgaaaatggcgttggcgttcgacgagttcgggcgtccgttcattatactaagggagcaggatcaaaagacgcgtcttagaggcatcgatgctcagaaagccaatatcgccgccggcaaagcggtggctcggatcctccgctcctctctcggacctaaggggatggataagatgcttcaaggacctgacggagacgtcaccatctcgaacgatggtgcgaccatcttggagcaaatggatgttgacaaccagattgcaaagcttatggtcgaactgtcgcggagtcaggattatgaaattggtgacggcacaacaggtgttgttgtcatggctggtgcacttctggagcaagctgaacgtcagttagatagagggatgcaccctatccgtatcgctgaaggatacgagatggcttctagagtagctgttgagcatctggagcgtatagctcagaagtttgagttcgacgttaataactacgagccgttggttcagacatgcatgactactctttcctcgaagattgtgaatcgatgcaagcgcagtttagctgagattgctgtgaaagcagttcttgctgttgctgatatagagagaagggacgtcaacttagatttgataaaagtagagggcaaagtcgggggaaagttggaggacactgagcttatatatggaatactggttgacaaagacatgagccatccacagatgccaaagcagattgaagatgcccacattgctattttgacttgcccctttgagccaccgaagccgaaaactaagcataaggtggacattgacacagtggagaagtttgagacgttgcgcaagcaagagcagcaatatttcgatgagatggttcaaaagtgcaaggatgttggtgctacactggttatttgccaatggggattcgatgatgaggcaaaccatctattgatgcacaggaatttgcctgctgtcagatgggttgggggtgttgaattagaacttatcgcaattgccacaggcggcagaattgttccaagattccaggagttgactccagagaagttagggaaggctggcatggtccgtgaaaaatcatttggcacaacaaaagaacgaatgctgtatattgagcactgtgcgaactccaaagctgttactattttcatccgtggaggtaacaaaatgatgatagaagaaacgaagcgtagtatccacgacgctctgtgtgtggcaaggaatctcatccgcaataactcaattgtatatggaggtggtgcagctgaaatcacatgctcacttgctgttgatgcagctgctgataaataccctggcgtcgagcagtacgcaataagggcattcgctgaagctttggactctgtccccatggctcttgcagagaacagtggactacagcccatcgagacactctctgcagttaaatctcagcaaattaaggagaatattcctttctatgggatagattgcaacgacgtgggaacaaacgatatgagggagcaaaatgtgtttgaaacattgataggaaagcagcagcagattttgcttgcaactcaagtcgttaagatgattctaaagatcgacgatgtcatctctaattctgaatactgatgaagttctgctgcaatctttgttacttcttccttttgcctcttttgtttgctttctaattagcttttgataacagtttttcctcttgtaagcttttattttaagaatcttctcatttgtgtacctgattttgaatccactttttcgacaatggaccaaacagcatgaaagattctattacaaaattaaaagtcttaacagacgctaaaggcaaaactgttctgaagtcttggaacaatttttctacagtcattac

SEQ ID NO: 1979 - DNA, 1782 bp, Brassica napus
ggacactctccttctcatttcttccccccaagatctgtatttcgataggatcgaagaaagcttaaacctcgaaaatggcgctggcgttcgacgagttcgggcgcccgttcattatactgagagagcaggatcaaaagacgcgtctcagaggcatcgatgctcagaaagccaatatcgccgccggcaaagcggtggctcggatcctccgttcctctctcggacccaagggaatggacaagatgcttcagggacctgacggagacgtcaccatcactaacgatggtgcgacgatcttggagcaaatggatgttgacaaccagattgcgaagcttatggttgagctgtcacggagtcaggattatgagattggtgacggtacaacgggtgttgttgtcatggctggtgcacttcttgagcaagctgagcgtcaattagatagggggattcatcctatccgtatcgctgagggatatgagatggcttctagagtggctgttgagcatcttgagcgtatatctcagaagtttgagttcgatgttaataactacgagcctttggttcaaacatgcatgactactctatcctccaagattgtgaaccgatgcaagcggagattagctgagattgctgtgaaagcagttcttgctgttgctgatttagagaggagggatgttaacttggatctgataaaagtagagggcaaagtcgggggaaacttggaggacactgagcttatttatggaatactggttgacaaagatatgagtcatccacagatgccaaagcaaattgaagatgcccacattgccattttgacttgcccctttgagccaccgaagccgaagactaagcataaggtggacattgacacagtgcagaagtttgagacgttgcgcaagcaagaacagcaatacttcgatgagatggttcaaaagtgcaaggatgttggagctacacttgttatttgccaatggggattcgatgatgaagcgaaccatctattaatgcacaggaatttgcctgctgttagatgggtgggggtgttgaattagaacttatcgcaatagccacaggcggcagaattgttccaagattccaggagttgaccccagagaagttagggaaggctggcatggtccgtgaaaaatcatttggcacaaccaaagaacgaatgctgtatattgagcactgtgcgaactcaaaagctgttactattttcatccgtggaggtaataaaatgatgatagaagaaacaaagcgtagtatccacgatgctctgtgtgtggcaaggaatctcatccgcaataagtcaatcgtatatggaggtggtgcagctgaaatcgcatgctcacttgcagttgatgcagctgctgataaataccctggcgtcgagcagtatgcaataagggcatttgcagaagctttggactccgtacctatggctcttgcagagaacagtggattacagcccattgagacactctcagcggttaaatcccagcaacttaaggagaacattcctttctatgggatagattgcaatgacgtgggaacaaacgatatgagagagcaaaacgtgtttgaaacattgatcgggaagcagcagcagatattgcttgcaactcaagtcgttaagatgatcctaaagatcgacgatgtcatctccaattctgaatattgatgatgtactgccggaacctttgtactatcctttggcctcatgtgtctttttttctttgttagctttctattggcttttgacactactcgacaacaatgttt

SEQ ID NO: 1980 - DNA, 1912 bp, Centaurea maculosa
  misc_feature (291)..(291): n is a, c, g, or t
  misc_feature (344)..(344): n is a, c, g, or t
  misc_feature (347)..(347): n is a, c, g, or t
  misc_feature (867)..(867): n is a, c, g, or t
  misc_feature (880)..(880): n is a, c, g, or t
  misc_feature (922)..(922): n is a, c, g, or t
  misc_feature (937)..(937): n is a, c, g, or t
  misc_feature (940)..(940): n is a, c, g, or t
  misc_feature (958)..(958): n is a, c, g, or t
  misc_feature (1051)..(1051): n is a, c, g, or t
  misc_feature (1081)..(1081): n is a, c, g, or t
  misc_feature (1097)..(1097): n is a, c, g, or t
  misc_feature (1230)..(1230): n is a, c, g, or t
  misc_feature (1272)..(1272): n is a, c, g, or t
  misc_feature (1456)..(1456): n is a, c, g, or t
  misc_feature (1500)..(1500): n is a, c, g, or t
  misc_feature (1503)..(1503): n is a, c, g, or t
  misc_feature (1602)..(1602): n is a, c, g, or t
  misc_feature (1611)..(1611): n is a, c, g, or t
  misc_feature (1676)..(1676): n is a, c, g, or t
  misc_feature (1678)..(1678): n is a, c, g, or t
  misc_feature (1696)..(1696): n is a, c, g, or t
  misc_feature (1718)..(1718): n is a, c, g, or t
  misc_feature (1720)..(1720): n is a, c, g, or t
  misc_feature (1724)..(1724): n is a, c, g, or t
  misc_feature (1743)..(1743): n is a, c, g, or t
  misc_feature (1758)..(1758): n is a, c, g, or t
  misc_feature (1762)..(1762): n is a, c, g, or t
  misc_feature (1768)..(1768): n is a, c, g, or t
  misc_feature (1780)..(1780): n is a, c, g, or t
  misc_feature (1804)..(1805): n is a, c, g, or t
  misc_feature (1822)..(1822): n is a, c, g, or t
tggcgggggagtttttgagggtaattctgagtgaaatggcgttggccttgaatgatatgggaggccggttataatattaagggaacaagagagtaagagcaggttaaggggtttagatgctcacaaatctaacattgccgctggcgttgcggtatctcgtatcctccgtacgtctctcggtcccaaaggcatggacaagatgctccagagccccgacgccgatatcaccatcacaaacgatggtgcaacgatcttggagcagatggacgtcgacaatcaaattggaaaacntatggttgaactttcccagagtcaagactatgagattggtgatggaacgaccngtntagttgttatggccggtgcacttttagaacaagccgagcggctgttggaacgcggaatccatcccatccgtgtagcagaaggattcgagatatcttcaaggattgcagttgatcatttagaacagatctcacataagtttgagttcactgctacaaatatagaacctttggttcaaacttgcatgaccaccttatcctctaaaattgtgaaccgatgcaagcgtagtttggctgagattgctgtaaagggagtcatggccgttgccgatctagagaggaaagatgttaacttagacctcattaaagtagaagggaaagtaggtgggaagttggaggataccgaactcatttacggaatcatagtcgacaaagatatgagtcatcctcagatgccaaagcaaattgaagatgcaaagattgccattttgacttgcccatttgagcccccaaagcctaagaccaagcataaggttgacattgataccgttgagaagttccaaactttacgtgagcaagagangaagtacttcgangagatggttcaaagatgcaaggatgtaggggctacgttggtnatatgccaatggggnttngacgatgaagcaaatcanttattaatgcacagaaacttgcctgctgtcagatgggttggtggtgtggaactggagcttatagcaatagcaactggtggtagaattgttccnaggttccaggaactaacacctgaaaagctnggaaaggctggtttgntcaagagaaggcatttggtaccacaaaagatcgaatgctttatattgagcattgtgcaaattcaagagctgtgaccgtatttattcgtgggggtaacaagatgatgatagaggagacgaaacgcagcatccangatgcactttgtgttgctagaaatctcatccgcaataattcnatcgtatatggtggcggtgcagcggaaatttcatgttcaattgcagtcgaagctgccgccgataaatatcccggagttgaacagtatgccattagggcttttgcggatgctttggattccgtgcccatggctcttgcggagaatagcggtctgcaaccgattgaaacactgtctgcggtgaaancgcagcaaattaaggagaacaatccttgttgtggcatagattgnaangatgccggcacaaacgacatgcgtgagcaaaacgtatttgaaaccttaatcggaaagcaacaacagatcttgctcgctacgcaagtcgttaagatgatnttgaagatngatgacgtgatttcgccttcggattattgatgagttttggcctatgtagaacattgctagaaaancntttttttcttcttcatgnattattgtggttaattgttttntngagnggtcgatcgtttgatgttngtgttttcgtttatntttnagaganaagtgtttatcnacctatgtatgtggtatggaaaannagttctgtaaaaagtgnttggatttgcttatttgtgtaaaatgatcaaaatggataaaggcgaaggagagctttattaaaataagagtaaaaaagtcatttggtttt

SEQ ID NO: 1981 - DNA, 1955 bp, Zostera marina
ggggggttaagaactaggtttgattttgttttatattctccggcgactttcgatcggaggagcttcaatcgttagagatggcgttggcgtttgatgaatatggaagacctttcataatcatcaaggagcaggagcagaagagtcgggttcgagggctcgaagcacagaaagctaacatcaatgctgggaaaactgttgccaggatcctacgtacatcgttaggacccaagggtatggataagatgttacagagccccgatggagaactcaccattacaaatgacggggcgaccattttggagcagatggatgttgacaatcagattgcaaaactaatggttgaattatcccgaagccaggattatgaaattggtgatgggacaactggtgttgttgttttagctggtgcacttcttgaacaggctgagaaattactggagcgtggtattcaccctattcgtgtggcagaaggatatgagatggcatctaggatagccgtggacaatctagagcatattcccaaaagttcgatttcagtgcttcgaatatggagtcattgatacagacttgtatgacaacactttcttcaaaaattgtaaatcgttgcaagcgaagcttagctgaaatagctgtaaaagcagttttagctgttgcagatttggagagaaaagatgtcaatttagatttgatcaaaattgaagggaaagtaggtggaaagctcgaagataccgaattgatccatggaattcttgttgacaaagatatgagtcatccacagatgcctaaacagattgttgatgcaaatattgcaattctgacttgtccatttgaaccacctaagccaaagactaagcataaggttgacatagacactgttgaaaagttccaaaccttacgtgaacaagagcaaaaatactttgatgatatggtccaacagtgcaaggatgttggtgctactctagtcatctgccaatggggttttgatgacgaagcaaaccacttgctgttgcataggaacctacctgctgttagatgggtcggtggtgtagaattggagttgattgcaattgcaacaggtgggagaattgttcccaggtttcaagaattgacaccagaaaaacttggcaaggctggtattgtgagagagaaatcatttggaactactaaagagcgaatgttgtatattgagcaatgtgcaaattcaaaggctgtcacaatattcattcgtggtggtaacaaaatggtgattgaggaaacgaagcgaagtatacatgatgctctttgcgtcgcaaggaatctgattcgtaacaattcgattgtctatggtggtggttcttctgaaatttcttgttcaattgcagtggaagctgcagctgaccgacatccgggggtggagcagtatgccattagatcatttgcagaggctttagagaacatcccaatggctctggcagagaacagtggtctcccatcaattgaaaccattacagcagtgaaatcccagcaaataaaggagaataatccacactgcggcatcgactgcaacgatattggaacgaacgacatgaaggtgcaaaatgtgtttgagactctgattggtaagcaacagcaaatcttgctcgcaacacaggtggtgaagatgatcttgaagattgatgatgtgatttctccatcagagtactgaaccattcacctcaaatcttttctcatttctctagttttccccaaagattttgcttatttgtgttgtagtttgtaatagcagcagaaactactgatagtaactactaactagtaagtagtccaaactctaaattaccacacaaccacacacaccttatccttaatagttatttatttgtgtgtgttttccctgttacgaaataatgtgcttatgtttctagaaacccaacaattattttcatgaatatttaatgtaaaatatagtatcagac

SEQ ID NO: 1982 - DNA, 1990 bp, Arabidopsis thaliana
acactcgaccactttaagctctcaaatcttccagacattcttcttctcgcttttttccccatttcaacttttttttttcctctccagtgcactaggaaacaaaaaaaacccaagatctatagttcgatcggatcgagagaagctcgaaaatggcgctggcgttcgatgagttcgggcgtccgttcattatactgagagagcaagatcaaaagactcgtcttagaggaatcgatgctcagaaagccaatatcgccgctggtaaagccgtggctcggatccttcgatcctctcttggacccaaaggaatggataagatgcttcaaggacctgacggagacatcaccatcacaaacgatggtgctacgatattggagcaaatggatgttgacaaccagattgcgaaactaatggtggaactgtcgcggagtcaggattatgaaattggtgatggaacaacaggtgttgttgttatggctggtgcacttcttgagcaagctgaacgtcagttagatagaggaattcatcccattcgtattgctgaaggatatgagatggcttctagggtggctgttgagcatttggagcgtattgcccaaaagtttgaattcgatgttaataattatgagcctctggttcagacttgcatgactactctgtcctcgaagattgtgaatcgatgcaagcgcagcttagctgagattgctgttaaagcggttcttgctgttgctgatttagagaggagggatgttaacttagatctgatcaaagtagaggggaaagttgggggaaagttggaggacactgagcttatttatggaatactgattgacaaagatatgagtcatccgcaaatgccaaagcagattgaagatgcccacattgccattttgacttgtccctttgagccaccgaagccgaagactaagcataaggtggacattgatacagtggaaaagtttgagacattgcgcaagcaagagcagcaatatttcgatgagatggtacaaaagtgcaaggatgttggtgctacgctggttatttgccaatggggattcgatgatgaggcaaaccatctattgatgcacaggaatttgcctgctgtcagatgggtagggggtgttgaattagaacttatcgcaatagccacaggcggtagaattgttccaagattccaggagttgaccccagagaagttagggaaggctggcgtggttcgtgagaaatcttttggcacaacaaaagaacgaatgctgtatattgagcactgtgcgaactcaaaagctgtcactgttttcatccgtggaggtaacaaaatgatgatagaagagacgaaacgtagtatccacgatgctctgtgtgtggctaggaatctcatccgcaacaaatcaattgtttatggaggtggggcagctgaaatcgcttgctcacttgcggttgatgcagctgctgataaataccctggcgtggagcagtatgcaattagggcgtttgcagaagctttggactctgtccctatggctcttgcagagaacagtggattacagcccattgagacactctctgcggttaaatctcagcaaattaaggagaatattcccttctatggaatagattgcaatgacgtgggaacaaacgatatgagggagcaaaatgtgtttgaaacattgatcgggaaacagcaacaaattttgctagctacgcaagtcgttaagatgattctaaagatcgacgatgtcatctccaattctgaatactgatttgttgctacctttgtcctaacctttggcttcttcggtgttttttgtttgctttctattagcttttgatacccttcgacatcgttatccttgacttgttccctttgttttgcaaccttctatttaagaacatcgtcagatcttaatttttgtgtgtacttgtccacagatcgaagcactcgtttgcattttcttttcgatttagtaactgatgcaggtctcatactgtagac

SEQ ID NO: 1983 - DNA, 2325 bp, Populus trichocarpa
gttagggctttgctttgaaaactgagagagagcggttcttccccccaaacgctactactagtattagtagtttctcatttcactgaatccttctaaaactaatctggaattcagagatggcgttagcgtttgatgaattcgggagacccttcgtaatcataaaagaacaagaccagaaggttcgattgagagggctcgatgctcaaaaggccaacattgcttctggtatggcggtctctcgcatccttcgaacctccctcggtcccaaaggcatggacaaaatgctccagagccccgacggcgatgtcaccatcacaaatgatggtgctacgatattggagcaaatggatgtggacaatcagattgcaaaactgttggttgagctttcgcggagtcaggattatgaaataggggatgggactactggtgttgttgttctggctggtgctcttttagagcaggctcagaagctgttggagcgtggggttcaccccattcgcgttgccgagggttacgagacagcttctagaattgctgttgaacatttggagaagattgcacagaagtttgactttggagttaataatattgagcccttggttaaaacttgcatgactactttgtcttccaagattgtgaatcggtgcaaacgcagtttagcagagatttctgttaaagcagtccttgccgttgcagatttagagaggaaagatgttaatctagatttgataaaggttgaggggaaagtcggaggcaagttggaagatactgaactgatttatgggatacttgttgacaaagaaatgagtcatccgcagatgccaaagcaaattgaagatgcaaaaattgctatcttgacctgcccctttgaaccacctaagccaaagactaaacataaggtggacattgatacagttgaaaagtttcaaactttgcgtaagcaagagcagcagtacttcgataacatggttcagaaatgcaagggtgtaggtgcaaccttggttatctgtcaatgggggtttgatgatgaggcaaatcatttattaatgcacaggaacttgcctgcagtccggtgggttggtggtgtagagttagagctgatagcaatagccacaggtggaagaatagtgccaaggttcgaggagttgacaccagaaaagctaggaaaggctggtttggttcgagaaaaggcttttggcacaacaaaagatagaatgctgtatgttgaacactgtgcaaattcaagggcagtaaccatatttattcgtggaggtaacaaaatgatgattgaggagacaaagcgtagcatccatgatgcattgtgtgtggcaaggaatctcattcgcaacaattctattgtatatggtggtggctcatctgagatttcctgctcaatttctgtggaggccgcagcagatagatatccaggagttgagcagtatgctatcagggcatttgcagatgctttagattccgtccctatgtcgcttgcagaaaatagtggcctccaacccattgagacattatctgctgtgaaatctcaacaaattaaggagaacaatccttactgtggaatagattgcaatgatgctggtacaaatgacatgcgagagcaaaatgtatttgagactcttatcggaaagcagcagcagattttgctagcaacacaagttgtcaaaatgattctaaaaatcgacgatgtcatctccccttctgatttctgatcttcgaagttctgttacatcacactgcttagccatcaaccgaggccatattgttttgatggcctgatgtggcatattgagccgcatggagacactctcagttcacgagagtttgttttggttacagatctatcattggattttagtcgggcttttcttgtgtctgaactggttgattttgtcgcttgttttctttgattactgatattactttataccccccttcttagctgtctctacttgtatactgcatattcattgcaggatcatttgtttcagctcgtttttcttattctttgtttcaaatgattccgactgaatgtatttcttaatgtgacggaactgaaaacattagttgtcaacaagctaatggagtttgtacaaggtagctgctgaggaatgcacgcaccccgttattcagggctgcaagaagcatctgcatttttcaggtaactaaacagggtaattgatgttattatagaatcagtgtggttgtctagtcctgtattttcataaactagagattcgcatgtgacgagcttaagaccaaaaatattgcccctcttatcacttgaatgagcatcactagtaattttaagct

SEQ ID NO: 1984 - DNA, 2164 bp, Populus trichocarpa
gcgtatcatcaagttagggctttgctttgaaaactgagagagagcggttcttccccccaaacgctactactagtattagtagtttctcatttcactgaatccttctaaaactaatctggaattgagagatggcgttagcgttcgatgaattcgggagacccttcgtaatcataaaagaacaagaccagaaggttcgattgagagggctcgatgctcaaaaggccaacattgcttctggtatggcggtctctcgcatccttcgaacctccctcggtcccaaaggcatggacaaaatgctccagagccccgacggcgatgtcaccatcacaaatgatggtgctacgatattggagcaaatggatgtggacaatcagattgcaaaactgttggttgagctttcgcggagtcaggattatgaaataggggatgggactactggtgttgttgttttggctggtgctcttttagagcaggctcagaagctgttggagcgtggggttcaccccattcgcgttgctgagggttacgagacagcttctagaattgctgttgaacatttggagaagattgcacagaagtttgactttggagttaataatattgagcccttggttaaaacttgcatgactactttgtcttccaagattgtgaatcggtgcaaacgcagtttagcagagatttctgttaaagcagtccttgccgttgcagatttagagaggaaagatgttaatctagatttgataaaggttgaggggaaagtcggaggcaagttggaagatactgaactgatttatgggatacttgttgacaaagaaatgagtcatccgcagatgccaaagcaaattgaagatgcaaaaattgctatcttgacctgcccctttgaaccacctaagccaaagactaaacataaggtggacattgatacagttgaaaagtttcaaactttgcgtaagcaagagcagcagtacttcgataacatggttcagaaatgcaagggtgtaggtgcaaccttggttatctgtcaatgggggtttgatgatgaggcaaatcatttattaatgcacaggaacttgcctgcagtccggtgggttggtggtgtagagttagagctgatagcaatagccacaggtggaagaatagtgccaaggttcgaggagttgacaccagaaaagctaggaaaggctggtttggttcgagaaaaggcttttggcacaacaaaagatagaatgctgtatgttgaacactgtgcaaattcaagggcagtaaccatatttattcgtggaggtaacaaaatgatgattgaggagacaaagcgtagcatccatgatgcattgtgtgtggcaaggaatctcattcgcaacaattctattgtatatggtggtggctcatctgagatttcctgctcaatttctgtggaggccgcagcagatagatatccaggagttgagcagtatgctatcagggcatttgcagatgctttagattccgtccctatgtcgcttgcagaaaatagtggcctccaacccattgagacattatctgctgtgaaatctcaacaaattaaggagaacaatccttactgtggaatagattgcaatgatgctggtacaaatgacatgcgagagcaaaatgtatttgagactcttatcggaaagcagcagcagattttgctagcaacacaagttgtcaaaatgattctaaaaatcgacgatgtcatctccccttctgatttctgatctttgaagttctgttacatcacactgcttagccatcaaccgaggccatattgttttgatggcctgatgtggcatattgagccgcatggagacactctcagttcacgagagtttgttttggttacagattttgtatctatcattggattttagtcagggcttttcttgtgtctgaactggttgattttgtcgcttgttttctttgattactgatattactttataccccccttcttagctgtctctacttgtatactgcatattcattgcaggatcatttgtttcagctcgtttttcttattctttgtttcaaatgattccgactgaatgtatttcttaatgtgacggaactgaaaacattagttgtcaacaagctaatggagtttgtacaaggtagctgctgaggaatgcacgcaccccgttattca

SEQ ID NO: 1985 - DNA, 1955 bp, Sequoia sempervirens
agaagcttcacaggcaggattgggacatctagggtttcgtctttgctcgtctacagtttaaatctcattcctgaaacgatctctttgatatccacgccaagatatggcgttggcatttgacgagttcgggagaccatttataatattgagggagcaggagcagaagagccgagtgaaggggctcgatgcgcagaaggctaacattgcggccgcgagggccgttgcaaggatccttcgcacttccctcggccccaagggcatggataagatgcttaccagccccgatggcgaagtcaccatctcaaatgatggtgcaacaattttggagcagatggatgtagagaatcaaattggcaaactgatggtagaattatctcggagtcaggattatgaaattggtgatggaacaactggtgtggtcgtcacagcaggtgcactattggagcaggcagagcaacttttagaacgaggaattcatcccataagaattgctgagggttatgaaatggcctcaaagatttcagtcgaccatttagatcgtattgctcaaaagtttgagtttagtttgaacaatgtggaacctcttgtgcagacatgcatgaccacactctcttcaaagattgttaacagatgcaaacgcatgctagctgagattgctgtcaaagcagtacttgctgttgcagatttagaaagaaaggatgttaacttggatttgattaaagttgaaggtaaagttggtgggaggttggaagatacagagctggttgaaggcattgtgattgacaaagatatgagtcatccacaaatgcctaaaagaatcgaggatgcaaagatagctatcttgacatgtccttttgagccaccaaagccaaagacaaagcataaggttgacattgatacagttgagaagtttgaagctttacgtgggcaggaaagacaatactttgatgaaatggttcagaggtgtaaggatgtaggtgcaactcttgtcatctgtcaatggggttttgatgatgaggcaaatcatttgctgatgcaccggggcttgccagcagtgcgatgggttggtggagtggaactggagttgattgcaattgcaacaggtgggcgaattgttccaaggtttcaggaattgacatcggataagttaggcaaggctggactggtgagagagaaggcctttggaacaactaaggatcgaatgctatacatagaacactgtgcaaattcaaaagctgttactgtttttattcgtggcggaaacaagatgatgattgaggaaacaaagcggagtcttcatgatgcgctttgtgtagcccgcaacttgattcgtaacaactccatcgtgtatggtggtggatcagctgaaatttcatgttcccttgctgtagaagctgctgctgataagattccaggagttgaacaatatgcagttcgggcatttgcagatgcccttgatgctgtacctatggctcttgcagaaaatagtggattgcaacccattgatactttgacggcagtgaaagctcaacagatcagggaaaataaccctcacttgggaatagattgtaatgatattggtacaaatgatatgatggagcaaaatgtatttgaaactctaattggcaagaaacaacagattttacttgcgacacaggtcgtgaagatgatcttgaaaattgatgatgtgatctcaccatcaggatattagatttattttcctcacagcatatgtggttgtgtaaacacctatgttggtgaatttaagaggaaaccaggcatttttggatactgaagcatatttgtgatgaactgcacgcacctgtgctgaatgcttgtattgtgtgagcacatgtaaatttgaggatatttacagcgcaagattggcaatgatattgccctgaattgcataagaattttcagattcattttgaaatagtataaacacaagttat

SEQ ID NO: 1986 - DNA, 2002 bp, Eutrema parvulum
agcgagttagggttttacactcaactatattcgctctcaaagcttcgagacactctccttctcgtttttttttcccatttcaactttttttttctgtaagaaaccaagatctgtacttcgatcggatccaggaaagtttaaagctccgaaaatggcgcttgcgttcgatgagttcgggcgtccgttcattatactgagggagcaggatcagaagacgcgtcttagaggcatcgatgctcagaaagccaatatcgccgctggaaaggcggtggctcggatcctccgttcttctctcggacccaaggggatggacaagatgcttcagggacctgatggagacgtcaccatcacaaacgatggtgcaactatcttggagcaaatggatgttgacaaccagatagcaaaacttatggtcgaactgtctcggagtcaggattatgaaattggtgatggcacaacaggtgttgttgtcatggctggtgcgcttctggagcaagctgaacgtcaactagataggggaattcatcctatccgtatcgctgaggggtatgagatggcttctcgagtggcagttgagcatctggagcgtatagctcaaaagtttgagttcgacgttaataatttcgagccactggttcaaacatgcatgactactctgtcctcgaagattgtgaatagatgcaagcgcactttagctgagattgctgtaaaagcagttcttgctgttgctgatttagagaggagggatgttaacttagatctgatcaaagtagagggcaaagtcgggggaaatctggaggacactgaacttatatatggaatactgattgataaagacatgagtcatccacaaatgccaaaacaaattgaagatgcccacattgccattttgacttgcccctttgagccaccgaagccgaagactaagcataaggtggacattgacacagtggagaagtttgagacactgcgcaagcaagagcagcaatattttgatgagatggttcaaaagtgcaaggatgttggtgctacactagttatttgccaatggggattcgatgacgaggcaaaccatcttttgatgcacaggaatttgcctgctgtcagatgggtcgggggtgttgaattagaacttatcgcaatagccacaggcggtagaattgttccaagattccaggagttgaccccagagaagttaggaaaggctggcgtggtccgtgaaaaatcatttggcacaacaaaagaacgcatgctttatattgagcactgtgcgaactcaaaagccgtcactgtattcatccgtggaggtaacaaaatgatgatagaagaaacgaagcgtagtatccacgatgctctgtgtgtggcaaggaatcttatccgcaataagtcaattgtatatggaggtggtgcagctgaaattgcatgctcacttgcggttgatgcagctgctgataaataccctggcgtcgagcagtatgcaataagggcattcgcagaagctttggactctgtccctatggctcttgcagagaacagtgggttacagcccattgagacactctctgcggttaaatctcagcaactcaaggagaatattcctttctatgggatagattgcaatgacgtgggaacaaacgatatgagggagcaaaatgtgtttgaaacattgatagggaagcagcagcagattttgcttgcaactcaagtcgtgaagatgattctaaagatcgacgatgtcatctctaattctgaatactgatgatgtacttctgcaatctttgactacccttggcctcttgtgtgtcttttttgtttgctttctatttagcttttgatactattcaacaacatttttcccctcttgcaagcttttattttaagaacatcctcattttgtgttcctgacttcgttttcatcccactttgtgttttttcgacactgaactaaacagaattttaaaacaatgtttttaactatttattgagtttgcagagaaaatca

SEQ ID NO: 1987 - DNA, 2344 bp, Cephalotaxus harringtonia
tagtagcacacttactcgaaagagagcgggagcactagaagctagaaaagaagcctcacaggcggagatctagggttttcacctgcggaggtccactgttcgaatctcgctgttgaaatcatctctttcataaccacgccaagatatggcgttggcgtttgatgagtttggtagaccgtttataatattgagggagcaggagcagaagagccgagtgaaggggctagatgcgcagaaggccaacattgcggcggcgaaggccgttgcgaggatcattcgcacctccctcgggcccaagggcatggacaagatgcttaccagccccgacggcgatgtcactatttctaatgatggtgcaacaatcttggagcagatggacgtagagaatcaaattggaaaactgatggtagaattgtcacggagtcaggattatgaaattggggatgggacaacaggtgtggttgttacagcaggtgcacttttggagcaggcagagcaacttttagaacggggaattcatcccataaggattgctgagggttatgaaatggcttcaaaggttgcagtggaacatttgggtcatattgctcaaaagtacgagtttagtctcaacaacgtagaatctctagtgcagacatgcatgaccacactctcttcaaagattgttaacagatgcaaacgcatgctagctgagattgctgttaaagctgtgcttgctgttgcagatttagaaagaaaggatgttaacctggatttgattaaagttgaaggaaaagttggtggaaagctggaagatacagagctggtgcaaggtattgttattgacaaagatatgagtcatccacaaatgcctaagagaattgaggatgcaaagatagctattctgacatgtccttttgagccaccaaagccaaagacaaagcataaggttgacattgatacagttgagaagtttgaagctttacgtgggcaggaaagacaatattttgatgaaatggttcagaggtgcaaggatgtaggtgcaactcttgtaatctgtcaatggggttttgatgatgaggccaatcatttactgatgcaccgtggcttgccagcagtgcgatgggtgggcggagtggaactggagctgattgcaattgcaacaggtgggcgaatagttccaaggtttcaggaattgacgccagataagttaggcaaggctggacttgtgagagagaaagcgtttggaacaactaaagatcgaatgctatacatagagcactgtgcaaattcaaaagcagttacagtttttattcgtggtggaaacaagatgatgattgaggagacaaagcgaagccttcatgatgcactttgcgtagcccgcaacttgattcgcgacaactcaattgtgtatggtggtggttcagctgaaatttcatgttcccttgccgtagaagctgctgctgacaagattccaggagttgaacaatatgcagttcgggcatttgcagatgctcttgatgctgtaccaatggcgcttgcagaaaatagtggactccaacccatagatactttgacagcagtgaaagctcaacagatcaaggaaaataacccctacttgggaatagattgtaatgatattggtacaaacgacatgatggagcaaaatgtttttgaaacactcattgggaagaaacagcagattttacttgcgacacaggttgtcaagatgatattgaaaattgacgacgtgatctcaccatctgcgttttaaatcatttttcccacagcatgggtgtgcaacacccttgttggtgaagttcagggaaacttaggatttttggatactgtgaatcatattcatgatgaattgcacctttgctgaatgcatgtaatgtgtgagcacatgtaaatttgagaatcttttacagcgtaagagttgaatgatgaacctcagtgcattaaaattttcagatttcattttgatatggcataatcattagtaggagctgctccatcatatagtgaatggcaaacgtttatatttagattttaccatcataagaaatatttcagaggtttgaaccttacagggacattgttggtgttcttggtacaacaatattaactccacctgcaattgtgtgagatgttgagagtagccagtagtttacaggtcaaaatgatttttgaggggctagttccaaatttgcctcttgtagtagaggctttactttttttattacatttccttatttcaaatttaaggtcaaaccatgtttcagcctcgggttgacgagattatccaggaggttgcagcttgtgtcttgtccacaatgacttggttgggtttatttcaaattgt

SEQ ID NO: 1988 - DNA, 1824 bp, Aquilegia formosa
gtgcgattacatcgaaaacaatggctttggcgttcgatgagtacggacgttcttttattataataagagagcaagagcaaaaaagcagattgagaggtttagatgctcagaaaagcaacattgctgctggtaaaactcttgctcgaattcttagaacttctcttggtcctaaaggcatggacaagatgcttcaaagtccagatggcgatgtaaccatctcaaatgatggtgcaacaatcttggatcagatggatgttgacaatcatattgcaaaattgatggttgaattgtctcgtagtcaagactatgaaattggtgatggtacaactggagttgttgtcttggctggtgcgcttctggagcaggctgagagactattagagcgaggtgtacatccgattcgagtaggcgaaggttatgagatggcttcgaagatagctgttgatcatttggagcatatcgctctgaagtttgaatttgatgccgcaaacactgagcctttggttcagacttgcatgacgacattgtcttctaagattgtgaatcgttgcaagcgcatgttagctgagattgctgttaaagcagttgtggcagttgcagacttagagaggagggatgtcaacttagatttgattaaagtggagggtaaagtagggggaaagttggaagataccgaacttatcaatggaattattcttgacaaagatatgagccatccccagatgccaaagcaaattcaaaatgccaaaattgccatcttgacttgcccatttgagcccccaaagcctaagactaagcataaggttgacattgacagtgttgagaagtttcaaactttgcgtttacaggagcagaaatactttgatgatatggtccaaaagtgcaaggatgctggggcaactcttgtgatctgtcaatggggttttgatgatgaagcaaaccatttgttaatgcacaggaacttgccagctgtccggtgggttggaggagtagaactggaactgattgcaattgccacaggaggaaggattgtgccaaggttccaagaattgacaacggaaaaattagggaaggctggactagttagggaaaagtcatttggaacaacaaaagaaaggatgttgtacattgaggaatgtgctaattcaagggctgtaacaatttttattcgtggaggtaacaaaatgataatagaggaaacaaagcgcagtgtccacgatgctctctgtgtggccaggaatctaatccgtaacaactctattgtgtatggtggcgggtcggctgaaatatcttgctcaatcgctgtagaagcagctgctgataaatatcctggagtcgagcagtatgctataagggcctttgcagatgctctggaatctgtccctatggcacttgcggagaacagtggactgcaacccattgaaacagtttctgcagttaaatctcaacaagtcaaggaaaacaactcttactgtggaattgactgtaatgatgttgggacaaatgacatgcgcaagcaaaatgtgttcgaaactctgattgggaagcaacagcaactcttactggctacacaggtggttaagatgattctcaaaatcgatgacatcatcagcccctcagagtattgatcaagcagtgttggaagtaagggtattgtgggttttaggtgtgtagtttagtcccacatagcttagatataaagtctatgtggttcctctctctatatatagagagagttagcttctttgtaagtaaaaaccttatttccgctatttttctgcgtcttgtgctactgttttttctgaggactgttcacgagtagta

SEQ ID NO: 1989 - DNA, 1982 bp, Podocarpus macrophillus
aagaaatacagcttgagcatcacaggggagagatctagggtttaagatatcggctctgatcgtgggttcgaacctctggactgcattatcaacagccttctaaagacgccaagtaatggcgttggcatttgatgagtacggtaggccttttataataataaaggagcaggagcagaaaacccgagtaagggggttagatgctcagaaggccaatattgcggccgccaaggctgttgcaaggatcattcgcacgtctctcggtcccaagggcatggacaagatgctcaagagtccagatggagatgttaccatctcaaatgatggtgcaacaatcttggagcagatggatgtggagaatcaaattgggaaattgatggtagaattatcacggagccaggattatgaaattggtgatgggacaactggtgtagtagttacagcaggtgcactcttggagcaggcagagcaacttttggatcggggaattcatcccataagaattgcagagggttacgaaatggcttcaaagattgcagtagaacatttgggtaatattgctcaaaagtttgagtttggccttaacaatgtggagtctcttgtgcagacatgcatgaccacactctcttcaaagattgttaatagatgcaagcgtatgttagccgaaattgctgtcaaagcagtgcttgccgtggcggacttggagagaaaggatgtgaacttggaattgatcaaagttgaaggaaaagtaggtggaaagctggaagatacagagttggtttatggtattgttattgacaaagatatgagccatccacaaatgcctaagagaattgaggatgcaaaaatagctattctgacttgcccttttgaaccacccaagccaaagacaaagcataaggttgacatcgatacagttgaaaagttcgaagctttgcgtgatcaagaaaagaaatactttgatgacatggttcagatatgcaaggatgttggtgcaactcttgtaatctgtcagtggggctttgatgatgaggccaatcatttactgatgcatcgtggcttgccagcggtacgatgggttggtggggtggaactggagttgattgcaattgcaacaggtggacgaatagttccaaggtttcaggaattgactcctgataaattagggaaggctggaattgtgagagaaaaaggatttggcacaactaaggatcggatgctttacatagaacaatgtgcaaattcaaaagcagttacagtttttattcgaggaggaaacaagatgatgattgaggagacaaaacgtagtcttcatgatgcactttgtgtagcccgtaacttgattcgtgacaattcaatcgtgtatgggggtggttcggcagaaatttcatgttcacttgctgtagaagctgctgctgacaagattccaggagttgaacagtatgcaatccgtgcatttgcagatgctcttgatgctgtaccaattgctcttgcagaaaacagtggacttcaaccaattgatactttgacagcagtcaaagctcaacagatcaaggaaaataatcctcatttgggaatcgattgcaatgatgttggcactaatgacatgatggaacaaaatgtgtttgaaactctaattgggaagaaacaacagatcctacttgctacacaggttgtcaaaatgattctaaaaattgatgatgtgatttcagcagctgggttttaaagtatatttgctaaattcggttgttgttgtaaaacacctattatttaagtgaagctcaggttttttgatcttctgaagcatattcaagatgggaaaattgatgagaaagcaactatgctgaatttgttgtgtttgagcatatgtttgattttgtatggtgcaagtcttcttgtgacgcaccaggaagcatgtaaaatttcagagcttgttttcaaaccattgagtgaactggtattttacattgaatctttagcacctt

SEQ ID NO: 1990 - DNA, 2062 bp, Sciadopitys verticillata
cgggtcccactttgagaaggcgggagcataaaacttgaagtgaagaaaagatcaaaggcattgcagagttctagggtttaatcaacactggttgcgggttcgaaactcgctactgtatcaccaatctgctgacaacgccaccgtttgtaaatggcgttggcatttgatgagtacgggaggccgtttataataataagggatcaggagaataagagtagagtgagaggtttagatgcacagaagactaacattgcggcggccaaggccgttgcgagaatcattcgcacctccctcggtcccaagggcatggacaagatgctcaccagtcccgatggcgatgtcaccatttcaaatgatggagcaacaatcttggagcagatggatgtagagaatcaaattgggaaactgatggtagaattatcacgaagtcaggattatgagattggggatgggacaacaggtgttgttgttactgcaggtgcacttttggagcaggcagagcagcttttagaaaagggaattcatcccataagaattgctgagggttatgaaatggcttcaaagattgcagttgaacatttggaacgtattgctcaaaagtttgagtttagtttgaacaatgtggagcctcttgtgcagacatgcatgaccacgctctcctcaaagatagtcaatagatgcaaacgcatgctagctgagattgctgtcaacgcagttcttgctgttgcagatttggaaagaaaggatgtcaacctggatttgattaaagttgaaggaaaagttggtggaaggctggaagatactgagctggttgctggtattgttgttgacaaagacatgagtcatccacaaatgcctaagaggattgaagatgcaaaaatagctattttgacttgtccttttgagccaccaaagccaaagacaaagcataaggttgatattgatacggtggagaaatttgaggctttacgtgatcaggaaaggcactacttcgatgaaatggttcagaggtgcaaggatgtaggtgcaactcttgtaatctgtcaatggggttttgatgatgaggccaaccatttgctgatgcaccgtggcctgccagcagtgcgttgggttggtggagtggaattggagttgattgcaattgcaacaggtgggagaatagttccaaggtttcaagaattgacaccggataagttgggcaaggctggaattgtgagagagaaggggtttggcacaactaaggatcggatgctctacatagaacaatgtgcaaattcaaaagcagttacagtttttattcgtggtggaaacaagatgatgatcgaggagacaaagcgaagccttcatgatgcactatgtgtagctcgtaacttgattcgtaacaattcaattgtttatggtggtggttctgctgaaatttcctgttcactagcggtagaagcggctgctgacacgattccaggagtggaacaatatgcagttcgggcatttgcagatgctcttgatgctgtaccaatggcccttgcagaaaatagtggactccaacccattgatactttgacagctgtgaaggctcaacagataaaggaaaataatcctcatttgggaatagattgcaatgatactggtacaaatgacatgatggagcaaaatgtatttgaaactctaattgggaagaaacagcagattttacttgcgacacaggtggtcaagatgatcttgaaaattgatgatgtgatctcgccttctcggtttgcttaaatttctccctctagtgttggtgttgatttaacaacacttgtgctggtgaatttgatattgtcaagcatattcacgactctttgcacctattctgaatggttgttttgtgtacatgtaaatttgaggaattcttacagttttgcgatcatgcaccttgaagttacacatacaaaattttctgagcttttaccattagaattaccattttaaatatttgaaagtttcaaggatattgctgatgtacaacccatagttgtgcggggttatgaaacttgtctcagcttgcattatgtccaaaatg

SEQ ID NO: 1991 - DNA, 1851 bp, Hordeum vulgare
cctcgcgccgcctcctcctcccccagtggtgcgatccgacccttctagaagcgccgcgcgcgcgtcccgtgcatcggcagcggcggccatggcgctggcgttcgacgattttggacggcccttcgtcatcctgagggagcaggagagcaagtcccgcctgcgggggctcgacgcgcacaaggccaacgtcgccgccggcaaggccgtcgcgcgcagcctccgcacctccctcggccccaagggcatggacaagattctccagtcacccgacggcgacgtcaccatcacaaatgacggagcgacgatcctggagcaaatcgatgttaataaccagattgcaaagctgatggtggagctttcacgaagtcaagattatgaaattggggatggtactaccggggtggtggactggtggtcctggccgggtcgctcctggaacaagctgagaaactgctagagcgtcgtattcacccaataagaattgccgaaggatatgagatggcctccaagatagcttttgatcaccttgaacgtatctccactaggtttgagttcactgctgcacatatagagcccttggtgcagacctgcgtgacaactctgtcctcaaagattgttaaccgttgtaagcggttgcttgctgagattgctgtcagggcagtccttgctgttgctgatttggaaaggaaggatgtaaacttggacttgattaaagtagaaggtaaagttggtgggaagctagaggacactgagctaatatatggaattgctgttgacaaagatatgagccacccacaaatgccaaagagaatcgaggatgctaatattgccatccttacctgcccatttgagcccccaaagcccaagacaaagcataaggttgacattgacactagaaaaattccagacgttgcgtgggcaagagcagaaatacttcgatgaaatggttcagaaatgcaaggatgttggtgcaactttagttatctgtcaatggggttttgatgatgaagccaatcatttgcttatgcaaagaaacctgcctgctgtcagatgggttggtggtgttgaattggaattgattgccatagctacaggggggcgcattgttccaagattccaagagttgactcctgataagcttgggcaggctggattagttagagagaagtcatttggaacaacaaaggaccgaatgctttacattgagaggtgtgcaaattccagagctgtaactatcttcatccggggcggcaacaaaatgataattgaggaggccaagagaagtattcacgacactctctgtgtggctagaaatctgatccacaataactctattgtttatggtggcggctcagctgagatatcttgctcaattgctgttgaagctgctgcagatcgatatgctggagccgagcagtatgcaatcaggtcgtttgctgatgtgttggatgggattccactagccttggctgaaaacagtggtttgccacctattgatacgttgactgcagtaaaatctcagcaaattcaggagaccaatccctactgtggcatcgactgcaatgatgtcgggtccaacgatatgagagtacagaacgtctttgagactctgattggcaagcaacaacagatattgttggcgacgcaggttgtgaagatgattctcaagatcgacgacgttatcatgctgtcagagttctgaacagtgatgatgttgcaagcatgggcaaccgtgttggataacaagccatcattgtaccatgcagcattgctgaagcagttggattggccacttgcttgtaccttaggcctgtattttgcttgtgacgcttgctgaagaccttggtttcc

SEQ ID NO: 1992 - DNA, 1948 bp, Pteridium aquilinum
tgcgtgtatgtgtgtgtgcgcgcgcgcgcgcgagcgagacaacacagacagtgagagacacagagatcagcgatggcgctcgcctttgatgagtatgggaggcccttcattatcataagggagcaggagcagaagtcgcgggtgcgcggcttggacgcccagaaggccaatatttcggctgcaaaggctgttgccagaattctccgcacctctctcggccctaagggcatggacaaaatgctgcagagccctgatggcgatgtcaccataacaaacgatggagctacaattttggagcaaatggatgtggataatcaaataggaaagctaatggtggaactatcaaggagtcaagattatgagataggcgatggacaacaggagtggtggtaaccgctggtgcattgcttgagcaggcagagctttttttagacagaggtgtacaccctatccgaattgcagaaggctatgagatggcttcgaagctggctgttgatcatctttccaatattgctcagaagtttgagttcagttcttcacacattgaacctctagttcagacatgtatgactacgctatcctcaaaaatagttaatcgttgtaagcgcaagcttgctgaaattgcagtgaaagctgtgttagctgtagctgatcttgagagaaaagatgtaaaccttgatcttatcaaagttgaaggcaaggtcggaggcaagcttgaggatacagaacttgtggaagggattattgtggacaaggacatgagtcatcctcaaatgccaaagaggattgaaaatgcgaagatagccattttgacctgtccttttgaacctccaaagcccaagactaagcacaaagttgacatcgatacagttgaaaaatttgaatctctaagggaacaagagacgaagtattttgatgacatggttcagctgtgtaaggatgctggtgccacattggtcatctgccaatggggatttgatgatgaggcaaatcatctgctgatgaatcgtggcttgccagctgttcgttgggtgggaggcgttgagctagaacttattgctattgctacagggggccgcattgttccaaggtttcaggagctcacttcagaaaagcttggtaaggctggattggtgagggagaaatcttttggaacaactaaggatcgaatgctgtacattgaacattgtgccaattctagagcagtgacaattttcatcagaggaggcaataaaatgatcatagaggagacaaaaagaagtattcatgatgctttgtgcgttgcccggaatttgattcgcaataatgcaattgtctacggaggaggatctgctgaaatatcatgctctctggtgattgatgcagctgctgacaaaatacctggggtggagcagtacgcgatgcgagcctttgcagaggcattggatgcagttccaatggcacttgctgaaaatagtggcctgcaaccaattgatacactggcagttgtcaagtcgcagcaagtcaaggaaagaaaccctcatctgggaattgattgcaacaatgtcggaaccaatgatatgaaggaacagaacgtgtttgagactttgattggaaagcagcagcagatattgcttgctactcaggttgtgaagatgatcttaaaaatcgatgatgttataacaccttctgctttttaagatagtaaaggcaaatgtgtggaagctcgtggagatttcaaatacgtcaagtgttgtcgctagagcaccttgtgagttttagagagctctcaaaaaaagcagttttatacacagtccgagcccgagggtaaatccttctctccgacgttttcctgtgtaaaagcactgctatgtgtttagaattttccagcatgtacgagcagtgttgtgacggaaaataatataattatcaaggcacaccattggtcccagatatttgaggaaaaaga

SEQ ID NO: 1993 - DNA, 1933 bp, Beta vulgaris
ctcgcaccttctataaacaccctctctagactctttctctctctcctaccttaacttcatcgccattgttgcaccttcttcttcttcctctgcaactgatctagctcgccaacaacaatggcgttggcgttcgatgaatatggacgccccttcattatactccgggagcaagaatccatgactcgtttgcgaggtttagaggctcaaaaggctaacatttccgctggtaaagccgtcgctcgtatccttcgttcttctcttggccctaaaggcatggacaagatgctccaatctcccgacggtgacatcactatcacaaatgatggtgccactatcctggatcagatggatgttgacaaccaaattgcaaaattgatggttgaattgtctcgtagtcaggattatgaaattggcgatggtactactggagtagttgtcatggctggttcccttctggagcaggctgaaaacctcttagaccgtggcattcatcctattagaatagcagaaggatatgaagtagcttcacggatggccgttgaacatttggagaagatcgcacataagtttgaatttggagaagcaaatgtagagcctttgatccagacatgcatgactactttgtcatctaagattgtaaatcgttgtaagcgcactttagctgagattgcggttaaagcggttctggctgttgcagacttggaacggaaggatgttaatcttgatttaattaaagtggagggcaaagtgggaggaagactggaagatactgaactcatctatggaattgtggttgacaaggacatgagccacccccagatgccaaagaaaattgaagatgccaacatagctatattaacatgcccctttgagccacctaagccaaaaaccaaacataaggttgagattgacactgtggagaagtttgagactttgcgtaaacaagagcaacaatactttgatgacatggttaaacagtgtaaggatgttggtgcaaccttggttatttgccagtggggatttgatgatgaggcaaatcatctgctaatgcataggaatttgcctgctgttagatgggttggtggtgttgagttggagttgattgcaattgccacaggtgggagaattgttccaaggttccaagaactgacccctgaaaagctgggacgggctggattggttcgtgagaaagcttttggtacaacaaaagatcgaatgctttacattgaacattgtgccaattccagggctgttaccatatttattcgtggtggtaacaaaatgatgattgaagagacaaaaaggagcatccacgatgcactttgcgttgcaagaaatcttatccgcaacaattctattgtttatggtggtggctctgctgaaattgcttgctctcttgctgtagaggcaggtgctgatcgattccctggagttgagcagtatgccatcagggcctttgctgaagctctggatgccattcccatggcacttgcagagaacagtggtcttcagcctattgaaacactgtctgcagtgaaacaccagcaagttaaggagaacaacacttgctgtggcatagattgtagtgacgtcggcacaaacgatatgcgtgagcagtttgtattcgagactttgatcggcaagcagcagcaaatattgctcgccacccaggttgtgaagatgattctgaagatagacgatgtcatcaccccatcagaattttgatagatggtccttttagggttatgtcgtgcaagcccctctcctaataaccgagaacagatgccatttagttgggtctttgcacttgtggtgtgaaatgaaactttgtttcccctaaattttgcaacggtgaagctttttactgaggctgcacagtttgactgttctttctgattaatatagatgtttgattttgtggtcttttctgaga

SEQ ID NO: 1994 - DNA, 2090 bp, Gnetum gnemon
gctttcccattgccatggtcgagagaattccagcaaacatttgaataacttgaactccgaggcgaggaaccctacttacgacgagcgtcattcctgcgcgcagcagagactcgagcttttaaatcgcaatcgcttcatcgacctcacattcggccaaacacatactgaatccaagacccccgcgcgcagcgagcgagcaagcaagcaggaaggtgctgctgatagaaccttggattagggttttagctgcagcgtgagagagaaagaagttgcgttggcagtgccatttgcaggaggagtgcagaaatggcgctggcatttgacgagttcgggaggccatttattatagtgcgagaacaagagcagaaagcgcgcgtgaagggcctcgatgcgcagaaggccaacatagcggccgccaaggccgtcgccaggattctgcgtacctctctcggccccaagggcatggacaagatgcttcagagccccgatggcgacgtcaccatctcgaatgatggagcgacgattctggagcagatggaggtggagaaccagatcggcaagctgatggtggaactgtcgcggagccaggattatgagatcggtgatggcactacaggagtggttgtcactgcgggctctctgcttgaacaggcagagcagcttttggatcgcggaatccatcccattaggatcgccgaaggttatgaaatagcctctaagattgctgtggatcatctcgatcgcatagcacacaagtttgaattcaacttgaacaacgttgaacctcttattcagacctgcatgaccactctgtcatccaaaatagtgaatagatgtaaaaggatgcttgctgaaattgctgtcaaagcagtgctggccgttgcagatttagagagaaaagatgtgaacttggatttaattaaagttgaaggcaaggtcggcggaaagctagaagataccgagttggtttatggcattgttgtagacaaggacatgagccatccgcagatgcccaaaaaattgagaatgcgaaaattgctatcttgacgtgcccgtttgagcccccgaagccaaaaacaaagcataaggttgacattgacactgttgagaaattcgaagcgctgcgacagcaagagaagcagtacttcgatgacatggttcaaaagtgcaaggatgttggtgcaacgttagtaatctgtcagtggggctttgacgatgaggccaatcatttattgatgcaccgtggtttgccagcagttcgctgggttggtggtgttgaactggagctaattgcaattgcaactggtggccgaattgtaccaagatttcaggaactgacacctgagaagttgggaaaggctggattagtaagagagaagtcctttggtacaaccaaagatcgaatgatttatatagagcaatgtgcaaattcaagggcagtgactattttcatacgtggtggaaataagatggtgatagaagagacaaaaagaagtctccatgatgctctctgtgtggcacggaatttaattcgcgataattcaattgtgtttggtggaggtgctgcagaaatatcagcttcacttgcagttgaagctgctgctgacaaaataccaggagttgagcaatatgcaatcagggcatttgcggatgctttagatgctataccaatggcacttgctgagaacagtggtctacaacccattgatacattgacagcagttaaatctcaacagataaaggaaaacaacccacatttgggtattgattgtaacgatgttggcacaaatgatatgaaggaacaaaatgtgtttgaaacacttattggaaagaaacagcagttgctgcttgctacccaggttgtgaagatgattttgaagattgatgatgtcataacacctacttcttattagtgtctggccaatgtggagaacatagttttatcagccgttggctatatgccatcttatgttggttttaaaataggaacagaagtatcaacaattttgttttctgttcccaggtgtatctgatatcagtgccagttttgattacaatttgaaaatgtgcacggtgatgtttctagtttt

SEQ ID NO: 1995 - DNA, 2032 bp, Tropaeolum majus
aaaaaaatcgtttgttttgtttcaattcctctaactggtgaaatataatcaccgctggtgagtgaaagtaatcgagaagaaaaatggcgttagccttcgacgagtacggaaggccgtttattatattgaaggagcaagatcagaagacgaggttgagaggtattgatgcacagaaagctaacatttctgctgcgaaagctgtggctcgcatcctacgcacttcgcttggaccaaagggcatggataagatgctctccagccccgatggggatgtcacgatcactaatgatggagccacaattttggaaaaaatggatgttgacaatcaaattgcgaaactaatggttgaactgtcaaggagccaggattatgaaattggtgatggcacgactggtgtggttgtcatggctggtgcacttcttgagcaagctgaacatttactagagcgtggaatccatcccattcgggttgcggagggctatgaaatggcttccagaattgctgttgaacatttagagcatatatctcagaaacttgattttagttcgacaaatatcgagcccttggttgaaacatgcatgactactttatcctcaaagatagtgaacaggtgcaaacgcagtttggcggagatctctgtcaaagcaatcctttctgtagcagatttggaaaggaaggatgtcaatttggacttgatcaaagtggagtcaaaagttgggggaaagttggaagacactgaattaatatatggaattgctgttgacaaggatatgagccacccgcagatgccaaagcaaattcaagatgcccatatcgctatattgacttgcccctttgaacccccgaagccaaagaccaaacataagattgacattgattcggtggaaaagtttcagactttacgcctgcaagagcagcagtattttgataacatggtccaaaaatgcaaggatgttggtgctacgctggtcatctgtcaatggggattcgatgatgaagcaaatcatttattgatgcacaggaacttgcctgccgtcagatgggttggtggtgtagagttggaactaatagcgatagccacaggtggaaggattgttcccaggtttcaggagttgacagctgataaattggggaaggctgggcttgttcgagaaaaggcttttggcactacaaaggatcgtatgctttacattgaacactgtgcaaattcaaaggctgtaaccatatttatccgtggaggtaacaaaatgatgatagaggagacaaagcgtagcatacatgatgcactgtgtgtggctaggaatctcattcgcaataattccatcgtctatggtggtggatctgctgaagttgcttgctcaatagccgtagatgcagccgcagataaatacccaggcgttgagcagtatgctatcagaggttttgcggaagctttggactccatctccatggcactcgccgagaatagtggcctacaacctattgaaactctatctgcgatcaaatctcagcagattaaggagaacaatcccttctacggaatagattgcaatgacgttggtactaacgacatgcgcgagcaaaaagtgttcgagactttaattgggaaacaacaacagatattgcttgcaacacaagttgtcaagatgatcttgaagattgacgatgtcatctctccttctgcattttaatcccgcaaaaccatattttgcttcaccaggatcgaagctcgcggtggtcgtcagcagctcgtatcaagttactccataattatgtgattatttttgtgaaaatgttttaatttcgtaaaatttttgaattatattctcctggtttcgtaatatgactgcacgtttcgtaaaatattatttatttgctgaagccttttcactactgaagttctctatgatttgcaatcgtattatgactaattaatttatattatgacatcattttgcgatacatctttctaaatcaattaattttgttattttcccttttaattataaggatattatctttaattataagt

SEQ ID NO: 1996 - DNA, 2083 bp, Physcomitrella patens
tctctcgaaagcttctcgctgctctcctgggcatttgcctctttctgctgtcgcgagcttacgatttgcgcaacccctggcttcagggttttgctctgctgattgtgaccatggctctcgccttcgatgagtatggccgtcccttcattatcattcgcgatcaggagaccaagtctcgcgttcgcgggctcgacgctcagaaagccaatattatggctgccaaggctgtagcgcgcgtcctccgcacttcccttggccctaatggcatggacaaaatgctccagagccctgatggagacgtcactatcacgaacgatggtgcaaccattctggagcaaatggaaatcgagaatcaaattggaaagctgatggtggagctttctagaagccaagactacgagatcggcgacggtactactggcgttgttgtccttgcgggtgctctactggaacaagcagaagttttgttggaaagagggattcaccccatccgtgtcgcagagggatatgaaatggcgtcgaagctggcagtggaaaaccttactcgcattggacaaacttttgaatttagtcccgacaacattgaacctcttgtgcaaacatgcatgaccacgttgtcttctaaaatagttggccgttgcaagcgacaattagcagaaattgcagtgaaggctgtcctcgcagtagctgaccttgagaggtcagatgtcaatcttgatcttatcaaagtggaaggaaaggtaggcggaaagctagaagacaccgaacttgtatatggaatagttgttgataaggatatgagtcatcctcaaatgccgaaggagattagagatgcaaaaattgccattctaacttgtccattcgagccccctaagcctaagaccaagcataaagtggatatcgattcggtggagaaatttgaggccttgcaggcggctgagaagtcatacttcaatgagatggttcagcaatgcaaggatgctggtgcaaccctagttatttgtcaatggggttttgatgatgaagccaatcatttgttaatgcatgaaaatttgccagcagtacgctgggttggaggagttgagctggagcttattgctattgctacaggtggccggattgttccaaggttcaaagaacttacgcctgagaagcttggtaaggctggtctcgtgagagagaagggttttggaaccactaaagatcggatgctctacattgagcagtgcgcaaattccagagctgtcactatctttatacgtggtggtaacaagatgatgattgaggaaaccaaaaggagcttgcatgatgccttgtgtgtggctcgtaacctgattcgggacaaggccatagtatatggtggcggtgctgctgaaatctcatgctctcttgccgtggaggctgctgctgataagatatccggtgttgagcagtatgctatgcgagcctttgcagatgcgctagatatggtccctatggctctggcagagaacagtggcttgcagcctatcaatacattaactgctgtgaaagctcagcaagtgaaggagcagaaccctcatctgggaatcgattgcaacgacgttggaacgaatgatatgcgcgagcaaaatgttttcgagactctgattgggaagaagcaacaagtcttattggcaactcaggtggtgaagatgatactgaaaatagatgacgtgattagtccttcatcatattaatttcttcatggttccgctcaggcttgttttgacgaaatttctaatcaagttttctaggattctcttcgtcttttcaaagacggctgcacacttcctacgagatttactgaacagagaacatggacaattaacaagctcggagttgctattgggtattcttctgtgaaactggaggggtgcttctagcaagaatttctctacttgtgttaattccttggaatctaggatctttacttgagtttctggcctaatcttgcttaaacttcaattctataatatggttgtggaggcttttaagtacagtggcttcgtacgagctacttgttttgttgagcggattggatctattaatgatattcttctta

SEQ ID NO: 1997 - DNA, 1759 bp, Allium cepa
ctcgaagctcagaaatccaacataagtgcaggagtggcagttgcaaggatcttgaggacttctctagggccgaaggggatggataagatgctccagagccctgatggcgatgttgttattacaaatgacggggcaacaatcttggaacaaatggatgtcgacaatcaaattgcaaaattaatggttgagctgtcacgaagccaggattacgagattggtgatggtacaactggtgtggttgttttggctggttctcttttagaacaggctgagaagcttttagaacgtggtattcatcctataagaattgcagaaggatatgagacagcatctcgaataaccgttgaccatcttgagcagatttctcaaaagtttgtgtttagtattaatgatattgagcccctggtgcaaacttgcatgactactttgtcatcaaagattgttaatcgctgcaaacgcactctagcagagattgctgtaaaagcagttctggctgttgcagatttagagaggaaagacgtcaatttggatctgattaaggtagaagggaaagtaggaggaaatttagaggacacagaactcatttacggaattattgtagacaaggatatgagccatccacaaatgccgaagcatatcgaagatgcaaaaattgctattttgacttgcccattcgagccacccaaacccaagacaaaacataaggttgacattgacactgtagagaagttccaaactctgcgtcagcaggaacataagtatttcgatgacatggttcaaaaatgcaaggatgttggtgctactttagttatctgtcagtggggttttgacgacgaagccaatcacttattgatgcatcgaaatttgcctgctgttagatgggttggtggcgttgaattggagttgattgccattgctacaggcggacgaattgttccaaggtttcaagaattaacacccgagaaacttgggaaagctggtctagttagggaaaaagcatttgggaccacaaaagaccggatgctttatatcgagcagtgtgcgaattctagggcggtgacaatatttattcgtggtggcaacaaaatgatgatagaagaaacaaaaagaagcgtacatgatgcactatgcgtggcaaggaatttgatccgcaataactcaatagtttatggtggtggctcggctgagatctcatgctcaattgctgttgaagctgctgcagataagcatcctggagttgagcagtatgctattaggtctttcgctgaagcattagatgctgttccaacagcacttgcagaaaacagtggtttacagcctattgacactcttaccgctgtcaaagcccagcaaatcaaggaaagcaattcattcttgggcatagactgtaacgatgttgggaccaacaatatgcgacagcaagatgttttcgaaacgttgatcggaaagcaacagcaaattatgctggcaacgcaggttgtgaaaatgatattgaagatcgatgatgttatcaccccaactgagtactaacttcattccaaactttgcaagattttgtttgctttgtataatttatgacttttgaattgaatgctgcaaaatttttgtaatatttaacactgaatttgtggggaaatggtgtttggttcttccagtacttttcatgattttctgatgtgtttgcagatagaaatttggagtgtaatatgccgtcctctgcatgtggattatcttttcaacgtatagctacctagtttga

SEQ ID NO: 1998 - DNA, 1743 bp, Zostera marina
gtccgcttcccttctcgatctccgctgatctctaaaacttggttgcttttccggtgcttgatcgtcggaaatggcgctggcatttgacgagtacggtcgtcctttcatcatcataaaggaacaggggcagaagagccgtatacgaggtctcgaggctcagaagactaacatcaatgctgggattgctgtttctcgcatcttgagaagttctcttggacccaagggcatggacaagatgcttcagagccccgatggcgaacttaccatcactaatgatggagcaactatcttggagcagatggacgttgataatcagattgcaaagctgatggttgaattgtcacgaagtcaagattacgaaatcggtgacggtacaactggggttgttgttttggctggtgctcttcttgaacaggctgaaaagctattagaacgtggtattcaccctattcgggtggctgaaggatatgagacagcctctggtgtagctgtaaaccatctggaacatatttctcagaaatacgatttcagtgcttcagaaattgagtcattggtgcagacttgtatgacaactctctcttcaaaaattgttaatcgttgcaagcgcatgctagcagagattgctgtaaatgcagttctggcagttgctgatttggagagaaaagatgtcaatttagatttgatcaaagtggaagggaaagtaggggggaagctagaagatacagagttgatcaaaggaattattatcgacaaagatatgagtcatcctcagatgccaaaatggattgatgatgcaaagattgcaatcctgacgtgtccatttgagccacctaagccaaagacaaagcataaggttgacatagatactgttgaaaagttccaaaccttacgtgatcaggagcaaaaatattttgatgacatggttcagcagtgcaaggatgtgggtgctaccttagttatctgtcagtggggttttgatgatgaagcaaatcatttattgatgcatcggaatctgcctgctgttagatgggttggtggtgtagaattagagttaatcgcaatagccacaggtgggagaatcgtcccaaggtttcaagaattgacaacagaaaaactcgggaaggctggtatagtgagagagaaatcttttggaactactaaggaacggatgttgtatattgagaaatgtgcaaactcaaaggctgtgacaatattcattcgtggtggtaacaaaatggtgatagaggaaaccaaaagaagcatccatgacgctctttgtgttgccagaaatctaatccgcaacaattctattgtatatggtggtggttctgccgaaattgcttgtgcaattgccgtggaatctgctgctgacaagcatcctggagtggagcagtatgccattaggtcttttgccgaggctttagagtccattccaatggctctggcagagaacagtggtcttccgtctattgaaaccgtcactgcagtaaagtcccaacaaatcaaggagaacaatccattctatgggatagactgcaatgatgttggaacaaatgacatgcagaagcaaaatgttttcgaaacattgattgggaagcaacaacagatgttacttgccacacaggttgtgaagatgattctgaaaattgatgatgtaatatcaccatctgatttttgatcatcatcaatagtcagcatagtaagaaaactaccttgtgccttgtggtatttgtttgcctatct

SEQ ID NO: 1999 - DNA, 1941 bp, Zostera marina
gtccgcttcccttctcgatctccgctgatctctaaaacttggttgcttttccggtgcttgatcgtcggaaatggcgctggcatttgacgagtacggtcgtcctttcatcatcataaaggaacaggggcagaagagccgtatacgaggtctcgaggctcagaagactaacatcaatgctgggattgctgtttctcgcatcttgagaagttctcttggacccaagggcatggacaagatgcttcagagccccgatggcgaacttaccatcactaatgatggagcaactatcttggagcagatggacgttgataatcagattgcaaagctgatggttgaattgtcacgaagtcaagattacgaaatcggtgacggtacaactggggttgttgttttggctggtgctcttcttgaacaggctgaaaagctattagaacgtggtattcaccctattcgggtggctgaaggatatgagacagcctctggtgtagctgtaaaccatctggaacatatttctcagaaatacgatttcagtgcttcagaaattgagtcattggtgcagacttgtatgacaactctctcttcaaaaattgttaatcgttgcaagcgcatgctagcagagattgctgtaaatgcagttctggcagttgctgatttggagagaaaagatgtcaatttagatttgatcaaagtggaagggaaagtaggggggaagctagaagatacagagttgatcaaaggaattattatcgacaaagatatgagtcatcctcagatgccaaaatggattgatgatgcaaagattgcaatcctgacgtgtccatttgagccacctaagccaaagacaaagcataaggttgacatagatactgttgaaaagttccaaaccttacgtgatcaggagcaaaaatattttgatgacatggttcagcagtgcaaggatgtgggtgctaccttagttatctgtcagtggggttttgatgatgaagcaaatcatttattgatgcatcggaatctgcctgctgttagatgggttggtggtgtagaattagagttaatcgcaatagccacaggtgggagaatcgtcccaaggtttcaagaattgacaacagaaaaactcgggaaggctggtatagtgagagagaaatcttttggaactactaaggaacggatgttgtatattgagaaatgtgcaaactcaaaggctgtgacaatattcattcgtggtggtaacaaaatggtgatagaggaaaccaaaagaagcatccatgacgctctttgtgttgccagaaatctaatccgcaacaattctattgtatatggtggtggttctgccgaaattgcttgtgcaattgccgtggaatctgctgctgacaagcatcctggagtggagcagtatgccattaggtcttttgccgaggctttagagtccattccaatggctctggcagagaacagtggtcttccgtctattgaaaccgtcactgcagtaaagtcccaacaaatcaaggagaacaatccattctatgggatagactgcaatgatgttggaacaaatgacatgcagaagcaaaatgttttcgaaacattgattgggaagcaacaacagatgttacttgccacacaggttgtgaagatgattctgaaaattgatgatgtaatatcaccatctgatttttgatcatcatcaatagtcagcatagtaagaaaactaccttgtgccttgtggtatttgtttgcctatctctctaatttttttttgatccacaaacttatttatttgttctactcttatttttgatcatcatcaatagtcagcatagtaagaaaactactgtgtgctatttgtttgtttatcttcctaattttttttgatccataaacttttttctttattctgcttctttatcaatcaatttccaaaccattatttttgtactgcaa

SEQ ID NO: 2000 - DNA, 1764 bp, Selaginella moellendorffii
gggcggccgttcatcattctccgcgagcaggagcagaagactcgagcgaaaggtttggaagctcagaaggcgaatattatggcggccaaatccgtcgctcgcatcctccggacgtctctgggcccgaaaggcatggacaaaatgctccagagcggcgatggcgatgtcacaatctcgaacgatggcgctaccatcttagagcagatggaagtggagaatcagatcggaaagctcatggtggagctctccaggagccaggattatgagattggcgatggaaccactggtgtggtagtcacagccggggcgctgctcgaacaggccgagatccttcttgaacgagggattcatcctattcgtgttgccgagggctacgagcaggctgctaggattgctgtggaccatctgtcgaagatctctcacagctttgagttcagctccaccaacatccagccgctagttcagacttgcatgacaacgctttcttcaaagattgtcaatcgctgcaaggcattgctcgcggagattgccgtcaaagctgttctcgcggttgcagatctggagaggaaggatgtgaacctggatctgatcaaggtcgagggaaaggttggcggtaaattggaggacacggagcttgtctacggcattgttgttgacaaagacatgagccatccacaaatgcccaagaggatagaagatgcgaagattgcaatcttgacgtgtcccttcgagccgccgaagccaaagaccaagcataagatcgacattgattccaccgagaaattcgaggcacttcgagaagccgagaagaagtactttgatgagatggtgcagaagtgcaaggatgttggtgctacgcttgttatctgccagtggggatttgacgatgaagcaaaccatctgttgatgcatcgtggtctgccggctgttcgatgggtcggaggtgttgaactggagctcattgctattgccacaggtggcaggattgtgcccagatttcaggagctgacgcccgagaagcttggacgggctgggatagtgcgggagaagtcttttgggacgacaaaagataggatgctttacattgagcagtgtgccaactctcgggcagtgacaatatttattcggggagctagcaagatgatggtcgaggagacaaaacgtagtatccatgatgcattatgcgttgcgcggaacctcatccgtgataattctatcgtttacggaggagggtctgccgagattgcatgctccatcgcggtggaagctgctgcagatcggattccaggcgtcgaacagtatgccgttcgagctttcgccgacgctcttgatggagttcccatggcgctggctgagaacagtggcttgcaaccaatcgatacattgacagccgtgaaagcccagcagatcaaggagaaaaatccccacctcggaatcgactgcaacgatgttaagacgaacgacatgaaggagcagaacgttttcgagacgttgattgggaagaagcaacagattctcctcgcaactcaggtggtgaagatgatcctcaagattgatgatgtgatcacgccgtcgcagtatagctgagcggagagaagcctggagcccgaatctaaccaaagccaggaggttggttccatctggcttgcaactggtcgtctagttgaggataggcggcgtagaagttttgtccgtcttgttgtattgtgctgtaatctgggaggctgggagaatagccaaactttggagctttttgcttgagct

SEQ ID NO: 2001 - DNA, 1821 bp, Silene vulgaris
ttctctatataccgccatttttacgcgatctgagctcgaaattttcgaagcttcgcaacaatggcgttggtgttcgacgaattcggacgtcaattccttttatttcgggaacaagaatcaaagagtagagttcgcggaatcgaagctcagaaatcaaatatcgccgctgcaaaatccgtcgctaatattcttcgttcttctctcggtcctaaaggaatggataaaatgcttcaatcacctgatggtgatatcgtcatcacaaatgatggtgctacaatcctagagcagatggatgttaacaaccagattgcaaagctaatggttgagttatctcgtagtcaagattatgagattggagatggaacaactggtgttgttgttttggcgggtgctcttttggaaatggctgcaacactcttagaccgtggcatccatcctatcagaatttcagagggatatgaagtggcctcacgtattgctgttgaacatttggagaatattgcacataagtttgagtttgaagcaggaaatatagagcctttagttcagacctgcatgaccactttgtcatcaaagattgtgaaccgttgtaagcgcagcttggcagagattgcagttaaagcagttatggctgttgcagacctagagcgaaaggatgttaaccttgatctgataaaggtggaaggcaaagttggggggaaagtggaagatactgaactcatctatggaattgtggttgacaaagatatgagccatccccagatgccaaaggaaattgaagatgcaaatatagcaattctaacttgcccctttgagccaccaaagccaaaaactaagcataaggttgagattgacacagtagagaagtttgagacgttgcgtaaacaagaacaacagtactttgatgacatggttcagaagtgtaaggatgttggggcgaccttggttatctgtcaatggggttttgatgacgaggcaaatcatttgctaatgcacagaaatttacctgctgtcagatgggttggcggtgtggagttggaacttattgcaattgccacagggggaaggattgtcccaagatttcaagaactgacccccgaaaagctaggacgggctggattagttcgtgagaaagcattcggtacaactaaagaccgaatgttgtatatcgaacattgtgccaattcaagggctgtaaccattttcattcgtggtggtaacaaaatgatgattgaagagaccaagaggagcatccatgacgccctttgcgtggcaaggaatttgattcgcaataattctattgtttatggcgggggctctgctgaaatatcttgctcgattgctgttgatgccactgccgatcgacatccaggagttgagcagtatgccattagggccttcgctgaagcgttagaggcggttcctatggcattggccgagaacagtggtcttcagcccattgaaacactgagtgctgttaaggctcaacagcttcaggacaacgatccttgttgtggggtagactgcaatgatactggcaccaatgacatgcgtgagcagaatgtattcgagacgttgataggaaagcaacaacaaatattgctcgctactcaggtggtgaagatgattttgaagattgacgatgtcatcacccctaacgaatattagtagatgtcaagttagatttcgagttccttcccttaatccaggtagatgtcacttgtctttgttgttgccttttggtgtgaaatcaaattgtagtagtcaacatgaatcgatttttatgctatgcgagaattttggtgtgattatataaaaact

SEQ ID NO: 2002 - DNA, 2181 bp, Ceratodon purpureus
gggtttctctgctgacgtccgccatggcgctcgcctttgatgagtatggccgccctttcatcatcatccgcgatcaggagtccaaggcacgcgttcgcggcctcgacgcacagaaagctaacatcatggctgctaaagccgtcgcccgcgtcctgcgcacctccctcggccccaacggcatggacaagatgcttcagagccccgacggcgatgtcaccatcacaaatgatggggcgaccatcttggagcagatggagattgagaatcagatagggaagttgatggtggagctctcaaggagccaagattatgaaattggtgacggtacaactggcgtcgttgtacttgccggagctctactggagcaagcagaggttttactggagagaggcattcatcccattcgtgtagcagagggttatgaaatggcgtccaagctggcagtagatcacctgactcacattggacacaagttcgatttcagtcctgacaacattgaaccactcgtgcaaacttgcatgaccacgctgtcttcaaaaatagtgggccgttgtaagcgacaattagcagaaatcgctgtcaaggctgtactcgctgtagctgatcttgaaagatcagacgtcaatcttgatcttatcaaagtggaggggaaagttggtggaagacttgaagatactgaactcgtatatggtatagttgttgataaggatatgagtcatcctcaaatgcctaaagaaataaaaaacgcaaaaattgccattctgacttgcccattcgaaccccctaagcctaagaccaagcacaaagtggatatcgattccgtggagaaatttgaggcgttgcaagcagctgagaagacttactttaacgacatggttcggcagtgtaaggatgctggtgcaacgttagtcatttgccaatggggtttcgatgatgaagcaaaccatttgttaatgcacgaaaatcttccagcggttcgttgggtcggaggagtggagctggaacttattgctattgcaacaggtggccgtatcgtcccgagattccaagaactcacatcggacaagcttgggaaggccggtcttgtcagggagaaaggtttcggaaccaccaaagatcggatgctttacattgagcaatgtgctaattccagagctgtcactatatttattcgtggagggaacaagatgatgatcgaggaaacgaagagaagtttgcatgatgccttgtgtgtggctcgtaatctgattcgggacaaagctattgtctatggtggcggtgctgctgaaattgcatgttccctggctgtggaggctgctgctgataagatatctggtgttgagcagtatgcaatgcgagcttttgcggatgcactagatatggtccccatggctctggcagagaatagtggtttgcagccaatcaacacacttactgctgtaaaagctcagcaagtgaaggagcagaatccgcatctgggcattgactgcaatgatgttggaaccaatgatatgcgagagcagaatgtttttgaaacactcatcgggaagaagcaacaggttctactggcgacgcaggtggtgaagatgattctcaagatagatgatgtgatcagtccttcagcattttaagttctgtggttctaagatttttggtagtgaaatttcactgagtgcaccatttcgttctgcattttttgaagctgagctggaggtttctaaaagattttctggacaaggagaaaagcgtctcgagatatagcgtctgtaccctagtattgttagctttttcccgccgtgactatgatccttttgctaatgattacacgaggatagcatatcagggtataaccaggatatctagtatcaagtttagtgtttgcgcagtgacgaattgttggagaatagcctagtagtgagatattttttgcttccaggaacaggataagagaaactagagcagtattccttccaacggggagagtaatgtcatagggaatcttatattctgtaagaattgttcatttaagaaggtgaattcgcattatgaagtttgagttggtgttgagtgtaatcaattgagtgcagattgtgcagtaaggttcggaaaatgaaatagtgattataccctgttcagtaaggtaggaataccaagaacggtgtgaaaagaaggtgatacgac

SEQ ID NO: 2003 - DNA, 1707 bp, Vinca minor
atagaccctaaatctagagagagagaaacaggtagtttctacgatctcttagatctgatctctgagaaatggcgttagctttcgatgaatttggtcgtccattcataataataaaggaacaagattcgaaaactcgattgcgcggtctcgatgctcataaatctaacatctccgccggaaaagctattgctagaattctccggacttctcttggtcctaaaggcatggataagatgcttcagagccccgacggcgatgttactatcacaaatgatggtgctacaatcttggaacagatggatgttgacaatcaaattgcaaagttgatggttgaattatcacgaagtcaagactatgaaattggggatggaacaactggtgttgttgtcatggctggtgctcttctagaacaggctgagagattacttgaacgtggcattcatcctattcgaattgccgaaggatatgaggtggcttcaagaattgcttttgaacatctggagcatatagcacataagtatgaatttgatgcaacagatattgagcccctggttcaaacctgcatgacaactttatcctccaagattgtgaatagatgcaagcaaagtttggcagagattgctgtcaaagcagttttagcagttgctgatttagagcggaaggatgtcaacttggatctaatcaaagtagagggtaaagtaggtggaaagctggaggatacagagctaatatacggaattgttgttgataaagacatgagtcatccacagatgccaaaggagataaatgatgctaaaattgccattttgacttgcccttttgagcctccgaagccaaagactaagcataaggttgacattgacacagtggagaagttccaaaccttaagacagcaagagcagaagtactttgatgacatggtacaacaatgcaaggatgtaggtgctagcttggttatctgtcaatggggttttgacgatgaagcaaatcatctgttaatgcacagaaatctgcctgctgttagatgggttggtggtgttgaactggagctgatagcaatagctacaggtggaagaattgtgccaaggtttcaagagctgacagcagaaaagctaggcaaagcgggtttggtcagagaaaaagcatttggtaccaccaaagatcggatgatctacatagagcactgtgcaaattcaagagctgtcactattttcattcgcggtggtaacaagatgatgatagaggaaacaaaacgtagcatccacgacgctctctgtgttgctaggaaccttatccgcaacaattctatagtatatggtggtggttctgctgagatttcttgctcagttgctgtcgaggctgctgcagataaacatcctggtgttgagcagtatgcaatccgagcattcgcggatgctttggatgctatccccatggcacttgctgagaacagtggcctccaaccaatcgagactctatcagctgtaaaatctcagcaaattaaggagaacaatccgtgctgcgggattgattgcaatgatgctgggacgactgacatgcgtgagcaaaatgtctttgaaactttaattaggaaaacagcagcagattttactcgcaacacaagttgtgaagatgattctcaagatcgatgatgtgatcacaccatcagatttctagtttagttaaatgataccgcattttttcctc

SEQ ID NO: 2004 - DNA, 2005 bp, Distylium racemosum
ctacacttgcgcggcaacaaagaagaacacagcggcgatctagggtttgcttgctgggtgctgttctcgggttcgaaagtctttattctatcaccattcctctgctgacaaagaagagggatggcgctggcatcgatgacgtatccggaggtcattactacactaacgagcaggagcagaagatccgagtgaggggcttagatgcgcaaaagaccaacattgcggccgccaaggccgtgtccagaatccttcgcacctccctcggtcccaaggggatggacaagatgctaaagagtcccgatggcgatgtcaccatctctaatgatggtgcgacaatcttggagcagatggatgtagagaatcaaattgggaaattgatggtagaattatcacggagtcaggattatgagattggtgatgggacaaccggtgtggttgttacagcaggtgcacttttggaggaggcagagcaacttttagatcggggaattcatcccataagaattgcagagggttatgaactagcctccaaaattgcggtggaacatttggatcgaattgcacggaagtttgagtttagtctaaatgatgtggaacctcttgtgcagacttgcatgactacactctcttcaaagattgttaatcgatgtaaacggatgctagctgagattgctgtgaaggcagtgcttgcggttgcagacttagagagaaaagatgtaaacctggatttgattaaagttgaaggaaaagttggaggaaagctggaagatacagagcttgtttatggtattgttattgacaaagatatgagtcatccacaaatgcctaagagtattgaggatgcaaagatagctattttgacttgcccatttgagccacctaagccaaagacaaagcataaggttgacattgacacagtggagaaatttgaagctttacgtgatcaggaacgacaatacttcgatgagatggtacagcagtgcaaggatgttggtgcaactcttgtaatctgccagtggggttttgatgacgaggccaatcatttactgatgaaccgtggtttgccagcagtgcgatgggttggaggagtggaactggagttgattgcaattgcaacaggtgggcgaatagttccaaggtttcaggaattgacatcagataagttaggcaaggctggacttgtgagggagaaagtgtttggaacaactaaggatcgaatgctatacatagaaaagtgtgcaaactcaaaggcagttacaatttttattcgtgggggaaacaagatgatgattgaagagacaaaacgaagtgtccatgatgcactttgtgtggcccggaatttgatccgtgataattcaattgtgtatggtggtggttcttcagaaatttcatgttcacttgctgtggaagctgctgctgacaagattccaggagtggaacaatatgcagttcgggcatttgcagatgctcttgatgctgtaccaatggctctagcagaaaatagtggactccaacctattgatactttgacagtagtgaaagctcaacaaatcaaggaaaataaccctcatttgggaatagattgtaatgatgttggtacaaacaacatgatggagcaaaatgtgtttgaaactctaattgggaagaagcaacagattctactcgccacccaggttgtcaagatgatcttgaaaattgatgacgtgatttcaccatcagggtattcataaatagcttttccctcaaaataggtgcttattaaaattcagggaagccttggttgtttcatgttgtcaaacattttcatgatgcaagaagctttgaaaacactactatgctaaatgcacgtagtgtctgagcacattggaagtttgggttttttaatggtgcaagaattggtatgatgcatcagaaaggtgtatgccaaacttttaaagattctgtacctcggatgaacattgctgttatttttggtatacaaatattgactatggccatggttgtg

SEQ ID NO: 2005 - DNA, 1669 bp, Olea europaea
agagcggtggctcgaatcctccggacctcacttggacccaaaggcatggacaagatgctcagagccctgacggtgacgtcaccatcacgaatgatggtgcgacaatcttggagcagatggatgttgacaatcagattgcgaagctaatggttgaattatcaagaagtcaagactatgaaattggtgatggaacaactggagtcgttgtcatggctggttcacttctagaacaagctgagaagttattagaacgtggtattcatcctatcaggattgcggaaggatatgaaatggcttctaggatagcttttgaacatctggagaatgtagccaataaattcgaatttgatgcttcaaacatagaacctctgattcaaacttgcatgactactttatcatcgaagattgtaaatagatgcaagcgtagtttggcagagattgctgtcaaagcagtgctagctgttgcagatttagagaggaaggatgttaacttagatctaattaaagtagaagggaaagtaggtggaaagttggaggatactgaactgatatatggaattgttgtcgacaaagatatgagtcatccacagatgccaaagcagattgaggatgcaaaaattgccattttgacttgtccttttgagccaccgaagccaaagactaagcataaggttgacattgatacagttgaaaaattccaaacactacgtcaacaagagcagaagtactttgacgacatggttcaaaaatgcaaggatgttggcgctactttggttatctgccaatggggttttgatgatgaagcaaatcacttactgatgcacagaaacttgcctgctgttcgatgggttggtggtgttgaattagagctgatagccatagccacaggtgggaggattgtgccgaggtttcaagagttgacctctgaaaaactaggcagagctggtttggttcgagaaaaagcatttggtactactaaagatcgaatgatatacattgaacattgtgcaaattcaagggctgtaaccatatttatacgtggtggtaacaagatgatgatagaggaaacaaaacgcagccttcatgatgctttatgtgttgctcgaaatcttattcgcaacaactccatagtatatggtggtgggtcagccgagatttcttgctcaattgctgtcgaagcagctgctgataaacacccaggagttgagcagtatgcaattagggcatttgcagatgcattagatgcaattcccatggcgctagctgagaatagtggtctccaacccatcgaaactctttctgctgttaaatctcaacagattaaggaaaacaaccactactgtggtattgattgcaatgatattggaactaatgatatgcgcgagcaagatgtctttgagacgttgattgggaaacaacagcagattcttctggcgactcaagttgttaaaatgattctgaaaattgatgatgttatctcaccatctgaatattaaattatcccatattttctacaaaattttgctgggtctaaaaaattgtgtacgctacatagtttgcttgaacatcagacaatttgagtcgatacattcctttggttaattcctctagaggctttgtttttcaaatgtgttctgtttcatggattgatgatcttgtttacttttat

SEQ ID NO: 2006 - DNA, 1594 bp, Flaveria ramosissima
tactccagaagcacacacacactgcgtgccgatcgcactgttgttttctcatcatttcatcgatctaaaaccttaatccggtgaaagatctgcaacaatggcgttagccttcgatgaatacggtcggccgttcattatactgagggaacaagagagtaagagcagattaaggggtttagatgctcaaaaagccaacatcgccgccggtgttgctgtatctcgcatcctccgtacgtctcttggccctaaaggcatggataagatgctccagagccccgacggcgacattaccatcactaatgatggtgcaacaatcttggagcaaatggacgttgacaatcaaatcgggaaactcatggttgaactgtcacgtagtcaagattatgaaattggtgatggaactactggtgttgttgttatggctggtgcacttttagaacaagcagagaagcttctagaacgtggaattcatcccattcgagttgcagaaggatttgaaatttcttcaaggattgctgttgatcacttggaaaaaatagcacataagtttgatttcagtgctacaaatatagaaccattggttcagacttgcatgactaccctgtcctccaaaattgtgaatcgatgcaagcgtagcttggctgagattgctgtaaaaagtgtcatggctgttgctgatttagagagaaaagatgttaatcttgacttgattaaagtggagggaaaggttggtgggaaattagaggatacagaacttatttatggaattattgttgataaagatatgagccacccccaaatgccaaagcaaattgaagatgcaaaaattgctattttgacttgcccatttgagccaccaaagcctaagaccaaacataaggtcgacattgatacagttgaaaagtttcaaactttaaggaagcaagaacagaagtactttgatgacatggttcagaaatgcaaggacgtaggtgcaacgctggtaatttgtcaatggggctttgatgatgaagcaaatcacttattaatgcacagaaatctgccagctgtcagatgggttggtggtgtagaactggagctaatagcaatagctactggtggtagaattgttcccaggttccaggaactaacacctgaaaaactaggaaaggctggtttggttagggaaaaggcatttggtaccacaaaagatcgaatgctttatattgaacactgtgcaaactcaaaggctgtaaccattttcattcgtggaggtaacaagatgatgatagaggagacaaaacgcagcatccatgatgcattatgtgttgctagaaatctcattcgtaataactcgattgtttatggtggcggggctgcagaaatctcatgctcaattgcagttgaagctgctgctgataaatatccaggcgttgaacagtatgccatcagggcttttgcagacgccttggattctgtacccatggctcttgcagagaatagtggtctgcagcccattgaaactctatctgcagtgaaagcacaacaaattaaggaaaacaatccttgctgtggcatcgactgcaacgatactggtacgaatgatatgcgtgag

SEQ ID NO: 2007 - DNA, 2297 bp, Taxus baccata
agcagacttacacgcatcgcatagacttagggtttcacctgcgcgggactagagttggaatctcattactgaaatcatctgatacaacgccaaggcgtgttctgttctatctccaacttcaccattttgttgcagaggaagattaagttttcatccagggctttcgtagggtttagcttgcagtggaactagggtttaagtattgcttgtttatgtgtgttggttttcagatatggcgttggcatttgatgagtatgggaggccgtttataatactgagagagcaagagcagaagagccgagtgagggggctggatgcgcagaaggccaacattgcggcggcgaaggccgttgcgaggatcattcgcacctcccttggccccaagggtatggacaagatgcttaccagcccggacggcgatgtcactatttcaaatgatggtgcaacaatcttggagcagatggatgtagagaatcaaattggaaaactgatggtagaattatcacggagtcaagattatgaaattggtgacgggacaacaggcgtggttgttacagcaggtgcacttttggaacaggcagagcaacttttagaacgaggaattcatcccataagaattgccgagggttatgaactggcctcaaagattgcagtggaacatttaaatcatattgctcgaaagtttgagtttaatctcatcaacgtggaatctcttgtgcagacatgcatgaccacactctcttcaaagattgttaacagatgcaaacgcatgctagctgagatcgctgttaaagcagtgcttgctgtagcagatttagaaagaaaggatgttaacctggatttgattaaagttgaaggaaaagttggtgggaaactcgaagatacagagcttgttgaaggaattgttattgacaaagatatgagtcatccacaaatgcctaaggcaattgaggatgcaaagatagccattctgacatgtccttttgagccaccaaagccaaagacaaagcataaggttgatattgatacagttgagaagtttgaagctttacgtggacaggaaagacactattttgatgaaatggttcagaggtgcaaggatgtaggtgcaactcttgtaatctgtcagtggggttttgatgacgaggccaatcatttgctgatgaaccgtggcttgccagctgtgcggtgggttggcggagtcgaactggaattgattgcaattgcaacaggtgggcgaatagttccaaggtttcaagaattgacgccagagaagttaggcaaggctggacttgtgagagagaaagcatttggaacaactaaggatcgaatgttatacatagaacactgtgcgaattcaaaagcagttacagtttttattcgtggtggaaacaagatgatgattgaggagacaaagcgaagccttcatgatgcactttgtgtagcccgcaacctgattcgtgacaactcaattgtgtatggtggtggttcagccgaaatttcatgttcccttgctgtagaagctgctgctgacaagattccaggagttgaacaatacgcagttcgggcgtttgcagatgcccttgatgctgtaccaatggctcttgcagaaaatagcggacttcaacccattgatactttgacagcagtgaaagctcaacagatcaaggaaaataacccccacttgggaatagattgtaatgatattggtacaaatgacatgatggagcaaaatgtatttgaaactcttattggaaaaaacaacagattttacttgcgacacaggtggtcaagatgatcttgaaaattgatgacgtgatctcaccatctgcgttttagatcatttttcccacagctggtgttgctttgaaagtgaagtccaggggaagctttgggtttttttataatgtgaatcatatttttgatgaattgcaccttgtgctttatgcatgtagtgtgtgatcacatgtgaatttgaggatttcttacggcatgagaattgaattatgcaactttgaagtgcatgaaaattcagttttcattttgaactggcattattgctttagtaggagagctgcccccttctgttgtgaatggcaagattttaaggttttatcatcagaaacattattgatgatgttcttggtagaaaaacattaattctgcccctagttgtgtgagatgatgagaatagccactaggctcatgtctttattcaaaatgattttttgtggtgctagctccaaattgtcttttggaggtatttctttttatattatgtttccttttcaaacttg

SEQ ID NO: 2008 - DNA, 1701 bp, Panicum virgatum
atcctggagcagatggatgttgacaaccagattgcaaagctgatggtggagctgtcccgcagtcaagactatgaaatcggggatggtaccactggggttgttgtcatggcaggggctctcctggagcaggctgagaagcttctggaacgtggtattcacccaattagggtggctgaaggctatgagatggcgtcaaggatagcttttgaacacctagagcgcatctcccacaagtttgagttcagtgcagacaatatcgagccactggttcagacctgcatgacaactctatcgtccaagattgttaaccgttgcaagcgggcactagcagagattgctgtgaaagcagtccttgcggttgccgatttggagaggaaggatgttaacttggatttaattaaagtagagggcaaggttggtggtaagctggaggacactgaactgatatatggaattgttgttgacaaagatatgagccacccgcaaatgccaaagagaattgaggatgctaagattgccattctgacatgcccattcgagcccccgaagccgaagacaaagcataaggtcgacattgacactgtagagaaattccagacgctgcgtgagcaagagcagaaatactttgatgaaatggttcagaagtgcaaggatgttggtgcgaccctggttatttgtcaatggggtttcgatgatgaagccaatcatttgttgatgcacagaaatctgccagctgtcagatgggttggtggtgttgaattggaattgattgccattgctacaggaggacgtattgttccgagattccaagagttgagtcctgaaaagcttgggaaggctggattagtccgagagaagtccttcggaactacaaaggaccggatgctttacattgagcagtgtgccaattccagagctgtaactattttcattcgtggtggaaacaaaatgatgattgaggagactaagcgcagtcttcatgatgctctttgtgtggcaaggaatttgatccgcaataactcaattgtgtatggtggcggttcagcagagatatcttgctcaattgctgttgaagctgctgcagatcggcaccctggagttgagcagtatgctatcaggtcatttgctgacgcattagatgctgttccactagccttggctgaaaatagtggtttgccaccaattgataccttaactgcagtaaaagctcagcaagttaaggagagcaacccccactgcgggatagactgcaacgacgtgggcaccaacgacatgaaagaacagaacgtgtttgagacgctgatcggcaagcagcagcagatcttgctcgccacccaggtggtgaagatgatactcaagattgatgatgtcatctcaccgtccgagtactgatgacccccccggaagaaggaacggattggctatgctggatggcagataggcggtcagtttattaggctgcaatgctgaggtggtgattggtgtactctgtgttctggcttgctcaggctgcttgttgtgttcaatgagctagctagctgcctacctgtttttgtgtgatgcttgccgaaatcgtttgtattgcacgatggcaccaagggtacgtttgaaattagtagtctagacgcttgatttagaagtctctctgtgctgtatctctctattcagatgcttgcagtgttgtttgcaatcgggtttttt

SEQ ID NO: 2009 - DNA, 1708 bp, Selaginella moellendorffii
gaagctcagaaggcgaatattatggccgccaaatccgtcgctcgcatcctccggacgtctctgggcccgaaaggcatggacaaaatgctccagagcggcgatggcgatgtcacaatctcgaacgatggcgctaccatcttagagcagatggaagtggagaatcagatcggaaagctcatggtggagctctccaggagccaggattatgagattggcgatggaaccactggtgtggtagtcacagccggggcgctgctcgaacaggccgagatccttcttgaacgagggattcatcctattcgtgttgccgagggctacgagcaggctgctaggattgctgtggaccatctgtcgaagatctctcacagctttgagttcagttccaccaacatccagccgctagttcagacttgcatgacaacgctttcttcaaagattgtcaatcgctgcaaggcattgctcgcggagattgccgtcaaagctgttctcgcagttgcagatctggagaggaaggatgtgaacctggatctgatcaaggtcgagggaaaggttggcggtaaattggaggacacggagcttgtctacggcattgttgttgacaaagacatgagccatccacaaatgcccaagaggatagaagatgcgaagattgcaatcttgacgtgtcccttcgagccgccgaagccaaagaccaagcataagatcgacattgattccaccgagaaattcgaggcacttcgagaagccgagaagaagtactttgatgagatggtgcagaagtgcaaggatgttggcgctacgcttgttatctgccagtggggatttgacgatgaagcaaaccatctgttgatgcatcgtggtctgccggctgttcgatgggtcggaggtgttgaactggagctcattgctattgccacaggtggcaggattgtgcccagatttcaggagctgacgcccgagaagcttggacgggctgggatagtgcgggagaagtcttttggaacgacaaaagataggatgctttacattgagcagtgtgccaactctcgggcagtgacaatatttattcggggagctagcaagatgatggtcgaggagacaaaacgtagtatccatgatgcattatgcgttgcgcggaacctcatccgtgataattctatcgtttacggaggagggtctgccgagattgcatgctccatcgcggtggaagctgctgcagatcggattccaggcgtcgaacagtatgccgttcgagctttcgccgacgctcttgatggagttcccatggcgctggctgagaacagtggcttgcaaccaatcgatacattgacagccgtgaaagcccagcagatcaaggagaaaaatccccacctcggaatcgactgcaacgatgttaagacgaacgacatgaaggagcagaacgttttcgagacgttgattgggaagaagcaacagattctcctcgcaactcaggtggtgaagatgatcctcaagatcgatgatgtgatcacgccgtcgcagtatatctgagcggagagaagcctggagcccgaatctaaccaaagccaggaggttggttccatctggcttgcaactggtcgtctagttgaggatagggggcgtagaagttttgtccgtcttgttgtattgtgctgtaatctgggaggctgggagaatagctaaactttggagctttttgcttgagctg

SEQ ID NO: 2010 - DNA, 1567 bp, Nicotiana benthamiana
tcgctgctagggttctgaaacccttctagattcatcgcgaaaccctctttctgtcgtcgtcgccggagattttcagtatccgatctgaccggatagcaggtcaccggaaacaatggctttagctttcgatgaattcggaaggccgttcataatactaagagagcaagaacagaaaaccagattaagaggcctcgatgctcaaaaggccaacatttccgccggaaaagctgttgcgcgtatcctgcgtacctcattgggtcctaaaggcatggataagatgcttcagggccccgacggcgatgtcaccatcacaaatgatggtgcaaccattttggagcagatggatgttgacaatcagattgcgaagttgatggttgagttgtcacgaagtcaagactacgaaattggtgatggaaccactggagttgttgtcatggctggagcacttctagaacaagcagagaagttgttagaacgtggtattcatcctataagggttgcagaagggtatgaaatggcttcaaggattgcagttgagcatttggagcgtgtagcaaacaagtttgaattcggtctgaatgatgttgagcctttggttcaaacctgcatgactactttgtcatccaagattgtgaatagatgcaagcgtagtatggctgaaattgctgttaaagcagttctagcagttgctgatttggagaggaaggatgtaaacctggacttaattaaagtcgaaggaaaagttggtggaaagttggaggacacagagctaatttatggtattgtagttgacaaagatatgagtcatccacagatgccaaagcaaattgaggatgccaaaattgcgattctgacatgtccttttgagcctccaaagccaaagaccaagcataaggttgacattgattctgtggaaaagtttcaaactttacgccaacaagagcagaagtattttgatgacatggttcagaaatgcaaggatgttggtgccacattagttatctgccagtggggttttgatgatgaagcaaatcacttattaatgcatagaaatttgcctgctgttagatgggtaggtggtgtggaattggagctgatagcaattgccacaggtgggagaatagtaccaaggtttcaagagttgacacctgaaaaacttggcaaggctggtgtagttcgggagaagtcttttggtactacaaaggacagaatgatatacattgaacattgtgcaaattcaagggcagtaactatattcatccgtggtggcaacaagatgatgatagaggagacgaaacgtagtatccatgatgctttatgcgttgctagaaatctaattcgcaacaattcaattgtgtatggtggtggttcagcagagatttcttgctctattgctgtggaagcggctgcggataaacaccctggagttgagcaggcatatgcaatcagggcatttgctgatgctttggattctgtcccaatggcacttgctgaaaacagtggtctacagcccattgaaactctatctgctgttaaggctcagcaaattaaggtaatccagcttacc

SEQ ID NO: 2011 - DNA, 1271 bp, Zea mays
ctacctcccgcgcccacacccgcacggccgcacactccattccaaccggcaagcaaagcaagcaaacaaacaaaacgaaacagcacagcagcaaagatcacacggcctccgctcgctcgacggcccactcggttccgatcgatctcgcgatcgcacaactagactcgagtcgagcgatcgagcgcccgacgaccaatggcggccaaggcggtggcttcgccgctcgcgttccgccgcgacgtgcgtggcccgctcggccgtcctgccccgggcggctgccggagcgggaccgggaccgggacagggctgccgggggtgctgtactggagcggtggcgccggcggcggcagcaggctgctcgcggcgcgggcgcgcgggaggaacaggttcggcggcggcggcggcgggcggggcgcgtccagggacgagacagcggaggaggacgaggacgaggccgccgacgtggtgatcgtcgacgccggggacgaggaggagtacgcctccgacgagctgtccggtttcaggggcctggttcttgatctctcctacaggcctgtcaacgtggtgtgctggaagcgcgccatctgcctggagttcattgggaaggcccatgtgttggagtactacgaccagaccgtctcttcgcctagcgggtccttctacatccctgcagttttgagggttccacagttgctgcaggtagtaaagagaagaagggtcaagcagagccttagccgtaaaaacattctttacagggatgacttcacctgtcaatattgttcttgtggtgacgacttgacaattgaccatgttattccgatctcgcgtggcggtaaatgggaatgggagaatttggtgactgcctgtgcaagatgcaactccaggaaggggcagaagacactggagcaggcaaacatgaagctgcgcaagatccccagggcgcccaaggagtacgatatcatggctgtgcccttgacaaaatctgcgttcagaacgctcaagaggaaccatggcctccctgaagtgtggctgcagtaccttgccaggccatctccatgaccaagacccccctcctcgtcatcgccatacgggccagcaacagcaagcaatctcactgtacattaacattattatagattatacaccatgcagcgcacaggcaaagactgcagatactgactccttatatacatgcccattctgtacacaataaactgttgcatgtactaaggacttatcttccaataaactgttgtaagctggtgcagaaa

SEQ ID NO: 2012 - DNA, 2026 bp, Setaria italica
ctcccccacactccattccaagctctctctctcagtctctctcctaccttccagccagcaaacaaacaaaacggcaacaaaaagatcaaacaagctcaacgacccactcgcctcccgtgatcacactcgagcgcgagatcaatggcggccaaggtggcggcgccgctcgcgttccgccgcgacgtgcgcggcccgctcggccggccgctgggctgcccgagcgggagaggtatgccgggcgtgctgtgctggagcagtggcaccgccggcagcaaaaggctcgcggcgcccgcgtggctggcgcgggcgcgcgggaagaacaggtccgccggcgggcggagctcgaccaaggacgaagcggaggaggaggaggaggccgcggaggtggtgatcgtggacgccggggatgaggaggagttcgccgccgacgagctgtccgggttcaggggcctggttcttgatatctcctacaggcctgtcaatgttgtttgctggaagcgcgccatctgcctggaattcatggagaaggccgatgtactggagtactacgatcagacggtctcttcgcctagcggatcattctacatccctgcagttctaagggttccacagcttctgcaggttgtgaagagaagaagagtcaagcagagccttagccgtaaaaacattctttacagggatgaattcacctgtcaatattgctcttctcgggacaacttgacaattgaccatgttattccgatttcacgtggtggtaaatgggaatgggaaaatttggtgactgcctgttcaagatgcaactccaggaagggtcagaagacactggagcaggcaaacatgaagctgcgcaagttacccagggcgcccaaggattacgacattctggcagtgcccttgacaaaatccgcattcagaacgctgaagaggagccaggggttgcctgaagtgtggctgcagtacctcgctaggccgtctccatgaccaggagctccagaccatatcaaccagccatctcattgtatattactaggctgtacagccaaaagactcaacattctctttcctatgtaacttctgtacatgacaataattctcagtagcacatcaaactgaatctaatatattcatggcccgttctatgacaaattctgtacaagtgaacatgacaacagtctgcaataaaggccatgacaggactgttttgagaaacattattaatcaaaatacatgctctgcccatatgcaaacattacagatcatatcaaaattgccaagcatttagtttacaggcatccatagtgaaaatacttcggatggcaacaataagagagcagacaattgtagacattttgcactgtcatccatgatttttcacataaacagacgatatgtaaattgctagattgaattcccagagtcatttcaggttcttacaccagccaacattaaaaaagaactaaacttgtccagaatttagaggtaggaaattgaattcagaaacaggcagaaagtaaatgaaaatacctcctcaaacccatgatccatcattggaaaacccagttaatcatccttctattcctaaatacctggtacgccagaacacagaccacaactatcaccaaacacaagcaactagctaaacctctagctcctattaactatactcctaactgcaagctatggggaagaagggaaacagggacaagaaataagcttaatgggatcttgaattgcctcgaacccaaaccccacaacctaggtttcgccccatgccaccagcaatggctgagctgatgacaaaaaaattaacagccatttgcatctgccaacttctcggttgcagatttcaggtcttctggggcaacaccatttcctatcgcatcatttttctctccagctttgtcaagtgaaggctctttgttcaagacatcaacctcaaccttggtaagttcagttgatccagtctcccccttgaggcttttcttctctgcatcagcagcattaggcagcttcacatcgatgacct

SEQ ID NO: 2013 - DNA, 1262 bp, Panicum virgatum
gggagagagagatatttcttgcatgcatccgaaagaaccagtggctctgggcattctacctcccctgcactccattccaagctctctctcccaccttctacccagcaaacaaacaaagcagcaacataaagatcaaacgagctcaacgactcgctcacctccggtcccgcgatcacacgcgagcgcgcccgatcgagcaatggcggccaaggtggcggcgccgctcgcgtttcgccgcgacgtgcgcggcccgctcgggcggccctgcctgggctcccggagcgggccacagggcgcgctgtggtgcagcagcgctggcgccgcgggaagcaggcccgcgccgccggtgtggctggcgcgcgcgcgggggaggaacaggtccgccggcgggcggagcccgaccaaggacgatgcggaggaggacgaggaggcggcggaggtggtgatcgtggacggcggagatgaggagttcgccgccgacgagctgtccgggttcaggggcctggttcttgatatctcctacaggcctgtcaatgttgtttgctggaagcgcgcgatctgcctggaattcatggagaaggccgatgtactggagtactacgatcagacagtctcttcgcctagcggatccttctacatccctgcagttctaagggttccacagctcctgcaggtagtgaagagaagaagagtcaagcaaagccttagccgtaaaaacattcttttcagggatgaattcacctgtcaatattgctcttctcgggacaacttgactattgaccatgtcattcctatttcacgtggcggtaaatgggaatgggaaaatttggtgactgcctgttcaagatgcaactccaggaagggtcagaagacactggagcaggcaaacatgaagctgcgcaagatacccagggcaccccaggagtacgacattatggctgtgcccttgacgaaatccgcattcaggacgctcaggaggagccaggggttgcctgaagtgtggctgcagtacctctccaggccatctccataatcaggagctccagacctgatcaaccagccatctggttgtaatattactaggcatgcgcagccaaaagtctcaattatctactctatcataacttctgtacatgtcaataattcgcagtaggaaaacatcaaactgactaatatatcatgcccccattccatggcaagttctgtacatgacaatggtcagcaataaaggctcacagaactgtttgcaagaatgtacacag

SEQ ID NO: 2014 - DNA, 1144 bp, Panicum virgatum
  misc_feature (451)..(451): n is a, c, g, or t
  misc_feature (517)..(517): n is a, c, g, or t
  misc_feature (550)..(550): n is a, c, g, or t
  misc_feature (598)..(598): n is a, c, g, or t
  misc_feature (634)..(634): n is a, c, g, or t
  misc_feature (664)..(664): n is a, c, g, or t
  misc_feature (685)..(685): n is a, c, g, or t
  misc_feature (700)..(700): n is a, c, g, or t
  misc_feature (727)..(727): n is a, c, g, or t
  misc_feature (751)..(751): n is a, c, g, or t
  misc_feature (1047)..(1047): n is a, c, g, or t
  misc_feature (1057)..(1057): n is a, c, g, or t
  misc_feature (1059)..(1059): n is a, c, g, or t
  misc_feature (1065)..(1065): n is a, c, g, or t
  misc_feature (1076)..(1076): n is a, c, g, or t
cagcaaacaaacaaagcagcaacataaagatcaaacgagctcaacgactcgctcacctccggtcccgcgatcacacgcgagcgcgcccgatcgagcaatggcggccaaggtggcggcgccgctcgcgttccgccgcgacgtgcgcggcccgctcgggcggccctgcctgggctcccggagcgggccacagggcgcgctgtggtgcagcagcgctggcgccgcgggaagcaggcccgcgccgccggtgtggctggcgcgcgcgcgggggaggaacaggtccgccggcgggcggagcccgaccaaggacgatgcggaggaggacgaggaggcggcggaggtggtgatcgtggacggcggggatgaggagttcgccgccgacgagctgtccgggttcaggggcctggttcttgatatctcctacaggcctgtcaatgttgtttgctggaagcgngcgatctgcctggaattcatggagaaggccgatgtactggagtactacgatcagacagtctcttcncctagcggatccttctacatccctgcagttctnagggttccacagctcctgcaggtagtgaagagaagaagagtcaagcanagccttagccgtaaaaacattcttttcagggatganttcacctgtcaatattgctcttctcggganaacttgactattgaccatgtnattcctatttcacgnggcggtaaatgggaatgggaaaatttngtgactgcctgttcaagatgcaantccaggaagggtcagaagacactggagcaggcaaacatgaagctgcgcaagatacccagggcgccccaggagtacgacattatggctgcccttgacgagatccgcattcaggacgctcaagaggagccaggggttgcctgaagtgtggctgcaatacctcgccaggccatctccataatcaggagctccagacctggtcaaccagccatctcgttgtatattactaggcatgcgcagcaaagactcaattatctgctctatcataacttctgtacatgtcaataattcacagtagnaaaacatcanantgactnattatcatgcncccattccatggcaagttctgtacatgacaatggtcagcaataaaggctcacagaactgtttgcaagg

SEQ ID NO: 2015 - DNA, 1293 bp, Panicum virgatum
cgaaagaaccagtggctctgggcattctacctcccctacactccattccaaagcgctctctctctctctcccaccttctacccaacaaacaaacaaagcagcaacaaaaagatcaaacgagctcaacgactcgctcacctccggccggtcccgcgatcacacgctagcgcgccggatcaagcaatggcggccaaggtggcggcgccgctcgcgttccgccgcgaagtgcgcggcccgctccgccggccctgcctgggctcccggagcgggctacagggcgcgctgtggtgcagcagtgctggcgccgggggaagcaggccagcgccgccggtgtggctggtgcgcgcgcgggggaggaacaggtccgccggcgggcggagctcgaccaaggacgatgcggaggaggacgaggaggcggcggaggtggtgttcgtggacggcggggatgaggagttcgccgccgacgagctgtccgggttcaggggcctggttcttgatatctcctacaggcctgtcaatgttgtttgctggaagcgtgcgatctgcctggaattcatggagaaggccgatgtactggagtactacgatcagacagtctcttcacctagcggatccttctacatccctgcagttctgagggttccacagctcctgcaggtagtgaagagaagaagagtcaagcagagccttagccgtaaaaacattcttttcagggatgaattcacctgtcaatattgctcttctcgggaaaacttgactattgaccatgttattcctatttcacgaggcggtaaatgggaatgggaaaatttggtgactgcctgttcaagatgcaattccaggaagggtcagaagacactggagcaggcaaacatgaagctgcgcaagatacccagggcgccccaggagtacgacattatggctgtgcccttgacgagatccgcattcaggacgctcaagaggagccaggggttgcctgaagtgtggctgcaatacctcaccaggccatctccataatcaggagcttcagacctgatcaatcagccatctcgttgtatattactaggcatgcgcagcaaagactcaattatctgctctatcataacttctgtacatgtcaataattcacagtagtaaaacatcatattgacttattatcatgctcccattccatggcaagttctgtacatgacgatggccagcaataaaggctcacagaactgtttgaaagaatgtacaaagtgaagctggtgcagaaaccagcctaacaacttgagaaagctccaatactta

SEQ ID NO: 2016 - DNA, 666 bp, Triticum aestivum
acaagccaacaaaccaaggtccgcccctaacaagcagttcccaaagctacaacttgagcacacacataagcaaagccatggcaaaggcacaggcaatggccgcgctgatgctgaccgtcttggtggtcctggcggcgtctgccgagatggcgcacggcgtctgcaacctgtcgagcgccggcatccgggcgtgccagccggcggcagccatccgcaacccgacggagcagccgtcggccgagtgctgcgccgcgctggcgggggccgacctggcgtgcctgtgccggtacaagaacgccgccggcgtgtgggtgaggttctaccggatcgacatcaaccgcgccatggggctgccgggcaagtgcggcctcgccatgccagccaactgctgaggcatggtcaccgtgcgtcactggctcatccacaataatgcaatgcaactgctgatgccgcgcgcgcgtgctgcgtgcgtattctactgctatatatagctacgacatctatcgaataaatgaaggcgcacacaaagatatgtgtgtgtctcctgtgcttctcctgggtgcacgtactgcactatgttgagctgtgggtgagcttattgatcagtgcagaagtttgtatacattactattctcaaagatgtattacacagtaagtattatgttt

SEQ ID NO: 2017 - DNA, 671 bp, Saccharum officinarum
acctgctacaagcctacaacacctctaacaagttcccaaagctacgagttgagcacatacataaccatagccatggcaaaggcaggggcaacggccgcgctgctgaccgtcttggtggtcctggcggcgtcggccgagatggcgcacggcgtctgcaacctgtcgagcgccggcatccgggcgtgccagcctgcggcagccatccgcaacccgacggacaagccctcggccgagtgctgcgccgcgctggcgggggccgacctggcgtgcctgtgccggtacaagaacgccgccggcgtgtgggcgaggttctacgggatcgacatcaaccgcgccttggggttgccgggcaagtgcggcctcgccatgccagccaactgctaatggtcactgtcacgtactggttcatcacaatgcaactgctggcgtgtgctgcatgcgccgttccatgcgcgcgtattctactgctatatagctacgacatgtatccaataaatgaaggcaaatatgtgtctcttgtgccgctgcaatatatttcagccgtgggtgagcttatttaggcaagggcacaagtttatattacaattggtccaactgtattatggtttacttggctcatatagtactccaaagctggggaaattaatatgaaagaacgacctttcatgcag

SEQ ID NO: 2018 - DNA, 817 bp, Panicum virgatum
cttaaccattggaaacaaaaccttttttccccgaaagaggcagcgtgtattaccaaaaactatcacaattttaccctataaataagactccccaaaccaaacactctccctcacaactccaaatcaaccaaatctagagcctaagcctaacaaccacccaaagctatacaacttccttgagcacataattaaccatggcaaaggcacaggcaatgggtgcgctcctgaccatcttggtggtcctagccacatcggccgagatggcacacggcatctgcaacctctcaagcaatggcatccgggcctgccagccggcggccgccatccgcaacccgaccgatcagccctcggcggtgtgctgcgccgccctggccggggccgacctgccgtgcctgtgccggtacaagaacgccgccggcgtgtgggtgaggttctacaggatcgacatcaaccgcgccatggggctgcccggcaagtgcggcctcgccatgccggccaactgctgatcatgactggcgatcagatgtgcgtagcgtgctgtctacatcggagcatgcacgcacattgctagtagtaattccgtattatatagctacgagattgaataaatgaagcacttaaaagactgataatgtctgtgcttctctctccaggtgatgcactgcaacatttcatatttgagctgcgaatgagctcatattaatcagtgcagaagaaagtgtcagaactgtcttatgtaatatgtgtcttttgtaactgcaaattaaagttgggcttattaatatgaatacatattggcaaatttggcatgaatata

SEQ ID NO: 2019 - DNA, 622 bp, Setaria italica
aaaacagccaaaccaataaatcgaggcccctatcttatttcccaaagctacaccttgaacacatatagtaagttagtaaccaatcaaccatggcaaaggcccaggcaatgggcgctctcctgaccgtcctggtggtcctcgccacgtcggccgagatggcgcacggcatctgcaacctgtcgagcaccggcatccgggcatgccagccggcggcggccatccgcaacccgaccgaccagccgtcgtcggagtgctgcgccgccctggcgggggccgacctgccgtgcctgtgccggtacaagaacgccgccggcgtgtgggtgaggttctacaggatcgacatcaaccgcgccatggcgttgccgggcaagtgtggtcttgcgatgccagccaactgctgatgatcaccggtgccttgctgcgtatacagctactactatgtagctacgtgatcgaataaatgatgcccgtaaaagacctgtgtgtcagaactgtattatgtattgtatgtcccgtccactgcaaagttggacgcatgagtatgaatggaggatctttcatgactctcacagagctttatttgtgtttgtcgagcaatccttaatgaaaatcatttgttttc

SEQ ID NO: 2020 - DNA, 312 bp, Setaria italica
atggcgaaggcacaggcaatgggcgcgctcctgaccgtcctggtgatcctcgccacgtcggccgagatggcgcacggcatctgcaacctgtcgagcaccggcatccgggcgtgccagccggcggcggccatccgccaccccaccgaccagccctcggcggagtgctgcgccgccctggcgggggcagacctgccgtgcctgtgccggtacaagaacgccgccggcgtgtgggtgaggttctacaggatcgacatcaaccgcgccatggggctgccgggcaagtgcggcctcgcgatgccggccaactgctga

SEQ ID NO: 2021 - DNA, 639 bp, Zea mays
tcgcaactcaacacaagcagccgaacctgctagaagcctatacacggccaaggtccaccgttcccaaatctacgacttgagcaaaaaccacagctatagccatggcaaaggcaggggcaacggccgtgctggtgaccgtcctggttgtcctggcggcgtccgccgagatggcgcacggcgtctgcaacctgtcgagcgccggcatccgcgcgtgccagcccgcggcagccatccgcaacccgacagaccagccgtcgtctgagtgctgcgccgcgctggcgggggccgacctggcatgtctctgccggtacaagaacgccgccggcgtgtgggtgaggttctacaggatcgacatcaaccgcgccatggcgctgccgggcaagtgcggccttgccatgccggccaactgctgatgtgctcactcacactccaactgcatgcatgccgtgctgcgtgcgcagctaagtttattacatgcgcgtcaaggcgcatgttctactgctatatagctacgacatctatgcaataaacgaaggcatgcacacaatgatacgtgcctcgtgcatgcagtgcaatatgtcgatgaactatgggtgcgtacgtgagcttaagcttattaatcagtgcagaagtttatgt

SEQ ID NO: 2022 - DNA, 1048 bp, Panicum virgatum
aaaagacttgtcctagcaaaattgaataaaccttgtacattcaaactgaggaagtacgatggaactgatgcactctttggttccttaaattgttgacaatgtacgtgactaacatccactcctttgtggtgttctcatacatttcaaggattgtcgaatttccttctagtgctgatggaggccggggagtgtggactgaaccgtcactacagctcatttgtctgtaagaaaacagtattaaaactttttagtgccaaaattcacatgtgcattcacaagtggggaacaagcttcgtttttgagggaacatgtacttgaaaacaagttgtggagaaacatggatcacattaaaatatcaaaaagagggagctactagtcagccaaactactaacttttgccctataaataagaccccgaaccaaacactctcctcacaactccataacagccaaaccagcccccagcaatctcccaaagctaaaacacacacacaggaacctaataaccatggcaaaggctcaggcaatgggcgcgctgctgaccatcttggtggtcctcgccatgtcctccgaggtggcgcacggcatctgcaacctgtcgagcgacggcatccgggcgtgccagccggcggccgccatccgcaacccgaccgatcagccctcggcggcgtgctgcgccgccctggccggggccgacctgccgtgcctgtgccggtacaagaacgccgccggcgtgtgggtgaggttctacaggatcgacatcaaccgcgccatggggctgcccggcaaatgcggcctcgccatgccggccaactgctgatgatccccagtattgtcttgctgagtgcgtcgttactcgttacaactactatatatagcttcgagatcgaataaatggagtacactgtaagtctgtaacattgagctgtcagctaagtgagattgttaaatcagggcagaagtaagtttcagaactgtattatgcaatacatggtccactgcaaagttggacgcatgatgagtatgaatggaggacctttgtttcatg

SEQ ID NO: 2023 - DNA, 857 bp, Panicum virgatum
tttcacatgttcattcacaagtggggaacaagctacttttttgaggggcgatgcacttgaaaacaagttgaggagaaaatgcatggatcacattaaaatatctgaaacagggagctaccagtcagccaacaaactactaatttttgttctataaataggagccccgaaccaaacactctcctcacaactccataacagccacaccagccctccgcaatctctcaaagctaaaacacacacacacacacagttaccaaaataaccatggcaaaggcccaggcaatgggcgcactgctgaccatcttgttggtcctcgccatgtcctccgaggtggcgcacggcatctgcaacctgtcgagcgacggcatccgggcgtgccagccggcggccgccatccgcaacccgaccgaccagccctcggcggcgtgctgcgccgccctggcggggccgacctgccgtgcctgtgccggtacaagaacgccgccggcgtgtgggtgaggttctacaagatcgacatcaaccgcgccatggggctgccccgcaagtgcggcctcgccatgccggcccactgctgatgatcttctccagcattgtcactctcgttataactactatatatacatgtgtagcttcgagatcgaataaatggggtatactgtaacattgagctgtaagctagtgagcttgttaaatcagggcacaagtaagtttcagaactgtactacgcaatacaacatgtcccgtccactgcaaagttggacgcatgatgagtatgaatggaggacctttgtttcctgcatctcacggagatttattcttgcgtgtctcgagcaactcttagtgaaaataattcaaaa

SEQ ID NO: 2024 - DNA, 809 bp, Zea mays
aatccagcaaggcgggcagacgagccgagagtgagacaaccatggcgtctctggccctccgccccgtcatcccggccaccaccgcttcatccaggaccctcacgatcgtcgttggctcccgctcctgccacgctgccacactccaccgtggctttcgctcgcggcgcctcatcacctgcaaggcggagccgagcggcggcaacagcaccctcgagctgggcgcaggggccgcagggctggcatcgagcgcggtcgtggcgtggtccctctacacgctgaacacgacggggtgcggcctgcctccaggccccggcggcgccctcggcgccgcggagggggtcagctacctcgtcgtggcgggtctagtcgggtggtcggtcaccaccaaggtgcgcactggctcgggcctcccggctggcccctacgggctcctcggcgccgctgagggcgttgcctacctcaccatcgcggccattgccgtcgtcttcggcctgcagttcttccagcaggggtccatcccgggtccgctgccatcggagcagtgttttggctgactgtgtattactcattcggttggatgtctgttgccgagtgtgccctgctatatacacataacttttattattaagtaaatttctagcattttagttagagatttaagtttctgtaattccttctccaagattggcaaaggctctcttttggatacaaagcagcctgactcgaggaatcgaaggatttcctgtttttgttttccaaataaatataaatataagagaaccgttaattatattaaaaatatccctttt

SEQ ID NO: 2025 - DNA, 920 bp, Panicum virgatum
cagcagcagaggataagcccctagcccccatccaccaaagagaacctcccgctcgtctgctccaatccagcaaggcaggtagtagccatggcgcctctggctctccgccccaccatctcggccaccgccgcctccacgacgcttgcgaccgttggctcccgctgccgccacgctgccaacccccgccggcgccccaccatcacctgcaaggcggagccgagcggcggcaacagcaccctggagctggccgcgggcgccgccgggctggcgtcgagcgcgacggtggcgtggtccctgtacacgctgaacacgacgggctgcggcctgcccccgggccccggcggcgccctcggcgcggcggagggggtcagctacctcgtcgtggcggccctggtcgggtggtcggtcaccaccaaggcgcgcacggggtcgggcctcccggccggcccctacggcctcctcggcgccgccgagggcgtcgcctacctcaccgtcgcggccattgccgttgtcttcggcctgcagctcttccagcaggggtccatcccgggcccgttgccgtcggagcagtgctttggctgaccctgtatctcatccccttcacccggacccggatcggatgcagtcatagctacgactgcaacttaagcggtacaactacatctgccgtccaaaagctaaccgacgctccagatttacagctagcccactatttcttcccctcccaaactcttcttccttcgttcattgcatctgctcaggtccgccgtcggctgcacggcctgcaccgaggactgcgccgcgctgtgggaggacgcgaaggaggacgtcgcgaacatggcgggcaagatgaagaaggccaaacaccaccggcgaagggtgaaggccgcagtggccatgctgtggagctgctcgagatt

SEQ ID NO: 2026 - DNA, 1155 bp, Panicum virgatum
tcgcaaaggagtgtctacacagcagtgcaagtgtgcaacagaggataagccccaagcccccatccactcgcagaaggcagaacctcccgctcgtctgctccaatccagcaaggcaggtaagcagccatggcgcctctggccctccgccccaccatctcggccaccgccgcctccacgacacttgcgaccgttggctccctttgccgccacgctgccaaatcccgccggcgccccaccatcacctgcaaggcggagccgagcggcggcaacagcaccctggagctggccgcgggtgccgccgggctggcctcgagcgcgacggtggcgtggtccctgtacacgctgaacacgacgggctgcggcctgcccccgggccccggcggcgccctcggcgccgcggagggggtcagctacctcgtcgtggcgggcctggtcgggtggtcggtcaccaccaaggcgcgcacggggtcgggcctcccggccggcccctacggcctcctcggcgcctccgagggcgtcgcctacctcaccgcagccgccatcgccgttgtcttcggcctgcagttcttgcagcaggggtcgatcccgggcccgttgccgtcggagcagtgctttggctgaccctgtagctcatcccgctcacactttgccggctgcaaagctctacggttgggtattgctgagagattgaatgtgtactctgcgatctgttgaactgcagtatatacatgcgtgtccgttggtgactgtagatctgtagtttttcaatctgagcttccatttttgcctacttcactggttcttgagctgagacgttttcttttgaggtttctgtgttcaaggattgggtagattcttcagaatttgagaaaatgagaccaaattttgaaatgtagctgcgattgcaagaatggagcactgctggataaggtttaaaaatagagttctggaaaacagctgtagaaatcctacggctgcctacggttgcgcctgtttggtttgagccagccatttgctgcctgggccaggcagcacctccaggccgtcgatttcatcagcctggggttcagattgctgcctggaagcagctgcctggctcaggcctccaaccaaacaagccggtgcgtgtcgctggtgtcatccatctctgaccct

SEQ ID NO: 2027 - DNA, 706 bp, Panicum virgatum
  misc_feature (195)..(195): n is a, c, g, or t
  misc_feature (198)..(198): n is a, c, g, or t
  misc_feature (257)..(257): n is a, c, g, or t
  misc_feature (281)..(281): n is a, c, g, or t
  misc_feature (452)..(452): n is a, c, g, or t
  misc_feature (530)..(530): n is a, c, g, or t
  misc_feature (542)..(542): n is a, c, g, or t
ccaatccagcaaggcaggtagtagccatggcgcctctggctctccgccccaccatctcggccaccgccgcctccacgacgcttgcgaccgttggctcccgctgccgccacgctgccaacccccgccggcgccccaccatcacctgcaaggcggagccgagcggcggcaacagcaccctggagctggccgcgggcnccnccgggctggcgtcgagcgcgacggtggcgtggtccctgtacacgctgaacacgacgggntgcggcctgcccccgggccccggnggcgccctcggcgcggcggagggggtcagctacctcgtcgtggcggccctggtcgggtggtcggtcaccaccaaggcgcgcacggggtcgggcctcccggccggcccctacggcctcctcggcgccgccgagggcgtcgcctacctcaccgtcgcggccattgccgttgtnttcggcctgcagctcttccagcaagggtccatcccgggcccgttgccgtcggagcagtgctttggctgaccctgtatntcatccccttcnccctttgccgattgcaaaattctggttgggtgttgctgagagtgagtgagtgtatgcgatctgtttaagtatatatgcctgtccgttggtgattgtagatctgtagttttgattggctgccggcctgcacatcgatttgataacagctgagatactcgagcatc

SEQ ID NO: 2028 - DNA, 1998 bp, Sorghum bicolor
tatcgccataacctttggcatctttctctcgggccactgcaaccttgaagtggtccgacactacttgtggtctgccactcatgaagcatgtgaaaatgaagcgcaaagtgaataggaacaaattagagccaacggtcaggcaacaagacatgagcatctgaagtactcaatccatcccaaatttgtgcacaccacacacgggcactgcgctaaagttagcactagcagatcggccggacgacagtcctagccagtagctagctagcaatggttgaccttcgtctccaggtcgtcgccaccgtcctgggcatggtggccctggcggccgctgccggcggcagcagctccagcggcaagcagtccgagttccaggaggtcaccgtggacgccatccatcagggcttcaagaacggcagtctcacctcgacggcgctcgtccggttctacctggaccagatcgcccgcctcaacccgctactccacgccgtcatcgaggtgaacccggacgcgctggcgcaggcggcgcgcgccgacgcggagcgctcggcctcccgcggccgctgcgccgtcggcctgcacggaatccccgtcctcctcaaggacaacatcgccacgcgcgacaggctcaacaccacggccggctccctcgctctgctcggctccgtcgtcaggcgcgacgccggcgtggtggcacgcctccgccgcgccggcgccgtcatcctcggcaaggctaacccttccgagtggtccaacttccgccccgtcgagtccggctggagcgcccgcggcggccagacgctgaatccatacgttctgtccgcgacgccatgcgggtcgagcgccgggcctggcgttgccgcggcagccaacatggcagcggtgacactgggatccgagaccgacggctccatcctctgcccatcgtcgttcaactctgtggttggcatcaaaccaactgttgggttgacaagccggtccggtgtcatccccatcactcctcttcaagacactatcggaccaatgtgtcgtacagtatccgatgctgtccatgtgttggacgtcattgtcgggtatgacgagcttgatgctgaagccaccggagcagcgtccaagtacatcccgcacgggggatacacgcagttcctgaggatccatggattgaagggcaagaggatcggtgtcctcgatgtgctttttcaaggatacgatgacatgcaactggcggtttacgagaagcatctcgatacaatgaggcaacaaggtgctgtcttgatcaaggatcttgaccttgcaacaaatttcactgatctgggtgagcaagagattctgctgatgaatgcagagttcaagttaagcatcaatgcttatctgtcggacctactgtactctccagtccgctcccttgcacagatcatagccttcaacgaagcacatcctgtagaggagagactgaaagattttgggcagccgaacctgattgccgcggaggaaaccaatggcattggcaccagggagagagctgccatccagcggctcaaggagatctcaaccaatgggttggagaagctgatgaaagaacaccagctggatgcaattgttggggccaacttcctcagcttccgtgttcttgccatcggaggctatccgggcatcgccgtgccagcagggtacgacaaggaaggagtcccctttgcgatatactttggtgggctcaagggctacgagccaaggttgattgagattgcttatgcattcgagcaagctaccaaagtcagaagaccaccatctttcaagagctagctaacaggaagtaactagcatgatggcagctggcaggtcatatggaatttaatggaaataattccaggggaagtaatcaccttggaaaaaaaatattggagtgtttttatttgagcaatcacttgatatacaatagaacgattcattgtgagaccatcccataatttttggctggataaaccaatctctcgttgttaa

SEQ ID NO: 2029 - DNA, 1969 bp, Zea mays
gacatgagcatctgaagacacgcagtgtggcagtgtgctgtgcacaccacacgatgcacaagcgctgaagataaagcaagcaccagatcgtcccgacgacagtactagccactagctagctagcgtcgcgatggttgacctgcgcctccaggtcgtcgccaccgtcctgggcgtggccctggcggccgctgccgccggcagctccagcggcaagcagttcgagttccaggaggccaccgtggacgccatccaccagggattcaggaacggcagcctcacgtcgacggcgctcgcccggttctacctggagcagatcgcccgcctcaacccgctgctccgcgccgtcatcgaggtgaacccggacgcgctcgcgcaggcggcgcgcgccgacgcggagcgcgccgcctcgcgcgggcgctgcgccgtcgggctgcacggcatccccgtcctgctcaaggacaacatcgacacgcgcgaccggctcaacaccacggccggctcgctcgcgctgctcggctccgtcgtcaggcgcgacgccggcgtggtggcgcgcctccgccgcgccggcgccgtcatcctcggcaaggccaacccctccgagtggtctaacttccgccccgtcgcctccggctggagcgcccgcggcggccagacgctgaatccatatgttctctcggtaaccccatgcgggtcaagcgctgggcctggcgttgcggcggcagccaacatggcggcggtgacacttggatcggagaccgacggctccatcctctgcccgtcgtcgctcaactcggtggtcgggatcaaacccactgttgggttgacgagccgatccggtgtcatccccatcacgcctcttcaagacactattggaccaatgtgtcgcacagtttcggacgccgtccgtgtgttggacgtcattgtcggctacgacgagcttgacgctgaagccaccggagcagcgtccaagtacatcccacacgggggttacacgcagttcctgaggaccaacggactgaggggcaagaggatcggtgtccccgacgtattttttcaaggatacgacgatatgcaactggcggtctatgagaagcatctcgatacaatgaggcaacaaggcgccgtcgtgatcatggatcttgacatcgcaacaaatttcaccgatctgggtaaccaggagattctgctcatggctgcagagttcaagataagcatcaacgcttacttgtcgggcctactgtactctccagtccgctctctcgcacaagtcatagcgttcaacgaagcgcatcctgtagaggagaggctcaaagattttgggcagccggatctgatcgccgcggagaagaccaacggcatcggcacaagggagagagctgccatccggcggctgagggagatctccaccaatgggctggagaagctgatgaaggaacgccgcctggatgcgatcgtggcgcccaacagcgacgcctcctctgttctcgccgtcgggggctatccgggcatcgccgtgccggcggggtacgatgagcaaggagtccccttcgcgatctgcttcggtgggctccagggctacgagccgaggttgattgagatcgcttatgcgttcgagcaagctacaaaagtcagaagaccgcctactttcaagagataaagatagctaactagcatgatgacacgcagtagcagtaagggatccttcaaactttttttgtggtgttattatttgaggaatcccttgctatatgaatgactcatcgtgagaccatttcattttttttgttcgataaatccaaccatcaacattaattagcagtgtgttggtttgatgaacgaggtggttcatcatcttctgacttatcactttttttctttgtttgatttgttagaattaaatgagttgatccatgtcattttatttcttatatgctaataattaaaaataatattaaaaataaattcattt

SEQ ID NO: 2030 - DNA, 1835 bp, Sorghum bicolor
gacctgcgcctccgggtcctctccgctgtcatggccttcgcggctgctgccggcagcagctccagcggcaagcagttcgagttcgaggaggccaccgtggacgccatccaccagggcttcaagaacggcagcctcacctcgacggcgctcgtccagttctacctggaccagatcgcccgcctcaacccgctgctccacgccgtcatcgaggtcaacccggacgcggtcgcgcaggcggagcgcgccgacgccgagcgctccgcctccggcggccgctgcgccgttggcctgcacggcatccccgtcctgctcaaggacaacatcgccacgcgcgaccggctcaacaccacggccggctccctggcgctgctcggctccgtcgtcaggcgcgacgcgggcgtggtgacccgcctccgccgcgccggcgccgtcatcctcggcaaggccaacccctccgagtggtccaacttccgccccgtcaattccggctggagcgcccgcggcggccagacgctgaatccatatgttctctcggcaagcccgtgcgggtcgagcgctgggcctggcgttgccgcggcagccaacatggcagcagtgacactgggatcggagacggacggctccatcctctgtccatcgtcgcgcaactctgtggttgggatcaaaccaactgtcgggttaactagccgatctggtgtcatccccatcatgcctcttcaagacacgattggaccaatgtgtcggacagtatccgatgccgtccatctgttggacgccattgtcgggtatgatgagtttgatgcagaagccaccggagcagcgtccaagtacatcccacaagggggttacacgcagttcctgaggatccatggattgaggggcaagagaatcggtgtccctgatgtgttttttcatggatatgatggcgtgcaaatggcggtttatgagaagcatctcgatacaatgaggcaacaaggcgctgtcgtggtcaaggatcttgacattgcaacaaacttgactgatctggatgaccaagagagtctgctgatgaatgcagagttcaagttaagcatcaatgcgtatttgtctgacctactgcactctccagtgcgctcccttgcagaggtcatagcattcaacgaagcgcatcctgtagaggagagactcaaagattttgggcagccggacctgattgccgcggagaaaaccaacggcattggcaccagggagagagctgccattcagcggctcaaggagatatccaccaacgggttggagaagctggtgaaggaacaccagctggatgcgatcgtggcggccaacagcgacgcctcctctgttctcgccgtcgggggctatccgggcatcgccgtgccggcagggtacgacaagcagggagtcccctttgcgatatgctttggggggctcaggggctacgagccaaggttgattgagatcgcttatgcgttcgagcaagctaccaaagtcagaagaccacctactttcaagagctagctaataagaactcaagaaggagctagcatggtggcacgtcataagaacactcccaatgcagaaactatcattgtttctatagattgtagtgtcatctaagcattttgctgatgtggtaatatagttattgaagagagagagtaaaagtcataaaaactgggtctaagttagaaaccatgtctacaaaaaatccaagacatgaagtgatatgattgactaagaatggagagagaatgaatgtgattggatataaaaatattctatagaaactatccattgagtccatagtttctatatatagtgtctaaaatttaatggat

SEQ ID NO: 2031 - DNA, 1730 bp, Setaria italica
cgcacactggattgttgcaccgcacaaagctatacctgccagtcggcgagagcacctagctatggttgacctgcgcgtccaggtcgtcgccgccgtcatgggcatggccctcgcgaccgccgccgccgccggcaccagctccagcggccggttcgagttccaggaggccaccgtggacgccatccagctgggcttcaggaacggcagcctcacctcgacggcgctggtccggttctacctggaccagatcgcgcgcctcaacccgctgctccgcgccgtcatcgaggtgaacccggacgcgctcgcgcaggcggcgcgcgccgacgccgagcgccaggcctcgggaggccgctgcgccgccgggctgcacggcgtccccgtcctcctcaaggacaacatcgccacgcgcgaccggctcaacaccacggcggggtccctcgcgctgctcggctccgtggtcccgcgcgacgccggcgtggtcgcccgcctccgccgcgccggcgccgtcatcctcggcaaggccaacccctccgagtggtccaacttccgccccgtcgagtccggctggagcgcccgcggcggccagacgctgaatccgtatgttctgtcggcttcgccgtgcgggtcgagcgccgggccgggtgtggccgcggcggcgaacatggccgccgtgacgctgggatcggagaccgacggctcaatactctgcccgtcgtcgtcgaactccgtggttgggatcaagccaacagttgggctgtccagccggtcaggcgtcatcccaatcacgccgaggcaagacaccatagggccaatgtgtcgtacggtatccgacgccgtccatgtgctggacgccattgtcggctacgataagctcgacgctgaagctaccggagcagcttccaagttcatcccacgtgggggttacacgcagttcctgaagatggatggattgaggggcaagagaatcggtgcccctgctgtatttttccaagggtacaatgacttccagacggcggtgtatgagaagcatctcaacacaatgagggaacacggcgctactgtgatcaaggatctcgacatcgcgacaaattttaccgatctaaatgcccaagagacgctcctgatgatcgcagagttcaagataagcctgaatgcatacctgtcagacctactgcgctccccggtccgctccctttcagatgtcattgcgttcaacaacgcacaccctgtagaggagaggctcaaagatttcgggcagccggacctcatcgcggccgaggaaaccaacggtattggcgtcagggagagagctgcgatccggcggctcgaggagatatccgccaacgggttggagaagctgatgaaggagcaccagctggacgcgatcgtggcgcccaacagcgacgcctcctctgtcctcgccgtcggcgggtatccgggcatcgccgtgccggcggggtacgacaaggagggggtccccttcgcgataagcttcggcgggctcaggggctacgagccgaggttgatcgagatggcctacgcgttcgagcaggctaccaaagtcagaaggccacctactttcaagcgctaggtagctagtaactgattagcttggcggcgcattacaagtaattttgtaacattatgaactccatggaaataatcacctcgtaacttcaatatcgttacgtggttacttttcactaagaattatgggttctcatctaaaa

SEQ ID NO: 2032 - DNA, 1974 bp, Panicum virgatum
aacgcatgacgccgctggcaattcctgccatcatggcctctgtatcttccttatcgccgtgttcgaccaaacaaaaaggcaattatcgccgtgttttttttcctcctcagtcctcaaagacgatggcgatggtcctgcgctcgtggtggcctgccactcaccaagcatctctgagaaagaaaaactaatcaggatttctgagcaagaacgtactccacgcacttcagtgagtacgcgcaccagtacccagctatggttgacctgcgtctccaggtcgtcgccgccgtcatgggcgcggccctcgccaccgccgccgccggcagcggccagttcgagttccaggaggccaccgtggacgccatccagctggggttcaggagcggcagcctcacgtcgacggcgctcgtccggttctacctggaccagatcgcccgcctcaacccgctgctccgcgccgtcatcgaggtgaacccggacgcgctcgcgcaggcggcgcgcgccgacgccgagcgcgcggcgtcgggagggcgctgcgccgcggggctgcacggcgtccccgtcctgctcaaggacaacatcgccacgctcgaccgcctcaacaccaccgccggctccctcgcgctgctcggctccgtcgtccgccgcgacgccggcgtggccgcccgcctccgccgcgccggcgccgtcatcctcggcaaggccaacccctccgagtggtccaacttccgccccgtcgcgtccggctggagcgctcgcggcggccagacgctgaatccatatgttctctcggccacgccgtgcgggtcgagcgccgggccgggcgtggccgcggcggcgaacatggccgccgtgacgctgggatcagagaccgacggatcaatactctgcccatcgtcgtccaactccgtggttggcatcaagccaacagttgggctgaccagccggtcaggcgtcatcccgatcacgcccaggcaagacaccatagggccaatgtgccgtacagtatccgatgcggtccatgtcctggacgccattgttgggtacgacgagcttgacgctgaagcgactggagcagcttccaagtacatcccgcgtgggggttacacgcagttcctgaggatcgatggactaaggggcaagaggattggtgtccctgctgtgtttttccaagggtatgatgacctgcatacggcggcatatcagaagcacctcaatacaatgaggaaacacggcgctattgtgatcaaggacatcgacatcgcgacaaatttcagtgatctgtatgaccaagagacgcttctgatgaatgcagagttcaagttgagcctgaatgcttatttgtcagacctgttgcgctccccggtccgctcccttgcagatgtcatagcgttcaacaacgcacaccctttagaggagaggctcaaagattttgggcagcccgacctcatcgctgccgaggcaaccaacggcatcggccccaaggagagagctgcgatccgacggctggacgagatttccaccgacgggctggagaagctgatgagggagcaccggttggacgcgatcgtggcgcccaacagcgacgcctcctctgtcctcgccgtcggcggctatcccggcatcgccgtgccggcggggtacgacagggagggtgtcccgttcgccatctgcttcggcgggctcaggggctacgagccgaggttgatcgagatggcctacgcgttcgagcaagctaccagagtcaggaggccacctactttcaagcgctagctaactgatttagcatgatagtgtattgtattcaaatttttatgaatataaaactccgagggaataatcaccttgtaacttgaataccgttatgaggctattcttatatctcgcaaaaacaatatttctagaccattagtaatgcttcctctgatctttattaagagatttgtgacactaaatctatccaactaatcattttca

SEQ ID NO: 2033 - DNA, 1795 bp, Panicum virgatum
aaaaaacttttacggaggaactaaacgagcccgagtacgcgcaccagtacccagcgatggttgacctgcgcctccaggtcttcgccgccgtcatgggtgcggccctcgccgccgccgccgccgccgccgggagtggccagttcgagttccaggaggccaccgtggacgccatccagctggggttcaggagcggcaccctcacgtcgatggcgctcgtccggttctacctggaccagatcgcccgcctcaacccgctgctccgcgccgtcatcgaggtgaacccggacgcgctcgtgcaggcggagcgcgccgacgccgagcgctcggcatcgggagggcgctgcgccgcggggctgcacggcgtccccgtccttctcaaggacaacatcgccacgcgcgaccgcctcaacaccacggccggctccctcgcgctgctcggctccgtggtccggcgcgacgccggcgtggtggcccgcctccgccgcgccggcgccgtcatcctcggcaaggccaacccgtccgagtggtccaacttccgccccgtcgagtccggctggagcgctcgcgccggccagacgctgaatccatatgttctcacggccacgccgtgcgggtccagcgccgggccgggcgtggccgcggcggcgaacatggccgccgtgacgctggggtcagagaccgacggctcaatactctgcccatcgtcgtccaactccgtggttggcatcaagccaacagttgggctgaccagccggtcaggcgtcatcccgatcacgcccaggcaggacaccatagggccaatgtgccgtacagtatccgatgccgtccatgtcctggacgccattgtcgggtacgatgagtttgacgctgaagcgactggagcagcttccaagtacatcccgcctgggggttacacgcagttcctgaggatcgatggactaaggggcaagagaatcggtgtccctgctgtgttttttcaagggtacgatgacctgcgtatggcggcatatgagaagcacctcaatacaatgagggaacacggcgctattgtgatcaagggcctcgacatcgcgacaaatttcagtgatctgcatgaacaagagacgcttctgatgaatgcagagttcaagttaagcctgaatgcttacttgtcagacctgttgcgctccccggtccgctcccttgcagatgtcatagcgttcaacaacgcacaccctgtggaggagaggctcaaagattttgggcagcccgagctcatcgcggctgaggaaaccaacggtattggccccaaggagagagctgcgatccgaaggctggacgagatttccaccgaagggttggagaagctgatgagggagcaccggctggacgcgatcgtggcgcccaacagcgacgcctcctccgtcctcgccatcggcggctatccgggcatcgccgtgccggcggggtacgacagggtgggaatcccgttcgctatctgctttggcgggctcaagggctacgagccgaggttgatcgagatggcctacgcgttcgagcaagctaccaaagtcaggaggccacctactttcaagcgctagctaactaattagcatgatggtgtagtagtcaattttatgaataaaacgccgtgggaataatcaccttgtaacttgaatatcgttatgaggttattctggtatctcacaaattaaaaacaacatttctagactatcagtaatgcttccctatgatccagaacacagaaccacccagattggctccatcaaataccagcatcaaatgcatagataaa

SEQ ID NO: 2034 - DNA, 1922 bp, Setaria italica
gcagaacatacacaccaatcgtccatggataggtcgtaggtggagtaggcgtggccgtggcgcacaccgattactggcgacagatctagtcaaaacaaaagaacaaaccgcacgtaatcatcagcattcagcaagcacgattcacacgagcgagccatcccactattatatgtgcacttcggcattcaattgccaagccacaagtgagggggggcagcactaaagctaagctacgtagacaaatccattatccagcatggctgcgccgcgcctccgagtgctcgccgccgtcgtggccctcgcggcggccggctgcggcgcgttcgagttccaggaggccaccgtggacgccatccagctgggcttcaggaacggcagcctcacctcgacggcgctggtccggttctacctggaccagatcgcgcgcctcaacccgctgctccgcgccgtcatcgaggtgaacccggacgcgctcgcgcaggcggcgcgcgccgacgccgagcgccaggcctcggggggccgctgcgctgccgggctgcacggcgtccccgtcctcctcaaggacaacatcgccacgcgcgaccggctcaacaccacggcggggtcgctcgcgctgctcggctccgtggtcccgcgcgacgccggcgtggtcgcccgcctccgccgcgccggcgccgtcatcctcggcaaggccaacccctccgagtggtccaacttccgccccgtcgagtccggctggagcgcccgcggcggccagacgctgaatccgtatgttctgtcggcttcgccgtgcgggtcgagcgccgggccgggtgtggccgcggcggcgaacatggccgccgtgacgctgggatcggagaccgacggctcaatactctgcccgtcgtcgtcgaactccgtggttgggatcaagccaacagttgggctgtccagccggtcaggcgtcatcccaatcacgccgaggcaagacaccatagggccaatgtgtcgtacggtatccgacgccgtccatgtgctggacgccattgtcggctacgataagctcgacgctgaagctaccggagcagcttccaagttcatcccacgtgggggttacacgcagttcctgaagatggatggattgaggggcaagagaatcggtgcccctgctgtatttttccaagggtacaatgacttccagacggcggtgtatgagaagcatctcaacacaatgagggaacacggcgctactgtgatcaaggatctcgacatcgcgacaaattttaccgatctaaatgcccaagagacgctcctgatgatcgcagagttcaagataagcctgaatgcatacctgtcagacctactgcgctccccggtccgctccctttcagatgtcattgcgttcaacaacgcacaccctgtagaggagaggctcaaagatttcgggcagccggacctcatcgcggccgaggaaaccaacggcattggcgccagggagagagctgcgatccggcggctcaaggagatatccgccaacgggttggagaagctgatgaaggagcaccagctggacgcgatcgtggcgcccaacagcgacgcctcctctgtcctcgccgtcggcgggtatccgggcatcgccgtgccggcggggtacgacaaggagggggtccccttcgcgataagcttcggcgggctcaggggctacgagccgaggttgatcgagatggcctacgcgttcgagcaggctaccaaagtcagaaggccgccgactttcaagcgctaggtagctagtaactgattagcttgacggcgcattacacgtaattttgtaacactatgaactccatggaaataatcacctcgtaacttcaatatcgttacgtggttacttttcattaagaactatgggttctcatctaaaatacatctatctcataatcgac

SEQ ID NO: 2035 - DNA, 1780 bp, Setaria italica
gcactaaagctaagctacgtagacatttccattatccagcatggctgcgccgcgcctccgagtgctcgccgccgtcgtggccctcgcggcggccggctgcggcgcgttcgagttccaggaggccaccgtggaggccatccagctgggctttaggaacggcagcctcacctcggcggcgctcgtccggttctacctgggccggatcgcgcgcctcaacccgctgctccgcgccgtcatcgaggtcaacccggacgcgctggcgcaggcggcgcgcgccgacgccgagcgccgggcctcggggggccgcctctgcgccggcggactgcacggcgtccccgtcctgctcaaggacaacatcgccacccgcgaccgcctcaacaccacggcggggtccctcgcgctgctgggctccgtggtcccgcgcgacgccggcgtggtggcccgcctccgccgcgccggcgccgtcatcctcggcaaggccaacccatccgagtggtccaacttccgcgcagtcaaggaaggctggagcgcccgcggcggccagacgatgaatccttatgatctctcggccacgccatgcgggtcgagctccgggccgggtgtggccgcggcagctaacatggccgccgtgacgctgggatcggagaccgacggctcaatcctctgcccgtcgtcgttcaactccgtggttgggatcaagccaacactcgggctgaccagccggtcaggcgtcatcccaatcacgccgaggcaagacaccgtagggccaatgtgtcgtacggtatccgacgccgtccatgtactggacgccattgtcggctacgataagctcgacgctgaagctactggagcagcttccaagtacatcccgcgtgggggttacacgcagttcctcagggccgatggattaaggggcaagagaatcggtgtctgtaatgtgttttttgttgggaaggataaagagcatttggacgtgtactcgaagcatctcgatacaatgagtcaacatggcgctatcctgatcggggatctcgacatcgcaacaaattttagtgatctaagcgacaaagagatgcttctgatgaaagcagagttcaagttaagcctgaatgcttacttgtccgacctgctgcactcaccggtccgctccctttcagatgtcatagcgttcaacaacgcacaccctgtggaggagaggctcaaagattttggacagaacgacctcctggatgcagagaaaaccaacggcattggcgccagggagagagctgcgatccggcggctcaaggagatatccgccaacgggttggagaagctgatgaaggagcaccagctggacgcgatcgtggcgctcaaatgggccgcctcctctgtcctcgccgtcggcgggtatccgggcatcgccgtgccggcggggtacgacaaggagggggtccccttcgcgataagcttcggcgggctcaggggctacgagccgaggttaatcgagatggcctacgcgttcgagcaggctaccaaagtcagaaggccgccgactttcaagcactagccagttcagtagtggcatgctgcaagaaattgcaataataattggtactctgcatggtaataatcggacgcatttgggaggtgaagaccttctgcgaaaatgctctgtttacaccggtcgtttatggtactagaacaatcggcgcaccatgcacgtcctaccatttcaataatcaaatccagcaatgggatcaaatgttgtttaattaaggtaatatagattcttcaccct

SEQ ID NO: 2036 - DNA, 1592 bp, Panicum virgatum
tttatgcagagggtgttgctaggcatctttgtctagctctgagtgttagccattcctttttgaattttaaagaaggtgttggatttcatctttttttactagttatttcgttttatataatagctatatcaaaattttagctattcatagatataaaagctcttgaagatgctctaacaattttcgtatgtgaaacattacaaaacctagtactacgacaaggaccgttactgaatttgaaaaaaaatgctcagactcttgttggaaaggcagatttctcaggagaagcgaattcttctttcgtgtaaaattcaagctcttgctgctcaggtttacaacagttcctgaaatcagaggcaatgatcccttggctggtggtcgtccttgatttctttgaaacgacgatcagtttcaaccgaaagctgccagtcctggtccgcacacttccaccaccacacatactctcggcagttcgttcggccggccggccgccgtggtgaaccatctcggacacgagctgcctgctcagcaccggtgaccactggccagccggccaaccagcctcgctgtgcctgcgtgcctgtgcacgctgcccgttcgaaagccaagtcaagacgggaacgcgccatggtcggccggctggccatggccaggccattaacgcctcctcctaccccacccctactcttccctccacttcccccaccactcccaccccgccatcaatgcgatccatatgccccgccttaaattcccctcggccccctcccgtcccccaccccgtcgcatctcgcattctcgcggaatcgcttgctgcttccctactggcgcggcctgccgctcgctcgctcgccattgctgacctcaccagcagcctcgtcaccgcgaggcgcgagttagttgcaggcctcgctccacattgccgctgccgctatataaagcacttgccgcacgcgaggagattagcctgttagttccgttggagagcggcacaagaaaccgaaggggatcaaggaaggtggggaggggagggatggtgttcttctgcttccttgtggaccagcggcggacggtgcggagcagcaagccggcggcggggatctgctcgcggtgcggcgggtgcgcgagcgtggcggacatggagaccgccaccagggtctgctacctgctcaccgtgcaccgccgcacctggcgcgccatcatctgcaccttctgcggcgccatgctcaagtcctaccgccactacaggctctactgatcgatctccatccacggctttcttcgtcgcctcgtgaggtgtagtcagctagctcgcgatctgcatgtgttcttggtcggtgatcttgctctcggcgtgcgactgttgttttttttttgttttgttcccgcttgattacgctcggtttgcagattgtaatggcagctcgcgcgcattgcctgtgcatgcatgtaaatttgggatgaactgtgccatgaagtgaaccctgtgtccgactaacaaagtcctcgcattgagtccgtatcgaattttcttctgaaacaaccctgtactctgtacaggctccacgttttgctctttcgagcccttacca

SEQ ID NO: 2037 - DNA, 1040 bp, Panicum virgatum
ccgccgccgccaccaccactcctaccccgccatcaatgcgatccatatgccccgccttaaattcccctctcggccccctcccccgtcccccccaccacgtcgcatctcgcggaatcgcttgctgcttcctactggcgctgcttgccgctcgccattgctgacctcacagcagcctcgtcaccgcgctccgcattgccgctgcggctatattagcacgcgccgcgcgcgaggagattagtttcgttggacagccgagcgagccgtgcaagaaaccgaaggggatcaaagaaggaagggagggagggaagggatggtgttcttctgcttcctggtggaccagcggcggacggtgcggagcagcaagccggcggcggggatctgctcgcgctgcggcgggtgcgcgagcgtggcggacatggagaccgccaccagggtctgctacctgctcaccgtgcaccgccgcacctggcgcgccatcatctgcaccttctgcggcgccatgctcaagtcctaccgccactacaggctctactgatctccatcgccggctttatttcttcatcgcctcgtgaggtgtagtcagctagctcgcgatctgcatgtgtttcttggtcggtgatcttgctctcggcgactattggattttttttttgttcccgcttgattatgctcggtctgcatattgtaatggcagctcgcattgcctgtgcatgcatgtaaatatgggatgaacatgaactagagccatgaagtgaaccctgtgtccgactaacaaagcgatccatatcttgttcatcctcctcacattgaatccgtatcgaattttcttctgaaataaacaaccctgtaaatagaggctccacgtttcgctcttccgaggtcttaccaacatgcacctggtgatctggaattactactactgttactgtggtaggatgagttctggtatctggtacacatctttgtgatgccatgcatggaggagatgcaagagaagtgttcagactgcctttctctgcgtaatcggccagcattcaccg

SEQ ID NO: 2038 - DNA, 503 bp, Panicum virgatum
gaaaccgaaggggatcaaggaaggtggggaggggagggatggtgttcttctgcttccttgtggaccagcggcggacggtgcggagcagcaagccggcggcggggatctgctcgcggtgcggcgggtgcgcgagcgtggcggacatggagaccgccaccagggtctgctacctgctcaccgtgcaccgccgcacctggcgcgccatcatctgcaccttctgcggcgccatgctcaagtcctaccgccactacaggctctactgatcgatctccatccacggctttcttcgtcgcctcgtgaggtgtagtcagctagctcgcgatctgcatgtgttcttggtcggtgatcttgctctcggcgtgcgactgttggttttttttgttttgttcccgcttgattacgctcggtttgcagattgtaatggcagctcgcgcgcattgcctgtgcatgcatgtaaatttgggatgaactgtgccatgaagtgaaccctgtgtccgactaac

SEQ ID NO: 2039 - DNA, 1065 bp, Hordeum vulgare
cgcacattgcctgcttactggctccccgccattgctgaccaaaatcacaaccaccaccacgcatcctcgcccgcggcccgcgactatatatataccccccgcgcgcgctgacgcagtggcagatcgcacaggcggcgcgcggcctagctagctgtattgcactgtccaccaccaccaggcaccatcatcaaatacctccggcgagagtttcagcgatatttctggagagcttggcgcggaaggaggagcggcggcatggtgttcttctgcttcctggtggaccagcggcggaaggtgcggagcagcaagccggcggcgggcatctgctcgcggtgcggcggctgcgccagcgtggcggacatggagacggccacccggctctgctacctcctcaccgtgcaccgcgtcacctggcgcgccatcatctgcaccttctgcggcgccatgctcaagtcctaccgccactaccggctctactagacccgcggtcgttgacgctgattgatctgcgcgcgcgacggccgtctccacccgcgtcccgtttgccgacggcggtggagcatgcatgtatgtgccagctagttttgtttgctccatctgcttattaatttgtgtttttagccgtgctctctagctagcttggccttggagattgttgcactggattcttgtggtcttatgtacatatagtattatgcaaggtggcaagtcttgattagtactccgagataaggttgcattgccctctcttctcgattagtatctccgtcaggaacaataggaattgttagcacgatctcatgcaagagagaagagggaagcattaggatctctatttgttatccatcactaattagttcctcttgtaatagcatggctgttcatacatttcccctctcctctccacggcattaaccgtgtgattcctcacaatattcatcttttcttcttgttgggaaaatcacacctttcatctgacaaggccctactatctactactgctatgagatattttttccaaataaacaaggacggggtatattcgtgttgcgttgtcgtcaaatt

SEQ ID NO: 2040 - DNA, 849 bp, Setaria italica
atgcgatccatatgccccgccttaaattcccctcgtccccctcccgtcccccacgtcgcatctcgcggaattgcttcctactggcgctgcctgccccctgctcctcgttcgccattgctgacctcacagaagcctcgtcaccgcgagttagctgcaggcctcgccccgctacgcattgccgctgccctgccgctatataagaaagcgccacacgcgagcagattagtctgttggtgttgttggagtctcggagagccgggccgcgaaagaaaccaaaagggaatcaaggagagggaagggatggtgttcttctgcttcctggtggaccagcggcggacggtgcggagcagcaagccggcggcggggatctgctcgcggtgcggtgggtgcgcgagcgtggcagacatggagacctccacccgggtctgctacctcctcaccgtgcaccgacgcacctggcgcgccatcatctgcaccttctgcggcgccatgctcaagtcctaccgccactacaggctctactgatcgatttcctccttccgcgcgcgccttgtgaggtgtagtgagctagtgatgatctgcatgtgttctttgttggtgatcttgctcgatctcgcggctattggattttttttttgggttcctgcttgatagattatgctcggtttgcagattgtaatggcagcttgcctgtgtgcatgcatcatgtaaatatgggatcggagccatgaagtgaaccctatttccgactaattaacaattgatccatatgaccatatcttcttcctcttcttgctgaagcaggagcgctttttttttattgtgaaacaacattgcagaagattcaca

SEQ ID NO: 2041 - DNA, 834 bp, Zea mays
actctaccaccccacccctgcccgccatcaatgcggtccatatgcgtgcgtcgccttaaatcggcctaccaccctccttcgcccccgccgcagcacgcagaattttcttactgctggctgctgctcgccattgctgaccacactcacagcagcctccctccccctcgccaccgaaagctagcccgttgcttgcaagcctcgccaactgccgctatatatacgcatacaagcgcgcgccgcgcacgcgcagcacgcaatcagaacagtggttgctggagagcgcgcgggccgggcaaggagcaaggacgagcagggtcgtcgatggtgttcttctgcttcctggtggagcagcggcggacggtgcggagcagcaagccggcggcggggatctgctcgcgctgcggcgggtgcgccagcgtggcggacatggagaccgccaccagggtctgctacctgctcaccgtgcaccgccgcacctggcgcgccatcatctgcaccttctgcggcgccatgctcaagtcctaccgccactacaggctctactgactctcggccgatcgacggagttgttcgagtcggtgggtggtggaggaacgcgcgccttcattcttcgcggcttgctgtgaggtgtagtgatgagctacgtacggtactagctagtgatctgttcttcctgatgagtcctcctctaactgggtgtcttgctcgcgactgctacaagctagattttgtttttgtttttgttttgttcctgcttgattatgctgctggggtttgcagatggttgtaatggcagagctgcgtgtaaatatagttatgtgtcatcactcatcc

SEQ ID NO: 2042 - DNA, 632 bp, Pennisetum glaucum
cgcgccacgcacgcgagcagattagtctgttagcgtcgttggagagccgagccagccgcgccagagaaaccaaaaaggaatcgaaggagagagagagggaagaggacgatggtgttcttctgcttcctggtggaccagcggcggacggtgcggagcagcaagccggcggcggggatctgctcgcggtgcggcgggtgcgcgagcgtggcggacatggagacctccacccgggtctgctacctcctcaccgtgcaccgacgcacatggcgcgccatcatctgcaccttctgcggcgccatgctcaagtcctaccgccactacaggctctactgattcacctcgatctcctccctccttccgcgcgcgccttgtgaggtgtggtgagatagtatagtgatgatctgcatgtgctctttgttggtgatcttgctcgatctcgcggctattggatttttccttcttcttcttttgggttcctgcttgatggattatgctcggtttgcagactgtaatggcagcttgcttgtgtgcatgcatgtaaatatgggatcggagccatgaagtgaagcctattttaccaaaactaaaaaaaaaaaaaaaaaataactactagacgttgataccactagctt

SEQ ID NO: 2043 - DNA, 846 bp, Secale cereale
accgcccgcacattgcctgcttactggctccccgccattgctgaccagtgaccgcaaccaccaccttcccgccactatatatatacctccgcgcgcgctgacgcagtgacaaatcgcacgggcggcgcgcggcttagctgtatcgcactgtccaccaccaccatcagcagcaaatatctccggcgagagcttcagcgatatttatttctggagagcttgccgggaaggaggagcaggagcggcggcatggtgttcttctgcttcctggtagaccagcggcggaaggtgcggagcagcaagccggcggcggggatctgctcgcggtgtggcggctgcgccagcgtggcggacatggagacggccacgcggctctgctacctcctcaccgtgcaccgcgtcacctggcgcgccatcatctgcaccttctgcggcgccatgctcaagtcctaccgccactaccgcctctactaggccggcggccgacgctgattgatctgcgcgcgcgacggccggccggccaccgtctccacccgcgtccagtttcctgacggccggtgcagcgtgtatgtgccagctagttttgtttgctctgcttattaatttgtgcttaaggcatgctgtctagctagcttggaggttgttgcactggattcttgttgtcttatgtacatatattatccaaggttgcgttgccttctcttctttaattgttatcaccgtctagacccatgcataggattatttagcaagaatctcatgcaagagagaaggggggaggcgtcaggatctttgttatccatcactaattagctcctcttgtaatagtagcatggctgttcaataaac

SEQ ID NO: 2044 - DNA, 1057 bp, Triticum aestivum
ggaggaggagcggcggcggcatggtgttcttctgcttcctggtggaccagcggcggaaggtgcggagcagcaagccggcggcggggatctgctcgcggtgcggcggctgcgccagcgtggcggacatggagacggccacgcggctctgctacctcctcaccgtgcaccgcgtcacctggcgcgccatcatctgcaccttctgcggcgccatgctcaagtcctaccgccactacaggctctactagaccggcgattgatctgcgcgcgcgacggacgtctccacccgcgtcccgtttcctgacggccggtggactggagcctgcatgtatgtgctagctagttttgtttgctcgatctgcttattaatttgtgtttcaggcatgctctctagcttgagcttggagattgttgcactggattcttgtggtcttatgtacatatacggggtagtattctgcaaggtggcaagtcttgattagttatttaatttcctccgaaggttgcattgccttgtcttctcactctccgtcgagactgtaaaaactgagaaagggttttgctccttgcatacaataggtgccggctcctctgtttatatgcatagcaacgaggttgttgcgtccacaatcaggagctaacaaactgaatcttatggctttacaacttgatacgcaagtctagctaactatctggactctctacatcattgtctgcacaacatctacacgtatcttaacagacccataggattagttagtaggatctcatgcaagagagaaggggagaagtgtcagaatcttgttatccatcactaagtagctcctcttgtaatagtagcatggctgttcatacatttcccctctcctctccacggcattaacgtgtggttcctcacacttttcatctttctttgttgttcgagaaaatcacacttttcatctgacaaggccctattgtctgctactactatgagatatttcgaaataaacaagacgggggatatttgtgtggcgttgttgttaaaatttgttctgtcaattcctgcgatcttttttat

SEQ ID NO: 2045 - DNA, 622 bp, Festuca arundinacea
ggcacgaggctgactagctctccgccattgctgcccacaaccaccactgccttaccaccgcacggccagtctatatacacaggctgaagcggtgacagactaaacaggcgactcgagcgcggcttagctgtaaactaactaccacgcacgcagcacaaggcagagaaagctccgtccgcccggcgagaaggtgaccggcggcggacatggtgtccttctgcttcctggtggaccagcggcggaaggtgcgcagcagcaagccggcggcggggatctgctcgcgctgcggcggctgcgccagcgtggcggacatggagacggccacgcgcctctgctacctcctcaccgtgcaccgcgtcacatggcgcgccatcatctgcaccttctgcggcgccatgctcaagtcctaccgccactacaggctctactagcctgcgcgcgcgtgctagggctacggcaggaccttaattaatcgatctgcgcgcgcgcgacggacggccgaccggccggccggccaccatctccatcctcgtcacgtttcttgacggcggagagtatgcgctagctagttttggttgctgcttaatttgtttttcgagcatgttcctcttgctgcccttgc

SEQ ID NO: 2046 - DNA, 573 bp, Lolium multiflorum
gcgcggcttagctgtaaactagctactcacctcgcacacgcaccagagggcagagaaagctcgaaggtgaccggcggcgcgcggacatggtgtccttctgcttcctggtggaccagcggcggaaggtgcgcagcagcaagccggcagcgggcatctgctcgcggtgcggcggctgcgccagcgtggcggacatggagacggcgacgcgcctctgctacctcctcaccgtgcaccgggtcacatggcgcgccatcatctgcaccttctgcggcgccatgctcaagtcctaccgccactacaggctctactaggccgcgcgcgcgtgctagggctacagcaggaccttaattaatcaatctgcgcacgcgcgacggacggccggccggccaccatctccatcctcccccgtccttggtggccttcttgagccagccatctcgtttcttgacggtggagaggagtatgtgctactcctagttttggtttgctgcttaatttgtttttccagcatgcctttgatgccttgggagattgttgcactaagcatgcatcctgtacatagtattatggtgg

SEQ ID NO: 2047 - DNA, 990 bp, Oryza sativa
tccagccatcaagccgacatgccattaatacctccacccccttctctcctctcctacccgctacctcactaccaccgccatcaatgcgatccatatgctctcctccttaaaacccccctgcgccatcctccaccaccacctccgccgccgtcagagaccaccactccacacatcgtgttatttgagattccggcgagccggccggccggagacgaggaggatggtgttcttctgcttcttggtggaccagaggaggaaggtccggagcagcaagccggcggcggggatctgctcgcggtgcggcgggtgcgcgagcgtggcggacatggagacggcgacgcgcttctgctacctgctcaccgtgcacagggccacgtggcgcgccatcatctgcaccttctgcggcgccatgctcaagtcctaccgccactacaggctctacgccagctagctctacgctacctacgatcgccggccgccggcggtgatggccggagagagagagaggaggaggcgacctacttgctgcgtacgtctctgtgctctctgcgaggtgtgcttgttgcgttgggccttggctactagtactactattggaggagtattaattaattggctttgttgatttcttgcaaaatgctaagctttgcatgcagcttgtaatccctgtgcatgtagtatgttgtacatatgctggagatgaagagaggaagttgattaaatttttgttaccggtttcattagcagagcctatgtgtgatcgatcttttaattatttcttctaatagaattatagaaaagatcagggaggttatgatatttgaaggggcatcactcatcagtactactacttttgctcgcatgactgctcatacatttttcttgtctcgccttgatccatcatatcatggcttgaacgtgattagtcacaccattgagagcggctggccatgagatatttcgaaataaataaagacccatttttctcta

SEQ ID NO: 2048 - DNA, 1175 bp, Brachypodium distachyon
aaagacaacttagtcaagaagcataagcggcagcaggggggccattatggccacccgtacccggcacccgctacctccccactgcagagcgccaagccatgaatgcgatcctcaagcgccctcgtcttaaatccttcctacccccgcccaggcccttcccccgtgactccgtcaaccgcaccgccgcacattgcttgttggctctccagttctccaccaccattgctgactgaccacaacaaccaccctctccacggcgcgccagtccgccagtatataaacacccgcgctagctgacgctgtgcccagagaaattaacaggcggcggggctcatatatatcatctgtgttgattacttgattgggcgaggagaaaggaggatcgaggatggtgtcgatgtgctttttggtggagcagcggcggaaggtgcggagcagcaagccggcggcggggatctgctcgcggtgcggcgggtgcgcgagcgtggcggacatggagacggccacacgcctctgctacctgctcaccgtgcaccgggtcacctggcgcgccatcatctgcaccttctgcggggccatgctcaagtcgtaccgacactaccgcctccactactagccgccccccccccccccccccccaacaatctgcgcgcagggcgccggccggccaccgcgcccatgtacgtggtctgcgcgtctcgtttctctgacgtgcgtacggtacggcggagtactacgcgcttgcttgctagttttcgtttgattaattagttggttttcctgctctatcttggagatggatttcattgcactggcatctccttgttatgcacatacagtaatatggaagacgagaagtcttgattaatttttacttacataattaagcttccagctgcaaatgttccgtatgcatgcatatattgcccttgcgccctttcatctcttttcttttcactacgattcatacagaaggagcatatggatcattgaaatacacaattaattaattggtagctttctcttcgaattgcatgactgctatcatacatttccactccgcagcatataaagtgtgattggttcctcacacctttcagaaaacctgttgtccactgtactgagatactgctactatttccgaaataaataaggacagtgtagggcatatttgt

SEQ ID NO: 2049 - DNA, 420 bp, Elaeis guineensis
ttgatttatcgtgaagagcggtcacgagagggggatggtgttcttctgctttctggtggaccagcggcggatggtgaggagcagcaagccggcggcggggatctgctcgagatgcggaggatgcgccagcgtcgccgacatggtcaccgccacccgcttctgctacgtccccgtctaccgccggacctggcgggccatcatctgtaccttctgcggcgcccttctcaagtcctaccgatagaatatatctatctatatataaatatatatagggacagagagttgcttcccagtttgctgcggccggcgttgcaccatgccaccgccaccaagtaatttgttttctttctctctttttttttcttatgtgtttcccgttggagagggtggtatggatgtgagggatttctagggaatggc

SEQ ID NO: 2050 - DNA, 970 bp, Sorghum bicolor
tgcaggacgactgccatagcttcctagctagcacgaccacaggcgctagtagctaataagctactgagtatagcttgtagctagagctctatctcaaagccagcagtgatggccgcggcagccctgaggcccctgacggctccgaacgcggcgctgccgccgagggggccggggaaggagcaccggacggcgatcacggtgccggagttcaagcgctgggtgaagcagttcgacaccgaccacgacggccgcatcagccggaaggagctccgggaggccatccgccgccggggcgcgtggttctccggcctgcgcgcactgttcgctgtccggcgcgccgacaggaaccgcaacgggttcgtggacgactccgagatcgagggcctcatcgacttcgccgagagggagctgggcttcaggatcacaacggaatgaacggcggcgcgatgagctagtctgtcgtctcgtctgctccgatcctctctacagctacaggtcgccgacgacgtacatgccggcgtatattgtactgtgtactgtattgacgtaattacgtgacacgtacttgattaattatgtacggtctgtgtagttttttttcgctgtgtagtgctagcactgtactactagtagttttgttatttttctttttctttttcttttttctgtgtgtcatcgtacctagtagctgctacctccacgtactttctcctctgaataatttgtgtcgaagcaggagagggtcgaatcatgtctgtgtacatgctagcagcttgttaagtgtactgccgcgtgaagtgatgatgctaccgtaccgtttgtataattgtttgtagcaatccatccattccatgtgctatatcactaccagactaaggattattcatttctgacggttttctaaaaaccaacagaaaccaaaataaagtccggtgggttttggtaatgctatggtacactttttacttat

SEQ ID NO: 2051 - DNA, 591 bp, Triticum aestivum
ccatagcttcctagctagcacgaccacaggcgctagtagctaataagctactgagtatagcttgtagctagagctctatctcaaagccagcagtgatggccgcggcagccctgaggcccctgacggctccgaacgcggcgctgccgccgagggggccggggaaggagcaccggacggcgatcacggtgccggagttcaagcgctgggtgaagcagttcgacaccgaccacgacggccgcatcagccggaaggagctccgggaggccatccgccgccggggcgcgtggttctccggcctgcgcgcactgttcgctgtccggcgcgccgacaggaaccgcaacgggttcgtggacgactccgagatcgagggcctcatcgacttcgccgagagggagctgggcttcaggatcacaacggaatgaacggcggcgcgatgagctagtctgtcgtctcgtctgctccgatcctctctacagctacaggtcgccgacgacgtacatgccggcgtatattgtactgtgtactgtattgacgtaattacgtgacacgtacttgattaattatgtacggtctgtgtagttttttttcgct

SEQ ID NO: 2052 - DNA, 690 bp, Saccharum officinarum
atagcttcctagcacgaccacaggctagctcataagctagctagtagctagagctccaggcccgagcagcagcagcagccatggccacggcagccgtgcctccgaacgcggcgccgccggcgtcgaggggcccggggaaggagcaccggaccgcgatcacggtgccggagttcaagcgctgggtgaagcagttcgacaccgaccacgacggccgcatcagcaggaaggagctccgggaggccatccgccgccggggcgcgtggttctccggcctgcgcgcgctgttcgccgtccggcgcgccgacaggaaccgcatcgggttcgtggacgactccgatatcgagggcctcatccacttcgccaagagggagctgggctttagactcacaacagaatgaacggcggcgcgatgagctaggctgtcgactgatcctctttactgctacaggtcgacgacgtacctggaggcggatattggactgtgggctgtgtatcgtgaaaggacttggaatagtctcaacggaatgtgatggtggctagtctagatctaagacagcgttttgtttatgttgacctgtaatgggtaagtggtaacttgtattttgtttcagcatttgattttgagataatgtgatagtggaaatggggaagtgcggtttcgaagtacatggtatgtgacaaatgatagtt

SEQ ID NO: 2053 - DNA, 799 bp, Zea mays
caagagtattttggggaatgggaatatatagggatccaaataatcaaatttgccctccctcaccaagtcgaggaccccctccgaatccgagggttcaagcgaccgacggcgaacatggcggcggacggcggcccagcgacgtcggcgctggaagaggccctcaagcccttccaggaaagagcctccgaggctgagatacgcatagcgaagctggaagccttgctgtacaacaaagatggtccgagcggtggatccgaggcaacttcctctgccgtgaaggatctccagtcgaagctagatgtggttactgcagaatgcttgactgaaaaggagaagaacaagaagctgaccatggagaacgagaagctccagtaccgcatgacccatctgattcgtgcgataaaagaggcggaatcgagataggagcagcccggcgaggccgattcaaagcctgatgtcgaagtgttccccacccgccttgctgatcctacacgctgttcctgcatctacctcaagttatcattgtgatcttgagatagagcttggtcacaagtcaagactgtattatcaaactgtcgattgaaaatgatgatgtgtgcacagctttctgtcttcacctgaccccatctcgaagggcacattggaacacaaaatgttatctgaaatgacagttcatattttgaaacatttcgcccccacttcatttatgcctaggggaatgttggtgatctactgagctgataatggagagccggatgttggtgatctactcagctgataacggttggagcaaagaggg

SEQ ID NO: 2054 - DNA, 643 bp, Panicum virgatum
ctgaataaaaaaatcgacccactgaaatcacttgaccagctggaacctggaagactgatccgaatccgagggcacgcgaggggttcaggcgaccggcggcgagcatggcggcgggcgacggcagcgcgacggcggcgctgggcgaggctctcaagcccttccaggaaagagcctccgaggctgagatacgcatagcaaagctggaagccttgctgtacaacaaagatggcctgaacaacggatcagagacaagttcttctgccatgaaagatcttgagtcaaagctagacgcagttagtgcagaatgcctgaccgaaaaagagaagaacaagaagctaatcatggagaacgagaagctccagtaccgcatcacccatcttatccgtgcaataaaagagacagaatcaagatagaagaagcctgataaggccgatttaaagcctgatgttgaagtatcctatcttgttggtgagcttaaactatttgttgtgatattgatataggtcttggtcaaaaactgtatcgatctaccgatcaggacgctattatatgtacacgatcgtctgtgttcacctgaccccattttggttaggctttgggcgttgaaccgtggtccgtggaatgcatgatgtgttatctgtca

SEQ ID NO: 2055 - DNA, 777 bp, Panicum virgatum
aaaaaaaaaatcgcttgaccagctggaacctggaagactgatccgaatccgagggcacgcgaggggttcaggcgaccggcggcgagcatggcggcgggcgacggcagcgcgacggcggcgctgggcgaggctctcaagcccttccaggaaagagcctccgaggctgagatacgcatagcaaagctggaagccttgctgtacaacaaagatggcctgaacaacggatcagagacaagttcttctgccatgaaagatcttgagtcaaagctagacgcagttagtgcagaatgcctgaccgaaaaagagaagaacaagaagctaatcatggagaacgagaagctccagtaccgcatcacccatcttatgcgtgcaataaaagagacagaatcaagatagaagaagcctgataaggccgatttaaagcctgatgttgaagtatcctatcttgttggtgagcttaaactatttgttgtgatattgatataggtcttggtcaaaaactgtatcgatctaccgatcaggacgctatttatatgtacacgatcgtctgtgttcacctgaccccattttggttaggctttgggcgttgaaccgtggtccgtggaatgcatgatgtgttatctgaattgactgtctatatgttatcatgtactactggcgtttggtaatctgctcagctgacaattgagccgggtggttgaaagaaataaagagagggttttcactgatagaagcagacagctctcatgattccatcatgcttcgtgctgggaaggc

SEQ ID NO: 2056 - DNA, 629 bp, Setaria italica
gcctgccccatctacgctctgaaaaaaaaggaatccctcgaagacctcctcctccgaccgaatccgagggcacgcgaggggttcaggcgaccgacggcgagcatggcggcggacgacggccgggcgacggcggcgctggacgagaccctcaagcccttccaggaaagagcttccgaggctgagttacgcatagcaaagctggaagccttgctgtacaaccaagctggtccgaacagtggatctgaggcaagttcttctgcaatgaaacatcttcagtcaaaactagacgcggttagtgcagagtgcctgactgaaaaagagaagaacaagaagctaatcattgagaacgagaagctccagtaccgcatcacccatcttatccgtgcaataaaagaggcagaatctagatagaagaagcccgaaggctgatttaaaagcctgatattgaactattgaaatatcctatcttgttgagctcaaaatattgttgtgatcttgatatagatcttggtgaaaaccgtatggaactattgatcagaacgctatgtacacgatagtctgttttcacctgaccccattttggaagacaggcgttgaacagtggaatacattttgttatctgaattgac

SEQ ID NO: 2057 - DNA, 2821 bp, Zea mays
atggcctcaccctccgctccgccgcccctcttcattttttattgctccccccggcgccggccccggtctctccagtctccacccacgtatccgcggaggcggaggagctgccctgccgctcagagaaatcggcgcgcccatcccgtctcccccctggcgattcattcggccgcccaaacccacagggagtcgcagccggaggagggaggcgtgctggagtccgtccaaggagcgcagcacacgagcaacgtacgagggaaaggggaaacaaagagccttctccgatcgtcgccagctagctacccacctgtcctccggatgtcctggagttctgcatgcccatggaaaactcagttcgccgcgtgagatgcccgagatgccgcagcgttctcgaggagcccagcgcgccggtgtaccagtgcggcggatgcggcactagccttcgagcaaagaaccgtaccggcaccggcaccggcagcacgggagacgcggccggggcgtcgccggcgcggagctggctgcctcctcagagcaggcacctggacgccagcgacgtcgcgagcaccagcaggtccagcaccccgacccctcctcgtgtcgccagcaccagcaggtccggcaccccgacccctcctgacgtcgggaccagctggcaccgagacaccgacgcgacaggcacccggcatggttccggtgatctcgctctcgtgtcggccgggacgcgtgggtccggtgacgtcgcgagcaccagcagtactcctgttgccaccgcgagaagcaggcgccgccaaggcaccgacgcgacgagccgtggctccggcgacgttgccagcaccagcagtactcctgacaccaccgcgagaatcaggcgccaagacaccgacgcgacgacccgtggctccggcgacgttgccagcaccagcagcacacctgacgccagtgccgacacgacgagacggggcgagtccggtggtcccgtgccggcgaggaatcgtgtccctgagcaagcggcagcggcactgatcgagaaaagagggcgcgaacagagcgcggccggtcaggaagtccgtgacgactctgaaggccgcggaacacgagatgccagtggtgcggagtccggcgtcggtggtgtcggcttctccggaggaaacagagatgccactcctgaattgcaggatgacacggagaaggggatgaaacgccatgacgaatctaacgatgctgcgagaaaggaacgtcgtggtgaagctgcagagcagccgcgttacgaccatgaccgacgccaagaacttgcaccgaaatcatcggctcaacccgcggctgctcagcttgcacgcgaagatgaagctgctactgccggagaaaaggcgccgagcccttctcgccacgaggttcaagaggaacatctgcggcccctgcggaagaagattctgaagacggtggatgagctgaaaggcgatctctctgaacttttcagcaagtcccccgagctcaacgcgccacgcgcgcgccctcctcgtcttcccaggcaagaagcctacgtgtcccacgcggtggcgggggcggcctcgggcctccctgccagagctcgccacgtcgcttctgctgccgaaggtcaccgtggcagcgtagctcgtgcggcgaagccccgtccagccgcggctcctccccgtggcttgccatcccggcgctaccgccagtgcagagcgcacccgtgctgccatgacgtggatccgaggccgtgccatcacgggcacggctgctgcggccaccacggcaaaccggagtgcagcagctgccgaggatactgctgcaggcccagagcgctggagccgtccgcgccgcggaagcccccggcagccaaggagcccaagcggcggctgccgccccgcaaccactgccggccagtactgaagggcgcgccgttcatcgtgtgctccagctgcttcaagctggtgcaggtgcccgccgacttcgccgtctcgaccaggatggtgcgcaggatgcggtgcggctcctgctccaccgtcctctcctactcctacagggacccggccaggaagaaagcctaccaggactcggtcaatcggtgcagcacagacggctccgagctgcacggcggcacaggcgaccaacggtcggacccgttcgcgccgttcatcgatggcttcggcctcagcagctactcgacggaggacgagcggcggctgcccgtctcgaggaacacgtcgttcgacaccctcgacgggacgaaaggcgtgggacggctgcaccggctgatggggtacgggtcagctagcgagctgctgcggcactcccctgacctgtacgagagcttcagtgagcgaacgacgcctgacgtgagacagcacgacacgaaagggaaaggcgtttgcatcgacgatgacgactacgactacgacttggatgacactgacgatgaagacattggtgcgctgaagagatcagcgaggaaagggtccggctggacgctcccatggattcccggcaagcggcaaggggactcgggagccatcaggatcaagtaaatagcaggaaaggcctgtgtatattgcaggaataggttcgggttttggaattcgaattggaatttatttcatagttttgctattccttttaggcgcactattggatttataggctgtttgtttgccattttttgaagcgtgaaaaatgctgttcaatgaaatgtaaatatcctgcgatgagtctcagaaagaataacattatggactttttaaggaacaagaaaaatcgaggtgcctagtgaagaaacagacgttctaatgcaatattgcaa

SEQ ID NO: 2058 - DNA, 2554 bp, Zea mays
aggcccacatggcagcctctgcactgcaggatctcatcccctccggctgcccgtgcccagccgtcgtggcgcgacggcggcggtcggtctggtagggctcccctcctttccaccagatcagaacagatagtcatagatcagtgtcacaccacgacccgccagccggaccgccacttgccaaccaacgcctttccctcctcctccgcctccgggcgctagcgggaatggacgccgccgagctgcccctcgtctaccacatcggtctggtgctggccgcgctctgggccgccgccgccgtcggcttccgcggctccctcctctacctcctcgccttcctctacctctacatggtaaatgctcgctgtgcagtgagactgcggaagaggatacaacatgaagagatgaaatctgcctaccaacgaaggctcctctctgatgcagaatcagcacgctggttaaaccatgcaatcgacaagatgtggcctgtctgtatggagaagatcgtttcaaaacttctacggcccatcataccatggttcttggataagttcaaaccttggacagtcagcaaagcaagtattcaggaactttacatgggcaggaatccaccaatctttacctccatgagagttctaccagagacatcagatgatgaccatttggttcttgagctgggattgaattttctttctgctgaagatatgagtgctgtacttgctatgcagctgcacaagagtgtgggacttggaatgactgcaaagatgcatttaacaagcatgcatgtcgagggaaagatattagttggtgtgaaatttgttcggagttggccatttcttggccgtgtaagactatgttttgtggagccaccttattttcagatggctgtgaaaccactcattaatcacgggctcgatgtcactgagtttccaggaatttcaggatggctggataagttgatggatactgcatttgggcagacattagttgagcccaatgtgatagtaataaatgtggaaaaatttgcatctactccttcagaaaataactggttcagcattgaggagagacctcctattgcatatgtgaagcttgagattctagaaggaactgacatgaagccatctgatataaatggactagcggacccatatgtgaaaggtcaccttggtcctttcaaattccaaacacagatacagaggaaaacattgtcccctaagtggtttgaagaatttaaaataccaatcacatcatgggaggcaacgaatgaacttgtcatggaagttcgtgataaggaccccatgtttgatgactcacttgggcaatgtaccattagtttacatgatctgagaggtggacaaagacatgacaaatggatatcactgaataatgtgaagaaaggaaggattcacttggcagtaacaattgatgatatatccgaggaccaaaatacatcaagtttggaccaatcattgaagcaagcggatactgaactaccagtatcaacatctgtttgtagcgaagtggatgctagtgaacctcctgaagaaaagaaagtcttaatggatgaagtggagcacataaacattgatggacaagaacagcctggaggtttatatgtacatcgccctggcactggggttccaaggacatgggaatcccggaaaggacgagcacgaaacccagacacacagattcaccaagaggttgacaagcaaaaggaagtcccaacaccaaaagggagtgggcaagggggtctatttaacgtaggctcctttttccggtggaactcgaggaaggggagctccagaaatctcgatgccagccctcctgcaactccgggttctcagagcgtgacagagcttgatccaaagctccctcaaactccacgtcccaacctgaaggagctaggcgagaagcggacgtcgataaagatcgtagtggacgaagaagcaagcccggcagacaaggtgggaggtgcggagaactcaggagaagatgtggcgaaggtgatagagaaaaatgcaggtgaaccgggcaggtcactgacaagcacattgagcaggaagatttgcagaaggagagcagatgataggctatcagatatccccgagaagattgaagctcgtggatctaagccggtgagtgaagggcctattcttgttagaggtgagccaatgataacagtggaccatccgacgacggaacatagcgatggaggtggcactgagcaagatgcggtgggagcaaaggttgctactcagacctcataaggattgcgacttaaggtcagcagttcttgttcttgtaatctttgctggtcgatttggttcgggcatgggaccttgctttctgtttatagatcagtgtccatagttgcgaagggtatccatttagaaatggctgaaaaatatagtaacaaagagcagcgtgttgtgcagtgatatacgctcatgttgataagatggctctgttagatcttgtttacttatgtaaagaaacatgaattgcatatatttcttgacataaataatgtaaaacgtatttttttggttgc

SEQ ID NO: 2059 - DNA, 2543 bp, Setaria italica
atgggatcagatgaagcagggcagctggttggcggcaggaggaagacgaagccatcatcaaagcccagccagcagtcccctcccagtcactcgattcacatcacgccccgccacctgccaccttacttttcaccttcctcgcgcacaccccgccgccggaggacgctaatggacgccgccgagctgcctctcgtctaccacatcggcctcgtgctggccgcgctctgggccgccggcgccctcggcatccgccactccttcctcttcctcctcgccttcctctacctctacatggtaaatgctcgctgtgccatgagactacgaaagaggatccaacatgaggagatgaaatctgcctaccaacgaagactcctttctgatgcagaatcagtacggtggttaaaccatgcaataaacaagatgtggcctatctgtatggagaagatcgtttcacaacttttacggcccatcataccgtggttcttggacaagttcaaaccttggacagttagcaaagcaagtgtccaggagctttacatgggtagaaacccaccaatgtttacctccatgagagttctacctgagacatcagatgatgaccatttggttcttgagctgggaatgaatttcctttctgctgaagatatgagtgccatacttgctatgcagctgcataagagtgtgggacttggaatgactgcaaacatgcatttaactagcatgcatgttgagggaaagattttagttggtgtgaagtttgttaggagctggccgtttcttggccgtgtaagactttgctttgtggagccaccttattttcagatgactgtgaaaccactcattaatcacgggcttgatgtcactgagtttccaggaatttcaggatggctagacaagttaatggatactgcatttgggcagacattagtcgagcccaatatgattgttatcaatgtggaaaaatttgcatctactccttcagaaaataactggttcagcattgaggagaggcctcctattgcgtatgtgaagcttgagattttggaaggaactgacatgaagccatctgatataaatggactagcggacccttatgtgaaaggtcgtctgggtcctttcaaatttcaaacagagatacagaggaaaacgctatcccctaagtggtttgaagaattcaaaataccaatcacatcatgggaggcatcaaatgaacttgtcatggaagttcgtgataaggaccccatgtttgatgactcacttggaggatgtaccatcgatttacatgagctgagaggtggacaaagacatgacaagtggatatcactgaataatgtcaagaaaggaaggattcacttggcggtaacagttgaagatatatctgaggacaaaaatgtatcatgttcggacgaaccattgaagaaagctgatgctgaactaccagtattaacctctgcagacagcacaacggatgctggtgaactgcctgaagaaaagaaagtcttaatggatgaagtggagcacataaacattgatggacaagaacaacctggagggttatatgttcatcgccctggcgctggggttccaaagacatgggaatcccggaagggacgagcacgcgccccggacacacagatttaccaagaggttgacaagtcaaaggaaatccccgcaccaaaaagcagtggacatgggggtctgtttaacctaggctcctttttccgaaagaactcaaggaaggagagcttcaaaggtgatcccagccttcctactactccgggttctcagagtgtgacagagcttgatccaaagctccccaaaacaccacatcccaacctgaaggagcttggtgagaagcggacatcaataaagcttgtagtgaatgaagaagcaagcccagcaagcaaggtgggagacacggataactcaacagaagatgtagcaaaggtgatccaaaaaaatgcaggtgaaccaggcagatcactgacgagcacactgagcaggaatatttctaggaagagagaggaggacaggttatcagatatccaggagcagattgaagctcatggatctgagtcggtgactgtgagtgaagagcatattcccgttgaaggtgaaccaatagaaaaggagggccatcagacaacggaacatgagaatggtgatggtgctgaagaagattcagtgggagcagagattgctactcaggcctcataagattgcaactttgcaagatcatcagcttccgttcttgtaatcttgctagtagatatggttcgcacatgcagccttctttgttgttcatagacccatggtggtgaggatgtcaatctcagaaagccttgttttgttgttcatagttgtgaagaataacagtttagaaatggctgtatggctgtacactaacaaagagcagcgtgctgtgcagtttagacgctcatgttgtaagatcaacgtagctctgtttgatggaacttttgtaaagaaacatatattccttgacaatactattgtaaatcataacttttctgtttctttccttc

SEQ ID NO: 2060 - DNA, 2454 bp, Panicum virgatum
ttccagattcacaccacgccccgccaccggtcaacttccttttcatcttcctcgcccagctcggcagctcgcaccccgctggcaccgaccggaggacgcgaatggacgccgccgaggttcctctcgtttaccacatcggcctcgtgctggccgcgctctgggccgccggcgccctcggcatccgccactccctcctcttcctcctggccttcctctacctctacatggtaaatgctcggtgtgcgatgagactgcgaaagaggatacaacatgaggagatgaaatctgcctaccaacgaagactcctttctgatgcagagtcagtacggtggttaaaccatgcaatcgacaagatgtggcctatctgtatggagaagatcgtttcacaacttctacggcccatcataccgtggttcttggataagttcaaaccttggacagttagcaaagcaagtgttcaggagctttacatgggtaggaatccaccaatgtttacctctgtgagagttttacctgagacatcagatgatgaccatttggttcttgagctgggaatgaatttcctttccgctgaagatacgagtgttgtacttgctatgcagctgcataagagtgtgggacttggaatgactgcaaacatgcatttaactagcatgcatgtcgagggaaagattttagttggtgtgaagtttgttcggagctggccatttcttggccgcgtaagactttgctttgtggagccacctttattttcagatgactgtgaaaccactcattaatcatgggcttgatgtcactgagtttccaggaatttcaggatggctggataagttgatggatactgcatttgggcagacattagttgagcccaatatgattgtcatcaatgttgaaaagtttgcatctactccttcagaaaatgactggttcagcattgaggagaggcctcctattgcatatgtgaagcttgagattctagaaggaaccgacatgaagccatctgatataaatggactagcggacccttatgtgaaaggtcgtcttggtcctttcaaattccaaacacagatacagaggaaaacactatcccctaagtggtttgaagaattcaaaataccaatcacatcatgggaggcatcaaatgaacttttcatggaagttcgtgataaggaccccatgtttgatgacttgcttggagaatgtaccattgatttacatgagctgagaggtggacaaagacatgacaagtggatatcattgaataatgtcaagaaaggaaggattcacttggcggtaacagttgaagatgtatctgaggacaaaaatgtatcatgtttggacgaatcattgaggatagctgatgctgaactaccagtatcaacctcagtcgacagcgcattggatgctggtgaactgcctgaagaaaagaaagtcttaatggatgaagtggagcacataaacattgatggacaagaacaacccggaggtatatatgtccatcgccctggctctggggttccaaagacatgggaatcccggaaagggcgagcacgtagcccagacacgcagatttaccaagaggttgacaagtcgaaggaaatccccgcaccaaaaggtagtgggcaagggggtctgtttaacctaggctcctttttccggaagaactcaaagaaggggagtctaaatcccagccttcctactactccgggttctcagagtgtgacagagcttgatccaaagctccccaaaacaccacgtcccaacctgaaggagcttggtgagaagcggacatcaataaagctcatagtgaacgaagaagcaagcccaccaagcaaggtgggagatgcagataactcaacagaagatgtagcaaaagttatcgaaaaaaatgcaggcgaaccaggcagatcactaacgagcacattaagcaggagtgtttccaggaagagagcggaggataagctatcagaaatcccggagcagattgaagcccatggatctgagtcggtgagtgaagaacatacgcccattgaaggtcaaccaatagaaatacagggccatcagacaacggaacatggcaagggtgatggcgctgaagaagatgcgttgggagcaaaggttgctactcaggccttataaagattgcaattttgcaagatcatcagttttgttgtgatcttgctggtgatttggttcacacatgcggccttctttgttgttcatagacccaaggagtgtcaatcttagaaagccttgttttgttgttcatatttgtgaagaaaaaatggctgtaaaatattactccgcactaacaaatagcagcgtgctgtgcagtgagagacgctcgagttgtaagttagtagctctgtttgagaaacttctgtacatttctggcattttattgtaaatcataactttttatgctcttctccatcatggaatatctttgccaat

SEQ ID NO: 2061 - DNA, 2607 bp, Panicum virgatum
ttccgctcgccgtccgccagctgccgtggccggttgccttccagattcacaccacgccccgccacgccaccggtcagcatctttttcatcttcctcgcccagttcggcagctcgcgagaaccccgctggcaccgaccggaggacgcgaatggacgccgccgagcttcctctcgtctaccacatcggcctcgtgctggccgcgctctgggccgccggcgccctcggcatccgccactctctcctcttcctcctggccttcctctacctctacatggtaaatgctcggtgtgcgatgagactgcgaaagaggatacaacatgaggagatgaaatccgcctaccaaagaagactcctttctgatgcagagtcagtacggtggttaaaccatgcaatcaacaagatgtggcctatctgtatgcagaagatcgtttcacaacttctatggcccatcataccgtggttcttggacaagttcaaaccttggacagttagcaaagcaagtgttcaggagctttacatgggtaggaatccaccaatgtttacctccatgagagttctacctgagacatcagatgatgaccatttggttcttgagctgggaatgaatttcctttccgctgaagatatgagtgttgtacttgctatgcagctgcataagagtgtgggacttggaatgactgcaaacatgcatttaactagcatgcatgtcgagggaaagattttagttggtgtgaagtttgttcggagctggccatttcttggccgcgtaagactttgctttgtggagtcaccttattttcagatgactgtgaaaccactcattaatcatggtcttgatgtcactgaatttccaggaatttcaggatggctggataagttgatggatactgcatttgggcagacattagttgagcccaatatggttgtcatcaatgttgaaaaatttgcatctactccttcagaaaataactggttcagcattgaggagaggcctcctattgcgtatgtgaagcttgagattttagaaggaactgacatgaagccatctgatataaatggactagcggacccttatgtgaaaggtcgtcttggtcctttcaaattccaaacacagatacagaggaaaacactatcccctaagtggtttgaagaattcaaaataccaattacatcgtgggaggcatcaaatgaacttctcatggaagttcgtgataaggaccccatgtttgatgacttgcttggagaatgtaccattgatttacatgagctgagaggtggacaaagacatgacaagtggatatcattgaataatgtcaagaaaggaaggattcacttggcagtaacagttgaagatgtatctgaggacaaaaatgtatcatatttggacgaatcattgaggaaagctgatgctgaactaccagtatcaaccaaagttgacagcgcattggatgctggtgaactgcctgaagaaaagaaagtcttaatggatgaagtggagcacataaacattgatggacaagaacaacctggagggttatatgttcatcgccctggcactggggttccaaagacatgggaatcccggaaaggacgagcacgtagcccggacactcagatttaccaagaagttgacaagtcaaaggaaatccccacaccaaaaagcagtgggcaagggggtctgtttaacctaggctcctttttccggaagaactcaaagaagggaagtctaaatcccagccttcctactactacaggttctgtgacagagcttgatccaaagctccccaaaacaccacgtcccaacctgaaggagattggtgagaagcggacatcaataaagctcgtagtgaacgaagaagcaagcccagcaagcaaggtgggagacgcggataactcaacagaagatgtagcaaaggttatcgaaaaaaatgcaggcgaaccaggcagatcactaacaagcacattgagcaggaatgtttccaggaagagagcggaggataacctgtcagaaatcccggagcaggttgaagctcatggatccgagtcagtgattgaagaacatatgcccattgaaggtgaaccagtagaaatacagggcccatcagacaacggaacatggcaagggtgacggcactgaagaagatgcgttggaagcaaaggttgatactcaggccttataaggattgcaattttgcaagatcatcagttttgttcttgtaatcttgctggtgatttggttcagacatgcggtcttctttgttgttcatagacccagggaatgttgatcttagaaagccttgttttgttgttcatatttgtgaagaataaatagatactccgcactaacaaatagcagcgtgctgtgcagtgagagacgctcgtgttgtaagatagtagtagctctgtttgcgaaacttctgtacattgctggcaatctggcatattattgtaaatcataactttttatgctctttccttcatgtaatatttttgccaatagtttaagaaaatatacatatttttgtcaatactatctccaagattgttacgctacaagtacatcacatcacacgttcaattcaggcaaccgtagaaattatttcatag

SEQ ID NO: 2062 - DNA, 2567 bp, Panicum virgatum
ctccttcttgttgtaggtaaatgctcggtgtgcgatgagactgcgaaagaggatacaacatgaggagatgaaatctgcctaccaacgaagactcctttctgatgcagagtcagtacggtggttaaaccatgcaatcgacaagatgtggcctatctgtatggagaagatcgtttcacaacttctacggcccatcataccgtggttcttggataagttcaaaccttggacagttagcaaagcaagtgttcaggagctttacatgggtaggaatccaccaatgtttacctccgtgagagttttacctgagacatcagatgatgaccatttggttcttgagctgggaatgaatttcctttccgctgaagatacgagtgttgtacttgctatgcagctgcataagagtgtgggacttggaatgactgcaaacatgcatttaactagcatgcatgtcgagggaaagattttagttggtgtgaagtttgttcggagctggccatttcttggccgcgtaagactttgctttgtggagccaccttattttcagatgactgtgaaaccactcattaatcatgggcttgatgtcactgagtttccaggaatttcaggatggctggataagttgatggatactgcatttgggcagacattagttgagcccaatatgattgtcatcaatgttgaaaagtttgcatctactccttcagaaaatgactggttcagcattgaggagaggcctcctattgcatatgtgaagcttgagattctagaaggaaccgacatgaagccatctgatataaatggactagcggacccttatgtgaaaggtcgtcttggtcctttcaaattccaaacacagatacagaggaaaacactatcccctaagtggtttgaagaattcaaaataccaatcacatcatgggaggcatcaaatgaacttttcatggaagttcgtgataaggaccccatgtttgatgacttgcttggagaatgtaccattgatttacatgagctgagaggtggacaaagacatgacaagtggatatcattgaataatgtcaagaaaggaaggattcacttggcggtaacagttgaagatgtatctgaggacaaaaatgtatcatgtttggacgaatcattgaggatagctgatgctgaactaccagtatcaacctcagtcgacagcgcattggatgctggtgaactgcctgaagaaaagaaagtcttaatggatgaagtggagcacataaacattgatggacaagaacaacccggaggtatatatgtccatcgccctggcactggggttccaaagacatgggaatcccggaaagggcgagcacgtagcccagacacgcagatttaccaagaggttgacaagtcgaaggaaatccccgcaccaaaaggtagtgggcaagggggtctgtttaacctaggctcctttttccggaagaactcaaagaaggggagtctaaatcccagccttcctactactccgggttctcagagtgtgacagagcttgatccaaagctccccaaaacaccacgtcccaacctgaaggagcttggtgagaagcggacatcaataaagctcgtagtgaacgaagaagcaagcccaccaagcaaggtgggagatgcagataactcaacagaagatgtagcaaaagttatcgaaaaaaatgcaggcgaaccaggcagatcactaacgagcacattaagcaggagtgtttccaggaagagagcggaggataagctatcagaaatcccggagcagattgaagcccatggatctgagtcggtgagtgaagaacatacgcccattgaaggtcaaccaatagaaatacagggccatcagacaacggaacatggcaagggtgatggcgctgaagaagatgcgttgggagcaaaggttgctactcaggccttataaagattgcaattttgcaagatcatcagttttgttgtgatcttgctggtgatttggttcacatgcggccttctttgttgttcatagacccaaggagtgtcaatcttagaaagccttgttttgttgttcatatttgtgaagaaaaaatggctgtaaaatattactccgcactaacaaatagcagcgtgctgtgcagtgagagacgctcgagttgtaagttagtagctctgtttgagaaacttctgtacatttctggcattttattgtaaatcataactttttatgttcttctccatcatgtaatctctttgccaataacttcaaaaaaatatacatatttttggatactgtctccaagatttttacgttgcaagtacaccacatcacacgttcagttcaggcaaccgtagaaattattacatagattaacgtgtcacagctaatcaaccattcgactttttttagacggaccaatagactataagatagacataggatcccaaaataggtaataaaaaagctgagtacttaaagaaaacagggcaaagtaatataatatactccgccagtcctaaactattagccgttttagcttttgtgcatagtttttgttatgcatctagatatatattatgtctagttg

SEQ ID NO: 2063 - DNA, 1668 bp, Zea mays
cccacttggaatctggaatttgactgaggggatgtagaccgttcgatttccaatcgcacggtccgcgttcgtttgacgtccttctggcggttatgctgctgcgaccaagtcgagggctttcgtgccttcagcccttcagtcttcaccagtcgcgcgccgccatgtcggagaccgaatcggcggcagcggcgccggtggctgcggctgaatcgaagcctcggcgactgcgggggcacaagaagggcgccgtcacctgctgcgtcgcctcctccgcccgccccggcgtcgtcgcgtcctccggcgaggatggatgtctttgctggtttgatctgcgcaccaaagatgcacttttgaccatggaggcagcaaataaaccaatttcttcaatttgctttaaaccaggaaatgaagattttgtgtatatctctgctggaaatgaaatattgtcctttgatgttcgtatgggaactcaatcaaagccattagagacatataactacaatagagatgaaatcaatcagattgctgtcagctctaaaggttttctcgctgctgcagatgatagtggggatgttaagattgtcaataccattcagaaatgcctgtataaaagattaagggaagcccacacaagtatttgcagcagcgtgcaattcattccttggagaccttggacagcaattactgggggccttgactcaaagctcgctgcatgggatttctccaaaggacgaacactgttttctattgattatggatcacctgaattgcaaaacggcagttcttccggtagtgcagggcaatgtttcaaccctgcttttgttcattcagtagcagtttctgaagagggtattttgggagggctctacaaggtttgtgctgttgcaaggggggatggtgctgttgatgtggttgatcttgagtatgaactggcccctgcgaaatcgaagggacctcctcgggcagctattttgacaacgagatcaaaaggcgctgaacttggagatgggagctgcaatcaaagtcgagcgaaaagaatccatcttgactacaccatgggcggccatactgcagctgtgtcttgtgtagcattttcagcatttggtgagaaggggaagttcctcatttcaggtggcaatgatgcatcagtgaagctgtgggattggtcgaaaggattttactctgaaacaaacagcaaagttgatttggttttggatattgatgtaaagaaaaaggtaaattggctgtgtactgctccaactgattcagataacttgattgtgtgtgacacatccaaggtggtcaaagtatatagtttccggtagatggatcaaggtgtagcctcagtttgtcaggcagttatctgagggagtgaagcttgtctgaccgttggaaccaatctggtcctgactctggtatccagatattacaagcctgccgcagacagttcctgaattgtgaggtcattggttagcaatttgcaatgtcagttgtggcgcagaacagatctgataaagtatatattattttgttactgtcagaactttttgtacaacttccagtctgctagcttagctggactcggcatgtatatctctgttgtacggtgaaatgaatttatgtgtttggagaaaataaggcttgtttgtgctggaagagattatcttg

SEQ ID NO: 2064 - DNA, 1567 bp, Setaria italica
cggaaaaaggctccgtgacttcaccagccacgcgccgccatgtcggagactgaatcggcggcggcggcggtccctgcgccggcgtcagcggaggagcggaagccccggcggctgcgggggcacaagaagggcgccgtcacctgctgcgtcgcgtcgtccgcccgcccgggcgtagtcgcgtccgccggcgaggatggatgtctttgctggtttgatctgcgcaccaaagatgtgattttgaccattgaggcagcaaataagccagtttcttccatctgctttaaaccaagaaatgaagactttgtgtatgcctctgctggaaatgaaatattgtcctttgatgttcgtatgggacctcaaccaaagccattagagacgtataactacaatagagatgaaatcaatcagattgctgtcagctctaaaggttttctcgctgctgcagatgacagtggggatgttaagattgtcaataccattcagaaatgcttgtataaaagattgagggaagcccacacaagtatttgcagcagtgtacaattcattccttggagaccttggacagcaatcactggtggccttgactcgaagctcgctgcatgggatttctccaaagggcgaacactattttctattgattacggatcacctgaattgcaaaatggcagttcttctggtagtgcagggcaatgtttcaaccctgcttttgttcattcgctagcagtttctgaagagggcattttgggagggctgtacaaagtttgtgctgttgcaaggggggatggtgctgttgatgtagttaatctcgagtatgaactggcccctgcaaaatcaaaaggacctccttgggcagcaacttcaacaatgagttcaaaaagaactgaagttggagatggaagcagtaatcaaagtcaagtgaaaaggatccatcttgattacacgatgggtggccatactgcagctgtttcttgtgttacattttctgcattcggtgagaaggggaagttccttgtttccggcggcaatgatgcatcggtaaagatatgggattggtccaaaggattttcttctgaaacaaacagcaatgctgaattggtgttggatattgatgtgaagaaaaaggtaaattggttgtgtactactccaactgattcagataatctgattgtgtgcgacacatccaaggtggtcaaagtatacaattttcggtagatagattaatgtgggccgtcagctatttggacaattttctgaggtagtgaatgttgcccgtctgtctcgagttggtcctgactccagtgtccagagacatatcatgatgccaagcctgcagcagatagttctctgagtggatagctttagcaatttgcaatatcagttgtaggatggaatggagccgctaaactatttattattttcttacttcgatgtgatattttttcgggcttctagctagagtttgaatgtatatcaatgttatattgtgaaacgaatatatggtttttgaggaaaaccgttgtactgtgttggcgggcatgatttttattaaatatgttgagatgtgttt

SEQ ID NO: 2065 - DNA, 1893 bp, Panicum virgatum
ttgatagtgtatttgaagagaaatcacagtacagggtagaaatcactgctaggtccatctgtgtcatttttttgagggaaaaaatcatcatcattgtggcattgggccggagccaccggagttgggtgatcgaatggaagccacattgggccgggcccgctagacccgcatggaaactggaccgaaaatgaggggatctgggccttccaattggggtccgcgctcctttccccgcagttcggcttctgggaatggaggagagggccggagcccggaggggacccgggggaaaaggaggctccgtgacttcaccagccacgcgccgccatgtcggaggctgaatcggctgcagcggcggtccctgcggcagcggcggagcggaagccccggcggctgcggggacacaagaagggcgccgtcacctgctgcgtcgcgtcctctgcccgcccgggcgtcgtcgcgtccgccggcgaggatggatgtctttgctggtttgatctgcgcaccaaagatgtgcttctgaccattgaagcagcaaataagccaatttcttcaatttgctttaaaccaggaaatgaagacttcgtgtatgcctctgctggaaatgaaatattgtcctttgatgttcgtatgggacctcaatcaaagccattagagacatataactacaatagagatgaaatcaatcagattgctgtcagctctaaaggttttcttgctgctgcagatgacagtggggatgttaagattgtcagtaccattcagaaatgcctgtataaaagattgagggaagcccacacaagtatttgcagcactgtacaattcattccttggagaccttggacagctatcactggtggccttgactcgaagcttgctgtgtgggatttttccaaagggcgaacgctattttctattgataacggatcacctgaattgcaaaatggcagttcttccgggagtgcagggcaatgtttgaaccctgcttttgttcattcgctagcagtttctgaagaaggcattttgggtgggctgtacaaagtttgtgctgttgcaaggggcgatggtgctgttgatgtagttgatctcgaatatgaactggcaccttctaaatcgaaaggacctcctcgtctagcaacatcaacaatgagttcaaaaagaactgaacctggagatggaagcagtaatcaatgtcaagtgaaaaggatacatcttgatttcacaatgggtggccatactgcagctgtgtcttgtgtagcattttctgcatttggtgagaaaggaaagttccttgtttcaggcggcaatgattcatcagtgaagatatgggattggtccaaaggattttcttctgaaacaaacagcgatgctgaattggtgttggatattgatgtaaagaaaaaggtaaattggttgtgtactaccccaaccgactcagataatctgattgtgtgcgacacatccaaggtggtcaaagtatacaattttcggtagatagattgatgaggccatcagcttgttggacaattttctgaggtagcgaatgttgcctggccgtctggtctgtctgtcttgagttggtcctgactccggtttccagatacatgatgccaagcctgcagcagatatttctctgagtcgatagctcaagatttttgtttagcactttgcaatatcagttgcaggatagcatgaagccgctaaactatttattattttcttacgagacagatcttacttcgttgtgatattttttgtacctccacatgcttctagctagactcggcatgtatatcttcgttgtatgatgaaatgaaattttgattttcaaggaaaacctttgtgtgctgttatggtatgcatgatttttcaaaaagatgttgagatgtgttt

SEQ ID NO: 2066 - DNA, 4445 bp, Secale cereale
ggaattctgtgatcagtggatgcttctcaaatggatggcatggtagggctgttgagcatttcagcgaaatgtggtttgaaggcctagagatcgattcagtgacgatgctcagtgttttgcctgcctgtgctgaattaggttacgagcctgttggaagagtgattcatggatactctgtgaaaactggattactgtgggagcttgagtctttggagagaggagtagatgacaatctgggatccaaattggtattcatgtatgtgaaatgtggtgaattgggctatgcacgaaaggtatttgatgcaatgtcatcgaaaagcaacatacatgtgtggaatctactgatgggtgggtatgcaaaggtcggtgaatttcaagaaagcctatttctttttgagaaaatgcatgacagtggaattgcccctgatgagcacaccgtttcatgccttgtgaagtgtgtcactagtttgtatagcggcagggatggcctggtggttcatgggtatcttttgaagttgggttttggtgcacagtgcgcagtttgcaatgcaatgatatcgttctatgcgaaatccaacatgactgaagatgcaatcttggtgtttgatggaatgcctcatcgagatgtcatttcttggaattctatcatcagtggctgcactttcaatggattatacagcaaatctgttgaactatttgtaagaatgtggttacaaggacaggagttggattcagccacattgttaagtgttttgcctgcttgtgcacagttgcgccactggtttctagggagagtagttcatggatattctgtgaaaactggattgatcggtgagacatctctcgctaatgttcttcttgatatgtactcaaattgctcagattggcgtagcaccaataagatattcagaaatatggatcagaaaaatgttgtctcatggacagcgataattacgagttataccagggctggtctttttgacaaagtggctgggttactccaagaaatggcattagaaggtatcagaccagatacctttgcaattaccagtgctcttcatgcttttgctggtaatgaatcgctgaaagatggcaaatctgtacatgcatatgccatcagaaatggaatggagaaggttcttcctgttaccaatgcgctaatggaaatgtatgccaaatgtggaaatatggtggaagcaaggttgattttttacggtgtgatgagtaaggatatgatatcatggaacacactgataggaggttactccaggaataatcttgccaatgaagccttcaatttgttcactgaaatgctgctccaattcagacctaatgccgtgaccatgacctgcatccttcctgccgcggcaagcctttcatccctggagcgaggcagagagatgcacacctatgccttacgaagagggtacttggaagacgatttcgtagccaacgccctcatggacatgtatgttaagtgtggtgcattgctgctagctcgacagctgtttgacaggttgagcagcaagaacctcatctcatggaccatcatggtggcgggatatggcatgcatggccgtggcagggacgccattgcgctcttcgagcagatgagggccagtggcatcgagccagatgcagcctctttcagtgccatactgtatgcttgcagccattcaggcctgagagacgagggatggagattcttcgacgcaatgcgccgtgaacacagaatagagccgaggctgaagcactacacctgcatggttgacctactaactaacaccggcaatttgagggaagcttacgagttcatcgagtcgatgccgatcgagccagattcaagcatatgggtctcattgctgaacggatgcagaattcacagggatatcaagcttgcagaggaggtagcggagagggtctttgaactggaacctgaaaacaccgggtactacgttcttcttgccaacatatatgctgaagctgagagatgggaggctgtaaggaagctcaggaacaagatcggtggtcgagggctccgggagaaaactggctgcagctggattgaggctaggggcgagggttcaggtcttcatcgcgggcaaccggaatcatccgcagggggagaggatcgcagagttcctggatgaagttaccagaagaatgcaggaagaaggccatgatccaaagaagagatatgctctgatgggcgccgacgacgcggtgaacggcgaggcgctctgtggtcacagctcgaagctcgccgtcgcgttcggggtgctgaatctgtcggaagggcgcccgatccgtgtgacgaagaacgcgagagtttgcactcactgccatgaggccgccaagttcatatccaagatgtgcagcagagagatcatattgagggattccaacaggttccatcattttgaacaaggcaggtgctcttgcagaggttattggtaacaacatcgctgctatgtgacagtaattagtgaatcggcttgccagctgcagtgtgttcatagctgttgctagaaatatcagcatgtaatatcgctgtatcacaatcacaacgtttggggaaatgcctttggcccagatcttttcgcgcagggttctcaagaatcgagattctgggaagttgctcacagaatctgcactaggatcctatgaagatcagtaggggtattgtcctatctgaaacgttttcatttgagggagttgtccagaatcttgagaatccaggtctcgggaggattttgagtatttccgaagcaaaatcgagttcttttgttttgttgattttccagacccagattctctagaatctgttcaaaagaactgggcctttgtaagaaacaacagttacaattctatgaaatcatatggaaaacaaaagatttaagcacatttcaccatctttgatgaactgccagcacacacccaatcattccatactgaaaccatacatttataacgccaacacaacaaagatatacatgtctatcctagcagcacatcagagtagaagatttccgtaccacataacttttgtttcgttacaaaaaatggtttctgcagagcctctaaagtcatatactgtcatttcaccaggtctagctgcacctggcttgggttcatatgaagaagagacaggagtaagggcaaacatggcaccgatgaccaggaaacatgttgtgtcataccccagaaaactgtccataaggcaacaccgcacatttctccatttatgggaaattatatactttgaccaccttggatgtgtcgcacacaatcaggttatctgaatcagttggagcagtacacaaccaatttacctttttcttcacatcaatatccaacaccagttcaccattgctgcttgtttcaggagaaaatcctttggaccaatcccatactttcagtgatgcgtcgttaccacctgaaacgacgaactttcccttctcaccaaacgctgaaaatgccacacaggagacagctgcagtatgtccacccattgagtaatcaagatggatccttctcccttgagattgattattgctcccatccccaagatcaattatttttgagctcatggtcgaaccccctgcccgagaagggccttttgattttgcaggggccaattcatattctagatcaactacatcaacagcaccgtccccccttgcaacggcacaaactttgtacaaccctcctaaaatgccctcttcagaaactgctaccgagtgaacgaaagcagggttgaaacattgccctgtactacccgaagaactgctattctgcaattcaggtgatccataatcaatagaaaatagtgttcgccctttggagaaatcccacacagcaagttttgagtcgaggccaccagtaattgctgtccaaggtctccaaggaatgaattgtacactgctgcaaatacttgtgtgggcttccctcaatcttttgtacaagcacttctgagtggtattgacaatcttaacatccccactgtcatctgcagcagcaagaaagcctttagaactgacagcaatctggttgatttcatctctattgtagttatatgtctccattggcttagattgggatcccatacgaatatcgaaggacagaatttcatttccagccgatacatatacatgatcttcatttcctgatttaaaacagatggaagaaataggtttatttgctgcctcaatggtcaagagcacatctttagtgcgcaaatcaaaccagcaaagacatccatcctcgccggatgacgccacgacgcccgggcgggcggacgacgctacgcagcaggtgacggcgcccttcttgtgcccccgcagcctccggggcttccgctccgtcgccgtcgccgccgccgccgccgccgtttctgtctcagacatggcgcgcgtggccggtgaagacgcgaggctttctcagtc

SEQ ID NO: 2067 - DNA, 1869 bp, Hordeum vulgare
atggaaactcgccggcggagtcgccggacttgggtggtggaacggaagcagctccggcacgagccgctgtttctagggtgggggtatgccctactagtctgtctgaaataaacgagcgaggatctcatctagaccgttcatatttcaatcgaacgggtcacgcgcacccgtgccgtgctttctcagcctgggtgagcgccgacgacaagggtcaggggggaagagaaagcctcgcgtcttcaccggccacgcgcgccatgtccgagacagaaacggtggcggcggcgccggcggcgacatcgatggagcggaagccccggcggctgcgggggcacaagaagggcgccgtcacctgctgcgtagcgtcctcggcccgcccgggcgtcgtcgcgtcctccggcgaggatggatgtctttgctggtttgatttgcgcaccaaagatgtgctcttgaccattgaggcagcaaataaacctatttcttccctctgttttaaatcaggaaatgaagaccatgtatatgtatcggctggaaatgaaattttgtcctttgatattcgtatgggatctcaatcaaagccactggagacatatacctacaatagagatgaaatcaaccagattgctgtcagttctaaaggctttcttgctgctgcagatgacagtggggatgttaagattgtcaataccactcaaaagtgcttgtacaaaagattgagggaagcccacacaagtatttgcagcagcgtacaattcattccttggagaccttggacagtaattactggtggcctcgactcaaagcttgctgtgtgggatttctccaaagggcgaacactattttctattgattatggatcacctgaattgcaaaatagcagttcttcgggtagtacagggcaatgtttcaaccctgctttcgttcactcagtagcagtttctgaagggggcattttaggagggttgtacaaagtttgtgccgttgcaaggggggacggtgctgttgatgtagttgatctagaatatgaattggctcctgcaaaatcaagaggcccttctcgggcagggggttcgaccatgagctcaaaaataactgatcttggggatgggagcaataatcaatgtcaagggagaaggatccattttgattactcaatgggtggccatactgcagctgtctcctgtgtagcattttcagcgtttggtgagaagggaaagttccttgtttcgggtggtaacgactcatcactcaaagtatgggattggtccaaaggattttctcctgaaacaaacagcaatagtgaattggtgttggatattgatgtgaagaaaaaggtaaattggttgtgcactgccccaactgattcagataacctgattgtatgcgacacatccaaggtggtcaaagtatataatttcccatagatggagaaatgtgcggctttgcgttatggacagttttctgtgatatgacacaacatgttctctggtcatcagtgccatgtttgccctgactcctgtctcttcttcatatgaacctaagccagctgcagctagacctggtgaaatgacagctcaaatggcatatatacgacttaagaggctctgcagaaactattgttcgtaacgagacaaaaattatgcggtactgaaattttgtactttgatgtgctgctaggtgctaggatagacatgtatatcttcgttgtgttggcattataaatgtatggtttcagtatcgaatgattgggtttgtgtcggcagttcatcttgggtttgtgtcggcagttcatcaaagatggtgaaatgtgcttaaatcttttggtttccttatgatttcgtagaattggaactgttgtttcttacaaag

SEQ ID NO: 2068 - DNA, 1922 bp, Triticum aestivum
gttccattcctcctcaagagaggtttaaccaaggaaactcgccggcggagtcgccggacttgggtggtggaacggaagcagctccgggacgagccgctgtttctagggtatgccccacttgtctttctgaaataaaggagcgaggatctcatctagaccgttcatatttcaatcgaacgggtcgcacgcactcgtgccgtgctttctcagccgggggaggttctgcgccgacgacaagggtcaaggggggaagagaaaggctcgcgtcttcaccggccacgcgcgccatgtccgagacagaaacggcggcggcggcggcgacatcgacggagcggaagccccggcggctgcgggggcacaagaagggcgccgtcacctgctgcgtagcgtcctccgcccgcccgggcgtcgtggcgtcatccggcgaggatggatgtctttgctggtttgatttgcgcactaaagatgtgctcttgaccattgaggcggcaaataaacctatttcttccatctgttttaaaccaggaaatgaagatcatgtatatgtatcggctggaaatgaaattatgtccttcgatattcgtatgggatctcaatcaaagccactggagacatataactacaatagagatgaaatcaaccagattgctgtcagttctaaaggctatcttgctgctgcagatgacagtggggatgttaagattgtcaataccactcaaaagtgcttgtacaaaagattgagggaagcccacacaagtatttgcagcagtgtacaattcattccttggagaccttggacagcaattactggtggcctcgactcaaagcttgctgtgtgggatttctccaaagggcgaacactattttctattgattatggatcacctgagttgcaaaatagcagttcttcgggtagtacagggcaatgtctcaaccctgctttcgttcactcggtagcagtttctgaagagggcattttaggagggttgtacaaagtttgtgccgttgcaaggggggacggtgctgttgatgtagttgatctagaatatgaattggcccctgcaaaatccaaaggcccttctcgggcaggggggtcgaccatgagctcaaaaacaactgatcttggggatgggagcaataatcaatgtcaaaggagaaggatccatcttgattactcaatgggtggccatactgcagctgtctcctgtgtggcattttcagcgtttggtgagaagggaaagttacttgtttcaggtggtaacgacgcatcactgaaagtatgggattggtccaaaggattttctcctgaaacaagcagcaatagtgaactggtgttggatattgatgtgaagaaaaaggtaaattggttgtgtactgctccaactgattcagataacctgattgtgtgcgacacatccaaggtggtcaaagtatataatttcttgtagatggagaaatgcgcggtgttgccttatggacagttttctgggtatgacacaacatgtttcctggtcatcagtgccatgtttgccccgactcctgtctcttcatatgaactcaagccagctgcagctagacctggtgaaatgacagtacatgacttaagaggatctgcagaaaccatctttttgtaagacaaaagttatgtggtactgaaatcttgtactctgatgtgctgctaggatagacatgtatatctttgttgtgttggcgttataaatgtatggtttcagtatggaatgattgggtttgtgttggcagttcatcaaagatggtgaaatgtgcttaaatcttttgttctccatatgatttcgtagaattgtaactgttgtttcttacaaaggcccagttcttttgagcagattctggagaatctggggtctgaaaaatcaacaaaacaaaagaactcgactttgcttcgg

SEQ ID NO: 2069 - DNA, 4408 bp, Brachypodium distachyon
ctcaaaaaaaaaaaggaggggttctgtgcccctgcgccgacggtaagggtggaaacgcgacatgtccgagacaggagcggcggcgggggcttcatcgacggagcggaagccgcggcggctgcgggggcataagaagggcgcagtcacctgctgcgtcgcgtcctccgcccgcccgggggtcgtcgtgtcctccggcgaggatggatgtctttgctggtttgatttgcgcacaaaagatgtgctcttgaccattgaggcgacaaataaggctatttcttccgtctgttttaaagcaggaaatgaagattttgtatatgtatctgctggaaatgaaattttgtccttcgatgttcgcatggggtctcaatcaaagccactggagacgtataactacaacagagaagaaatcaaccagattgctgtcagctcaaaaggctttcttgctgctgcagatgacagtggggatgttaagattgtcaatacgatgcaaaaatgcttgtacaaaagattgagggaagcccacacaagtatttgcagcagtgtgcaattcattccttggagaccttggacagccattactggtggcctcgactcaaagcttgctgtttgggatttctccaaagggcggacactattttctattgattatggatcacctgaaatgcaaaatcgcagttcttcggctagtgcagggcaatgtctcaaccctgctttcattcactcggtagcagtttctgaagagggtgggttgtacaaagtttgtgctgttgcaaggggggatggtgcagttgacgtagttgatctagaatatgaattggcccctgcaaaatcaaaaggcccttctcgggcaggagggtcggccatgagctcaaaaggaactgatctggggaatggaagcagtaaccaaagtcaacagaaaagaatccttcttgattacacaatgggtggccatactgcagctgtgtcctgtgtagcattttcagcgtttggtgagaagggaaagttccttgtttcaggtggtaatgatgcatcagtgaaactatgggattggtccaaaggattttcttctgaaacaaatagcaatagtgaattagtgttggatatcgatgtgaagaaaaaggtgaactggttgtgtactgctccaactgattcagataacctgattgtgtgcgacacatccaaggtggtcaaagtatataatttcccgtagattgagaaatgtgtggactgtggcatcatctggcgaacaatttcctgaggtggcagggcacaaaatactccctggccgtcagtaccatgttggggactccagtctcttgatatgaagccaaaccagttgcagctagaccgatgaaatgacagctcaagaccattttggttctccttttggcgtgtcatacatgggacttagaggctctactaaaattattattttctaccaagacacgttacattctactgaaattttgtactttcatatgcggctagaatagacatgtatatctaccttccttcagatgttgtacggtggtagtatgaatgtatggtttcggaatggaatgatcaggtttgtgctggtaatcgtggttttcatcaaagatggtgaaatgtgctcaaatcttttgttttctttccatatctatagaattgcaactatcgtctcttacaaaatcatcgtccacatgttgtgaatgctacggcgcctcttcctattgtttcttagcaaccacacatgtccgcccctagaacatgctgcagttgggtcactaattactgttacaggtgtgatgtcttctcaccagtaacctctgcaagagcacctgccttgttcaaaatggtgaaatctgtttgaatccctgagtataatctctctgctgcacatcttggatatgaacttggcagcctcgtggcagtgactgcaaactcttgagttttttgtcacgcggatcagccgcccttctgacaaatttagcacgccaaatgcaacggcaagctttgagctgtgcccacagagtgcctcgccatgcactgcattgtcggcacccatcagagcatattttttcttcgggtcatggccttcttcctgcattcttttggcaacttcattcaggaactcagcaatcctcgtcccttgcgggtgattacggttatccgcgataaagacatgaaccttgcccttggcctcaatccaactgcagccagtgttctcccggagtcctcggccaccaatcttgttcttgagcttccttacagcctcccatctctcggcctcggcgtatatgttggcaagaagaacatagtatccagtgttttcaggttccagctcaaagaccctctctgccacctcctctgcaagtttgacattcctgtgaattcgacatccgcgcagcaacgagacccatatgcttgaatctggctctatcggcattgaatcaatgaactcataggcttccttcagatttccggtgttgatgagtaagtcaaccatgcaagtgtagtgcttcagtctgggctctattttgtgttctttacgcattgcatcgaagaatctccatccctcatctctcagacctgaatggctgcaagcatacagtatggcactgaaagaggctgcatctggtgcaatgccgctgaccctcatctgctcaaagagagcaatggcatctctgccacggccatgcatgccatatccagctaccatgatggtccatgagatgaggttcttgttgctcaacctgtcaaacaaccgccgagctagcagtaatgcaccacacttaacatacatgtcaatgagagcattcgctacgaaatcgtcttccaagtaccctcttcgtaaggcataggcatgcatctctctgcctcgctccagggatgaaaggcttgctgcggcaggaaggatgcatgtcatggtcacagcattaggcctcaactggagcagcatttcagtgaacaaactgaacgcttcattggcgagattattcctggagtaacctcctatgagtgtattccatgatatcatatctttactcaccacaccatcaaaaatcaactttgcttcttccatatttccacatttcacatacatctccattagtgcattggtaacagcaagaactttttccattccatttctgatggcatatccatggacagattttccatgtttcagcaattcattaccagcaaaagcatgaagagcgctggtgattgcaaagatatctggcctggtaccttctaatcccatttcttgaaataacccagccactttgtcataaaggccagccctggtataactcgtgatcattgctgtccacgagacaacatttttctggaccatattcctgaatatcttatttgtactgcgccaatctgagcaatttgagtacatatcaagaagaacattagcgagagatgtctgactaatgaatccagttttcacagaatacccatgaactactctccctaaaaacaaaaggtgcaactctgcacaagccggcaaaacacttaataatgtggctgaatccagctcctctccttcaagccacattcttacaaacagctcaatagctttgtcgtataatccattggaagtgcagccactaatcatagaattccaagaaatgacatctcgatgaggcattccatcaaacaccaagattgcatccttagtcctgttggatttcgcatagaatgccatcagtgcatttccaactgcacattgtgaaccaaaacccaacttctcaaggagtccatgaactacctcgccatcttcgatactgcccaaaccagcaatgcatttcaagacacaggaaatagtgtatgcatccggtctgaccccacaacagtgcatcttcctaaagagcaatactccttctcgtaaatcaccagccttcgcatagccgctcatcagagcagtccaaacacgtacatcgcttacttgaggcatttcatcaaacacccttcttgcattctccaggtccccgcatttcaaatacattagcaccaatttctgtccgagaacattgtccattccatctcttccaaggctagatgcacgaaccaggaaatgggctctcttcccaccctccaacgatctcacttccgagcagagttggaggacggcgccatagctccggtcatcgactccatctgagccgagtaaccccaaagcctcctccaagtcacccgaccgacacagtctctgaatgtgcaggttcacgtcggatgtcgggacccaatctggcgatttctcggcacccctcggagaagcggctgcctccaaggcttggccggacggcgcgaggacgctgcacctaacccttgctctctggctgatgttcttgggaggtggccatggcggcggggcacggaggtggctggatatggaggcgactggaggcgtcgccat

SEQ ID NO: 2070 - DNA, 1790 bp, Zea mays
ctcgctcgtcttctttcgccgcttccccgcgaatcccgccgcccggcttccggtctccgcttcccccgtacgcagtgggcaccatggacccttcggtctcctcgtcgcctctccggctctccgccggaacccgcgcgagccccgcccctaccccgaggccgcccagcctcgtcgtcgcggccggccgccaccagcccgcggccgccaccgccaccacccgcctccgcgccgtctcgccgtccccgcccccgccctcccccgtgggctcgttcggcttcgacgcgctcaaggagaccttctccgtggacgtggcggcggccggcgcgcgcccgctccgcgtcccgctcgccgcgcccttcaccatcgcgtcctcgcgcctcgccgcgctctccaacgtcgccgtgcgcgtcgagctccgcagcggcgccgtcggctggggcgaggcgcccgtgctgccctccgtcaccgccgaggaccagccggcggcgctcggcgccgcggcccgggcgtgcgccgcgctcgccgccgcccccgcggcgcccctcggcgccctgctgcaggacgttgccggtgtgctcccgggacacgccttcgcctcggccagagcaggagtggagatggcgctgattgacgcggttgctaatagcattcgcatacctctatggagattatttggaggagcatcagatagcgtgacaactgacatcacgattccaatcgtgaccccaaatgaagctgctcaattggctgcaaaataccgcggacaagggtttcaaactctaaagctcaaggttgggaagaacttgaattcagatatagaagttctgaaagctatacggcttgtccatccagattgctcgtttattttggatgccaatgagggatacacagcaaatcaagcaattgaggttctcgatagactaaatgaaatgggagtgacccctgtgctcttcgagcaaccagttcacagagatgattgggaaggtctccgagatgtcagcgctgtggccatggagaaatacaaggtcgctgttgctgctgatgagagctgtcggagtttgcttgatgctcagaaaataatacaagggaatattgcccatgttattaacatcaagttggcaaagttaggggttcttggagcccttgaaataattaatgctgcaagaaaatccaatactgctctgatgatcggtggcatggtcgagactaggattgctatgggctttgctggtcatttagctgctggccttggttgctttagtttcgttgacctggacacacctcttttactgtctgaagaccctgtgtatggtggctatgaagcctttggacctctgtacaagttcacaaatgcccgtggccatggtggtttccttcacttggacaacaatgatgcctcgaaatgaagctggttaatgattttgtctgtccttctggagcttcaccgaagcattgcagtgcattccacacaaatgcagtgttccactggacaaccatgacataaccaaaaatcaaacaagcgattgcaagcatatagccatacaggtacagcctgctgttgcgagtccagtcgggcctggaaccctggactgaattggtcagccagcctgtagatagatagatattcgtatggctgttcccgtcggctctgttgttttattttacccagatagatacagtattttagtgacttctgtgcaataaacgcatatggttgtaaatgtcactacatgcagccgtgccgtcccaagcttttgttgttctatcgttcggctttccttgattacgct

SEQ ID NO: 2071 - DNA, 1522 bp, Panicum virgatum
agcccgccgcctcctcctcctccacgcgcctccgcgccgtctcgccgtcccgtccccgcgtcccccgtggagtcgttcggcttcggcgcgctcaaggagaccgttctccgtggacgtggcggcggccgaggcgcgcgcgctcgacgtgcccctcgccgcgcccttcaccatcgcgacctcgcgcctcgaggccgtctccaacgtcgccgtgcgcgtcgagctccgcagcggcgccgtcggctggggggaggcggccgtgctgccctccgtcacggccgaggaccagccggccgcgctcgccgccgcgggccgggcctgcgacgcgctcgcgggcgcgcccgcggcaccgctcggcgcgatgctgcaggaagtcgccggtgtcctcccgggacacgccttcgcctcggctagagcaggagtggagatggcactgattgacgcagttgctaatagcattcgcatccctctgtggagattatttggaggggcatcagatactgtgaccacagacataacgattccaatcgtggccccaaatgaagctgctcaattggctgctaaatatcgagggcaagggtttcaaacgctgaagctcaaggttgggaaaaacttgaactcggatatagaagttctgaaggctatacggctcgtccatccagactgctcatttatcttggatgcaaatgagggatacacagctgatcaagcaattgaagttctcgatagattaaacgaaatgggtgtgacccctgtactctttgagcaaccagttcacagagatgattgggagggtctccgtgatgttagtattgctgccatggagaaatacaaagttgctgtcgctgctgatgaaagttgccggagtttacttgatgctcagaaaataatacatgggaatctggcccatgttattaacatcaagctcgcaaaattaggggttcttggagcccttgaaataattgatgctgcaagaaaagccaatgttgctttgatgattggcggcatggtcgagactagaatcgccatgggctttgctggtcacctagctgctgggcttggttgtttcagttttattgatctggacacgccccttttattgtctgaagatccagtttatggtggctacgaagcctttggacccctgtacaagtttacaaatgcccgtggccatggtggtttccttcacttggacaacaatggctcgaaatgaagatgattagtggatttgtctgtccgtctggagcttcatgcggagcattgcagtgcactccacacatgcattgttcaaacgggcaaccaccgttgtaactgaaaacagatgagcgataggaagcatgtagccttctgtttactgtagtccaatcagaatcagggttataaatctataacatttgatcaaggtgtagatagtagtatgtatactcataaggctgtatcagctggcattgttgttttatcgaaatattacaataaatatattgttatattgtgatctaaatattacacaaaaaaaaaaataaaa

SEQ ID NO: 2072 - DNA, 1461 bp, Zea mays
aatcccgagtctcgagcgagtagcgacggccgcgcctgcgcctgcctgcgtcttccgtggcggcgcccctacctctcgaacccgtcaggcggtctggccgacctcgcttcctcggctagctacctactcgccagcgtctattgtccagcaggcgcccagctcccaagcggccgcagtgcccctgcttctgcccttgcacgttcggcccctgtgctgcactgcacagtaaggtttgttttcttccattcagtttgttgtactgtggagatcaaactagctaagggcagagccaaatttggggattcttcaactgaagccttgtatagatatagtttgaaagatgatgaacgaacacagagaggaggatgccttgagaggtcaagcagtcaaaaaccagaaggcgatatgggacaagaccatggaaatgagattcttgctgcagaaggcgttttctacttccaacaagttaccccaggaatccatcagaacaaggttttgcaatcatgataagcagatagagcaagcatatgatgatcttttgaattcgacgaaacatactttgagcagcatgatggagctgcaggaggctttgcttgagagtaatcaggctacaaaggatgccaatgaaattccttctgcctcaaatggagacaatgacgagtggtcagaagtacagagattgcaggcaaggataacaacattcagaaataccgagatagataaatggcacaggaaaatacaggtgacaacgggtgctgctgcacttaaaggaaagctacatgcatttaatcagaacattagtgatcaagttgctggttacatgagagatccaagccggatgattaacaggatgtacttgaccaactctgctgttagagtatttggaaaggatgtgggagaacctggaacagctgaggaggggcacattatggaaggtgatcctgaacttattgatgattctgagttttatcaacaacttctcaaggagttccttgagtcatgtgatagaggggcatcaaagtcggcattttactctctaaaaaagcagcaggttaaaaagagaaagcttgtcgatcgtcgtgcttcgaagagcaggaagatacggtaccatgtccacgagaagatcactaatttcatggcaccggagcccatggttcttcctccaatggctccgaagttgtttgagaatttatttgggaatagcagctagaatccataaactgcagtaggtttacatttctttctgttgccttttctacttctataaactgtagtaggtatgatgtcactagacttagactgaattgtaagttttgatgtcctcatcagttttgtgcgtagacaagcagagcctagttcaccaatcaaattatgcttcgatttgggcctgatgagtgccatttaccggtggacccgcggtgagtcgtgatatacgtgattatcgaaaaatgagttttccta

SEQ ID NO: 2073 - DNA, 1298 bp, Setaria italica
cccccagcccaagaactggagtgcggcgctcgcgctcttcccgtctcctgttctgcggccgccgccacaaaccctctctcaccgttggcgacctcgccgccgtcgccttcatcctctcccccggcctctgccgctgccggactgtcttgttgtttgttgtagtgcgcgaggtcaacctaggcaagggcacccccaaaagttttcgggattcttcaactgaagctcgccccccgtgtggagaaagcttgaagatgatgaaccagcacagggaggaggatgccctgagaggttgcgcggtcaaaaaccagaaggcgatttgggacaagaccctggagatgagattcttgctgcagaaggcgttttccacttctaacaaattgccccaggaacccatcaagacgaggttttgcaatcatgataaggagatagagcaagcctatgagaacttggtgacgtcgtcaaagcagactctggctagcatgacggaactgcaggaggctttgctggagagtaaccaggctgtgaaggatgccaatgaaattccttctgcccccaatggagagaatgacgagtggtctgaagtacagaggttgcagacaaggataacgacatttagaaatactgagatagataaatggcagaggaaaatacaagtgacaacaggtgctgctgcactgaaaggaaagctacatgcatttaatcagaacataagtgaccaagttgctggttacatgagagatccaagccgaatgattaacaggatgtacttgaccaaatctgctgttggtgtgttcggagaggatgtgggagaacatggagcagctgatgaggggcgcattgtggaaggtgattctgaacttattgatgattctgagttttatcagcaacttctcaaggagtttcttgagtcatgtgatagaggggcatcagagtcagcattctatgctctacgaaagcagcaggtgaaaaagagaaagcttgttgatcgccgagcttcaaagagtagaaagataaggtataatgttcacgagaagatcactaacttcatggccccagtacccatggctcttcctccaatggccccgaagttgtttgagaatttatttggcacgagcaactagaaatccaccaaagcgtgaactcaaatttcacatataacgtgtagcaattttttgtagtcttgaaattgtagcatgtgcgatgttgctggacttgaaactgtgaatcgatcattttcattgtcaattttgtgcagcgacaagcaaatgcaagagttctatacttctatttgggttgag

SEQ ID NO: 2074 - DNA, 1220 bp, Pennisetum glaucum
gtcccgtcgccaggggccaccttcatcctcccccacggcctctgctgctgccggactgtcttgttgtttgttgtagtgcgcgaggtgaacctagccaagggcgccgaaattttttttgggattcttcaactgaagctcgccccccgtgtggagagagcttgaagatgatgaaccagcacagggaggaggatgccctgagaggtcgcgcggtcaaaaaccagaaggcgatatgggacaagaccctggagatgagattcttgctgcagaaggcgttttccacttctaacaagttgccccaggaacccatcaagacaaagttttgcaatcatgatgaggagatagagcaagcctatgaggacttgttgacgtcgtcaaagcagactctggctagcatgactgaactacaggaggctttgctggagagtaaccaggctgtgaaggatgccactgaaattccttctgcccccaatggagaaaatgatgagtggtcagaagtacagaggttgcagacaaggataacgacctttagaaatactgagatagataaatggcagaggaaaatacaagtgacgacaggtgctgctgcactgaaaggaaagctacatgcatttaatcaggacataagtgaccaagttgctagttacatgagagatccaagccgaatgattaacaggatgtacatgaccaaatctgctgttggtgtattcggagaggatgtgcgagaacctggagcggctgatgaggggcgcattgtggaaggtgatcctgaacttattgatgattctgagttttatcagcaacttctcaaggagtttcttgagtcgtgtgataaaggggtatcagagtcagcattctatgctatacgaaagcagcaggtgaagaaaagaaaacttgttgatcgccgtgcttcgaagagtaggaagataaggtataatgttcacgagaagatcactaacttcatggctccggtacccatggatcttcctccaatgaccccgaagttgtttgagaatttatttggcatgagcaactagaaatacaccaaagcttgaactcaaatttcacatataacattagtaattttttgtagtcttaaaattttagcatgtgcgatgttgctagacttgaaactgtgaatcgagcattttcaatgtcagttttgtgcagcgacaagcatatgcaagctttaactctgcattttaagttctatttgggttgag

SEQ ID NO: 2075 - DNA, 1017 bp, Panicum virgatum
atgccttgagaggacgcgctgtcaaaagccagaaggcgatatgggacaagaccctggagatgagatttttgctgcagaaaacattttccacttctaacaagttgccccaggaacccgtcaaagcaaggttttgcaatcacgataaggaggtagagaaagcctatgaggacttgtttgattcatcaaagcagactctgggtagcatgatggaattgcaggaggctttactgcaaagtaatcaggctgcaaaggatgccaatgaaattccttctgtcgcaaatggagagaatgacgagtggtcagaagtacaagagattgcagacaaggataacaacatttagaaatacagagatcgataaatggcagaggaaaatacaggtcacgacgggtgctgctgcactgaaaggaaagctacatgcatttaatcagaacataagtgaccaagttgctggttacatgagagatccaagccgaatgattaacaggatgtacttaaccaaatctactgttggtgtattcggagaggatgcgggagaacctggagcagttgaggaggggcacattgtggaaggtgatcctgaacttattgatgattctgagttttatcaacaacttctcaaggagtttctcgagtcgtgtgatagaggatcatcagactcagcattttatactctacaaaagcagcaggtgaaaaagagaaagcttgttgatcgccgcgcttcaaagagcagaaagataaggtatcatgttcacgagaagatcacaaatttcatggccccggtacccatggctgttcctccaatggctccgaagttgtttgagaatttatttggcacgaccaactagaaacccaccaaagcatgaattcaaatttcacataacatgtagcgattttttgtatttttaaaattgtagcatgtatgatgttgctatagacttcaatctgtgaatcgaacatttccatgatctgatcagttttgtgcatcggcaagcaaatgtaaggatcaatcttatcgt

SEQ ID NO: 2076 - DNA, 1111 bp, Panicum virgatum
tcctcccctgattcagttcgttgtagtggtcgagatcaacctagccaagggcaccccgagaaaaatttggggattcttcaactgaagctcgccccgtgtgtagtgagagtttgaagatgatgaaccagcacagggaggaggatgccttgagaggacgcgctgtcaaaagccagaaggcgatatgggacaagaccctggagatgagatttttgctgcagaaaacattttccacttctaacaagttgccccaggaacccgtcaaagcaaggttttgcaatcacgataatgaggtagagaaagcctatgaggacttgtttgattcatcaaagcagactctgggtagcatgatggaattgcaggaggctttactgcaaagtaatcatgctgcaaaggatgccaatgaaattccttctgtcgcaaatggagagaatgacgagtggtcagaagtacaaagattgcagacaaggataacgacgtttagagatactgagatagataaatggcagaggaaaatacaggtgacaacgggtgctgctgccctgaaagggaagctacatgcatttaatcagaacataagtgaccaagttgctggttgtatgagggatccaagcaaaataattaacaggatgtacttgaccaaatctgcagtcggtgtataaggagaggatgttggagaatctggagcatctgaggaggggcacgttgtggaaggtgatcctgaacttcttgacgattctgagttttatcaacaacttctcaaggagtttcttgagtcatgtgatagaggagcatcagagtcagcattttatgctctacgaaagcagcaggtgaaaaagagaaagcttgttgatcgccgcttcaaagagcagaaagataaggtatcatgttcataagaagatcactaatttcatggcccaagtacccatggctctttctccaatggccccaaagttgtttgagaatttattcggcacaagcaactagaaatccaccaaagcttgaatttgcacactataacgtgtagtaatttttgtagctctaaatttgtagcatgtatgatgttattattgaaactatgaatccaacattttcatgtttagttcctaaagcg

SEQ ID NO: 2077 - DNA, 2131 bp, Zea mays
aaaataacaatttttttcggtggaacgtgacattgggcaagtcctttccttcaccgctaccgaagtctacttccattcctctccttcctaaccccgcgtcgcccacgagctcgccgtgccggcagaggcgaggacctcgccgaagcagaggccatggggcgaccgcagccagccagggctggcgccatcaacatcgaggcgtgcgcgcggccgatcgccgtcgaccaccgtatcagtctcccgtactacttccgcatcgcgggcagcctcctccgacaggctaatatatatcggaacgagagtaacttgctcgacctgtatgtcatccttctgagatactcgagcttgctgtgcgagacgattccgaagcatcgtgattaccatgccttcaagttaagagaaaaggcattttttgataaacttattgatattatcaaagagcttgagacattgaagccagttgtgcagcggcaggttgttgagcataacagaggaagtactgtggaatttaatactaatagtctaaatggaaactacggtacaactcgtaggatagagcagtgtactccaagctcttatactccacagacatttgtaggcagcagtaatggagcattgcaaaaacccttccatgctgggagacaagtggcatcattatcaagtgtacagaaacaatttatgaatctaccatatccaaaagaagaaacactagctagacactccatattaggacctaatggtcttaatggccggtggaatgggcctgttactggaatcaaggttcaatatccaagcaattttgaattaacacaaaatggtataacaagtttagtgccatccatcttgaaccaagatgatttgcatggttccaacactgcacctgcacctccacctccaagtagctcctcaaatgacaatgacaatatgaaatctgttctctctcttgatgatggtcgatggtctgtaccagcagaagaacacactccacttccttctgctaatttggaagaggagttgttccaattgaatatcaaacaaccttctcctccaccagttcttgcagaggtacaaagaccaatttctccatcaagagttgccgatccaacaccaggacttccgacctcaggaactgcccgatttcagaacttgcatgttccgatcaagttgatggagtgttttctaagggttgctgagtcaaacaccaaaagaagcttagaaacctgtggggttcttgctggtaccctgaaaaatagaactttttatgtgacaaccttaattattccaaagcagaaatcgacatctgatacgtgtgaagctacaaatgaagaagaactatttgaagttcaggacacatactcattgttcactcttggttggattcatacacatccaacacagtcctgcttcctttcttccattgacgtccacaatcattattcttatcaggtcatgctacctgaagcaattgcaatagttatggcacctactgacacaagaaaacatggtatatttcatctcacggatccaggtggcatgggcgtgatccatgattgtcaagagagaggtttccatcctcacaaggcaccacttgatgggtcgccaatatatgagcagtgctcccatgtgtacatggacaccgatataaagttcgatatgattgatctgcgacaaagatgacgaagctcacctttgggtttattttgcaacctatacttctcgcagttaaatcaattgctgccttatttttttcttagctcaagatttgtgaattcttatgtacgctgttgtacatagctattgcgttgtatagggaaaaccattgaggtaataatatcattggtaatgcttcgttgtaattcattccttcaacctcgcaaggcacgtttgtgcggcaagatgaggaagtggtgtctggattttatgccatgccaaatatttgacttaaaagggcatcaaatatcacaaattgttaaaggtctcatttcttagactatcttcattagactatcttcagtagacttcttatcccactctttattttaaacttcactctgcaaatagtgtaatctacagtacaaattttgcacggccgtttatatgacctgctagagatggacttagagacttatga

SEQ ID NO: 2078 - DNA, 2126 bp, Zea mays
tttttttttgagagaaacttaaggaccttcaaaataaataaataaaagattcttgacctttttaatccgtcaaacttaaatttaccgatccttgaagagcataagcgccgcatccgcccgcagtccaatgtgacgacatcacgagttcacgacatactgacattcggcaattccttccctccaaactaccgaagtctacttccattccttcctttctcctttcatatacccgcgtcgcccacgagcccgccgtgccgacagaggtgtggacctcgccggagcagaggctatggggccaccgcagccagccaggcccggcgtcatcaacatcgaggcctgcgcgcggccgatcgccgtcgaccaccgcatcagccttccctactacttccgcatcgcgggcagcctcctccgacaggctaatatatatcggaacgagagtaacttcctcgacctatatgtcatccttctgagatactcgagcttgctgtgtgaaacaattccgaggcatcgtgattaccatgccttcaagttaagagaaaaggcattttttgataaacttgttgatgttatcaaagaacttgagacattgaagccagttgtgcagcggcagattgccgatcataacagaggaggtactgtggaatctaatatgaatagtctaaatggagacaatggtacaactcataggatagagcagcatactccaagctcttatactccacagccatttgtaggtagcactaatggagcatcgcaaaaatccttccatgctgggagacaagtggcatcattactgagtgtccagaaacaatatatgaatctaccatatccaaaagaagaaacactagctagacactccatattaggacctaacggtcttaatggtcgatggaatgggcctgttactggaattaaggttcagtatccaagcaattttgaattaacacaaaacgatataacaagtttagtgccatccatcttgaaccaagatgatccgcaaggtcccagtactgcacctccacctccagatagcccctccaatgacaatgacgatatgaaatctgttctctctcttgatgatggtcgatggtctgtatcagcagacgaacacacttcatttacttctgctaatttggaagaagagttgttacagttgaatatcaaacaaccttctcctccaccagttctggcagaggtacaaagaccaatttctccatcaagagttgctgatccaacaccaggacttccgacctcgggaactgcccgttttcagaacttgcatgttccgatcaagttgatggattgttttctaagggttgccgagtcaaacaccaaaagaagcttagaaacctgtggggttcttgctggtaccctgaaaaatagaactttttatgtgacaaccttaattatcccaaagcagaaatcgacatctgttacgtgtgaagctacaaatgaagaagaactatttgaagttcaggacatgggctcactgttcactcttggttggattcatacacatccaacacagtcctgcttcctttcttccgttgacctccacaaccattattcttatcaggtcatgctgcctgaagcaattgcaatagttatggcacctactgacacaacaagaaaacatggtatatttcatctcacggatccaggtggtatgggcgtgatccatgattgtcaagagagaggtttccatcctcataaggcacctcttgatggttcgccaatctacaagcaatgctcccatgtgtacatggacaccgacataaagtttgatatgattgatctccgagaacgatgagagcctaacttttttgggtttattttggagcccatactgtagttaaatcaagttgctgcctttttcttagtcgtgctgaagatttgtggattcttatgtatgctgttgtacatagctattgtattgtatagagaaaacaattgagtgaatgatatcagtcattgctgctttgttgcgattcatcccatatcctcgcgaggcacgtttgtgtggcaagatgaagtgatgtctagattttataccatgccaattctccatacttgaatatttgacttgaagagcactaaatatcactgattgttaaagctctattatc

SEQ ID NO: 2079 - DNA, 2037 bp, Setaria italica
cccgcagctgcccgcagtccaattccaacgtgacccaattcggcaattccttcaccgctgccaaagtctactgccattcctaccccctcctaaccccgcgtcgccacgagctcgccgcgccggtgaaggagggggacctcaccggagcagaggccatggcccccccgcagccagccaggggcggcgccatcaatatcgaggcgtgcgctcggccgatcgccgtcgacaaccgcatcagcctcccctactacttccggatcgcgggcagtcttctccggcaggctaatatatatcggaacgagaagaacatcctcgacctgtatgtcatcctgctgagatactcgagcttattgtgtgagacgataccgaagcatcgcgatttccttgccttcaagttgagagaaaaggcgttctatgataaacttaatgatgttatcatagagcttgagtcattgaagccagttgtgcagcggcaggttgccgagcataacagaggaggtactgtggaatcaaatactaatagtctaaatggtacctatgctacatctcgtaggatagagcagcataccccaagcttgtatactccacagccatttgtaggtagcgctaatggagcactgcaaaaatccttccatgtcgggagacaagtgccatcattaccaagtgtccaacctgataagcagattcagaaacaatttatgaatctgccttatccaagtgaagaaacactagctaggcactccatattaggacctaatggtcttcatggccgatggaatgggcctgttactggaattaaggttcaatatccaagcaattttgaattaacacaaagtgacatgacaagtttagtaccatccatctcgaaccaagatggttcaaatggtcccggtactgcacctccagatagctccacaaatgacaatgaggatatgaaatctgttctctctcttgatgatggtcggtggtctgtaccagcagaaaaacgaaccccacttccttctgctagtttggaagaagagttgttccaattgaatatcaaacagccttctcctcctccagtcctggcagaggtacagagaccaatttctccatcaagcgttgctgatccaacaccaggacttccgacctccggaactgcccgttttcagaacttgcatgttccgatcaagttgatggagtgctttctaagggttgctgaatcaaacaccaaaagaagcttagaaacttgtggggttcttgctggtaccctgaaaaaaagaactttttatgtgacaaccttaattattccaaagcagaaatcaacatctaatacgtgtgaagctacgaatgaagaagaactatttgaagttcaggacacgggctcacttttcactcttggttggattcatacacatccaacacagtcctgcttcctgtcttccattgatctccacaatcattattcttatcaggtcatgctacctgaagcaattgcaatagttatggcacctactgacacaacaagaaaacatggtatatttcacctcacggatccaggtggtatgggtgtgatccatgattgtcaagagagaggtttccatccacataaggcacctctagatggctcgccaatctatgagcagtgctcccacgtctacatggacactgatataaagtttgatatgattgatctccgagaacgatgacaaagctcaacttcatttggtatatttggagtctatacttctggcagttcaacaaatagctgccttattttttttagttgtgcttaagaattgcgaattcttatgtaagcagttgtacatagctgttgcattgtacagagaaaaaattgaattaatgatatgattggtaaccttcgaggtcattgaggctttgttgtaattcatccctttaaccttgcaaggcacacgatcacgtgacaagatgaggaagtgctgtacttcattttcatgccatgccttgccttcggtacattgctgaatctttgaccttaatattatgaatgcatcgattgtttaagctatatttttt

SEQ ID NO: 2080 - DNA, 2041 bp, Panicum virgatum
cggagccgcacccgcccgcagtcccaattccaacgtgacccaattcagcaattccttcaccgctacccaagtctactgccattcctacccccgcgtcgccacgagctttcaccgcgccggcgaaggaggggcggcctcgccggagaagaggccatgggcccgccgcagccagccaggggcggccccatcaacatcgaggcgtgcgcgcggccgatcgccgtcgacaaccgcatcagccttccctactacttccgcatcgcgggcagcctcctccggcaggctaatatatatcggaacgagaaaaacatcctcgacctgtatgtaatcctgctgagatactcgagcttgttgtgcgagacgatacccaagcatcgtgatttccttgccttcaagttcagagaaaaggcgtttttcgataaacttactgatgttatcaaagagcttgagtcattgaagccagttgtgcagcggcaggttgccgagcataacagaggaggtactgtggaatctaatactaatagtctaaatggaacctatgctacaactcgtaggatagagcaacattccccaagcttgtatactccacagccatctgtaggtagcgctaatggagcgctgcaaaaatccttccaaattgggagacaagtgccatcattaccaagtgtccaacatgataggcagatgcataaacaatttatgaacctgccttatccaagtgaagaaacactagctagacattcgatattaggacctaatggtcttcatggccggtggaatgtgcctgttactggaattaaggttcaatatccaaacaattttgagttaacacaaaatgatatgacaagtttagtgccatccatcttgaaccaagatggttcatttggtcccagtacgtcacctccagatagctccacaaatgaaaatgaggatatgaaatctgttctctctcttgatgatggtcgatggtctgtaccagcagaagagcaaaccctaatcccttctgctagtttggaagaagagttgttccaattgaatatcaaacagccttctcctccaccagtcctggcggaggtacaaagacctatatctccatcaagagttgctgatccaacaccaggacttccaacctcaggaaccgcccgctttcagaacttgcatgttccgatcaagttgatggagtgctttctacgggttgctgaatcaaacacaaaaagaagcctagaaacttgtggggttcttgctggtaccctgaaaaaaagaactttttatgtgaccacattaattattccaaagcagaaatcgacagctaatacgtgtgaagctacaaatgaagaagaactatttgaagttcaggattcatgctcacttttcactcttggttggattcatacacatccaacgcagtcctgcttcctgtcttccattgatctccacaatcattattcttatcaggtcatgctacctgaggcaattgcaatagttatggcacctactgaaacaacaagaaaacatggtatatttcatctcacggatccaggcggtatgggtgttatccatgattgtcaagagagaggtttccatcctcataaggcacctctggatggctcaccaatttacgagcagtgctcccatgtctacatggacaccgatataaagtttgacatgattgatctccgagaacgatgacgcagctctacttcactcggtctatttggagcctatacttcaggcagttcaacaaatcgctgccttatttttttagttgtgcttaagaaatacatattcttatgtaagcagttgtacatagctattgcattgtatagagaaaattggttaccttcaaggtccttgagggctcgaagccttgttgtaattcatccctttaacctcgcaaggcttcatgtgacaagacgaggaagtgctgtatttaatttttaagccatgatctttgtacctcgttgaatgtttgacctaaataacattaaattccatcgattgtttgagctcaatttattattttatacgagacattaggtttcca

SEQ ID NO: 2081 - DNA, 1932 bp, Panicum virgatum
acccctcctagcccgcgtcgccacgagctcgccgcgccggcgaaggaggggaggggcgacctcgccggagaagaggccatgggcccgccgcagccagccaggggcggccctatcaacatcgaggcgtgcgcgcggccgatcgccgtcgacaaccgcatcagcctcccctactacttccgcatcgcgggcagcctcctccgacaggctaatatatatcggaacgagaaaaacatcctcgacctgtatgtaatcctgctgagatactcgagtttgttgtgcgagacgataccgaagcatcgcgatttccatgccttcaagttgagagaaaaggcgttttttgataaacttagtgatgttatcaaagagcttgagtcattgaagccagttgtgcagcggcaggttgccgagcataacagaggaggtactgtggaatctaatactaatagtctaaatggaacctatgctacaactcataggatagagcagcataccccaagcttgtatactccacagacatttgtacgtagcgctaatggagcactgcaaaagtccttccaaattgggagacaagtgccatcattacccagtgtccaaaaagataggcagatgcataaacaatttatgaacctgccttatccaagtgaagaaacactagctagacattccatattaggacctaatggtcttcatggccgatggaatgtgcctattacaggaattaaggttcaatatccaaacaattttgaattaacacaaggtgatatgacaagtttagtgccatccatcttgaaccaagatggttcacttggtcccagtacagcacctccagatagctccacaaatgacaatgaagatatgaaatctgttctctctcttgatgatggtcgatggtctgtaccagcagaagaacaaaccctaattccttctgctaatatggaagaagagttgttccaattgaatatcaaacagccttctcctccaccagtcctggcagaggtacaaagacctatatctccatcaagagttgctgatccaacaccaggacttccaacctcaggaaccgcccgctttcagaacttgcatgttccgatcaagttgatggagtgctttctacgggttgctgaatcaaacacaaaaagaagcctagaaacttgtggggttcttgctggtaccctgaaaaaaagaactttttatgtgaccacattaattattccaaagcagaaatcgacagctaatacgtgtgaagctacaaatgaagaagaactatttgaagttcaggactcatgctcacttttcactcttggttggattcatacacatccaacgcagtcctgcttcctgtcttccattgatctccacaatcattattcttatcaggtcatgctacctgaggcaattgcaatagttatggcacctactgaaacaacaagaaaacatggtatatttcatctcacggatccaggcggtatgggtgttatccatgattgtcaagagagaggtttccatcctcataaggcacctctggatggctcaccaatttacgagcagtgctcccatgtctacatggacaccgatataaagtttgacatgattgatctccgagaacgatgacgcagctcaacttcactcggtctatttggagcctatacttcaggcagttcaacaaatcgctgccttatttttttagttgtgcttaagaaatacatattcttatgtaagcagttgtacatagctattgcattgtatagagaaaattggttaccttcaaggtccttgagggctcgaagccttgttgtaattcatccctttaacctcgcaaggcttcatgtgacaagatgaggaagtgctgtatttaatttttaagccatgatctttgtacatcgttgaatgtttgacctaaataacattaaattccatcgattgtttgagccc

SEQ ID NO: 2082 - DNA, 2303 bp, Zea mays
gagcagcggccacgcattctcccttccctggactattcttggtgggtggagagagccgcagaaggcagctggaagaggagaggaccgcgcgaggctccgtgccggcgagttcgggtgcttttcctgcggtccgagatgcgatcgttgggacccgggagacagcgcagctcgggttcgggttcgggggggcggtagccacctgagcaggatgtttaactggaacgacgagcagcaccaggtaagggatgcaatatgggctgaattcaatgagtgtgatgaccattttgggctttgcccaaagggggcaaaaaaaaacccaatatttatttccggggtccgcaaaaacaatgaggaagaggtggctagtattgctgccatcactgaacagtctgcaggtgttcaaaatggacatcaagggatggaaaagcagactgcaagtcacacaagtgcacatatttcagccacacaaattgacatggaatcctggcccgaacttccttccctgaatcctacacttgatagaaactatagtgatgacaacatagcatccacatatctggatttttgtgctgcaaccagtttacaagaagtgaccagaaattctacagagcaactagatggtaaatcagaagtgtttggtaatgatcaagaagaaaagagtaacagtttccttgattgcgactggggcaatattggaggttttgatgattttgaccgtctatttagccatagtgactccatatttggtaatgagatagttgccaacgacagtgattttctttctgcatcttcgaatttgatggatactgctgtgctatcaatcccagttccggtcgaagcacataagaggccagtgtggtcacgtagaaaaccagaggaaagaggtaaaagtaaaatatccagcagtacaagtggcttctcccacagcaaagtagagagttcatcgacgaatttgcaaactcctatggaacctgtacagactcctcaatatgcactgttccaggatagcaagaagataggagaagttcagcatgctaatcagtttatgtttcctggatatgggtatcctcctgcatatccatttcctaccattccgttagtgtcaaacattcaagctgaaggctatcagacaaaaccagctggcacaagctaccgaacttcggaagattacctaaaacagtcaagttccacagaaatgtcacaagatataccatcaagaccactaacaatgacaccacaagaaaagatagaaaagcttaggcgccggcaacaaatgcaagcactgatagctattcagcaacaacagcaacagtttggtcaacagggtcctggcagtgacacaatggtgtctcaagcatacacccctggtaacaaaaatccggattccttagggagttcaattgtcatagatgaaaacacaaataaggttatttcgcctgagatgattccaactgaccatgaccgggttcacaagagttctgcaatttcagatgatccctttatagaggaaaaaatatattatcaactacaagatgctcttgacaagttggataccaaaactcgactatgcattcgagatagtttacttcgtttggcccatagtgcaacagagagacaaattgatggtgataggagcactaacaagacaaataaagatgaagatgaagcttcggaagacgcatctactaggaaaacaaggtctccaaacaaggaagcagaaacaaccactaatccaattgatcgtatagtggcccatttgctgttccacagacattgctccaaggttgcaaaagcaacaaaagaaataatatcgtcaatccccttgactctagaacctgagccgaaggtacccttgggaactcctagggttccatcaaaagatcaacgagatgagcaagaaattgtgttgcaaccatcacaataatgtgagatgtgctagaagataaggttttactcaatttgagtaaacttatttgcatttagttagcctatgaatctaatgtcgtccttctaatgagtatagtacacatgctgattaatcaactgttcaggataaaaaattatgcaaatccagtgatgatggcagtcttatgatcacctgtggccccggagatcgcttgtgtaatatgtagccatttcaacattgtaggatccttttattttcatcctgtaagaacatctcagattgtataggaacctacgattttgtgccgagccgtaaaaagagcaaaccttggctctggacataaggcgtgtttaggagcaagaggattaaagcaaaccttggctcttggctctggaca

SEQ ID NO: 2083 - DNA, 1620 bp, Zea mays
aactttctttcgtgcgcgcctgtcatcgtccggctcagagccgccacagcctcgccgtcgattctctcccctccccttcgtcctcacgagcgacgaacgtcacgaacccctcctccacctcctgctactatcggcgccggagccctcctctggtctcaccgtgcaaatccccaaccccgaggcagacgcaggccagcccctgtgatggcacagaccaacggcaacgaccccttcagtccccctgtttcccaagaaagggttgtgataacaaacaagcatggtgagaggcttgtggggctgctgcatcacaccgcttcaaacaagattgtggtcttgtgccatggttttatagctaccaagaatgacagcctcattcttgacctggcggaagcgttgacaaaggaagggatcagtgtcttccgcttcgatttcagtggaaatggagaaagtgaaggccagtttgagtatggcaactacaggaaggaggctgacgatttgcattctgttgtattgtatctgtgtcaaaaaagttatgatatagcagctgttgttggtcatagcaaaggaggagatgtggtgattctatatgcttctgtccatgatgatgtgggcacaattgttaatttatcgggccggtttgatttaagaaaaggcattgaagaacggataggggaagggtctatcgataaaataaacaaagaaggctaccttgatgtcaaggataaatctgaaaatgccagctacagggtaaccaaagaaagtttgatggaacggcttaatactgatatgcgcgctgcaagtgtttccataagcaagggatgcaggttcttaacagtccatggctcagctgataagaccatacccgtagaagatgcccatgagtttgcgaagcatatacccaaccatgaactgcgtgtcatagaaggagcaaatcataactacacctcacatcgcaaagaagttgctgatgcagtagtagatttcatcacgtccaatgtaaccgtataataaggctgggggatgaatgtcattccagaccacttggtcatgcacctatcgatcccctccatcatggggcaatactggtactaggtgtctattatcttctgaaccgaaaaccccatgtcatgcaggtttgatatgatgatgttgctcgtatgtgctcttaagaattactgtaaatattgaactcctggtagacttgtatgccgcagctcgcagtttatataggctcatatctctatagtttttttttctttcttctttgttcgagggctctattcccttgctcttttttgcctggttcatgtaagttttcttccttgtaccctatagttatttaatttatttaaatttggcactgtggactattttgtacaagaagtcttagtacaaacgtacaagcaggcctattggttcttttagatcgtgatctaatcatagttgtacattttagtacttaaaacctgccccaccaacaggtatataagtattgggcaacaatctgcgtgagctggtggaggatttaaacacacaagaccatttcaacacacgtgaataaattttactctaaaccatttcgacatggtttgttcactagtgcaaaaagaaaagaaaaga

SEQ ID NO: 2084 - DNA, 3503 bp, Panicum virgatum
cggggatttcctaagatgctcgaagccaaagccaaccgaggaaaaattgcatcaatgctagtctacgacttaagagtcacatgatcaacatagcatcaaagaaaaaaaactactttagggtcaggcaatggaagcattcttgttggccacgataagccgatcgaatattaaacacgtgacatgggcgagatctgatctacagatctgctattacgtcatcaaacatttagctttgactctgataaacaaatttaggtttatgcaagtgttcgagcattcaatttcgtagaaataacaatgtgagggtcatcctctcagaaacgcaacccaccggtgtactatacaattgatccatgtctttcatgctgtcttttatcctcttccacaaatgcaaaacgttcccatcagtggacgtcatccgaaaccaaagtgaaacactgcgggatacagtgtgtacatctggatcggcctgcagttttggccctacttgggtcagttttaaaatagttgagtcagcatcgaacatagtatatgcgtgtcatcgtctagagttaaactgcgaggagctaaagcagaaataaagctaccaacctaccttatcaccattgctctacctacgcctccacagccaaaagagctccatgagaagaagaatgactgcactgctctatcttctcctccttccattgctctcctacaagatttgctctggcgcatcgccatggcagaccatgaccaccggctcgcacatcagaggagaggacaacaacgaggtcttcctcatctcaccggaccgcaccttctcttgcggattccacgagcttggcacaaatgctctcaccttctccatctggtacaccacaaccaccaccaatagaaccgtcgtctggacggcaaactcctactccgcggagagtggctactctcccgtgaacaaacacggctccaggatatcgctgaaccacgaaggcaacctgatacttacagataccaatggttccacggtgtgggagagcagaacatcgtctggcaagcacacaaaagtagccctcctcaacagcggcaaccttgtgatcaacgactccagcaacaatatcgtgtggcagagcttccattcgccaactgacaccttgctcccggggcagaacctgacaaaggacacaaggttagtctctggttaccatcacctctatttcgacaacgacaacgtcctgcggatgttgtatgatggcccagagatcacaagcatctactggccaagtccggattacaacgctgaaaaaaatggccgcaataggttcaacagcaccaggatagcagttctagatgacatgggtaattttgtgtcaagtgatgggtttaagatagaggcttcagattcaggtccaggaatcaagagaaggatcacaatcgattatgacggcaatttcagaatgtacagtttgaatgcatcaacatggaaatggagtgtcacaggacaggctgtaatacagatgtgctatgtgcatgggctatgtggaaagaatgggctctgtgactacaccaatcgtctccagtgtagatgccctccagattatgagatggttgatccaacaaattggaacaaaggatgccgaccaatgttctcaactgataaaaaccaatcacctgatgattttacatttgtcaagcaacctcatgccgactactatggctttgatctgtcctcaaataaatccatctcatttgaagcatgctggaacatttgcttgaacaccagtacctgcttatctttcacatacaagggtggagatggttggtgttacactaaagatttactttacaatggtcaggtctacgtgtattttcctggagacaactatatgaaagtaccaaagaattcgagtagcttgatatccacaatctctaaaaaggaaagcctcacctgtggaccaccaggttctgaggtcatgctaggatcagcaagtatgtatggaacaaagaaggacaacataaactggacatacttctatgtctttgctgcaatactgggagctctagagttgcttgttattgtgacgggctggtaccttttcttcaagaagcataacatccccaaatcaatggaggatgggtacaagatgattacaaaccagttcaggcggtttacataccgagaactgagggaagcaactggaaagttcaaagaagagcttgggagaggaggagcaggaatcgtctacagaggtgtgcttgaagataagaaaatagtggcagtaaagaagcttacagatgttcgccagggagaggaggaattctgggcagaagtgacacttattggaagaatcaatcacataaatttagtcagaatgtggggattttgctcagaagggccaaacaggctattagtgtatgagtatgtagagaatgagtcactggataagtacctctttggtgagagaagtacggaaagcctgcttggttggagccaaaggttcaggattgccctgggcactgcaagaggccttgcttatcttcatcatgaatgccttgagtgggttgttcactgtgatgtgaagccagaaaacatactcctaacacgagactttgatgccaagatagcagactttggactggccaagcttgcaaagcgagatagcactagcttcaattttacccatatgagaggcacaatggggtacatggcaccagaatgggcactcaatttgccaatcaatgcaaaggtcgatgtttacagctatggggtcgtacttctggagattgtgactggaatcagggtttcgagtggcatattgttagaggaaagacagatagatttcctggagtttgtccaggaggctaaacatattctgtctaccgggaatgttggtgacattgttgatgataggttgcatggccattttgatacagagcaggcaattgcaatggtgaaaatagccttttcatgcctcgaagaaagaagcaagaggccgacaatggatgaaattgtcaaggtgctcatgtcttgtgatgatgaagatgactaccatccagcttattcatattgacttgcaacagatgccagatcagcggaaggcataacaagtttcatgccaaatgcacctttgatcatgttagtataggaacaatgagaaaagataaaaagctctgactgcatggatgtactgtaaaatgtggagattgtgatctttgaatgcaataatgtcaatattactagaacccagcagctgcagttcctttatcttaattacgtttgctaattagataaagaggggaggagcacagcctgagaatttcatctccctaaacattttcaccgtcacaagtttcagcacaccatattcacaaagactgattagttttatcccttccatcaataggcaaatatactccgatatcattgtacacaaagacatacagggaactattttgttacctgagaagcagcatccacaaaatttattggaaacagcctcttttcagcagtaaaatggagcctccac

SEQ ID NO: 2085 - DNA, 2612 bp, Setaria italica
ctaaagcagagataaagctaccaacctgtacccctaccgccctacgcctccacagccaaaagagctccctgagacggagaagaatggctacgctgctctatctcctcgttcttccgttgctctccttccagatttgctccggtgcttcgccatggcagaccatgaccaccggctcacacatcagaggagaggatcatgacaaggtcttcctcatctcgtcggaccgcaccttctcttgcggcttccacgagcttggcacaaatgctctcaccttctccatctggtacaccacaagcaccaccgatagaaccgtcgtctggacggcaaacccctactccgcggagagtggctactctcccgtgaacaaatatggctccaggatatcactgaaccacgacggcaacctgatactcacagataccaacggttccagggtgtgggagagcaggacgtcgtctggcaagcacacgacaattaccctcctcaacaacggcaaccttgtgatcaacgactctgacaacaaaatcgtgtggcagagtttccattcaccaactgacaccttgctcccggggcagaccctgacaaaggacacaaggttagtctctggttaccatcacctctacttcgacaacgacaacgtcctgcgaatgttgtatgacggcacagagatcacaagcatctattggccaagtccagattacaacgcagaaaataatgggcgcaataggtttaatagcaccaggatagcagttctagatgatgtgggtaattttgtgtcaagtgatgggtttaagatagaggcttcagattcaggtccaggaatcaagagaaggatcacaattaattacgatggcaatttcagaatgtacagcttgaatgcatcaacagggaaatggaacgtcacagggcaggctgtaatacagatgtgctatgtgcacggcctatgcggaaagaatgggctctgtgactactctggtggtctcagatgtagatgtcctccagattatgagatggttgatccaacaaattggaacaaaggatgcagaccaatgttctcgattgacaaaagccgagcaactgaggattttacatttgtcaagcaacctcatggtgactactatggctttgatctgtcctccaacaaatccatctcatttgaagcatgctggaacatctgcttgaacaccagtacctgcttatctttcacatacaagggtggagatggttggtgttacactaaagatgtactttataatggtcaggtgtacacatacttccctggagacaactatatgaaaataccaaaaagttcaaatagtttgataccctatatctctaaacaggaaagcctcacatgtggaccaccaggttccgagatcatgctaggatcagcaagcatgtatggaacaaagaaggacaacataaattggacatacttctatgtctttgctgcaatactgggagctctagagttacttgttattgtgacaggctggtaccttttcttcaagaagcataacatacccaaatcaatggaggatgggtacaagatgataacaaaccagttcaggaggtttacataccgagaattgagggaagcaactggaaagttcaaagaagagattggaagaggaggcgcgggaatcgtatacagaggagtgcttgaagataagaagatagtggcagtaaaaaggcttacaaatgttcgccagggagaggaggaattctgggcagaagtgacccttattggaagaatcaatcacataaatttagtcagaatgtgggggttttgctcagaagggacaaacaggctattagtatatgagtatgtagagaatgagtcactggataagtacctctttggtgagagaagtactgaaagtctgcttggttggagccaaaggtacaggattgccctaggcactgcaagaggccttgcttatcttcatcatgaatgcctcgagtggattgttcactgtgacgtgaagccagaaaacatactcctaacacgagacttcgatgccaagatagcagactttggactggccaagcttgcaaagcgagatagcactagcttcaatttcacccacatgagaggcacaatggggtacatggcaccagaatgggcattgaacttgccactcaatgcaaaggttgatgtttacagctatggggtcgtgcttctggagattttgactggaattagggtttcaaatggcataatgttaaaggaaagacaaatagattttctggagtttgtccaggaggctaaacatattctatcttccgggaatgtcagtgatattgttgatgataggttgcatggccattttgatacggagcaggcaattgcaatggtgaaaatagccttttcatgcctcgaagaaagaagcaagaggccaacaatggatgaaattgtcaaggtgctcatgtcatgtgatgatgaagacgactaccatcctgcttattcatattaacttgcaacagaatcaaagaattgagctgcaggcataacaagtttcatgctaagtgtacctttgatcatgttagtataggaacagtgagacaagatgaaaagagctggctgaatgaatgtactgtaaaatgtggag

SEQ ID NO: 2086 - DNA, 2558 bp, Panicum virgatum
agaatgactgcactgctctatctcctccttattccattgctctccaagatttgctctggtgcatcgccatggcagaccatgaccaccggctcgcacatcagaggagaggaccacaacgaggtcttcctcatctcaccggaccgcaccttctcttgcggcttccacgagcttggcacaaatgctctcaccttctccatctggtacaccacaagcaccaccaatagaactgtcgtctggacggcaaacccctatttcgcggcgagtggctactctcccgtgaacaaatatggctccaggatatcgctgaaccacgacggcaacctgatactcacagaaaccaatggttccacggtgtgggagagcaggacatcgtcaggcaagcacacaacagtagtcctcctcaacaacggcaaccttgtgatcaacgactccagcaacaatatcgtgtggcagagcttccattcgccaacggacaccttgctcccggggcagaacctgacaaagggcacaaggttagtctctggttaccatcacctctatttcgacaacgacaacatcctgcggatgttgtatgacggcccagagatcacaagcatctactggccaagtccggattacaacgctgaaaaaaatggccgcagtaggttcaacagcaccaggacagcagttctagatgacatgggtaattttgtgtcaagtgatgggtttaagatagaggcttcagattcaggtccaggaatcaagagaaggatcacaatcgattacgatggcaatttcagaatgtacagtttgaatgcatcaacagggaaatggaacgtcacaggacaggctgtaacacagatgtgctatgtgcacgggctatgcggaaagaatgggctctgtgactactccagtggtctccagtgtagatgccctccagattatgagatggttgatccaacaaattggaaccaaggatgccaaccaatgttcttgactgataaaaaccaatcacctgaggattttacatttgtcaagcaacctcatgccgactactatggctttgatctgtcctcaaataaatccatctcatttgaagcatgcaggaacatttgcttgaacatcagtacctgcttatctttcacatacaaggctggagatggttggtgttacactaaagatttactttacaatggtcaggtctacatgtattttcctggagacaactatatgaaagtaccaaaaaattcgaatagttctttatccccaatctctaaaaaggaaagcctcacctgtggaccaccgggctctgaggtcaagcgaggatcagcaagtatgtatggaacaaagaaggacaacataaactggacatacttctatgtctttgctgcaatactgggagctctagagttgcttgttattgtgacgggctggtaccttttcttcaagaagcataacatacccaaatcaatggaggatgggtacaagatgattacaaaccaattcaggcggtttacataccgagaactaagggaagcaactggaaagttcaaagaagagcttgggagaggaggagcaggaatcgtctacagaggtgtgcttgaagataagaaaatagtggcagtaaagaagcttacagatgttcgccagggagaggaggaattctgggcagaggtgacacttattggaagaatcaatcacataaatttagtcagaatgtggggattttgctcagaagggccaaacaggctattagtgtacgagtatgtggagaatgagtcactggataagtacctctttggtgagagaagtacggaaagcctgtttggttggagccaaaggtacagaattgccctgggcactgcaagaggccttgcttatcttcatcatgaatgccttgagtgggttgttcactgtgatgtgaagccagaaaacatactcctaacacgagacttcgatgccaagatagcagactttggactggccaagcttgcgaagcgagatggcactagcttcaattttacccatatgagaggcacaatggggtacatggcaccagaatgggcactcaatttgccaatcaatgcaaaggttgatgtttacagctatggggtcgtacttctggagattgtgactggaatcagggtttcaagtggcatactgttagaggaaagacagatagatttcctggagtttgtccaggaggctaaacatattctgtcttccgggaatgttagtgacattgttgatgataggttgcatggccattttgatacagagcaggcaattgcaatggtgaaaatagccttttcatgcctcgaagaaagaagcaagaggccgacaatggatgaaattgtcaaggtgctcatgtcttgtgatgatgatgactaccgtcctgcttattcatattgacctgcaacagatgccagactagctgaagacgtaacaagtttcatgccaagtgcaactttatcatgttattataggaacgatgagacaagataaaaagctctgactgaatcgatgtaatgtaaaatgtggagattgtgatatttgaatgcaataatgtcaaaattact

SEQ ID NO: 2087 - DNA, 2839 bp, Panicum virgatum
accggggatttccaagatgctcgataccaaccgaggaaaaattgcttcaatgctagtctacgacttagagtcacatgatcaacatagcatcaattaaaaaaaagctactttagggtcacgggcaatggcagcatccttgttggccacgataagccgatcgaatattaaacatgtgacatggccgagatctgatctacgcatctgctattacgtcatcaaacatttagctttcactctgataaacaaatttaggtttatatgcgtgtcatcgtctagctaccaacccaccttatcaccattgctctaccttcctacgcctccacagccaaaagagctccctgagaagaagaatgactgcactgctctatctcctccttattccattgctctccaagatttgctctggtgcatcgccatggcagaccatgaccaccggctcgcacatcagaggagaggaccacaacgaggtcttcctcatctcaccggaccgcaccttctcttgcggcttccacgagcttggcacaaatgctctcaccttctccatctggtacaccacaagcaccaccaatagaactgtcgtctggacggcaaacccctatttcgcggcgagtggctactctcccgtgaacaaatatggctccaggatatcgctgaaccacgacggcaacctgatactcacagaaaccaatggttccacggtgtgggagagcaggacatcgtcaggcaagcacacaacagtagtcctcctcaacaacggcaaccttgtgatcaacgactccagcaacaatatcgtgtggcagagcttccattcgccaacggacaccttgctcccggggcagaacctgacaaagggcacaaggttagtctctggttaccatcacctctatttcgacaacgacaacatcctgcggatgttgtatgacggcccagagatcacaagcatctactggccaagtccggattacaacgctgaaaaaaatggccgcagtaggttcaacagcaccaggacagcagttctagatgacatgggtaattttgtgtcaagtgatgggtttaagatagaggcttcagattcaggtccaggaatcaagagaaggatcacaatcgattacgatggcaatttcagaatgtacagtttgaatgcatcaacagggaaatggaacgtcacaggacaggctgtaacacagatgtgctatgtgcacgggctatgcggaaagaatgggctctgtgactactccagtggtctccagtgtagatgccctccagattatgagatggttgatccaacaaattggaaccaaggatgccaaccaatgttcttgactgataaaaaccaatcacctgaggattttacatttgtcaagcaacctcatgccgactactatggctttgatctgtcctcaaataaatccatctcatttgaagcatgcaggaacatttgcttgaacatcagtacctgcttatctttcacatacaaggctggagatggttggtgttacactaaagatttactttacaatggtcaggtctacatgtattttcctggagacaactatatgaaagtaccaaaaaattcgaatagttctttatccccaatctctaaaaaggaaagcctcacctgtggaccaccgggctctgaggtcaagcgaggatcagcaagtatgtatggaacaaagaaggacaacataaactggacatacttctatgtctttgctgcaatactgggagctctagagttgcttgttattgtgacgggctggtaccttttcttcaagaagcataacatacccaaatcaatggaggatgggtacaagatgattacaaaccaattcaggcggtttacataccgagaactaagggaagcaactggaaagttcaaagaagagcttgggagaggaggagcaggaatcgtctacagaggtgtgcttgaagataagaaaatagtggcagtaaagaagcttacagatgttcgccagggagaggaggaattctgggcagaggtgacacttattggaagaatcaatcacataaatttagtcagaatgtggggattttgctcagaagggccaaacaggctattagtgtacgagtatgtggagaatgagtcactggataagtacctctttggtgagagaagtacggaaagcctgtttggttggagccaaaggtacagaattgccctgggcactgcaagaggccttgcttatcttcatcatgaatgccttgagtgggttgttcactgtgatgtgaagccagaaaacatactcctaacacgagacttcgatgccaagatagcagactttggactggccaagcttgcgaagcgagatggcactagcttcaattttacccatatgagaggcacaatggggtacatggcaccagaatgggcactcaatttgccaatcaatgcaaaggttgatgtttacagctatggggtcgtacttctggagattgtgactggaatcagggtttcaagtggcatactgttagaggaaagacagatagatttcctggagtttgtccaggaggctaaacatattctgtcttccgggaatgttagtgacattgttgatgataggttgcatggccattttgatacagagcaggcaattgcaatggtgaaaatagccttttcatgcctcgaagaaagaagcaagaggccgacaatggatgaaattgtcaaggtgctcatgtcttgtgatgatgatgactaccgtcctgcttattcatattgacctgcaacagatgccagactagctgaagacgtaacaagtttcatgccaagtgcaactttatcatgttattataggaacgatgagacaagataaaaagctct

SEQ ID NO: 2088 - DNA, 2746 bp, Zea mays
acgcttgcgctgccaagctctccgaggtccaacaatggctgcgctgctctatctccatccctatctcgcggttcttccacttctgatctccccgatctgctctggcgcttcgccatggcgaaccatgaccaccggctcgcacatgagaggagaggaccacgacaaggtcaccctcctctcgcccgacgctaccttctcctgcggcttccacgaggtgggcacgaacgccctcaccttctccatctggtacacccccagcgccagcgccagcgccaccgagaggaccgtcgtctggacggcgaacccctactccgcagagcgaggccagcactctccggtgaacaagtacggctccagactgtcgctgaaccgcgacggcaacctggtcctcacggacaccaacgggtccacggtgtgggagaccaagacgtcgtcgggcaggcacacgacggccgccctcctcgacagcggcaacctcgtgatccgcgactccagcagcggcagcaacaaggtcgtgtggcagagcttccgctcgccgaccgacaccctgctccccgggcaggagctgaccaaggacacgaggttagtctccggctaccaccacctctacttcgacaacgacaacgtcctgaggatgctctacgacggcccggagatcaccagcatctactggccgagccccgactacaacgccctcaagaacggccgcaacaggttcaacagcaccagggtagcggtcctggacgacctgggtactttcgtatccagcgacgggttcaggatagaggcttcggattctggtccaggggtcaagaggaggatcacgattggctacgacggcaacttcaggatgtacagcttgaacgcgtcgacgggggcgtggcgcgtcacggggcaggctgtcatacagatgtgctatgtgcatggactgtgtgggaggaacgggctctgcgactacctgggtggcctcagatgcagatgccccccggactacgagatggtcgatccgacgaactggaacagaggatgcaagcccatgttcttgacgaccgacgacggaaaggagttcaccttcgttgagcagcctcacgctgactactacggcttcgacctgtcctccaacgagtccgtcccgttcgaagcctgccgggacatgtgcttgaacagcagcgcctgcttgtcgttcacgtacaagggcggggatggctggtgctacactaaaggcctactctacaacggccaggtgttcccgtacttccctggagacagctacatgaaggtaccaaagagtttcaacagctcggcggcctactcatcgatctccaaccagaaagaagccctcacctgtgggccggcgggttctgctgagctgatgctgggaccggcgagcatgtacggaacaaagaaggacaacatcaactggacatacctgtacgtcttcgctgcagtgctgggagctctggagatgcttgtcatcgcgacaggctggtacctgttcttcaacaagcacagcatacccaaatcgatggaggacgggtacaagctggtcacaaacccgttcaggcggttcacgtaccgtgagctggcggaagccactgggaagttcaaagaagagctcgggagaggaggcgccggggtcgtctacaggggagtgcttgaggacaagaaggtagtggcggtgaagaagcttacggatgttcgtcagggagaggaggagttctgggcagaagtgaccctgattggaaggatcaaccacataaacctggtcaggatgtgggggttctgctcggaggggaccaagaggctgttggtgtacgagtacgtggagaatgagtcgctggacaagtacctctttggcgagagaagcgccgaaagcctgcttggctggagccagagatacaagatcgcactgggcacggcgagaggcctcgcctacctacaccatgagtgcctcgagtgggtcgtccactgtgacgtgaagccggagaacatacttctgacccgggatttcgatgccaagatagcagactttgggctggccaagctcgcgaagcaagggagcactagtctgaacttcacccatatgagaggcaccatgggctacatggcgccggaatgggcgctcaactcgccgatcagcgcgaaggttgatgtgtacagctacggggtcgtgcttctggagatcgtgactgggatcagggcttcgagtggcatagtgctagatgagaggcagatagactttcggcagtttgtacaggaggctaagcatatcctgtctactgggagtgtcagtgatatcgttgatgatagattgcaaggccattttcacgcggaccaagcggttgcgatggtcaaaatagccttttcatgcctcgaggaaagacgcaagaggccaacgatggatgagattgtcaaggtgctcatgtcgtgtggtgatgacgatgactaccatcctgcttattcatattgacttgcaacagatgtgaaggtttcccaaaagaaaacagatgcaaagatttgagaggcagaggcaagtgtacctttgatcaatgatagaagctgaactgaactgactgatgaaatatattcgaaagcgtgccaaattgtgatatttgtgtagagtatgttggggtatctccatatctggtagattaaaattgagtaatgttgttttgctctatttctaagggaggtgtcttgccctataagtggaatactataatattctctccgttccaaattataa

SEQ ID NO: 2089 - DNA, 2558 bp, Oryza sativa
tcgatagccaaagctccctggaaaaggagataatggctgcgctgctgtatctaaccatcctctcatcactctccttccacctctgctcttgtgcttccccatggcgaaccatgacgaccggctcacacatcagagctgaggaccatgacaagatcttcctcctctcacctgataccaccttctcttgcggcttccatcagcttggcacaaatgctttcaccttctcgatctggtacacccacaccaccgagaaaactgccgtgtggacggcgaatccctactctccggcgaatgggggatactccccagtgaacctttacggctccagggtgtcgctgggccatgatggcaacctagtcctcacagataccaacggcacgacggtgtgggaaagcaagacatcttcaggcaagcatactacagttacccttcttgacaccggcaatcttgtaatcaaggattccagcaatagtactgtgtggcagagcttcgactcaccgaccgataccttgctgccatggcagaacctgaccaaaaacataaggttagtctctcgttatcatcacctctactttgataacgataatgtcctgcgcctattatatgacggcccagagattacaagcatctactggccaagtccagattataatgccgaaaaaaatgggcgtactagatttaacagcaccaggatagcatttcttgatgatgagggtaattttgtgtcaagtgatggattcaagatagaggctacagattcaggtcctaggatcaagagaaggattacaattgattatgatggcaattttagaatgtacagcttgaacgagtcaacgggcaactggactatcacagggcaggccgtgatacagatgtgttatgttcatgggctatgcggcaagaatgggatatgtgactactcgggaggtctaagatgtagatgtcctccagaatatgtgatggttgatccaacagattggaacaaaggatgtgaaccaacgtttacaatcgatagcaaaagaccacatgaggactttatgttcgtcaaacagcctcatgcagacttctatggcttcgatctgggatcaaataaatccatctcatttgaagcatgtcagaatatttgcttgaacagcagctcctgcttatcattcacatacaagggtggggatggtttatgttacactaaaggcttactctacaatggtcaggtgtacccatatttccccggagacaactacatgaaagtacctaagaattcaagcaaatcaacaccctcaatctccaaacaacaaagactcacttgcaacctcagtgctcctgagatcatgctaggctcagcaagtatgtatggaacaaagaaggacaatataaagtgggcatacttctatgtttttgctgcaatattgggaggtctagagtcgcttgtaatagtgacaggctggtacctttttttcaagaagcataacatacccaagtccatggaggatggatacaagatgataacaaaccagttcaggcgatttacataccgagaattgaaggaagcgactggaaaattcaaagaagagcttgggaggggtggggctggaattgtttatagaggagtacttgaagataagaaaatagtggcagtaaagaagcttacagacgttcggcaaggagaggaggaattctgggcagaagtgactctaattgggaggatcaatcacataaatttggtaaggatgtgggggttttgctcagaagggacaaacagactattggtatatgagtatgtggagaacgagtcattggacaagtacctctttggtgagagatgccacgaaagcctgctaagttggagccaaaggtacaggattgccctgggcacagccaggggtcttgcttatcttcatcacgaatgccttgagtgggtcgtgcattgtgatgtgaaaccagaaaacatacttctaagtagagatttcgatgccaagatagcagactttggactagccaaacttgcaaagcgagacagcactagtttcaatttcacccatatgaggggcacaatgggctacatggcaccagaatgggcgttgaatttgccgatcaatgcaaaggttgatgtctacagctatggagtagtgctccttgagattgtgacaggaatcagggtttcaagcggcatagtggtagatgaaaggcaagtggagtttccagagtttgtccaggaggccaaaaagattcaggctacagggaatgtcaccgatttagtggatgacagactgcatggacactttgatccagagcaagtaattacaatggtgaaggtagctctttcatgcctggaagaaagaagcaagaggccaacaatggatgaaattctgaaggctctcatgttatgtgatgacgaagacgactaccatcctgcctattcatattagcctgcagctactgcataaattttgagatgtgtacgtaataggatatcctagatgatgtaattataggcatagctagatatggtgacaagggcttattgtttatgacattggaatgattatattgcataatgt

SEQ ID NO: 2090 - DNA, 2949 bp, Oryza sativa
tactattcattcactcatttcatctacagaacaaaacttgttacattatgcaatataatcattccaatgtcataaacaataagcccttgtcaccatatctagctatgcctataattacatcatctaggatatcctattacgtacacatctcaaaatttatgcagtagctgcaggctaatatgaataggcaggatggtagtcgtcttcgtcatcacataacatgagagccttcagaatttcatccattgttggcctcttgcttctttcttccaggcatgaaagagctaccttcaccattgtaattacttgctctggatcaaagtgtccatgcagtctgtcatccactaaatcggtgacattccctgtagcctgaatctttttggcctcctggacaaactctggaaactccacttgcctttcatctaccactatgccgcttgaaaccctgattcctgtcacaatctcaaggagcactactccatagctgtagacatcaacctttgcattgatcggcaaattcaacgcccattctggtgccatgtagcccattgtgcccctcatatgggtgaaattgaaactagtgctgtctcgctttgcaagtttggctagtccaaagtctgctatcttggcatcgaaatctctacttagaagtatgttttctggtttcacatcacaatgcacgacccactcaaggcattcgtgatgaagataagcaagacccctggctgtgcccagggcaatcctgtacctttggctccaacttagcaggctttcgtggcatctctcaccaaagaggtacttgtccaatgactcgttctccacatactcatataccaatagtctgtttgtcccttctgagcaaaacccccacatccttaccaaatttatgtgattgatcctcccaattagagtcacttctgcccagaattcctcctctccttgccgaacgtctgtaagcttctttactgccactattttcttatcttcaagtactcctctataaacaattccagccccacccctcccaagctcttctttgaattttccagtcgcttccttcaattctcggtatgtaaatcgcctgaactggtttgttatcatcttgtatccatcctccatggacttgggtatgttatgcttcttgaaaaaaaggtaccagcctgtcactattacaagcgactctagacctcccaatattgcagcaaaaacatagaagtatgcccactttatattgtccttctttgttccatacatacttgctgagcctagcatgatctcaggagcactgaggttgcaagtgagtctttgttgtttggagattgagggtgttgatttgcttgaattcttaggtactttcatgtagttgtctccggggaaatatgggtacacctgaccattgtagagtaagcctttagtgtaacataaaccatccccacccttgtatgtgaatgataagcaggagctgctgttcaagcaaatattctgacatgcttcaaatgagatggatttatttgatcccagatcgaagccatagaagtctgcatgaggctgtttgacgaacataaagtcctcatgtggtcttttgctatcgattgtaaacgttggttcacatcctttgttccaatctgttggatcaaccatcacatattctggaggacatctacatcttagacctcccgagtagtcacatatcccattcttgccgcatagcccatgaacataacacatctgtatcacggcctgccctgtgatagtccagttgcccgttgactcgttcaagctgtacattctaaaattgccatcataatcaattgtaatccttctcttgatcctaggacctgaatctgtagcctctatcttgaatccatcacttgacacaaaattaccctcatcatcaagaaatgctatcctggtgctgttaaatctagtacgcccatttttttcggcattataatctggacttggccagtagatgcttgtaatctctgggccgtcatataataggcgcaggacattatcgttatcaaagtagaggtgatgataacgagagactaaccttatgtttttggtcaggttctgccatggcagcaaggtatcggtcggtgagtcgaagctctgccacacagtactattgctggaatccttgattacaagattgccggtgtcaagaagggtaactgtagtatgcttgcctgaagatgtcttgctttcccacaccgtcgtgccgttggtatctgtgaggactaggttgccatcatggcccagcgacaccctggagccgtaaaggttcactggggagtatcccccattcgccggagagtagggattcgccgtccacacggcagttttctcggtggtgtgggtgtaccagatcgagaaggtgaaagcatttgtgccaagctgatggaagccgcaagagaaggtggtatcaggtgagaggaggaagatcttgtcatggtcctcagctctgatgtgtgagccggtcgtcatggttcgccatggggaagcacaagagcagaggtggaaggagagtgatgagaggatggttagatacagcagcgcagccattatctccttttccagggagctttggctatcgaagtagagagaagaagagagacagagagaggcaggtagctttaggttcagttttaacactatgcggcttacttaggtgacgatatgcattagcgcgcatgtggccgtaatacccatgtatgttgctgacttgaacaattgaatactggggttggtaaggcaaaaaaactgttgggcatctccacggtgtacacattgcattgtcctactatattgcttgatttagactgcaagacggaatattgtcaacttcatgggggcatccatgtttctttcaatgtgtgaaagaggagtaccgatgaaaccgtgattttgtatattatatatatcagtttttcctcccttctgccc

SEQ ID NO: 2091 - DNA, 2786 bp, Triticum aestivum
tccttcacgcacaatgttccattagttgacatcatgccaaccaacccaataccttaactatagcaaaacaatgtgtacactctggaccagcatgacaagtttgtcttcccagtctagttttcaatagttcaagtcaggatctaagataataggtctatgtgctaatgcacatcgtcatctgttaaaaagaaaagcatttggaacttaaagctgccttaccactctctaatctctgcacatccatacccaaggcagagctccccggagaggagaaaaatggctgcactgctctttctagcccttctttcatctctctccttccacctttgctcttgtgcttctgcttccccatggcataccatgaccaccggctcatatatgagaccagaagaccatgacagaatctttctcctctcaccagacaccaccttctcctgcggcttccatccagttgggacaaatgctttcaccttctcgatctggtacaccaccgtgaaaacggttgtctggacggcgaatccctattccgcggcgaatggctactattccccggtgaaccttcacggctccagaatatcgctgaaccaggatggcaacctggtcctggcagataccaatggctccatggtatgggaaagcaagacgtcttcaggcaagcacacaattgtttccctcctcgacactggcaaccttgtaatcaatgattctagcaataaaatcgtatggcagagctttgattcaccaacagacaccttgctcccttggcagaaactcaagaaagacataaggttagtctctggttaccatcacctctattttgacaacgacaatgtcttgcgcctgttgtatgatggcccagatattacaagcatctactggccaagtccagattatgatgcacaaaaaatggacgcaatagatataacagcaccagggtcgcatttctggacgacaagggtaattttgtgtcaagtgatgggtttaaaatagtggcttcagattcaggccctgggatcaagaggaggattacaattgatcatgatggcaattttagaatgtacagcttggacgcgtcagcaaggaaatgggtggttacagggcaggctgtaatacagatgtgctatgtgcacggattatgcggcaagaatgggctttgtgactactcagaaggccttaaatgtagatgccctccagaatatgtgatggttgatccaacagactggaacaagggatgcaaaccgacattcacaattggtagcaatcaaccacatgagaactttacatttgttaagcaacctcatgcagacttctatggctttgatctgggctctaatcaatccatctcatttgaagcatgttgggacatttgcctcaacagcagctcatgtatatctttcacatacaagggtggggatggttggtgttatactaaaaacatactctacaacggtcaggtgtacccgtacttcccaggagacaactacatgaaagtaccaaagagtttcaatggttcagcatcctcaatctccaaacaagaaagcctaacctgcagacccagtggttcagagattatgataggatcagcaaacatgtatggaataaagaaggacaacataaagtggatatacttgtatgtctttggtgcaatactgggatttctagagttgcttgttattgtgacaggatggtgtctttttttcagaaagagtaacatgcccaaatcaatggaggatggatacaagatgataacaaaccagttcaggcggtttacatacagagaattgagggaagcaactggaaagttcaaagaagagattgggagagggggtgctggaattgtttacagaggagtacttgaagataagaaaatagttgcagtaaagaaacttacaaatgtccaacagggagaagaggaattctgggcagaagtgactctaattggaaggattaatcacataaatttggtcaggatgatgggattctgctcagaagggaaaaacagattattagtatacgagtatgtggagaatgagtcactggacaagtacctctttggtgagagaagtactgaaagtctgatcggttggaaccaaaggtacaagattgccgtgggtgcagcaaggggtcttgcttatctacatcatgaatgcctcgagtggatcgtccattgtgacgtgaagccagaaaacatactcctaactcgagatttcgatgccaaaatagcagacttcggactagccaagcttgcgaagcgagacagcgctagcttcaatttcacccatatgaggggcacaatgggctacatggcaccagaatgggcattgaatacgccgatcaatgcgaaggtcgatgtttacagctacggagttgtgcttctggagattgtgactggagctagggtttcaagtggcataatggtcgacggaagacaagtggagtttccagacttcatccaggaggccaaacagattctggctaccgagaggatcactgatctagtggatgccagattgaaggggaatttcgatctagagcaggcaactgcaatagtgagaatagctgttgcatgccttggaggtagatgcgagaggccgacgatggacgagattctgaaggctctcatgtcatatgatgatgaagacgaccatcctgcctattcgtattgacatgcaatgcaaactgatgtaaatatttgagctatgcacactgtttgttagctctgttgacgttataagctaataggcataagtagataagatgcaaaaggtgaattgttgtgtgcattt

SEQ ID NO: 2092 - DNA, 2698 bp, Brachypodium distachyon
aagcagcaaagcaacctaattctaccatacctctccctacgcctccatagccaagcagaacttcctcgaaaggagaaaaatggctgcgctgctctttctagcgcttctttcatcactatccttccagttttgctcttgtgcttccccatggcagaccatgaccactggctcgcacataagagcggaggatcatgacagaatattcctcctctcatcagataccaccttctcttgtggtttccatcaagttggagcaaacgctttcaccttctccatctggtacaccgccgtgaaaaccgtcgtctggacagcgaatccctactccgcggtgaatggctactactccccagtgaacctttacggctccaggatatcgctgaaccaggatggaaacctggtcctgacagataccaatggctcgacggtatgggaaagcaagacatcttcaggcaagcccacaactgtttccctcctcgacaccggcaaccttgttatcaaagatttcggcaataatattgtgtggcagagctttcattcaccaacagacaccttgctcccttggcagaacctgaagaaagacacaaggttagtctctggctaccatcacctctattttgacaacgacaatgtcctgcgactgctgtatgatggcccagagattacaagcatctactggcctagtccagattacaatgcactaacaaatggacgcaatagatacaacagcaccagggtagcattcctcgatgacagaggtaattttgtgtcaagtgatgggtttaaaatagaagcttcggattcaggtcctgggatcaaaaggaggattacaatggattatgatggcaatttcagattgtacagcttgaatgcatcaacagggaactgggtggttacagggcaggctgtaatacagatgtgctatgtgcacggattgtgcggtaagaatggactttgtgattactcagaaggccttaaatgtagatgtcctccagaacatgtgatggttgatccaacagattggaaaaaaggatgcaaaacgacattcacatttggcagcaaccaaccataccaggacttcacatttgttaagcaacctcatgcagacttctatggctttgatctgggctctaatcaatccatctcatttcaagcatgttggaacatttgcctgaacagcagatcatgcatatcgttcacatacaagggtggggatggttggtgctacaccaaagacttgctctacaatggtcaggtgtacccatatttcagtggagataactacatgaaagtaccaaatagtttcaatagttcagcatcaatccccaaacaagaaagcctaacttgcagacccaatgggtctgacatcatgctaggatcggcaactatgtatggactgaagaaggacaacataaagtggatatacttttatgtcttcactgcaatattgggatctctagagctgcttgttattgtgactggctggtatctttttttcaaaaagaataacatgcccaagtcaatggaggatggatataggatgataacaaaccagttcaggcggttttcatacagagaattgagggaagcaactggaaagttcaaggaagagattgggagagggggcgctggcattgtgtatagaggagtacttgaagataagaaaatagtggccataaagaagcttacaaatgttcaccaaggagaggaggaattctgggcagaagtgactctaattggaagggtcaatcacataaatttggtcaggatgagggggttttgctcagaagggacacacagactattagtatatgagtatgtggagaatgagtcattggacaagtacctctttggtgagagaagtgctgaaagtctactcagttggagccagaggtacaagatcgccttgggcacagcaaggggtcttgcttatcttcatcatgaatgcctcgagtggattgtccattgtgacgtgaagccagaaaacatactcctgactcgagattttaatgccaaaatagcagatttcggactagccaagcttgcaaagcgagataacactagtttcaatttcactcatatgagaggcacaatgggctacatggcaccagaatgggcattgaatatgccgatcaatgcaaaggttgatgtttacagctatggagttgtgcttctagagattgtgactggaactagggtttcaagtggtgtaattttcaacggaagacaagtggagtttccagagtttatccaggaggccaaacagattctggctacagagagtatcactgatcttgtggacgccagactacacgggcaattcgacccagagcaggccatcgcaatggtgacgatagctgtttcatgccttggagacagaagcaagaggccaacaatggatgaaattttcaaggctctcaggtcatacgatggtgaagaagaagaccatcccgcctattcatattgacatgcaattgatggaaaatttgggcaatgcacgcaaagcttcgttggtgatataggctaataagaaaaagtagataagatggaaagagtgtattggcttgcccatttgcataaacttatcatagatgttgcaggttttctgttttaaatgcaatgaataaaaatagtacgttcaactgatacttcattgcatattgacatcaagtgttctcataatagcaatgttttctttttc

SEQ ID NO: 2093 - DNA, 2348 bp, Zea mays
atgaagggaaagcagaagcttcttttccccttcctccaaaaaaggcatcaaaattctttgctaaaaaaggcttcaaaattctccgcttagggaaaaaaacttgattaggagcaatccatcgtttctttactcctcgatcgagagccccattcgttaggggttagggtcgtagcgagggctctgaaattggaatcccaacagaggaattacacccgctttgggacttcggagaagggaatgtcggcaaccatcgaccggctcgcgacaccgagtcatgagggtcgtgcacacagtgacgaaaagcgagagtgcaattctgatgaagagaactcagaaggagaaagaaagcccaaaaaggattccttcaagaagagagcagttactacagggtatagatttaggcattccttaaggagaaagagtaaaacaaagaatgataaccatatagcctcaatagaagacataagagatgttcaagagctggagattgttgaaaggtttcgccagtgtttacttgatgatggtctgttgccagaacatcacgatgattatcacacgatgttgaggttcctgaaagcaagaaaatttaatattgacaaagcaaaacatatgtggtcagagatgcttagatggaggaaggaatttggtgctgacaatatagaggaatttgactacactgaattagatgaagttgtgaagtactatccgcagttttaccatggtgtggacaaagatggaagacccgtttacatagaactaattgggaaagttgataccaacaaactagtgcagatcacaactattgaccgctatttaaaatatcatgtcaaggagttcgagagatgtctccagatgaggtttccagcttgttctattgctgcgaaaaggcacatagactcgtctactacgatattggatgtgaaaggcgtgagcctaaagaacttcacaaaagatgcaagagagctaattatgcggttgcagaagatcaacaatgacaactatccagagaccttatatcaactgtacatcataaatgctggccaaggattcaagatattatggggtacaataaaatcatttcttgatccagaaaccgcttcaaaaattcatgtccttggaaacaagtaccaaactaaattacttgaaataatcgatggcagtgaactcccagaatttcttggtggcaagtgcaggtgtgaagaatatggaggttgtccaaaatcagacaaaggcccttggaaggaccctgaaattttcaagagggttatcaatggtgaggcaaactatggtcgacaagttcttgctgtatcaagcataaatcagaaggaagttggttgtactgaacacacaactgagcaggaaaaaggcaatgatgcctctgctaaatctatttctcaggtggaagatgtttcttcttcaacggctttagtggatcccatcataagccctaatttgacccatttaaaatttcaaggacatgcttcctcatctgatgctcctcccattataggggatagcatccctgctgctggcaaggtcatggatgcatgctccaatccaagaaacagctcgacaccttccagctcaggttctttctctttgagaaatataccggcaacattgggaggacttaaaactcgaattgttgcatggtcaacattcgtaatcctgaccttgtcagcattcctctgttctgtgctgagcatagtgaccaaaaggctctcaaaccaggccatcacatgtgaccactatagtgctgacttccatcaaggatatatgggaaatggcacccttacatccgtattgacacggcttggtgagctggaggagaaggtacaagcacttgaagcaaagccaccccaagtgccatttgaaaaggaggaattgttacatactgctgtttaccgcgtggatgtgttggaagctgaactaatttctatgaagaaggccttgtatgagacattgattcggcaggatgagctgcttgcatatattgaccaacaacagacagccaaattttgtcggcagaagttctgtttctaagtactggagtacctgccacctattttcgtctctttggagatcgcatgcagctattgtggacccagtatacttgcaaatgttttcatatttgttgcagtgtaaagaaatgcaatttttagaaatacataggattgaggagcatggtagcttgtcttgagatcgtgttttagcgacaaaaacagaaaagcttgataccttgtacgcattttcaaccagatgcaggcgtaatctttccccagtatttggtgcaaggctccagtatttggtttgcttgtattatactatctctattctcgaatatttgt

SEQ ID NO: 2094 - DNA, 956 bp, Zea mays
cggttgccacacccggcccagcacaggcgtagggtttattggcatctgtctcctgtcgcgccggccaccacagcgcagaagaacacagcacccgcctgcctcgccgccgcaatggccgccgccgcctccgctgcgagatccttcctccggtccagcggctcatcgtctctccgcagcgcggtggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcagcgctcatgacgtcgcttctcgccgccccggcttgcaagggattcggttggctatcagaaggtcaagctgaaactagatgaacttcatgggacccaaaagctggtaatgatgacgtgtgacggtctctagatgggaattagcagattattatcccgtcacctcagatcttcaggcctgtgattagtgcgatggaggtcaacttggatgaagactagactgctatttattttgccatctctgttgccttggttttgcccattataaatggaacatagagcaatgtagctttcgtcgctgttaatttatatgatgttattctagagcttgagcccagattattgtgtttctatttgtagatggatgatttgtcgttactggagatctgcagtgatggtatcttgtctggattatggatacctcgtgaatttaaagtacttggttggcgtctcagttaacatgttttgtgctctgggattgcagtttgtatgaaatttgcagaattgatcctgagatttattttggctggttagctgtcaaaaagactttggtcttgacgacttgcctgatcaagtagatctggaatgaataaacttaatagaagggttttcacaccttttgcgtt

SEQ ID NO: 2095 - DNA, 592 bp, Saccharum officinarum
gccaccacacagcgcagaagaacacagcagcagccgcctgcctcgccgccgcaatggccgccgctgcgagatccttcctccggtccagcggctcatctggcctccgcagcgcggcggccagagccgcctcgcgtgccggacctgctccgctgccgaggcggatgcccacctctgccccccgcgcactcctaaggtcgccggtggagatgagcagcgtgtgcctggagtccctgatgcccatgcacagcgccacggcttcggcgctcatgacgtcgctactcgctgccccggcttgcaagggattcggttggctatcagaaggtcaagatagatgaacttcagggacccaaaaggtgaataatttttaaagattccatcaataataactgttgatggctaggttccatcactagttcacgtgtcagaatgatttgtggaaagaagagcccgctatctttatcttatggaattgcttgtaaattcatctattgggaactactgcacttgcacattaagatgtacaatatggaacaaaagaagtctgcatttttatgagccatacatttgtattgagccaggtatttttattgtt

SEQ ID NO: 2096 - DNA, 1797 bp, Panicum virgatum
acgaaaaacacgcggaaatctcacaggatcacgaccaggggaaaaaacaacccggcggaccgagcgccaggcccgttcgcagatatgggccatctagccaacaccacaaaagctgcaaagaaagaccggcccagtttcgtgcgggagagagatctctctctctcctccacgagagcgccaccgccgtctccccaagcccaccacggtggtagggtttattggcatctctctccgctcctgccgcgccccgccaccacagggcagaacaccgcacccgccgccgaaatggccgccgccgccgccgcgaggtccttcctccgatccagcgccccgtcgtcactccgcagcgcggcggtcagagccgcctcgcgtgcggggccggctccgctgccgaggcggatgcccacctctgccccccgcgtcctcctgaggtcgccggtggagatgagcagcgtgtgtctggagtccctgatgcccatgcacagcgccacggcttcggcgctcatgacgtctcttctcgccgccccggcttgcaagggattcggttggctctcgaaaggtcaagatgaaactagatgaacttcagggccccaaaaggtgaataactttaaagatgccatcactagtaactgttgatggctagtttccatcactagtttgtgcatcgtaatgatttgtggaaagaagagtttgtcatctttattttatggaactgcatctaaatttttgtattgcgcatatttacatgaatatgtaaacatgcagcacaatatgggaaaaagaactctgcgttgttatgatgtattgagctaggtcttttttactgttccttgtattcttgcaaaatgatttggcatcgaaggtcttgtgctgcaatttgtgtgcctgagctatctgtttttgaagttttgacaatgcgagggatttctttcgcaagttgaattatgcccgtagttttattgaagtcaaactattcgtgaattcagcataagaaaagaacacttctaaatttgaatgtaacatcatcattaattataaagttgagttaaaagaggagactgattcttttgtattggctcagctggcaatgatgacgtgtgacaatatctaggtggaacgtagcagattattatcccttcacctcatatcatatctacaggcctgtgattagtgcgtggaggtcatcttggatgaagactagaccatgcttttatttgccatccctgttaccttggttttgtccatgataaatggacataatagagaagaagtagcatttattgctgctaacttttatggtgtcaattaagagctggagctcaggttattgtgtttctatttgtagatggatgatttgtcattattggagccctgcagtgatgctagctggtctggattatggactaccacctcatgaatttaaagtacctgtttggcgtctcagttaacatgttttgcgctctggcctctgagattccagtttgtataagcttttaccgaattattcttgagattcattggtgggtatttaatagatttttggtcttgacgacctgcttgattaacagatctgtaatgaataaattaaacagagtttctgctgttttttgtggtttactctcggcatagttcattcaactgccaatcatctcaagttagggatgcaaattatctggatcgcaaggtttcaggatgttgacctgtagaatagaaatgcagattggtacgctggggcatttcacaggccttgggtcagttataaactaaaagctgtttttttgttagctggtgccttca

SEQ ID NO: 2097 - DNA, 701 bp, Setaria italica
gcctctcccggcccaccacggtggtagggtttattggcatctttctcctctcctgccgcgcctcgccacctccagagagcaagagcagaacaccgcaccagccgccgaaatggccgctgccgccgccgcgagatccttcctccgatccagcgcgccctcgtcgctgcgcagcgcggcggccagagccgcctcgcgtgccgggccggctccgctgccgaggcggatgcccgcctccgccccccgcgtcctcctaaggtcgccggtggagatgagcagcgtgtgcctggagtccctgatgcccatgcacagcgccacggcttcggcgctcatgacgtcgcttctcgccgccccggcttgcaagggattcggctggctctcggaaggtcaaggtgaaactagatgaacttcaggggcccaaaaggtgaatagctttaaagattccatcactaataactgttgatggctaggttccatcactagtttgtgcgtcggaatgatttgtggaaagaagagcttgtcatctttattttatggaattgcgtctaaattcttgtatcgtgcacacatttacattaatatgtaaacatgcagcgcaatattggaaaaaaaaccctctgaagtcttgtgatgcattgagctaggtctttttttactgttccttgtatccttgcaaaatgatttggcctatgagctcttgtgcc

SEQ ID NO: 2098 - DNA, 704 bp, Panicum virgatum
  misc_feature (325)..(325): n is a, c, g, or t
  misc_feature (514)..(514): n is a, c, g, or t
  misc_feature (531)..(531): n is a, c, g, or t
  misc_feature (538)..(538): n is a, c, g, or t
  misc_feature (557)..(557): n is a, c, g, or t
  misc_feature (564)..(564): n is a, c, g, or t
  misc_feature (595)..(596): n is a, c, g, or t
  misc_feature (640)..(640): n is a, c, g, or t
  misc_feature (653)..(654): n is a, c, g, or t
catctctctccgctcctgcgcgcccgccaccacagggcagaacacgcacccgccgccgaaatggcgcgcgccgccgcgaggtccttctccgatccagcgccccgtcgtcactccgcagcgcggcggtcagagccgcctcgcgtgcggggccggctccgctgccgaggcggatgcccacctctgccccccgcgtcctcctgaggtcgccggtggagatgagcagcgtgtgtctggagtccctgatgcccatgcacagcgccacggcttcggcgctcatgacgtctcttctcgccgccccggcttgcaagggattcggttggctctngacggaagctggcaatgatgacgtgtgacaatatctaggtggaacgtagcagattattatcccttcacctcatatcatatctacagatggatgatttgtcattattggagccctgcagtgatgctagctggtctggattatggactaccacctcatgaatttaaagtacctgtttggcgtctcagttancatgttttgcgctctgncctctgngattccagtttgtataagnttttacngaattattcttgagattcattggtgggtatnnaatagatttttggtcttgacgacctgcttgattaacagatctgnaatgaataaattnnacagggagtttctgctgttttttgtggtttactctcggcatagttcattc

SEQ ID NO: 2099 - DNA, 601 bp, Pennisetum glaucum
caccacggtggtagggttctttctcctcttctgccgcgccgccccgccgccgccgcccccaccaccagagagcaagagcacccgccgccgaaatggccgccgccgccgctgcgagatccttcctccgacccagcgcctactcgtcgctccgcagcgcggcgtccagagccgcctcgcgtgccgggccggctccgctgccgaggcggatgcccgccgccgccccccgcgtcctcctaaggtcgccgctggagatgagcagcgtgtgcctggagtccctgatgcccatgcacagcgccacggcttcggcgctcatgacgtcgcttctcgccgccccggcttgcaaggggttaggctggctctcggaaggaaactccatgcctttatgacagcacaatctctcttttgtaatgaatgtatcctcatcatttggggcgcttttgaatgttcacaatgttcttacattgtaagctatgagtgagaatataaagtgccttgcggtgacaagaacagttcaatggacagaagcaattgattccttttgttgtagtagtattcagctacttaatgccatccttgtgtggcaagtactactggcagcatg

SEQ ID NO: 2100 - DNA, 1102 bp, Brachypodium distachyon
gtaaatgggccggtcgataatgtcaagatcctcgaacacggcattcaaccacagcgttgcccagcccaactgcctgtagggttttagcctcgctctctccttcctgccgcgcgccaccgcaccacgcaccatggccgccgccgccgccgcgagatccttcctccgatccgcacccgccacatcctcctccctccgtggatcggccgccagagccgcttcccgtgcatgtccgcctccgctcccgaggcggttcccggcctctgctccccgcgtcctcctaaggtccccggtggagatgaccagcttctgcgtggagtcgctgatgcccatgcacagtgccacggcgtcggcgctcatgacgtctctcctcgctgccccggctcgcacggggtttggctggctgtcagaagctggcaatgatgatgtgtgacaatttctaggtggaatgtagcagattataacctcctcacgtcaaacatacagacttgtgatcagtggcaatgggcgtcgtctgggatgaagacatactatttttgccatctgcatttatgttttatctatgcaaactagaatttctggacttggagcaaaagtagtttctatggttgtaacttttatgatgtcaggataagagtttgggcttagactattcgcttctatttgtagatggatgatttcttgttgtcggagctggttgtgatggtacctgctacggacctcccctgttgagttcaaactagttttgatcgccttattatcaggctgtactctgtgattctgcacaagcgtactcaggattatacctgacggtgacaagatttaactgaatttctggacgttgtatggattggtgtccatggagaaataatgttaaatttaaagtctccctgattatacctgatcgtgacaagatttaactgtatttgtggtaatactccttattatggtgtctgcggagaaatgctgttaaatttgaaagttcatctcccattttattttgcttcttgatgttgttatgttagccatgtcaagaaaatgaaatccatatattttgtatagtccagcctcctgtagttcattccttccttggtttttctttaaa

SEQ ID NO: 2101 - DNA, 2531 bp, Oryza sativa
caaaaacgaagtacgcgttcacgtttcccaggcccatctaaccgtagggttttagcgtctcgcccccgtcctctgccggcgtagcgccaccgcactgcgcacccgccccgacgcaatggccaccgccgccgccgcgagatcgttccttcgatcgggagtcgcctcctcctcgtccatccgcggcgccgccgcgagagccgcatcccgagccgggccggctccgctcccgaggaggctgcccgccgctgctccccgtctcatcttgaggtcgccggtggagatgagcagcgtctgcttggagacgctgatgcccatgcacagcgccacggcgtcggcgctcatgacgtcgctcctcgctgcccctgcgtgcaggagctttggctggctctccgaagctggcaatgatgacgtgtgacaaactctaggtggaatgtagcagattatagtcccgtcaactcaaatctacaggtctggcaaggttttaaggagcatccatgttagcatatattcatagtcatgttctattaattttcctgccatggtttgcacaaaaaatgaaagatgaagacgtatataaatctctgccagggtacttgtttctccttttaattaactaggaactacatgattatgtttgttctttgtgatcattcgggaccatgctattcgatgtccttggaccttacctaatgatgtatgcagtttatttgtcctgctatcatgctattggaattataataagctacaatgaaaccatgattatgtttttagttcttgtatatacttgttttttgacacattatatatctctataggtctgtgattagtgacaatggagggtgtctgagatgaagacatgctagtatttactttgtcatttctgttgcttcatgttttatcactttgtaattcgtggaattaaaacaaaaaagaaaatttatttctttggctgtaactttttacgctgtcagttaaaaattggatcttagattgttgcgtttctatttgtagatggatgatttgttgttatcggagcctgatgtgacgatagctgctacgagatacctcctattcaatttaaagtactttccgtcggcgtcttctgagcgacatgttcagtattctgggattttggtctgtgtaagcgtctacaagattgttacctgatcgttgcgacgcttacctccggttgtccaactgattttactattgatggcctactactgattaagtcccgctgagaaaataatgctgagttggaaattttctaattctacattgttttgcttctatctgcactgttactgtattatgtacagcgacagtttcgtaccttattactacagcagtacagtattatcgtgttgtattaagctggagacgccgttactctctgttccgttgacgagcagtatcagaggcctctatctccatggtggccatcgcgtcccaactgttagagcattgtaattcaagctagcttctttctagaggggaaggtggtgccatatataacaaacaacgatgtagggaaacactcagcatccaagaaacaatttttgcccatatggaccagaggttcaaacataagattactacggttcgaatcagaagcactgcagacaatttatctcctagaaatcatatccttttagaggctcaaaatgcagcagcaaattgactgatcatctcacatcacatttgttcttacaaccacaactgctgcagcacctaataggctaatacccatccgtacatagaaatgctcgataggaggacatgaagcagttcagaccaactgctacaacctaacctcagaatctccttcatctttcactttcttgagccaactcaaaaggtagaatttgaccaaataggcttggaacacataacttctgaataacaacgaaaccaacacgatctcacccttcaacattgacaagttcatactccacaagtgagagattgttatcctcctttacgttgaaacttgccggttcagtcacttcaatgcggccccatttgtccacagcaagcctcattgatcctttgaacatatcaatttttgcattgcggataataacagtgctgtcagccttcatcaggtcaactatcgtaccctgctcgttgcgggcggtgaacaggatgcagccggtctcgtcgccgatgaggcactcggcgatcctcgtgggacgcgccgccgggcccgctcccgcggcggcgcggcccttctggaccacggtcttggagctgagcaccttggcgacgagcgtgtggccgcccgtgccgggcttgagctggtccaccttgacgaacaccggcttcctcttcgccgccgccgccgccgccgccatgggtacggaaaaaagaacactggagagtagtaatggatagagataggaataggattacacggagggccaaaccctagatgaggcggggagagaatttaataggcgatcgaggaggaggccaccactagcgacgcgcgcggcggtgacttgttaaaaccagacgctatcattaccggg

SEQ ID NO: 2102 - DNA, 877 bp, Zea mays
gtacggtttattggcgtctcgctccgtctccgcactgtcctgttgcgccggccaccacagtgcagaagaacacacagcatccgcctgcctcgccgccgcaatggccgccgtggcgagatcctttctccggtccagcggctcatcgtccctccgcagcgcggcggccagagccgcctcgcgggccggaccggttccgctgccgaggcggatacccagttctgggccccgggtactcctaagcgtgtgcctggagtccctgatgcccatgcacagcgccacggcttcggcgctcatgacgtcgctactcgctgccccggcttgcaagggattgggttggctatcagaagctggtaatgatgacttgtgacactctctagatggaatgtagcagattattatcctgtcacctcagatctacaggcctgtggttagtgcgatggaggtcatctttgatgaggactagaccgcgtgctatttgttttgccctctgttgccttgattttgctcattataaatgaaacagagtaaatgtagctttcatcgttgtaacttttatgatgttagtttagagcttgagctgatgaactcagattattgtgtttctatttgtagatggatgatttgtcattattggagacctgcagtgatggtatctggtctggattatgcaatacctcgtgaatttatagtacttggttggcgtctcagttaacatgttttgtgctctgggattccagtttgtatgaaatttacataattcttcctgagatttattttggcccactagctgtcaaaaagactttggtcttgacgaccaggctgatcatgtacatctggaatgaataagcttgattaaaggcttttcacatttcacata

SEQ ID NO: 2103 - DNA, 777 bp, Brachypodium distachyon
aactgcctgtagggttttagcctcgctctctccttcctgccgcgcgccaccgtaccacgcacacgccgcgcccagccgcaatggccgccgccgccgcgagatccttcctccgatccgcacccgccgcctcctcctccctccgtggatcggccgccagagccgcttcccgtgcatgtccgcctccgctcccgaggcggttcccggcctctgctccccgcgtcctcctaaggtccccggtggagatgaccagcttctgcgtggagtcgctgatgcccatgcacagtgccacggcgtcggcgctcatgacgtctctcctcgctgccccggctcgcacggggtttggctggctttcagaagctggcaatgatgatgtatgacaatttctaggtggaatgtagcagattataacctcctcacgtcgaacatacagatggatgatttcttgttgtcggagctggttgtgatggtagctgctacggacctcccctgttgagttcaaactagttttgatcgccatattatcagcctgtactctgtgattttgcacaagcgtactcaggattatacctgacagtgacaagtttaactgaatctgtggacgtcgtatggattggaaataatgttaaattttaactctccctgattatacctgatcgtggcaagatttaactgtatttgtggcaagtactcctgattatggtgtctgcggagaaatgctgttaaacttgaatgttcatctcccaatttattttgcttcttgtctttttatgtcagcca

SEQ ID NO: 2104 - DNA, 1986 bp, Panicum virgatum
gacgtctgcgcacaaacgggttccagcgtggaaggggccgccaatgcaacaaccaactcggaaattcagctccagctgacggaaatgcccctgccgcgagcatataaataggagccaattccctcaatgccattaaaattttcgccaatcccttgaatgccattgaccccatatgtcatagacacaaaaaaaactcccttcaatgccattcagtggcattcaagggattgacgaaaatttcaatggcattcagggaattgattctataaatagagctccgcacccggcacatctccttcagctcaaggccttgtcttcttgctccttgagttctatagtacctagccaccctgctgatctccaagctagcagcaacttgctctgttaccctagaggctgcgtcgccatgggctgctgcggtgacttcttcgagaaggccaagccttacatcgccatgatctccctgcagttcggctacgccggcatgaacgtcatcaccaaggtctccctcaaccacggcatgagccactacgtgctcgtcgtctaccgccacgccttcgccaccgtctccattgctccatttgctctcatcctcgagaggaaggtgaggcccaagatgacgtggccagtcttcctccagatcttcgtactggcactgctcgggcctgtgatcgaccagaacttctactacgccggcctgaagttcaccggcccgaccttcgcgtgcgccatgagcaacatccttccggccatgaccttcgtgatggccgtgatcttcaggatggagaaggtggacctgaagaaggtgaggtgccaggcgaaggtggccgggacgctggtgacggtggccggcgcgatgatgatgacgctgtacaagggccccctgatgaagatggcgtggagcagcagccacgcgcaggcgcacgggcacgccgcggaggcccccgtcgccgccatcgaccccagcggccgggagtggttcctgggctcgctcttcgtcatcatcgccaccctcgcctgggcctcgctcttcatcctgcaggcgcacaccctcaagcactacgcggccccgctctccctcaccaccctcatctgcttcgtcggcaccctccaggccatcgtcgtcaccttcgccatggagcaccgcccctccgtctggaccatcggcttcgacatgaacctcctcgccgccgcatacgcaggcattgtgacgtcgagcatagcgtactacgtgcaaggcctggtgatccagaagaccgggccggtgttcgcgtcggcgttcagccccctgatgatgatcatcgtggccgtcatgggctccttcatcctcgccgagaagatattcctcggcggcgtcctgggcgccgtcctgatcgtgatggggctctactcggtgctctggggcaagcacaaggagacccaggagaaggaggaacaagaggccatggagctgcccgtggcgtcgtccaaggcggtcggaatctacgacgatgccacgttcatcaaggagatcgccgcctctgttggggatgactcggagtgcaagaaggcgaatggggtgaagtcatcctccgacggacacggagctggtgcagtttgatgcgacctgcgattccaagctactagcgatgagctgagcgcacgcagctagcagctggatatggaagaggcccttgtccaagactcccaagtgctaactgtcttgtcatgtgcctgtgcgtgtgcccctgaaatgatgtgtatactgacgctgcatgcattagggtcggatgattgagcgagggtgcacctgcactgcagagtggaaggactggaataattttgttctgtgacctttttttcttttttgctatcctttttgtaatatgatggacctactagtatatttaaattgtattttattatgctttcctgtggaaaaagagtgttatgttctgagacttatgtcaaagagtattatagaaaatcaagtgtttgtttcaatat

SEQ ID NO: 2105 - DNA, 1681 bp, Setaria italica
cttcagctcaaggcctttgtcttgctccttgagttctgtactagcacctagctacccagctgatcgccaagcttgcatagcttgttgttaccctagagacaccgtcgccatgggctgctgcggcgatttcttcgagaaggccaagccttacatcgccatgatctccctgcagttcggctacgccggcatgaacgtcatcaccaaggtctccctcaaccacggcatgagccactacgtgctcgtcgtctaccgccacgccttcgccaccgtctccattgctccattcgctctcatcctcgagaggaaggtgaggcccaagatgacgtggtcagtcttcctccagatcttcgtactggcactgctcgggccagtgatcgaccagaacttctactacgcgggcttgaaattcactggcccaaccttcgcttgcgccatgagcaacatccttcctgccatgaccttcgtcatggccgtgatcttcaggatggagaaggtggacctgaagaaggtgaggtgccaggcgaaggtggccgggacgctcgtgacggtggccggcgcgatgatgatgacgctgtacaagggcccgctgatgaagatggctgggagcagccacgtgcagccgcacggccacggcggcgccgaggcgcccatcgccgccatcgaccccagcggcagggagtggttcctgggctccctcttcgtcatcatcgccaccctcgcctgggcctcgctcttcatcctgcaggcgcacaccctgaagcagtacgcggcgccgctctccctcaccaccctcatctgcttcgtcggcaccctgcaggccatcgtcgtcaccttcgccatggagcaccgcccctccgtctggaccatcggcttcgacatgaacctcctcgccgccgcatacgccggcattgtgacgtcgagcatagcgtactacgtgcaaggcctggtgatccagaagaccgggccggtgttcgcgtcggcgttcagccccctgatgatgatcatcgtggccgtcatgggctccttcatcctctccgagaagatcttcctcggcggcgtcctcggcgccgtcctgatcgtaatggggctttactcggtgctctggggcaagcacaaggagacccaggagaaggaggaggaagaggccatggagctgcccgtggcgtccaaggcgaacggagtctacgacgacgccacgttcatcaaggagatcgccgccgccgccgttgttggagatgactcggagtgcaagaaggtcaatggggtgaagtcatcctccgacggacacggagctggtgcagtctgatttgatgcaacctgagattccaagctagtgctgagagcgcagctagctggatggaagaggcgttgcccaagtgctaactgtcttgtcaggtgcctatgcgtgtgtccctgaaatgatgtgtttactgacgctgcatgcattagggtcggatgattgagggaggctgcacctgcactgcagagtggaaggcctggaataattttgttctgtgcccccttttttgctatcctttttgggagatctatttagtatatttaacatgtattttattaagctttacttttctgtggaaaaagagtgttatgttctgagatttatggcaaggacatatattatatcattcatgtttaagaaatcgagtgtttgcttcaatat

SEQ ID NO: 2106 - DNA, 1955 bp, Panicum virgatum
caggtgtgatcttcactttgcctccaccacagcaggccttctgcaactgacatgtgggcccgtcctggcccagccacccacgatgccactcgcggagaaaagccgacgtctgcgcacaaacggtttccagcgtggaaggggcccatgcaaccaaccagcctttgaggagcgagccttactcggaaattcagctccagcgcgctgacggaaatgcccctgccgcgagcatataaatagagcagcgcacccggcacatctccttcagctcaaggccttgtcttgctccttgagttcgcctgctagccagtagccaccctgctgatctccaagctcgcagcttgctgttaccctagaggctgcgtcgccatgggctgctacggtgacttcttcgagaaggccaagccttacatcgccatgatctccctgcagttcggctacgccggcatgaacgtcatcaccaaggtctccctcaaccatggcatgagccactacgtgctcgtcgtctaccgccacgccttcgccaccgtctccattgctccatttgctctcctcctcgagaggaaggtgaggcccaagatgacgtggccagtcttcctccagatcttcgtactggcactgctcgggcctgtgatcgaccagaacttctactacgccggcctgaagttcaccggcccgaccttcgcgtgcgccatgagcaacatccttccggccatgaccttcgtgatggccgtgattttcaggatggagaaggtggacctgaagaaggtgaggtgccaggcgaaggtggccgggacgctggtgacggtggccggcgcgatgatgatgacgctgtacaagggcccgctgatgaagatggcgtggagcagccacgtgcaggcgcacgggcacggcgcggaggcgcccgtcgccgacatcgaccccagcggcagggagtggttcctgggctcgctcttcgtcatcatcgccaccctcgcctgggcctcgctcttcatcctgcaggcgcacaccctgaagcagtacgcggcgccgctctccctcaccaccctcatctgcttcgtcggcaccctccaggccatcgtcgtcaccttcgccatggagcaccgcccctccgtctggaccatcggcttcgacatgaacctcctcgccgccgcatacgccggcattgtgacgtcgagcatagcgtactacgtgcaaggcctggtgatccagaagaccgggccggtgttcgcgtcggcgttcagccccctgatgatgatcatcgtggcggtcatgggctccttcatcctctccgagaagatattcctcggcggcgtcctcggcgccgtcctgatcgtgatggggctctactcggtgctctggggcaagcacaaggagacccaggagaaggaagaacaagagtccatggagcttcccgtggcgtcatccaagacgatcggaatctacgacgatgccacgttcatcaaggagatcgccgccgccgccgttgttggggatgactcggagtgcaagaaggcgaatggggtgaagtcatcctccgacggacacggagctggtgcagtttgatgcgacctgcgattccaaggtactagcaatgagctgagcgcacgcggctagcagctggatggaagaggccttgtccaagactcccaagtgctaactgtcttgtcatgtgcctatgcgtgtgtccccctgaaatgatgtgtatactgacgctgcatgcattagggtcggatgattgagagaggctgcacctgcactgcagagtggaaggactggaataattttgttctgtgacccttttttcctttttttttgctatcctttttgtaatatgatggacctactagtatatttaaattgtattctaatatggtttcctgtggaaaaagagcgttatgttctgagacttgtgtcatcgtagtttactataggaaatcaagtgtttgtttcagtat

SEQ ID NO: 2107 - DNA, 1561 bp, Pennisetum glaucum
aaggccggcctttgtcttgctccttgagttctactagcacctagctagctactgatcaggctcatctgatctccaagcttttgcacaatagctttgttgttaccctagccttagagactgcgcgcgtcgccatgggctgctgcggcgatttcttcgagaaggccaagccttacatcgccatgatctccctgcagttcggctacgccggcatgaacgtcatcaccaaggtgtcgctcaaccacggcatgagccactacgtgctcgtcgtctaccgccacgccttcgccaccgtctccattgctccattcgctctcatgctcgagaggaaggtgaggcccaagatgacgtggtcagtcttcctccagatcttcgtactggcactgctcgggcctgtgatcgatcaaaacttctactacgccgggttgaagttcaccggcccaaccttcgcgtgcgccatgagcaacatacttcctgccatgaccttcgtcatggccgtgatcttcaggatggagaaggtggacctgaagaaggtgaggtgccaggcgaaggtggccgggacgctggtcacagtggccggcgcgatgatgatgacgctgtacaagggcccgctgatgaagatggcgtggagcagccgcagcagccacgtgcacggcggcgcggaggcgcccgtcgccgccatcgtcgaccccagcggcagggagtggttcctggggtccctcttcgtcatcatcgccaccctcgcctgggcctcgctcttcatcctgcaggcgcacaccctcaagcagtacgcggcgccgctctccctcaccaccctcatctgcttcgtcggcaccctccaggccatcgtcgtcaccttcgccatggagcaccgcccctccgtctggaccatcggcttcgacatgaacctcctcgccgccgcgtacgccggcattgtgacgtcgagcatagcgtactacgtgcaaggcctggtgatccagaagaccgggccggtgttcgcgtcggcgttcagccccctgatgatgatcgtcgtggccgtcatgggctccttcatcctctccgagaagatcttcctcggcggcgtcctgggcgccgtcctgatcgtgatggggctctactcggtgctctggggcaagcacaaggagtcccaggaggaggaggaggaagccatggagctgcccgtggcgtccaaggcgaacggaggagtctacgacgacgccacattcatcaaggagatcaccgccgctgttggagatgactcagagtgcaacacgaaagtcgtcaatggggtgaagtcatcctccgacggacacggagctggtgcagtttgatcagatattctgatgcaacccgagattccagagagctgctagtgctgagaatgcagcagctagctggatgcatggaagaggcgttgtccaagtgctaactgtcttgtctcatgtgcctatgatgtgtttactgacgctgcatatgcattagggtcggatgattgagagagagaggagtggaaggcctggaataattttgttctgtgcccctttttgtttgctatatccttttt

SEQ ID NO: 2108 - DNA, 1734 bp, Zea mays
ctcttcagctcgaggccttgtcttgagttctctagctcgtccacaggcctggccagctagctagctagcactgacactgaccgagaccctgcagctagcagctgatcgatccatccatggccatgggctgctgctacggtgatttcttcgacaaggccaagccttacctcgccatgatctccctgcagttcggctatgccggcatgaacgtcatcaccaaggtctccctcaaccacggcatgagccactacgtgctcgtcgtctaccgccacgcctttgccaccgtctctattgcaccgtttgctctcatccttgagaggaaggtgaggcccaacatgacgtggtccgtcttcctccagatcttcgtgttggcactgctcgggcctgtgatagaccagaacttctactacgccggcctcaagttcaccgggccgaccttcgcgtgcgccatgagcaacatccttcctgccatgaccttcgtcatggccgtgattttcaggatggagaaggtggacctgaagaaggtgcggtgccaggcgaaggtggccgggacgctggtgaccgtggccggcgcgatgatgatgacgctgtacaagggcccgctgatgaagatggcgtggaccagcagcggccacgcgcacggcggcggcggcggcgccgaggcggccgtcatcgaccccagcggcagggagtggttcctgggctcgctcttcgtcatcgtcgccaccctcgcctgggcctcgctcttcatcctccaggcgcacaccctgaagcagtacgcggcgccgctctccctcaccaccctcatctgcttcgtcggcaccctacaggccatcgtcgtcaccttcgccatggagcaccgcccctccgtctggaccatcggcttcgacatgaacctcctcgccgccgcatacgccggcattgtcacgtcgagcatagcgtactacgtgcaaggcctggtgatccagaagaccgggcccgtgttcgcgtcggcgttcagcccgctgatgatgatcatcgtggccgtcatgggctccttcatcctcgccgagaagatattcctcggcggcgtcctcggcgccgtcctcatcgtcatcgggctctactcggtgctctggggcaagcacaaggagacgcaggacaaggaggacgatgagacgacagagctgcccgtcgtggcaataatggcatccaaaaccaatggagtcgtctacgacgacgacgatgacgtcgtcttcgtcaaggagatcgccgccgccggcgctggcgctgttggaggagatgactcggagtgcaggaaggcgactggggtggtgaagtcatcctcccgtggacacggagctgctggtgcagtttgatggaacatgcatggaagaggcggtgtccaactgctaacttcctttccttgcattgccatgtgtgtcccctagtatctactgacgttgcatgcatcacagggtcgggtgattgagagaggcagctgcgatgcagagtggaaggactggaataattttgttctgtgcccttttgaattttgctacctttttgtaccgtaagatgtatctactagtatatttaacttgtattttcttatgctttaatttctgtggagaaaaaagtgatgttccgggacttaagcgaaggacatatatatatgtatgtatcacatcggcttttgccatgtaatatattattgcttttctcatcgaataaaaaaacatcgcccttgccaac

SEQ ID NO: 2109 - DNA, 1704 bp, Oryza sativa
aactcaaggccagtgtctttgctccttgagttctgcactagctagctagtgtgtaacacacctactagctaggaagctacccgtctctgctaaccaccaagctcgagcaaattaagcaagtgacacagttcagaacaccagcattcgccatggcctcctccccctgcggcggcttcctcgagaaggccaagccctacttcgccatgatctgcctgcagttcggctacgccggcatgaacgtgatcaccaaggtctccctcaaccacggcatgagccactacgtgctcgtcgtctaccgccacgccttcgccaccatctccatcgcacccttcgccctcctcctcgagaggaaggtgaggcccaagatgacgtggtcggtgttcctccagatcttcgtcctggcactgctcgggcctgtgatcgatcagaacttctactacgccggcctcaagttcaccgggccaaccttcgcatgcgccatgagcaacatcctccccgccatgaccttcgtgatggccgtaatcttcaggatggagaaggttgacctgaagaaggtgaggtgccaggcgaaggtggccgggacgctggtgacggtggccggcgcgatgatgatgacgctgtacaagggcccgctgatgcagatggcgtggacgagccacgtgcaggcgccgcacggccacggcgcggaggcgcccgccgccgccgccgccgtcgacccgtcgggcagggagtggttcctcggctcgctgttcgtcatcatcgccaccctcgcctgggcctcgctcttcatcctgcaggcgcacaccctcaagaagtactcggcgccgctctccctcaccacgctcatctgcttcgtcggcaccctccaggccatcgtcgtcaccttcgccatggagcaccgcccctccgtctgggccatcggcttcgacatgaacctcctcgccgccgcttacgccggcatcgtgacgtcgagcatcgcgtactacgtgcaggggctggtgatccagaagacagggccggtgttcgcatcggcgttcagtccgctgatgatgatcatcgtggccggcatgggctccttcatcctcgccgagaagatatacctcggcggcgtcctcggcgccgtcctgatcgtggtcgggctctactccgtgctctggggcaagcacaaggagacccaggagcaggacgcggccatgatggagcttccagtggcctctaagggaaacgacgccgagttcaccgccgccaccgttgttggagacgacgacgacgcggcggactgcaagaaagcaaatggagtgaaaaagtcgtcatcctccaacgagcaaggagctagtgcagtttgacgcagctggctgcagcatgcaggcacaatgcacaatgattccaagtgttttgctgcatcagtcgatcgtggtggagaggttttgtccaaatgctaattaactgtcttctcatgtgagggcgtacgtgtgacggaaacgtttgtgttactgacgttgcatgcattattacttattagggcccggtgattattgagaacgggtggagtggaataattttgttctatgtgcttttcgttttgtcccttcctgtaacctggattccttactccagctacccctgaatcatcagttctccttctgtttttgatcggaagtaattaagagcgtgttgtgttttggccttccatatattttcctc

SEQ ID NO: 2110 - DNA, 1705 bp, Brachypodium distachyon
ctccgcatcctgccccttgagttcgatcccctagctagctaattacagctaccttagctagaagcttctatcccttttggaatttcctcacaaaggcttgcagctagcaagaattgaagtactaccatacatttaagcatcaccatgggttgctacggcgatttcttcgagaaggccaagccttacatcgccatgatctgcctgcagttcggctacgccggcatgaacgtgatcaccaaggtctcccttaaccacggcatgagccactacgtgctcgtcgtctaccgccatgccttcgccaccgtctccatcgccccatttgcactgcttctcgagaggaaggtgaggccgaagatgacgtggtcgtcctttctccagatcttcgtactggcactactcgggcccgtgatcgaccagaacttctactacgccggcctcaagttcaccggcccaaccttcgcatgcgccatgagcaacatccttcccgccatgaccttcgtcatggccgtcatcttcaggatggagaaggtggacattcggaaggtgaggtgccaggcgaaggtggccgggacagtggttacagtggccggcgcgatgctgatgacgctgtacaagggcccgctgatgcagatggtgtggacgagccacgcgcagccgcacggcaacggcggcggggagggcggcccggtggccgccgccgtcgacccaacgggccgggagtggttcctgggctcgctcttcgtcatcatcgccaccctggcgtgggcctccctgttcatcctccaggcccacaccctgaagcagtactcggcgccgctctccctcaccacgctcatctgcttcgtcggcaccctccaggccatcgtcgtcaccttcgccatggagcaccgcccctccgtctggaccatcggcttcgacatgaacctcctcgccgccgcttacgccgggatcgtgacgtcgagcatcgcgtactacgtgcaaggcctggtgatccagaagacgggcccggtgttcgcgtcggcattcagcccgctgatgatgatcgtggtggccgtcatgggctccttcatcctcgccgagaagatatacctgggcggcgtcctgggatccgtcctcatcgtcatcgggctctactcggtgctctggggcaagcacaaggagacccaggaggagtcacgggcgctggcaatggagctgcccatggccgtggccgcctccaagctgggagacgccgacgcggcgttcgccaaggattccgagtgcgggaaagcggacggagccaaggcatcttccaacggacacggaggagctagtgcagtttgatgctgcgattgtccaactcaactacttcttccaagtgctaactgcgtgtgtgcactgactgggaagagcggaaataatttttgctccgtgcctgtgtatttttgtcctcgatctcctgtaattttgtcgaccgactagtagtactccaatgcacctcgtatttttcttctgttttttttatcaggggagaaagaatgtttgtgttgtgttgtgttgtgttgcgttgtgttgaggggtatatatgtgttcacgtactagcagaattttgagtgttttcgggcagagtactatttctggccgcaaattaatattgagatcatcgatttgtctctggcatgatgaatcaatggagcaccattgtacaacgaaccgttctgtcaca

SEQ ID NO: 2111 - DNA, 1546 bp, Triticum aestivum
gctttagcctctagctctagctaacttatcttctacttaaccaaggctttgcagccagcaagaagtaccatatatatcatcaccatgggtggctacggcgacttgttcgagaaggccaagccttacatcgccatgatctgcctgcagttcggctacgccggcatgaacgtcatcaccaaggtctcgctcaacggcggcatgagccactacgtgctcgtcgtgtaccgccacgccttcgccaccgtctccatcgcgccatttgccctaattttcgagagaaaggtgaggccgaagatgacgtggtcgtccttcctccagatcttcgtgctggcacttctcgggcctgtgatcgaccagaacttctactatgtgggtctcaagtacactggcccgaccttcgcatgcgccatgagcaacatccttccagccatgaccttcgtgatggccttcatcttcaggatggagaaggtggacctgagaaaggtgcggtgccaggcgaaggtggccgggacggtggtgacggtggccggcgcgatgctgatgacgctctacaagggcccgctgatgcggatggcgtggacgagccacggacaggcccacggcggcgaggccccggccgtcgatcccacgggcagggagtggttcctcggctcgctcttcatcatcatcgccaccctcgcctgggcttctctcttcatcctccaggctcacaccctgaagcagtactcggcaccgctctcccttaccacgctcatctgcttcgtcggcaccctccaggccatcgtcgtcaccttggccatggagcaccgcccctccgtctggaccatcggcttcgacatgaacctcctcgccgccgcatacgccggcatcgtgacgtcgagcatagcatactacgtgcaaggcctggtgatccagaagaccgggccggttttcgcgtcggccttcagcccgctgatgatgatcgtggtggccgtgatgggctccttcatcctctccgagaagatatacctgggcggcgtcctcggctccgtcctcatcgtcatcgggctctactccgtgctctggggaaagcacaaggagacgcaggcagagtctgcggctctgcgggaggccatggcctccatcaactccaagggagacggagacgccgtacacgggcacgatcctgagtgcgagaaagccaacggagcacccaagccatcctccaacggacacggagctagtgcagtctgatcaagagattccaactgcttccaagtgctaactgcgggtgcgcgcgcgcgtctgaacgaaatgtctcgtcactgacgttgcatgcactagggctgcatgataattttgcgccgtgccttttatttttgtcctcttgtatgatttccacaaccaacgactatattaccccagtacgccctgtacttttgttcttctgttttattatcgggggagaaagaaatgtgttccggcaaggggtatgtacgtgttcgtgtaagagaattttgagcgtttttgtgatcccggcttaatttcgaaataaatatcagtttag

SEQ ID NO: 2112 - DNA, 1658 bp, Triticum aestivum
aggtctagcttggtctctcttgctccttgagttccctaaccagaagcttctaggctttagcctctagccctagctaacttatcttctagttaaccaaggctttgcagccagcaagaagtaccatatatatcatcaccatgggtggctacggcgacttgttcgagaaggccaagccctacatcgccatgatctgcttgcagttcggctatgccggcatgaacgtcatcaccaaggtctcgctcaacggcggcatgagccactacgtgctcgtcgtgtaccgccacgccttcgccaccgtctccatcgcgccatttgccctaattttcgagagaaaggtgaggccgaagatgacgtggtcgtccttcctccagatcttcgtgctggcactgctcgggcctgtgattgaccagaacttctactatgtgggtctcaagtacaccggcccgaccttcgcatgcgccatgagcaacatccttcccgccatgaccttcgtgatggccttcatcttcagaatggagaaggtggacctgagaaaggtgcggtgccaggcgaaggtggccgggacggtggtgacggtggccggcgcgatgctgatgacgctctacaagggcccgctgatacggatggcgtggacgagccacgggcagccccacggcggcgaggacccggccgtcgaccccacgggcagggagtggttcctcggctcgctcttcatcatcatcgccaccctcgcctgggcctctctcttcatcctccaggctcacaccctgaagcagtactcggcgccgctctcgctcaccacgctcatctgcttcgtcggcaccctccaggccatcgtcgtcaccttggccatggagcaccgcccctccgtctggaccatcggcttcgacatgaacctcctcgccgcagcatacgccggcatcgtgacatcgagcatagcgtactacgtgcaaggcctggtgatccagaagaccgggccggtgttcgcctcggcgttcagcccactgatgatgatcgtggtggccgtgatgggctccttcatcctctccgagaagatatacctggggggcgtcctcggctccgtcctcatcgtcatcgggctctactccgtgctctggggaaagcacaaggagacccaggcggagtccgcggccctgcgggaggcgctgcctatggccatggcctcctacacctccaaggtgaccggagacgccgcgtcggccggacacgatccggagtgcgagaaagccaacggagcagccaagccatcctccaacggacacggagctagtgcagtctgatcaatcgattccaactgcttccaagtgctaactgcaaatgtctcgtcactgacgttgcatgcactagggccgtgtgcgctgcatgcaaggggagagtggaataattttgcgccgtgccttttatttttgtcctcttgtatgatttccacaaccaacgactatagtactccagtacgccttgtatttttcttcttcttttttttatcgggggagaaagaaatgttgtgctccggcaaggggcatgtaccgatgtacgtgttggtgtaagagaattttgagtgtttttgtgatcccggcttaatttcgaaataaatatcagtttggaaaaagtagttcaattctgtgataaaaaaaaaa

SEQ ID NO: 2113 - DNA, 1652 bp, Hordeum vulgare
ctcaaggtctagcttggtctctcttgctccttgagttccctaaccagaagcttctaggctttagcctctagccctagctagctaacttatcttctagttaaccaaggctttgcagccagcaagaagttccatatatatcatatatatatcatgatcaccaccatggggggctacggcgacttgttcgagaaggccaagccttacatcgccatgatctgcctgcagttcgggtacgccggcatgaacgttatcaccaaggtctccctcaatggcggcatgagccactacgtgctcgtcgtgtaccgccacgtcttcgccaccgtctccatcgcgccatttgccctaattctcgagaggaaggtgaggccaaagatgacgtggtcgtctttcctccagatcttcgtgctggcactgctcgggcctgtgattgaccagaacttctactatgtcggtctcaagtacaccggcccaaccttcgcatgcgccatgagcaacatccttcctgccatgaccttcgtgatggccttcatcttcaggatggagaaggtggacctgagaaaggtgcggtgccaggcgaaggtggccgggacggtggtgaccgtggccggcgcgatgctgatgacgctctacaagggcccgctgatgcggatggcttggacgaaccacggacaggccaacggcggtgaggccccggccatcgatcccacggggagggagtggttcctgggatcgctcttcatcatcatcgccaccctcgcctgggcctctctcttcatcctccaggctcacaccctgaagcagtactcggcaccgctctccctcaccacgctcatctgcttcgtcggcaccctccaggccatcgtcgtcaccttcgccatggagcaccgcccctccgtctggaccatcggcttcgacatgaacctcctcgccgccgcatacgccggcatcgtgacgtcgagcatagcgtactacgtgcaaggcctggtgatccagaagaccgggccggtgttcgcgtcggcgttcagcccgctgatgatgatcgtggtggccgtgatgggctccttcatcctctccgagaagatatacttgggcggcatcctcggctccgtcctcatcgtcatcgggctctactccgtgctgtggggaaagcacaaggagacccaggcggagtccgcggctctgcgggaggcgctgcccatggccatggcctcctccaactccaagggagagggagacgccgtacaggggcacgatcctgagtgcagcgagaaagccaacggagcagcgaagccatcctccaacggacacggagctagtgcagtctgatcgatagattccaactgtttccaagtgctaactgcaaatgtctcgtcactgatgtcacatgcactagcgccttgtgcgctgcatgcagaggggagagtggaataatgttgcgccgtgccttttatttttgtcctcttgtatgatttccacaaccaacgaacgccttgtatttttcttctcttcttttcttttatcgggggagaaagaaatcgtgtgttcctgcaagggtatgtacgtgagtttcacataaataggtgttcacgtaagagaattttgaatggtttgtgatcccgacttaattttgagataaatactccttccctccg

SEQ ID NO: 2114 - DNA, 2268 bp, Saccharum officinarum
aacctcccatcccaccccctcatgtcgtcgccttcctccccgcgctcttgccgccgcatctcctcgctccccaccacgccctcgcaggctcatctctgatgatggaggtaacagtcggctagcacaccgcaccgccgtgcgtccctctctgttgcccgtcccttcattcccagtttagaagagtttttgtttcggtttcgtcgttccatcgagcgcggcattctgtggatcgcgtggatttggcccgggggaggaggaggaggaggaggctggtcaaagatttgtggtggaattgatggtggggttcatggaatgggtgcatgactggttgctgtgggacgccttcttggagtgcggagggatcatgaggccaccgattagatagcggctggggagcgagggaccacaggaggcggaggccgccgttagcaccccccaccaccccgcggcgcgagtcagcagccatgggggaagacctcgtcaccaccctgtccatggagaacggcggcggcggcggccacggcccctgcacgctcctctccatggacccgtcgggccacctctccgcgccggacgaccgcgccgtcggcgtcatggtgcaggccctcatcggagggggcgccggcatcggtgcccgcgcccacgccgtgtcgccctccggcgcgcctccgcccgacatcaaccagccctggcagacggacctctgcgacatgctggacgtcggcctcggcccgcaggtctacagcgccgaggccgtgctcagctgcgctcccaaggccgggagccggaaggccgccaagcgcggggacaccatctggggcgcctggttcttcttcaccttctatttcaagcccctgctgtccgacaagtgcaaggacaaggtcgtccgggacaacagcggcgtctcggggttcgacaagtcggacctccgccttgacatgttcctggtgcagcacgacatggagaacatgtacatgtgggtgttcaaggagcgcccggagaatgctctggggaagatgcagctgaggagctacatgaacgggcactccaggcctggtgagccacagttcccattcagtgtggacaggggattcgtgcgatcgcaccggatgcagcgtaagcactaccgggggctgtcaaacccgcaatgtattcatgggattgaggtggtcaggtcaccaaagcttgcggggctcactgaggcagaccttaggaggtgggcagagcttacagggagggagctcaatttcatcatcccgcaggaagccagtgattttgggacatggaggaccattccgaactcagagcttgagcttgagaagccacaccctgtcatgaagagcaatggtacccaaaacccaaagaaagcaggcttgaatttgtcatcaccgtccaatcattcaggcgaagatggtatggatctctccccagttagcagcaagcgtaggaaggaattatccccacaagccatggatgaggaagtattcttcccactgaattctttccctcagaagacacaacaagatgtggagatgcattcaccagcacaacctgcatggctccatgagtttgctggggtgatgagaaacgcttgtgggccagtgactgctgccaagtctatctatgaggatgaccagggctacttaataatggtcagcttgccatttgttgatcagcagagggtgaaggtttcatggaggaacactctgactcatggcattgtgaaaatcgtttgtgttagtactgctaggatgcaacatataaggagacatggtaggatgttcacacttgccgatccttcccccgagcactgccctcccggggatttcattcgtgaaatacctctagctactcgtatccctgaagatgctaagctggaggcctgttttgatgaggctgcctcagtgcttgagatcatggtcccaaaacgaggaaatgaacctgaagaacatgaagttagggtctctctgcgaccccctcactttggagctaatgatctacttttgacctaagctaagtaaggtctctgcaccatgttctgtcttgtttgtaaccccagatcgatgccaaatttagctgggaatcaaggtttcagtatgcttattctctgcctaatgttttcagtacctgtgacatactaagtctcttcagcaacgaagactgggctgaagactagtttgttctagcttttgtgttatgggtgtctttttaaccctcatgtttagattttgtaccaagttcaattaaagaaaataatattctgagttg

SEQ ID NO: 2115 - DNA, 2315 bp, Zea mays
ttcccctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagccatgggggaagacctcgtcaccaccctgtccatggagaacggcggcggcggcggcggcggccaccacggcccctgcacgctcctctccatggacccgtccggccacctctccgcgccggacgaccgcgccgtcggcgtcatggtgcagaccctcatcggagggggcgtcggcgccggcgcccgcgcccacgccgtgtcgccctccggcgcgcctccgcccgacatcaaccagccgtggcagaccgacctctgcgacatgctggacgtcggcctcggcccgcaggtctacagcgccgaggccgtgctcagctgcgcccccaaggccgggagccggaaggccgccaagcgcggggacagcatctggggcgcctggttcttcttcaccttctatttcaagcccctgctgtccgacaagtgcaaggacaaggtcgtccgggacaacagcggcggggtctcgggcttcgacaagtccgacctccgccttgatatgttcctggtgcagcacgacatggagaacatgtacatgtgggtgttcaaggagcggccggagaatgctctggggaagatgcagctgaggagctacatgaacggccactcccggcccggggagccgcagttccccttcagcgtcgacagggggtttgtgcggtcgcaccggatgcagcgtaagcactaccgggggctgtcaaacccgcaatgtatccatgggattgaggtggtcaggtcaccaaatcttgtagggctcaccgaggcagaccttaggaggtgggcggacctgactgggagggagctcaatttcatcatcccacaggaagccagtgatttcgggacatggaggaccattccaaattcagagcttgagcttgagaagccacaccctgtcatgaagagcaacggcacccaaaacccaaagaaaacaggcttgaatctgtcgtcaccgtccaatcattcaggcgaagatggtatggatctctctccagttagcagcaagcgtaggaaggaattgtccccacaggccatggatgaggaagtattcttcccactgaattcttgccctcagaagacacaacaagatgtggagatgcactcaccaacgcagcctgctgcgtggctccatgagtttactggggtgatgagaaacgcctgtgggccagtgactgctgccaagtctatctatgaggatgaccagggctacttaataatggtcagcttgccgtttgttgatcagcagagggtgaaggtttcgtggaggaacactctgactcatggcattgtgaagatcgtttgtgttagtactgctaggatgcaacatataaggagacatggcaggatgttcgcgcttgccgatccttccccagagcattgccctcctggtgatttcattcgtgaaatacctctagctactcgtatccctgaagatgctaagctggaggcttgttttgatgaggctgcctcagtgctggagatcatggtcccaaaacgagggaatgaacctgaagaacatgaagttagggtctctctgcgaccccctcactacggagctaatgatctacttttgacctaagctatctctgcaccatgctacatcttctttgtaaccccagattaatgccaaatttagctgagaatcaaggtttcagtatgcttgttctttgcctaatgtttccagtacttgtgccatactatgtctcttcagcgacgaagacttgctgaagactagtttattctagcttctgtgttatgggtgtctttttaaccctcatgtttagattttgtactaagttcagttaaaagaaataatattctgagttgccactggtttgttttg

SEQ ID NO: 2116 - DNA, 2354 bp, Setaria italica
cccataccccccctcccacccccccgcgcatgtcgtcgccttcctcccctcgctcttgcccccgcatctcctcgctccccgccgcgccctcacattaatggaggaggccgatctctgatggaggtaacagtcggctaacccaccaccgcgttacttggcttggagtagattagttctgtttcggtttcttcgatcccacccggtgcggcattctgtgggtcgtggatttggcgtggggaggaagctgggtctgggtgaagatttgtggtggaatctgccggggaattgatggtggggctcatggaatgggtgcatgactggttgctgtgggacgccttcttggagtgcggagggatcatgaggccgccgattagatagcggcgggagaagaagagagggaggacagcaggcggaggccgccattcgcaccaaccaccccgaggctcgagtcaccagccatgggggaagacctcgtcaccaccctgtccatggagaacggcgtgggcggcggccaccacggcccctgcacgctcctctccatggacccgtccggacacctcgccgcgccggacgaccgcgccgtcggcgtcatggtgcaggccctcatcggaggggccggcggcgtcggcgcgcgcgcccacgccgtgtcgccctccggcgcgcctccgccggacatcaaccagccgtggcagacggacctctgcgacatgctcggcgtcggcctcggccatcaggtgtacagcgccgaggctgtgctgagctgcgtcgctcccaaagccgggagccggaaggccgccaagcgcggggacagcatctggggcgcctggttcttcttcaccttctatttcaagcccctgctgtcggacaagtgcaaggacaaggtcgtccgggacaccagcggcgtctcggggttcgacaaatctgacctccggctcgacatgtttctggtgcagcacgacatggagaacatgtacatgtgggtgttcaaggagcggccggagaatgccctcgggaagatgcaactgagaagctacatgaacgggcactcccggcctggtgagccacagttccccttcagtgtcgacaggggatttgtccggtcgcaccggatgcagcgcaagcactaccgggggctgtcaaacccacaatgtattcatgggattgaggtggtgaggtcaccaaatcttgcagggctcactgaggcagacctgagaaggtgggcagagcttacagggagggaggtcaatttcatgatcccacaggaggccagtgattttgggacatggaggaccataccgaactcagagcttgagcttgagaggccacaccctgtcatgaagagcaatggtacccaaaacccaaagaaatcaggcttgaatttgtcatcgccgtccaatcattcaggcgaagatggtatggatctgtcccctgttagcagcaagcgcaggaaggaattatccccacaagctatggatgaggaggtattcttgctggtgaattcttgcaatcagaagacacaacaagacgtggagatgcattcagcggtgcaaccttcatggctccatgggtttgctggggtaatgagaaatgctcgtgggccagtgactgccgccaagtccatctatgaggatgagcagggctacttaataatggtcagcttgccatttgttgatcagcagagggtgaaggtttcgtggaggaacactctgactcaaggcattgtgaagatcgtttgtgttagtactgcaaggatgcaacagataagaagacatggtaggattttcaagctttcggatccttctcccgagcattgccctcctggggatttcattcgtgaaatacctctagctactcgcattcctgaagatgctaagttggaggcatactttgatgaggctgcttcagtgcttgagatcatggtaccaaaacgaggaaatgaacctgaagagcatgaagttagggtctctctgcgacctcctcacttcggagctaatgatctacttttgacataaactaagtaaggcctacgcaccatgtggcatcttgtttgtaaccccagattaatgctgaatagctcagaatcaaggtttcagtatgcctgttctctgccttttccttttgtgcatgtgctgtgcaagtctcttcagtaacagacttggctgaagactagtttgttctagttgtgttatgggtgtatttttaaccctcttgtttacagttgtggtgggatttctgatttagattttgtactaagttcagtttaaaataataaaaatctgagttgttacatatctgcttgtatcttggattgtgatatcctgtttgtaaccatctcaaccaaattttacagggta

SEQ ID NO: 2117 - DNA, 2388 bp, Panicum virgatum
ccgccccccagcaaccatcccttcccctttcccaacctcctcccatcccatcccaccccctcatgtcgtcgccttcctccccgcgctcctgcacccgcatctcctcgctccccgccacgccctcgcattgatggcggaggctgatctctgatggaggtaatacagccggctaacccaccaccgcgctacttggcttcgttccattttagacgagtctagcttccggtttcttcatcccgaccctgtgcggcattctgcgcgtcgtggatttggtcgggggaggaggctgggtgaagatttgaggtggaatccgcgggggaattgatggtggggttcatggaatgggtgcatgactggttgctgtgggacgctttcttggagtgcggagggatcatgaggccgccgatcagatagcggcgggagaagacagggaggacagcaggcggaggccgccattagcaccaaccacccccgaggtgcgagtcaccagccatgggggaagacctcgtcaccaccctgtccatggagaacggcgtgggcggcggccaccacggcccctgcacgctcctctccatggacccgtccggccacctcgccgcgccggacgaccgcgccgtcggcgtcatggtgcaggcgctcatcggagggggcgccgccgtcggcgggcgcgcccacgccgtgtcgccctccggcgcgcctccgccggacatcaaccagccctggcagacggacctctgcgacatgctcgacgtcagcctcggccctcagctgtacagcgccgaggctatgctcagctgcgtcgctcccaaagccgggagccggaaggccgccaagcgcggggacagcatctggggcgcctggttcttcttcaccttctatttcaagcccctgctgtcggacaagtgcaaggacagggtcgtccgggacgccaacggcgtcacggggttcgacaaatctgacctccggctcgacatgttcctggtgcagcacgacatggagaacatgtacatgtgggtgttcaaggagcggccggagaatgccctcgggaagatgcaactcaggagctacatgaacgggcactcccggcctggtgagccgcagttccccttcagcgtcgacaggggatttgtccggtcacaccggatgcagcgtaagcactacagggggctctcaaacccgcaatgtattcatgggattgaggtggtcagatcaccaaatcttgcagggctcactgaggctgacctgaggaggtgggcagagcttacagggagggagctcaatttcataatcccacaggaggccagtgattttgggacatggaggaccatgccgaactcggagcttgagcttgagaggccacaccctgtcgtcaagagcaatggtactcaaaacccaaagaaatcaagcttgaatttgtcatcgccgtccaatcattcaggcgaagatggtatggatctgtccccagttagcagcaagcgcaggaaggaactatccccacaagccatggatgaggaggtattcttaccagtgaattcttgcaatcagaagacacaacaagacgtggagatgcattcagcagtgcaaccttcatggctccacgagtttgctggggtaatgagaactgcttgtgggccagtgactgctgccaagtccatctatgaggatgagcagggctacttgataatggtcagtttgccatttgttgatcagcagagggtgaaggtttcgtggaggaatacactgactcgtggcattgtgaagatcgcttgtgttagtactgcaaggatgcagcacataagaagacatggtaggattttcaaacttgctgatccatctcccgagcattgccctcctggggatttcattcgtgaaatacctctagcttctcgcattcctgaagatgctaagttggaggcatatttcgatgaggctgcttcagtgcttgagatcatggtcccgaaacgaggaaatgaacctgaagagcatgaagttagggtctctctgcgacctcctcactttggagctaatgaactacttttgacctaagctgagtaggtctctgcacgatgtggcatcttgtttgtaaccccagactaatactgaattgagctgagaatcaaggttcagtatgcttgttctctgcctattcattttagtgcctgtgctttgtaagtctcttcagtaacaaagaactaggctgaagattagtttgttctagttgtgctatgggtgtatttttaaccctcatgtttacagttgtgctgggattgccgatttagattttgtattaagttcagttaaagaaataaaatactgagttgttacctatttgcttgtatcttggattgtgacttcctgtttgtaacaatctctacacccaaatttcac

SEQ ID NO: 2118 - DNA, 2413 bp, Panicum virgatum
gaggggtcttccgcgtcccagatgccattaaaatcggccgccccccgcaaccatcccttcccctttcccaacctcccatcccacccccctccccctcatgtcgtcgccttcctccccgcgctcctgcacccgcatcccctcgctccccgccgcgccctcgcattgatggcggaggctggtctctgatggaggtgacagtcggctaacccaccaccgcgctgcttggcttcgtgccagttagagaagtttagttccggtttcctcatcccgaccctgtgcggcattctgtgcgtcgtggattcggtcgggggaggaggctgggtgaagatttgaggtggaatctgcggggaaattgatggtggggttcatggaatgggtgcatgactggttgctgtgggacgccttcttggagtgcggagggatcatgaggccgccgatcagatagcggcgggaggagacagggaggaggagcaggcggaggccgccattagcaccaaccaccccgaggcgtgagtcaccagccatgggggaagacctcgtcaccaccctgtccatggagaacggcgtgggcggcggccaccacggcccctgcacgctcctctccatggacccgtccggccacctcgccgcgccggacgaccgcgccgtcggcgtcatggtgcaggcgctcatcggagggggcgccgccgccgccggccgcgcccacgccgtgtcgccctccggcgcgcctccgccggacatcaaccagccgtggcagacggacctctgcggcatgctcaacgtcggcctcggccctcagctgtacagcgccgaggctatgctcggctgcgtcgctcccaaagccgggagccggaaggccgccaagcgcggggacagcatctggggcgcctggttcttcttcaccttctatttcaagcccctgctgtcggacaagtgcaaggacaaggtcgtcggggacaccaacggcgtctcggggttcgacaaatctgacctccggctcgacatgttcctggtgcagcacgacatggagaacatgtacatgtgggtgttcaaggagcgcccggagaatgccctcgggaagatgcaactgaggagctacatgaacgggcactcccggcctggtgagccgcagttccccttcagcgtcgacaggggatttgtccgctcacaccggatgcagcggaagcactacagggggctctcaaacccgcaatgtattcatgggattgaggtggtcaggtcaccaaatcttgcagggctcactgaggcagacctgaggaggtgggcagagcttacagggagggagctcaatttcataatcccgcaggaggccagtgattttgggacatggaggaccatgccaaactcagagcttgagcttgagaggccacaccctgtcgtgaagagcaatggtacccaaaacccaaagaaatcaggcttgaatttgtcatcgccgtccaatcagtcaggcgaagatggtatggatctgtccccagttagcagcaagcgcaggaaggaattatccccacaagccatggatgaggaggtattcttgccagtgaattcttgcaatcagaagacgcaacaagacgtggagatgcattcagcagtgcaaccttcatggctccacgagtttgctggggtaatgagaactgcttgtgggccagtgactgccgctaaatccatttatgaggatgagcagggctacttgataatggtcagcttgccatttgttgatcagcagagggtgaaggtttcgtggaggaacactctgacttgtagcattgtgaagatcgcttgtgttagtactgcaaggatgcaaaacataagaagacatggcaggattttcaagcttgccgatccgtctccggaacattgccctcctggggatttcattcgtgaaatacctctagcttctcgcattcctgaagatgctaagttggaggcatatttcgatgaggctgcttcagtgcttgagatcatggtcccaaagcgaggaaatgaacctgaagagcatgaagttagggtctctttgcgacctcctcactttggagctaatgaactacttttgacctaagctgagtaaggtctctgcaccatgtggcatcttgtttgtaaccccagattaatactgaattgagctgagagtcaaggttcggtatgcttgttctctgcctactcatttaagtgcctgtgctttataagtctcttcagtaacaaagacttggctgaagattactttgttctagttgtgctatgggtgtatttttaaccctcatgtttacagttgtgctgcgattgctgatttagattttgtactgagttcagttaaagaaataaaatactgagttgttacctatttgcttgtatcttcgattgtgacttcctgtttgtaccaatctctacacccaaa

SEQ ID NO: 2119 - DNA, 3299 bp, Pennisetum glaucum
cgcgccggacgaccgcgccgtcggcgtcatggtgcaggccctcatcggaggggccgccggcgtcggcgcgcgcgcccacgccgtgtcgccctccggcgcgcctccgcccgacatcaaccagccgtggcagacggacctctgcgacatgcttggtgttggcctaggccatcaggtgtacagcgccgaggctatgctgagctgtgtcgctcccaaagccgggagccggaaggccgccaagcgcggggacagcatctggggcgcctggttcttcttcaccttctatttcaagcccctgctgtcggataagtgcaaggacaaggtcgtccgggataccagcggtgtatcgggtttcgacaaatctgacctccggctcgacatgttcctggtgcagcacgacatggagaacatgtatatgtgggtgttcaaggagcggccggagaatgccctcgggaagatgcaactgagaagctacatgaacgggcactcccggcctggtgagccgcagttccccttcagtgtcgacaggggatttgtccggtcgcaccggatgcagcgcaaacactaccgggggctgtcaaacccacaatgtattcatgggattgaggttgtgaggtcaccaaaccttgcagggctcactgaggcagacctgagaaggtggggagagcttacagggagggagctcaatttcatgatcccacaggaggctagtgattttgggacatggaggaccatgccgaactcagagcttgagcttgagaggccgcaccctgtcatcaagagcaatggtacccaaaactcaaagaaatcgggcttgaatttgtcatcgccatccaatcattcaggcgaagatggtatggatctgtccccagttagcagcaagcgcaggaaggaattatccccacaagccatggatgaggaggtatttttgccggtgaattcttgcaatcagaagacacaagacttggagatgctttcagcggtgcaaccttcatggctccatgggtttgctggggtaatgagaagtgctcgtgggccagtgactgccgccaagtccatatatgaggatgagcagggttacttaataatggtcagcttgccatttgttgatcagcagagggtgaaggtttcgtggaggaacacactaactcaaggcattgtgaagattgtttgtgttagtactgcaaggatgcaacagataagaagacatggtaggattttcaagctttctgatccttctcccgagcattgccctcctggggatttcattcgtgaaatacctctagctactcgcattcctgaagatgctaagttggaggcatactttgatgaggctgcttcagtgcttgagatcatggtaccaaaacgaggaaatgaacctgaagagcatgaagttagggtctcgctgcgacctcctcactttggagctaatgatctacttttgacataagctaagtaaggcctatgcaccatgtggcatcttgtttgtaaccccagattaatgtcgaatagctgagaatcaaggttttactatacctgttctctacctattccttttgtgcatgtgctgtgcaagactagttggttctagttacgttatgggtgtatttttaaccctcttgtttacagctgtgggatttctgatttagattttgtactaagttcagtttaaaataccaccagggaaagatacgccaaagatgtataaactagcagcagatttgaatatgaaatgtgatgaatccacgtgttacagagatcatgccgcaaccatcttgtgctgcaaaacaacatattaacctaccaactcaatcttgctttggcctggtgctaacttggcacattcaatgtattgtggcaaaacattggtgagtgcattcctgaaaggaattcatgcaggctctgaaaaaaaattccacgaattgagcagcagtcggtcaaggtaaacttcccacaaacaggcccatctttcacctgttatttagtccctctcttcagcttttcttttcacctttctcttctgctctcgtgaacgcttcttttcttcatgcttcttttgcttccagttctgagcaagtcttcgcttttccctttgtttgtctaagtttacacagacctcttgcccagaattctgaagagcttgcaagggttcaacacgatcctgcccaataacaacaaatcgagaccctttattctcagccttgcttctattgttgcttacttttctcttggccaactcttctagttgcttctgaagtaatggtgaaataccagccccagctaaatagcgtcgtgaaaaagtcttaggctgcaacgggcgttgcaaaagatcattcaattcctgttgaagcttttggagatgtgcagaagttgcctttcgttgcttgtggccctttacacgttcttcttcactgtcactagtctctaatatcaatcccatggattcagcattcctctcaagccaggatttgttagcattttcctgtgaatttttgcgtgtaatcttgtcaatctgtcgagcaagcgagagcctattcattattgcaggcatgtaagcatgatctataggaaattgctggaggttctcctttgacaatgacttacaaagagagtaaaactttgacttgtcagcaggagagattaatgcaatgctgcagccagccaatgatttgcgtgctgtccttccacttctgtggatataaacatcagtggaatgtggcaactggtaatggataactgtccgcacatcatcaaaatccataccccttgcaaatccatcagttgcgaccaaaatggaattcttacttccacgaaaacgatccacggccttcatgcgagccctttgttgcatttgagcatggtttgtcaaggcattaataccaagaatgcgcaatatggaggaaatgtggcgtagtgcagcgattgatgtacaaaaaataattgttcgaccttgcccatgtacactcagtatataatacagataggcatccttatcctcttcactgcactcaataaaagattcttcaagtttctcgggcaagattgaagcctttgtcagatcaactatttctgcatttggtttcattccagcctgcttcgacagtgcctcaatagagcttacatcatcagtcgacgcctttgaagtagataggccacgcttcagcttcttccggaaattagatgaaagtgcaagtgtggctgagaaaacaaaggtttgcctcttctttatttgcaagattggcacagtctcacagtttggcattgttcttgcaacttgttcatcagaaccattagtcagtgga

SEQ ID NO: 2120 - DNA, 1792 bp, Panicum virgatum
ccggacgaccgcgccgtcggcgtcatggtgcaggcgctcatcggagggggcgccgccgtcggcgggcgcgcccacgccgtgtcgccctccggcgcgcctccgccggacatcaaccagccctggcagacggacctctgcgacatgctcgacgtcagcctcggccctcagctgtacagcgccgaggctatgctcagctgcgtcgctcccaaagccgggagccggaaggccgccaagcgcggggacagcatctggggcgcctggttcttcttcaccttctatttcaagcccctgctgtcggacaagtgcaaggacagggtcgtccgggacgccaacggcgtcacggggttcgacaaatctgacctccggctcgacatgttcctggtgcagcacgacatgaagaacatgtacatgtgggtgttcaaggagcgcccggagaatgccctcgggaagatgcaactcatgagctacatgaacgggcactcccggcctggtgagccgcagttccccttcagcgtcgacaggggatttgtccgctcacaccggatgcagcgtaagcactacatgggggctctcaaacccgcaatgtattcatgggattgaggtggtcagatcaccaaatcttgcagggctcactgaggctgacctgaggaggtgggcagagcttacagggagggagctcaatttcataatcccacaggaggccagtgattttgggacatggaggaccatgccgaactcggagcttgagcttgagaggccacaccctgtcgtcaagagcaatggtactcaaaacccaaagaaatcaagcttgaatttgtcatcgccgtccaatcattcaggcgaagatggtatggatctgtccccagttagcagcaagcgcaggaaggaactatccccacaagccatggatgaggaggtattcttaccagtgaattcttgcaatcagaagacacaacaagacgtggagatgcattcagcagtgcaaccttcatggctccacgagtttgctggggtaatgagaactgcttgtgggccagtgactgctgccaagtccatctatgaggatgagcagggctacttgataatggtcagtttgccatttgttgatcagcagagggtgaaggtttcgtggaggaatacactgactcgtggcattgtgaagatcgcttgtgttagtactgcaaggatgcagcacataagaagacatggtaggattttcaaacttgctgatccatctcccgagcattgccctcctggggatttcattcgtgaaatacctctagcttctcgcattcctgaagatgctaagttggaggcatacttcgatgaggctgcttcagtgcttgagatcatggtcccgaaacgaggaaatgaacctgaagagcatgaagttagggtctctctgcgacctcctcactttggagctaatgaactacttttgacctaagctgagtaggtctctgcacgatgtggcatcttgtttgtaaccccagactaatactgaattgagctgagaatcaaggttcagtatgcttgttctctgcctattcattttagtgcctgtgctttgtaagtctcttcagtaacaaagaacttggctgaagattagtttgttctagttgtgctatgggtgtatttttaaccctcatgtttacagttgtgctgggattgccgatttagattttgtattaagttcagttaaagaaataaaatactgagttgttacctatttgcttgtatcttggattgtgacttcctgtttgtaacaatctctacacccaaatttcaccaa

SEQ ID NO: 2121 - DNA, 2764 bp, Oryza sativa
ctagattgagtctgtttggccggtttttgcactaagctaatcacggtttaaaacagacggggttggcttgtgccctaacggcgtgagaggcgtgacgggcggcgccgtcgtcgtcgtgttcggccgcatccggtggagggcgcttccggatctgagaggccattataagcggtcgcccccacgagtaatctcctcttccccttttctcccacctcgccgcgcacccctcccctccccatgtcctcgccttcctccccgcgctcttgctcccgcagcttcacgcttcccccgcactagtacagactcctgatggtggtggaggtaaacctcggcggctaacccatcgtccaccgcgcgcggcggctctgtttttggtttgggcggcattttggtctccttgggggtgtggatttgggttgggggggaggagagctgggtgaagatttgtggcggaaactgttgggggggaattgatggtgggattcatggagtgcgtgcacgattggttgctgtgggacgccgtcctggaatgcggagggatccggaggccaccgattagatagcggccgggggaggagggagaggagaggagagaggagcaggcggtggcagaggcggaggccgtcgccattagcaccagtcaccccgaggcgcgagtcaccaagccatgggggaagacctcgtcaccaccctgtccatggagaacggcggcggtggcggtggcggtggccaccacagcctctgcacccttctctccatggatcccgccggccacctcgacgaccgcgccgtcggggtcatggtgcagccccgcatcggggacggcgccgggcgcgcccacgccgtgtcgctctccggcgcgcatccgccggacatcaaccagccgtggcagactgacctctgcgacatgctcgacgtcagcctcggcccgcagattcaggtgtacgacgccgaggcgctcgccgtgctgagcagtgccccgaaggctgggaaccgcaaggccgccaagcgcggggacagcatctggggcgcctggttcttcttcacgttctacttcaagcccctgctcgcggacaagtgcaaaggcaaggtcacccgggatgccaacggtgtgtcagggtttgacaagacggatctccggctcgacatgttcatggtgcagcacgacatggagaacatgtacatgtgggtcttcaaggagcggccggagaatgcccttggcaagatgcagctgaggagctacatgaacgggcactcccgccctggtgagccgcaattcccgttcagcgttgacaggggatttgtgcgatcacaccggatgcagcgcaagcactaccgtggactctcaaacccacagtgtattcatggaattgaggtggtgagatcaccaaatcttgcaagcataactgaggtagacaggaggaggtgggtggagcttacagggagggagctcaatttcgcaatcccgcaggaggcctgtgattttgggacatggaggactatgccaaacacagagattgagcttgacaggccacatcctgtcatgaagggcaacgttcatcaacacccaaagaagctgcttaatggatctggcttgaatttgtcatcaccctccaatcactcaggagaagatggcatggatctctccccagttagcagcaagcgcaggaaggaggtgtttccgcatgccatggatgaggaatgcttcttgccactcaactcttgcggcgagaggacacaacaagatgtggagatgcattcagtagtgcagccttcatggcagcacgaattttctggggtgatgaaaaaggctcgcgggcctgtgactgccgccaagtcgatttatgaagatgaccaaggctacttgataatggtcagcttaccatttgttgatcagcagaaggtgaaagtttcatggaggaacagtcttactcatggtatagtaaagatcctttgtgttagtacagcccagacgccatacatcagaaggcatgacagggtattcaagcttgctgatcctatgcctgagcactgccctcatggggaatttgtccgtgaaatacctctagcaactcgcatccctgaagacgctaagctagaagcatactttgatgaggccgctgcagtgcttgagatcatggttcccaaacgtggaaatgagccagaagaacatgaagtaagagtctctatgcgcccccctcaccttgcagctaacgatctactcctgacataaccagtggaaggtctatcaaccatatagtcttgtttctgaccaccagatcaatgcccaaacatggctgagaaggtatgagcatgactgtgttgggagttttgctttctgagtatttgtcgtactgcactaggcctcttcagcgaagtctgctgaaggctactcagtttgttctagtatgttatgatgggtgtctttttagccctcatgctcttctcctttgtagaatatggctagattgctttttctagaatttgtactgtgttgaattaaccagaaataaattgtctgaattactattccattcttggatcatggattgtgggtgttttgtttagcattaaatatgattggtgggtaagaacctagttgcatgtgtcatgtgccaatcaacacaggaatgggcatatgcaggattgccttgatcttctcctgcagagatacgttgaattctagcagttagatggtctttttggatatggtagtataggttgtgagatggtgaacattgctgcgggtctgcagagtatatgc

SEQ ID NO: 2122 - DNA, 2551 bp, Brachypodium distachyon
gccctccacaaccacttcttccctttctcccacctcccacctccaccacccctatgtcaccgccttcctccgcgcgctcttgctcccgctgcttccaacgacccccgcgctaattgtgccaaggttgttcagatttgttaatggaggtaaccgtcggctaacccatcctccgccgtccgcccctctctgtctctgggcttctctgcatctcctggttcctaccagtgcgtgggaaattgtttggggtgtggatttggttggggggaggaggaggctggttgagatttgtggtgtgctcccgtgggggaattgatggtgggtcgtatggcgtgtccccatgattggttgctgtgggacgccttcttggaatgcggagggatccggaggccgccgattagatagcggccgggaaggagggggaggaggaggagaacgaggaggcggaggccgccattagcacccaccaccccgaggctcgagtcaccggccggccatgggggaggacctcgtgaccaccctgtccatggagaacggcggcggaggcggccatcacggcccctgcaccctcctctccatggacccctccggccacctcgacgaccgcgccgtcggcgtcatggtgcagccccgcatcggagcgggcgcgcgcgcccgcgtcgtgtccctctccggcgcggccccgcccgacatcaaccagccgtggcagacggagccctgcgacatgctggatgtcggcctcgggccgcaggtctacgacggcgaggtcgtgctgagcagcgcaccgaaggctgggagccggaagaccgccaagcgcggggacagcatctggggcgcgtggttcttcttcaccttctacttcaagcccctgctgtcggacaagggcaagggcaaggtcgtccgggacagcaaggggttgtcggggttcgacaaatcggacctgcgcctcgacatgttcctggtgcaacacgacatggagaacatgtacatgtgggtgttcaaggagaggccggataatgcccttggtaagatgcagctgaggagctacatgaacgggcactcacgccctggtgaacctcatttcccttttagtgttgacaggggatttgtccgatcacaccggatgcagcgaaagcactaccgggggctctcgaatccgcagtgtattcatggaattgaggtggttaattcaccgaatcttggaggcatcactgacttggaccggaggaggtgggtggagcttacagggagggagctcaatttctctatcccacaagaggccagtgactttgggacatggagaactatgccaaactcggagcttgagctggagaggccacaccctaccatgaagagcaatgttcagccaccccaaaagaagttgctaaatggatctagcttgaatttgtcatcaccatccaatcattcaggagaagacggcatggatctctccccagttagcagcaagcgcaggaaggaggcgtttccacatgccatggatgaggactgcttcttgccactgaactcttgcaatggaaggacacaacaagatattgagatgcattcagtgttgcaaccgtcgtggctgaatgagttcactggggtgatgaggaaggcttccgggccagcaacagctgccaagtctatttacgaggatgaccagggctacttaattatggtcagcttgccattcgttgatcagcagagggtgaaggtttcctggaagaatagtcttacccatggtatagttaagatcctttgtgttagtacagcaaggatgccatacttaagaagacatgatagagtcttcaagctcgccgacgctacgccagagcactgccctcctggggagttcatccgtgaaatacctctagctacccgtatccctgaagatgctaagctggaggcatactttgatgaggctgctgcagttcttgagattatggtccccaaacgaggaagcgaaccagaagaacatgaagttagggtctcaatgcgccctcctcaccttggaactaacgatctcctgctgacataggtaatggaaggcctccccgtatcttctttgtgatctccagatcagagatgctcgaaggagctaaaagttatactactagcgtcttgttctgagggtgttgctaggcctcttcagcagcaagcctctcctgaagactagtttattctagctgctgtgttgcgggtgtctttttagccctcatgttctcattatagcatatggtgggattgcttgttctagaatctgtaccaagttcagttaacataataaactttccatttcttaagtctcagctccacttctgaatctggattataattgcttttggttgtaccagtctgcactacccagattttctgtgaacattctttgccggtaaaagactactccgttccataattcttgtctcaaatttgtctaaaaatggatgtatctattcctaaaaggtgtctagatacatgtaagatttcgacaagaattatgaaacagagggagtaattcagtgttaacgcagtttcagtttatgaccaactgtgt

SEQ ID NO: 2123 - DNA, 2270 bp, Secale cereale
gcccctgtcctcgcgcccctgctccccgctccactcgcgctaaattggtaaaaattgcgaagctttcctaatggaggtgaccgtcgggtgacccatcgtccgcccgcctccgctatgagcccgtgattcctaggaaggcctccggggttccggatttggtttagatttgtgggcgtgttcccgcgggggaactgatggtgggttacatggagtggtcgcacgattggctgctgtgggacgccttcttggaatgcggagggatccggaggccgccgattagatagcggccggggaggagggaggagcggaggaccaggaggaggaggaggccgccattagcacccacccaccctgcctgccacccaccaccccgacgcccgactcacccaccacaccaccctgccgcccatgggggaggacctcgtcaccaccctgtccatggagaacggcggcggcggcggcgggggtcaccaccgcctctgcaccctgctctccatggacccctccggccacctcgacgaccgcgccgtcggcgtcatggtgcagccccgcgtcggagcgcgcgcccacgccgtgtccctctccggcgccccgccgcccgacatcaaccagccgtggcagacggagccctgcgacatgctcggcgtcggcctcgggccgcaggtcttcgacgccgaggccgtgctcagcaccgcgcccaaggctgccgctgccgggagccgcaagaacaccaagcgcggggacagcatctggggcgcctggttcttcttcaccttctacttcaagcccctgctgtcggacaagggcaagagcaaggtcgtccgggacgccaacggcgtgtcggggttcgacaagtcggacctccggctggatatgtttctggtgcagcacgacatggagaacatgtacatgtgggtgttcaaggagaggccggacaatgccctcgggaagatgcagctgaggagctacatgaatgggcactcacgccccggtgagccgcatttccctttcagtgtcgacaggggatttgtccggtcgcaccggatgcagcgcaagcactaccggggcctctcgaacccgcagtgcatccatgggattgaggtggtgagttcgccgaatctcgtgggcatcaccgacgtggaccggaggaggtgggcggagctcacagggagggagctcaatttctccatcccacaggaggccagtgattttgggacatggaggaccatgccaaactcagagcttgagctggagaggccacacactactaccatgaagagcaataatgttgttcagcagcaaccccccaagaagacgcttaatggatcaggcttgaatttgtcatcaccatccaatcattcaggagaagacggtatggatctctcccctgtcagcagcaagcgcaggaaggaggcatttccacatgccatggatgaggagtgcttcttgcctctgaacccttgcaccgggaggacacaacaggatatcgagatgcagtcagtcgtgcaaccttcatggctgcacgagttcaccggggtgatgaggaaggcatccgggccagcaactgctgccaagtccatttacgaggatgatcagggctacttgataatggtcagcctaccatttgttgatcagcagagggtaaaggtttcatggaagaacactcctactcatggcatagttaaaatcttctgtgttagtacagcccggatgccatacataaggagacatgatagggtcttcaagctcaccgacgccatgcccgagcactgccctcctggggagttcatccgtgaaatacctctagccacccgtatacctgaagacgccaagcttgaggcatgctttgatgaggctgctgcagttcttgagatcatggtccccaaaaggggaaacgagccggaagaacatgaagttagggtctccatgcgccctcctcacctgggagtgaacgacctgcttatgacataggtaatggatggtctatcctctttgtgatcaccagatcatatgctcgaaggggctaccattagcatcttgttccgagactgttgctgttgcttactgtgctaggcctcttcagcaacaagcttttgctgaagattagttcgttctagcttgtatgtgacgggtgtctttttaaccctcgtgttctcctagcatcatattgtgggcctgtttgtccttgaatctgtaccaagttcagttaacagaataaaatttatatttggtgggttactgctcaatttttggatctggattatatagtt

SEQ ID NO: 2124 - DNA, 2476 bp, Triticum aestivum
aggaggaggaggccgccattagcacccaccctgccaccaccccgacgcccgactcgccactcaccagccgggcgcccatgggggaggacctcgtcaccaccctctccatggagaacggcggcggcggcgggggccaccacggcctctgcaccctgctctccatggacccctccggccacctcgacgaccgcgccgtcggcgtcatggtgcagccacgcgccagaggtggcgcgcgcgcccacgcccacgccgtgtccctctccggcgccccgccgcccgacatcaaccagccgtggcagacggagccctgcgacatgctcggcgtcggcctcggcccgcaggtgttcgacgccgaggccgtgctcagcgccgcgcccaaggctgccgccgccgggagccgcaagaccaccaagcgcggggacagcatctggggcgcctggttcttcttcaccttctacttcaagcccctgctgtcggacaaggccaagagcaaggtcgtccgggacgccaacggcgtgtcggggttcgacaagtcggacctccggctcgacatgttcctggtgcagcacgacatggagaacatgtacatgtgggtgttcaaggagaggccggacaacgccctcggcaagatgcagctgcggagctacatgaatgggcactcacgccccggtgagccgcatttccctttcagtgtcgacaggggatttgtccggtcgcaccggatgcagcgcaagcactaccgggggctctccaacccgcagtgcatccatgggatcgaggtggtgagttcgccgaatctcgtgggcatcaccgatgtcgaccggaggaggtgggcggagctcacagggagggagctcaatttctccatcccacaggaggccagtgattttgggacatggaggaccatgccaagctcagagcttgagctggagaggccacacacacacactgccatgaagagcaatactaataatgttcagcagcagccccccaagaagacgcttaatggatctggcttgaatttgtcatcaccatccaatcattcaggagaggacggcatggatctctcccctgtgagcagcaagcgccggaaggaggcattcccacatgccatggatgaggagtgcttcctgcctctgaacccttgcaacgggaggacacaacaagatgtcgacatgcaatcagcagtgcagccttcatggatgcacgagttcaccggggtgatgaggaaagcctccgggccggcaactgctgccaagtccatttacgaggatgaccagggctacttgataatggtcagcttaccatttgtcgatcagcagagggtaaaggtttcatggaagaacacccccactcacggcatagttaaaatcttctgtgttagcacggcccggatgccatacataaggagacatgacagggtcttcaagctcaccgacgccatgccggagcactgccctcccggggagttcatccgcgaaatacctctagccacccgtatccccgaagacgccaagcttgaggcatgctttgatgaggccgctgcagttcttgagatcatggtccccaaacgggggaacgagccggaagaacatgaagtcagggtctccatgcgccctcctcacctgggagtgaacgacctgcttatgacataggtaatggaaggcctatctttcttgtctgtgatcaccagatcgtatgctggaaggggctactgttagcgtcttgttccgagactgttgctgttgcttactgggctaggcctcttcagcaacaagcttttgctgaagattagttcgttctagcttgtatgtgacgggtgtctttttaaccctcgtgttctcttctcctagcagcatattgtgggtggcctgtttgtccttgaatctgtaccaagttcagttaacagaataaaatttatatttggtgggttactgctcaatttttggatcttgattagtagctcttctgttagcacaagtctgtacttcttcccaaatttccaatgttctttgctgtcaagaaattgattcagtgcttcagcttatggtgatgaactgtacgtgtctgtatccaagtcacaatcatctttcatgtcccaatcagcatacactatactggaattgttgatgcagcagcattactttggtttctgaaaaacagaaacatcatcccttgcattaaacttccatctggctccttctcactgaatctcttgctcttgaaactggattttcacaacagaaaaataaagctcctccgaactgtgacagatttggcatccgggaagccggctgtcttgtgctgatctccaaatagccccgagtcttactacatcttactactatctccaatagctctgagtcttctactgtggactgctgatctctatctactctggtatacttccgtttcggaaacaaatctactccggtatacctggaaaactaagaatgagtgtaagtttcaaggtacg

SEQ ID NO: 2125 - DNA, 2299 bp, Hordeum vulgare
catgtcctcgcgcccctgctgctccccacgccgcccgcgataatcgcgaagctttccgaatggaggtgaccgtcgtcgggtaactcgtcgtccgcccgcccgcttccgccatgagcccgtgattcctaggataggataggagattgtccggggttccggatttggttcagatttgtgggcgtgttcccgcgggggaactgatggtgggttacatggagtggtcgcacgactggctgctgtgggacgccttcttggaatgcggagggatccggaggccgccgattagatagcggccggggaggagggaggagcggaggaccaggaggaggccgccattagtagcacccacccaccaccccgactcgccacccatgggggaggacctcgtcaccaccctgtccatggagaacggcggcggcggcggcgggggccaccacggcctctgcaccctgctctccatggacccctccggccacctcgacgaccgcgccgtcggcgtcatggtgcagccccgcgtcggagcgggcgcgcgcgcccacgccgtgtccctctccggcgccccgccgcccgacatcaaccagccgtggcagacggagccctgcgacatgctcggcgtcggcctcggcccgcaggtcttcgacgccgaggccgtgctcagcaccgcccccaaggctgccgccgggagccgcaagaccaccaagcgcggggacagcatctggggcgcctggttcttcttcactttctacttcaagcccctgctgtcggacaagggcaagagcaaggtcgtccgggacgccaacggcgtgtcggggttcgacaagacggacctccgcctcgacatgttcctggtgcagcacgacatggagaacatgtacatgtgggtgttcaaggagaggccggacaatgccctcggcaagatgcagctgaggagctacatgaatgggcactcacgccccggcgagccgcatttccctttcagtgtcgacaggggatttgtccggtcgcaccggatgcagcgcaagcactaccgggggctctccaacccgcagtgtatccatgggattgaggtggtgaattcgccgaatctcgtgggcatcaccgatgtcgaccggaggaggtgggcggagcttacagggagggacctcaacttctccatcccacaggaggccagtgattttgggacatggaggactatgccaaactcagagcttgagctggagaggccacacactgctaccgtcaagagcaataatgttcagcaacaacccccaaagaagatgcttaatggatcaggcttgaatttgtcatcaccatccaatcattctggagaagacggtacggatctctcccctgtcagcagcaagcgccggaaggagtcatttccgcatgccatggacgaggagtgcttcttgcctctgaacccttgcactgggaggacacaacaagatgtcgagatgcagtcagtagtgcagccttcgtggcttcacgacttcaccggggtgatgaggaaggcctctgggccagcaactgctgccaagtccatttacgaggatgatcagggctacttaataatggtcaccttaccatttgttgatcagcagagggtaaaggtttcgtggaagaacactcctacccatggcatagttaaaatcttttgtgttagtacagcccggatgccatacataaggagacatgacagggtcttcaagctcactgacgctatgcctgagcactgccctcctggggagttcatccgtgaaatacctctagccacccgtatacctgaaggtgccaagcttgaggcatactttgatgaggctgctgcagttcttgagatcatggtccccaaacggggaaacgaacctgaagaacatgaagttagggtctccatgcgccctcctcaccttggagtcaacgacctgcttatgacataggtaatggatggtctatcttgtttgtgatcaccagatcatatgctccaaggggcgagaagttggaactgttagcatcttgttccgagacttgctgttgcttattgtgctaggcctccttcagcaacaagcttgtgctgaagattagtttgttctagcttgtatgtgacgggtgtctttttaaccctcgtgttctcctagcatatcgtgggcctgtttctccttgaatctgtaccaagttcggttaacagaataaaatttatattgggtgggttactgctcaattttttggatctggattatagttcttctgtcagtaccagcctgtacttagcaaatttgcaatgttctttgccgttaagaaatta

SEQ ID NO: 2126 - DNA, 5104 bp, Sorghum bicolor
atggactcctcctcccccttctcccctgacgaccagaccgacgccgacttcttcgacaagctcgtcgacgacgacgacaaccccatcccgcctcccgccaccgacttgcctcggtccgtctccgccaccagcctcgacgccgcagacgaccacgccccaccgccagccaccgacttgcctcggcccgtctccgccaccagcctcgacgccacagacgacccacccgccccggagccgcagcctccggctcccgaggggtcaggcaaggacggcgccggcgtccacaccgcggtcaagcaggtgcagtgggcctccttcggaggtggcgcggacgacggtcctgatccgttcgctgatctctcgggaggcgccggcgacgacgacggcttcctcgggagcacggccgggacccagacggcctcggatcaggacttcttcgctgggaccaactcctcctccgatcagcagaatgtcaatggtcagcacgaccagggaggtggcaccagcactgcagtggactcagcagatcccaaatcttgggaggccatgtaccctgggtggaagtacgacgaggcatcgcagcagtggtaccagcttgatggcagtgtaaattcaaccgggaatgcagctcaggtgctggagaatagcactcagaatgcgcagcagcagcagctcgacacgtcttacctgcacaattcgtcccatgcggggctcgagacaattgccgaggagggcactgccgcagctggtgctgtctcaagttggggccaaggggccgcctcagagtacccacccaacatgctcttctacgcagaataccctggttggtactttgacaccaacactcagcagtggcactcgcttgagtcgtaccagcaggccgctatgcaggctggaacagctagcacgggtcagactgttgttgcaaacgatgttgttgctgcgaattcctcctctctgacaggctataatgctgcacaaactgaggaccttgctgcccacaatcaggtgacccaacacaactcattctcaaatagtttcactctgcagaaccaatggcagactacggatgcatttggtaacaatgtacgatctgaaagtgctacggataacagcctggctagtagtttctatggttttgaacaaaacaggaatgctgagactaccacttcctctatgagccaacaggctggttttaacacagcggaaactgttacagatcactatggtgcacgcaagggctttgaatcatcaagtcttcggagtggttatagctcatctgacagtcagcaatccagttacaaggcattcgaaccttccacgggttatcagactggttacaaagcgtttgaacctgccatggataaccagagtggctacaaggcattaccttctacgggtcaccataacgcttcccagggattcatgccttccacgggtcaccggactgatttcaagggttccggagcttccacagttcaccaggctggttacaaagagtttgaaacttctacaggttacagtacaagtttcaaggcatttgaaccctcttcatctcaacatgctagttacaagggttcccaacctaactacacaggatttgacacttctgcaaaccaccatggttatggtgatgccaatggtgttgcgagtactcaaggctttgtcccaatgcaaaccacgtaccagggccagaaacaagcaaatgcaacctcgcaagggcacctgtcaaatagttattttggtactgaaagctccatgaactttaatcagcaacaatttctgggtgcaaatgcatcaaacttgcaattcggtcactccccacatgaaggcaggtcatcggctggtcgaccaccgcatgcccttgttgcttttgggtttggagggaagctcataattttgaaagaaactagctccatgcccgcaagctttaacactggaaatcagttcaagggtaactctagtagcacagtttcagttcttaatctgtcagaggtggtcgttgataaagttgatccttcaagcatcactaatggtagtgcacttagttatttccatgctctgtgccgtcaacctgttcctggccctctggttggtggaagtgctgcatcaaaggatgtaaataagtggcttgatgaaatgattgcattgtacgagtcttcctctagtgaattccagaaaggtgatactcgcaagttgcttatttcattgctgaagatactatctcagcactatggaaaactccgttcaccttttgcgtctgacccatcgcaagaggagacagatggtccagaaatggcagtaactaagctattttcatcgtgtaagagaagcactgttcatatgggagattatggatccattgttccctgcatgaaaaatattgcttcagaaagtcagatgcaggctgttgcacaagaggtccaaggccttctagtttctgggagaagaaaagaggcccttcagtgtgcccagagaggtcaactttggggacctgcaatcatactggcattgcagcttggtgatcagttttatgtggatacagtgaagaaaatggctcacttccattttgtatctgggtcccctctgcgaacgctatgccttctcattgctggacaacctgcagatgtttttaatgtagagaacaatgtcaacagtgactatggtacatccggtcaacctatggagagtcagcctggtcctaatggtatgttggatgattgggaggagaatttggctataattactgcaaacagaacgaaaggtgacgatctagtaatcacccatcttggtgattgtctctggaaagaaaaaaatgaggttgcagctgcccattcatgctatttagttgctgaactaaatattgattcatactcagaaagtgcaaggttatgcctcattggtgcagaccacttgaagtgtccgcgaacatttgccagccctgaagccattcagaggacagaggtttatgaatacgcgaaggtgcttggtaattctcagtatattctactaccctttcagccatataagctgatatatgcatacatgcttgtggaagtggggaaggtttcggattctttgaggtattgccaagcatctatgaaggtgctgaaagcctctggccgtgcccctgaattggaggtgtggaaacaattattttcttcattggaggagaggatacgcactcaccagcagggtggatatggaacaaatcttgccccagcaaaactagttgggaagatttttacctcgcttgataaatctatatcccgcatgatgggtacaccatctgcaccacttccaccattaccacatggatctgttagtgatagagagagccactctatgcctgcagcagcaaaatttggaaatagccaatcggtaatgaccatgtcatcgttaatgccatctgcttcaatgcagtcaatgactgagatagcagagaatagtggtggcactggcaggacaattgcacacaacagaagtgtttctgagccggactttggtagaacatcaaaacagggtgctggatcagatggcacacagagtagtgcatcaggatctggtagttctcgatttggttggctagtgcagaagactatggatttagtgtcgaaatcccaccgccaggcaaaattaggggatcagaacaaattttactatgatgaaaagttgaagcggtgggtggaagaaggtgctgcggttcctgccgaggagcctcctcttcctccacctccaacaaaaccatctttccagaatggtatgccagaccataagttgaatggccccatgagtgtaaaccatgctcccaatggagtcacagaatggaaatcctcaaattcttcggagcaaggaggtctgggtatgcctccaattccacctagccaaaaccagttttctgctcgtggacggatgggtgtccggtccagatatgttgacacattcaataaatcgggtgcgtctggagcagtgccatcatataacaaaccagctgctccatctgtgacaccaccagctggtgccaagttcttcatgccgactgcagcacctgctgctgcagatcagatggtgccacaccaagcagcagagatacacagtgaaaccatccatcaggatgagcggtcagcctcaccaccagcagaaacatcattttcttcaaccccaccacccacacaattttcatcacccccaccgcacatgcaattttcatcaccaatgcaatcaacaattcatcggcaatctagtatggacaacatctccaccccttaccagggttctggggtatcatcattaagcagcagcagctcattctcaaaatcacgagccgcatcctggagtgggacatactctgagcagtatagtgcttttgcgggcactcaatcacctgatagacagacgatgccttcaccactcatgcctggcaaaccatcacacagtcgttccaacagcaactcatcagtgcagctcaatggattggcagaggatcttcatgaggttgagctctaactgaccactgctcagcatgaccgaggtgactcatgtcttgtatccacaaagacagccatggcaaacccctgacggttccagaaaccccaagcgggtgacagaaaagaagctgccctgacaacgctgatcacagggatgccacagttggaattggctggtgcgactttgcatgagattctggcagcgcgctctaaaccaccgaggtgcgtcggacctgtactaatagaaatgcagggtttttgaacattttgtagctatatatagatgttggttttacgttttagagagaagggaaagggttgggtgggccttgtttacaggtgagaagaggagagaagcagcatgcagatgcccttgtacagataatctgcccctacccaatttgtttaaacgcaaagaaacccacacccccactccatattgattttcgtttttgggagaaggatagaagagaaggtgtgttctagtagtgtgagaagcatggctctgtagagtgttgttgttatatcattatatggtgtagtgtcctagccgtatacacagtatattatcactgtttattctttggagacgaatcgattctttcatcttgaaacaa

SEQ ID NO: 2127 - DNA, 5155 bp, Zea mays
gtatctccctgatccaactccgcatggcctcctcctccttcgcccccgacgaccagaccgacgccgacttcttcgacaagctcgtcgacgacgacgacccggccaccgacttgcctcgggccgtctccgccaccagcgtcgccgacgacccaccacccgtcctggagccgcaggttccggcgccggcgccttcggaggggtcaggcaagggcggcgccggcgtccacaccgcggtcaagcaggtgcagtgggcctccttcggaggtggcgtggacgacggccctgatccgttcgctgatctctcgggaggcgccggtgacgacgacggcttcctcgggaacacggcggggacccaggcggccttggatcacgccgccgaggtgacggatcaggacttcttcgctgggagcagctcctccgatcagcagaatgtccatggtcagcacgaccagggcagaggcagcgccgcggtggattccgcagatcccaaatctctggaggccatgtaccctgggtggaagtacgacgaggcctcacagcaatggtaccagcttgatggcagtgtaaattcaactgggaatgcagctcaggcgctggacgatagcgctcagaatgcacatcatcatcagcagcagctcgacgcggcttacctgcacaattcagcgcacgcggggcttgggacaattgccgaggagagcactaccgcagctggtgctgccaatagttggggccaaggggctgccccggagtacccacccagcatgctcttctatgcagagtatcctggttggtactttgacaccaacactcagcagtggcactcccttgagtcgtaccagcaggccgccgtgcaggctggaacatctagcacgggtcagactgttgttgcaagcgatgatgttgttgcgacttcctctctgacaggccataatgccgggcaaactgaggaccttgttgcccacaatcaggtgacacaacgcaactcatcctcgaatagtttcacccatcagaaccaatggcagaccaccgatgcacttggtaacaatgtacaatctgaaagcctggctagtagcttctatggttttgaacaacacatgaatgctgagactaccagttcctctacgagccaacagactggttttcacacagctgaaacaattacagatcactatggtggacgcaaagccttcgaatcatcaagtcttcagagtggttatagctcctctgacagtcaacaatccagtcacaaggcattcgaaccttccacgggttatcaggctggttacaacgggtttgaacctgcttcaggtcaccacacggcgtttgaacctgccatgcataaccagagtggatacaaggcatttgacccttctacgggtcaccatagtgcttcgtggggattcatgccttccacgggtcagcagactgatttcaagggttccagagcttccacagttcaccaggccggttatgaagagtttgaaatttctagaggttacaatacaaatttcaaggcatttgaatcatcttcatctcaaaatgctggttacaatggttcccagccttcttcaggtcaccaacctaactacatgggatttgacacctctgcaaaccaccatggttatactgatgtcaatggtgttgcgagtactcaaggctttgtcccaatgcaaaccacgtaccagggccagaaacaagcaaatgcaacctcacaagggcacctgtcaaatagctatttgggtactgacaactccatgaactttaatcagcaacaatttctgggtgcaaatgcctcaaatttgcaattcggtcactccccgcatgaaggtaggtcatcggctggacgaccaccacatgccctcgttgcttttgggtttggagggaagctcatagttatgaaagaaactacctccatgcctgcaagttttaacagtggaaatcagggtaactctagtagcacagtgtcggttcttaatctgttggaggtagtctttgataaagttgatccttcaagtgtcactaatggtagtgcacttagttatttccatgctctatgccgtcaacctgttcctggccctctggttggtggaagtgctgcatcaaaggatgtaaataagtggcttgatgaaatgattgcacggtacgagtcttcctctagtgaattccatagaggtgatactcgcaagttgcttatttcattgctgaagatactgtctcagcactatggaaaactgcgttcaccttttgcgtctgacccatcgcaagaggagacagatggtccagaaatggcagtaactaagctattttcatcgtgtaagagaagcactgttcatatgggagattatggatccctagttccctgcatgaaaagtattccttcagaaagtcagatgcaggctgttgcacaagaggtccaaagtcttctagtttctgggagaagaaaagaggcccttcactgtgcacaggcaggtcaactttggggacctgcaatcatactggcattgcagcttggtgataagttttatgtggatacagtgaagaaaatggcccacttccattttgtatctgggtcccctctgcgaacgctatgccttctcatcgctggacaacctgcagatgtttttaatgtagagaacaatgtcaacagtgactatggtgcatcccatcaacctgtggagcctggtcctaatatgttggatgattgggaggagaatttggctattattactgcaaacagaacagaaggtgacgttctagtaatcacccatcttggtgattgcctctggaaagaaaaaaatgaggttgcagctgcccattcatgctatttagttgctgaactaaacattgattcatactcggaaagtgcaaggttatgcctcattggtgcagaccatttgaagtgtcctcgaacatttgccagccctgaagccattcagaggacagaggtttatgaatatgcgaaggtgcttggtaattctcaatatatcctactatcctttcagccatataagctgatatatgcatacatgcttgtggaagtggggaaagtttctgattctttgaggtattgccaagcgtctataaaggtactgaaagcctctggtcgtgcccctgaattggaggtgtggaaacaattattttcttcgctggaggagaggatacgcactcaccagcagggtggatatggcacaaatcttgccccaggaaaaatagttgggaagatttttacctcgcttgataaatctatatcccgcatgatgggtacaccatctgcaccacttccaccgttgccacatggatcttttagtgataaagagagccactctatacctgcggcagcaaaatttgttaatagccaatcggtaatggtcatgccatcgttaataccatctgcttcaatgcagtcaatgactgagatagcagaggatagtggtggcactggcaggaaaattgcacacaacagaagtgtttctgagccggactttggtagatcatccaaacagggtgctggtggatcagatggtacacagagcagtgcatcaggatccagcagttctcgatttggttggctagtgcagaagactatgggattagtgtcaaaatcccaccgccaggcaaaattaggggatcagaacaaattttactatgatgaaaaattgaagcggtgggtggaggaaggtgctgctgttcctgccgaagagcctcctcttcctccacctccaacaaaaccatctttccagaatggtatgctagacaataagttgaatggccccatgagcgtaagccatgctcccaatggagtcacagaatggaaatcctcaaattcttcagagcaaggtctgggtatgccgccaattccacctagccaaaaccagttttctgctcgtggacggatgggtgtccggtccagatatgttgacacattcaatagatcaggtgcatctggtgcaatgccatcatataacaaaccagctgctccatctatgacaccaccagctggtgccaagttcttcatgccaactgcagcacctgttgccgcggatcagatgataccacaccaagcagcagagatacacagtgaaaccatccatcaggatgagcggtcagcctcaccgccagcagaaacatcattttcttcaaccccaccacccacgcaatttccatcaccagtgcaatcaacaatttatcggcaatctagtatggagaacatctccaccccttaccagggttccggggtatcgtcattaagcaacgacagctcattctcaaaatctcgagccgcgtcctggagtgggacatactctgagcagtttaatgcttttgcgggcactatatcgcctgacagacagacgacgcattcaccactgatgcctggcaaaccaccacacagccgttccaacagcaactcatcagggcatctcaatggattggcagaggatcttcatgaggtcgagctgtaactggcgactggtcagcatgaccgtcgcaactcgtgtcttaaaggcagcgatgacaacccctccccaagcaggtgacagaaaagaaggtgcccttaaaatgctgaccacggggatgccgcagctggaatgggcttggtgtgactttgcacgagattctggggcgcgctctaaaccaccgaggtgcgtcaggcctgtactaatagagatgcagggtttttttttgtagccatatatacatatatgttggttttgtgttttagagagaagggaaagggttgggtgggcctttgtttacaggtgggaagggaagagaagcagcatgcagatgcccttgtacagataatctgcccctacccagtttgtttaaaacgcaaacaacgccattttggttttagttccctggagaaggatagaggagaaggtgtgtgtctttgtagtgtgagaagcatggctctgtagtgttgttgttatagtgtactactactgtgctagccagccgcatacacagactgtttattctttggagacgaatcaattctttcatcttgactagggcattattatttgttaacataatgctgcatcttgttatgtacgtaaaagtcaagagaaggtacaaattaagccatatgttatgtactagtaaacaatgatacaggatgcagatgcttatcgattgatacgttgatgtagca

SEQ ID NO: 2128 - DNA, 5544 bp, Zea mays
agaccacgggtggcgcgatgcgacgtcggctgtcgtgctcgtgaccgcagccgcgccttcccgcctccacctcctcctgcgattccgatccgccgccctgtccggccggccggtaagccccgcctccgccctgttccctcggcacccatttttcatttcaactgagaggcggaggaaccaacccaggcacccaaccaaccctagatccaccgcttctgccacacgagagggagagatagacctctccgatctaattccgcatggcctcctcctcctccttcgcccccgacgaccagaccgacgccgacttcttcgacaagctcgtcgacgacgacgaccccgccaccagcctccccgacgacccacccatcccagagccgcaggcgcctcccgagggttcaggcaagggcggcgccggcgtccacactgcggtcaagcaggtgcagtgggcttccttcggaggtggcgcggacgacggtcctgacccatttgctcatctctcgggaggcgccggcgacgacgacggcttcctcgtgaccacggccgggacccagacggcctcggatcacgccttctttggcgggacccagagcttggccgccgaggtgacggaccaggacttcttcgccgggagcaactcctccaatcagcataatgtcagtggtcagcacgaccagggcggcggcagcactgcagtggattcagcagatcccatgtctttggaggccatgtaccctgggtggaagtatgatgaggcctcccagcaatggtaccagcttgacgacagtgtaaattcaactgggaatgcagctcaggtgctggacaacagcactcggtatgcacagcagcagcagcagctccacgcctcttatctgcacaattcagtgcattcagggcttgagacaattgctgaggagggcactaccgcaaccggtgctgtctcaagttggggccaaggggctgcctcagagtacccacccaacatgctcttctatgcagagtaccctggttggtacttcgacaccaacacccagcagtggcactccctcgagttataccagcaggccgccatgcaggctggaacagctagcatgggccagactgttattgcaaacgacggtgttgctgcaacttcctctctgacaggctataatgccgcacaaaatgaggaccttgctgcccatgatcaggtcacccaacacaactcattctcgaatagtttcgctcatcagaaccaatggcagattaccgatgcatttggtaacaatgtacgatctgaatgtgctacagagaacagcctggctagtagttcctatggttttcaacaacacaggaatgctgattctaccagttcatctacgaaccaacgggctggttttaatgcagctgaaactgttactgatcactatggtggacgcaagggcgttgaatcgccaagtattcagagcggttatagcacttctgacattcaacaatccagtcacaaggcattcgaaccttacacgggttatcaggaccattacaaagcatttgaacctgccacaggtcaccatgccagtaacaacatgttcaaacagtccacaggtaaccagggaggttacaaggcgtttgaacctgccatggataaccagagtggctacaaggcatatgaaccttctatgggtcaccatagtgcttcctgggaacccgtgccttccacgggtcaccagactgatttcaaggggtccggagcttcaactgttcatcaggccggatacaaagaatttgaaacttctacaggttacaatacaagtttaaaggcatttgaaccttcttcatctcaacatgctggttacatgggttcccaatctaactacatgggatttgacacttctacaaaccaccatggttatggcgatgcaaatgttgttgcgagcactcaaggctttgtcccaatgcaaaccacataccagggacagacacaagcaattgcaaactcacaagtgcacctgtcaaatagctatttgggtattgacaactccatgaactttaatcagcagcaatttctgggtgcaaatgcctcaaacttgcaattcagtcactccccacatgatggtagagctggacgaccaccacatgctctcgtttcttttgggtttggagggaagctcatagttatgaaagaagctagctccatgcccgcaagctttaacaatggaattcagggtaactctagtggcacagtttcagttcttaatctgtcagaggtggtcatggataaaattgattcttcaagcatcactaatggtagtgcacttagttatttccatgctctgtgccgccaaccagttcctggtcctctggttggtggaagtgctgcatcaaaggatgtaaataagtggattgatgaaatgattgcatggtacgattcttctagtgaactccagagaagtgatactcgcaagttgcttatttcattgctgaagatactgtctcagcactatggaaaactccgttcaccttttgcgtctgacccatcacaagaggagacagatggtccagaaatggcagtaactaagctattttcatcgtttaaaagtactgttaatatgggagattatggatccattgtttcttgcatgaaaaatattccttcagaaagtcagatgcaggctgttgcacaggaggtccaaaatcttctagtttctgggagaagaaaagaggcccttcagtgtgcccagggaggtcaactttggggacctgcaatcatactggcattgcagctcggtgatatgttttatgtggatacagtgaagaaaatggctcacttccattttgtatcggggtcccctctgcgaacgctatgccttctgattgctggacaacctgcagatgtttttaatgtagataacaatgtcaacattgactatggtacatcccatcaacctatggagcctggtcctaatggtatgttggatgattgggaggagaatttagctattattactgcaaacagaacgaaaggtgacgatctagtaatcacccatcttggtgactgtctctggaaagaaaaaaatgagattgcagctgctcattcgtgctatttagttgccgaactaaatattgattcatactcggaaagcgcaaggttgtgcctcattggtgcagatcacttgaagtgtcctcgaacatttgccagccctgaagccattcagaggacagaggtttatgaatacgcgaaggtgcttggtaattctcagtatatcctactaccctttcagccatataagctgatatatgcatacatgcttgttgaagtggggaaggtttctgattctttgaggtattgccaagcgtctatgaaggtattgaaagcctctggccgtgcccctgaattggaggtgtggaagcaattaatttcttcactggaggagaggatacgcactcaccagcagggtggatatggcacaaatcttgccccagcaaaactagttgggaagatttttacctcgcttgataaatctatatcccgcatgatgggtacaccatctgcaccacttccaccattgccacatggatctgttagcgatagagagagccactctatgcctgaagcagcaaaatttataaatagccaatcagtaatggccatgtcatcgctaatgccatctgcttcaatgcagtcaatgactgagatagcagagaatagtgatggcactggcaggaaaatggcacacaacagaagtgtttctgagccagacttcggtagaacatcaaaacagggtggtggatcagatggcacacagagcagtgcagcaggatctggcagttctcgatttggttggctagtgcagaagactatgggattagtgtcaaaatctcaccgccaggcaaaattaggggatcagaacaaattttactatgatgaaaagttgaagcggtgggtggaagaaggtgctgtggttcctgccgaggagcctcctcttcctccccctccaacaaaatcatctttccagaatggtatgccagaccataagttgaatggccacatgagcgtaggccatgctcccagtggagtcacagaatggaaatcctcaaattattcagagcaaggtctgggtatgccgccaattccacctagccaaaaccagttttcttctcgtgggcggatgggtgtccgatccagatatgttgacacattcaataaatcaggtgcatctggagcggtgccatcatataacaaaccagctgctccatccgtgacaccaccagctggtgccaagttcttcataccgactgcagcacctgttgctgcagatcagatgatgccacaccaagcagcagagatacacagtgaaaccatgcaacaggatgagagggcagcctcaccgcctgctggaacatcattctcttcaaccccaccacccacacaattttcatcgcccccaccacacacgcaattctcgtcaccaatgcaatcaacaatccatcggcaatctagtatggcgaacatctccaccccttaccagagttccggggtatcatcattaagcagcgacacctcattctcaaaatcacgagctgcatcctggagtggaacatactctgagcagttcagtgcttttgcgggcacaagatcacccgatggacagacggtgcgctcaccactcatgcctggcaaaccatcacacagtcgttccaacagcaactcatcagtgcagctcaatggattgacagaggatcttcatgaggtcgagctctaattggcggctgctcagcatgactgtcgtcttttatccaccacaaaaggcagccataacaacccctgataaaccccttcccaagcgggtgacagaaaaaaaaggtgcccacgaaatgctgatcacgggggacgctgcagttggaatgggcatgtgggacttttgcacgagattctggggtgcgctctaaaccaccaaggtatgtcagacatgtactaacagaaatagaaatgcggggggttttggacattttgtagctatatatatatatatgtgtgtgtgttttgttttatgttttagagagaagggaaagagttgggctggcctcgtttacaggtgagaaaaatggagcaggagccgcatgcagatgcccttgtacagataatctgcgcctacccagttttttttttttttaaaaaaaaaacgcgaacaagttcacacccgcactccattttgatgttcgtttctgggcgaaggatagaagagaaggtgcgttctagtgtgacaagtatggctctgtagagtactgttgttttggtgtactgcactagccgcagtatattgtctctgttttattctttgggtacgaatcgattctttcatcttgaaacaattgtgttacgccttgttgtgtattcttgtgccctggccgatgtggcggatgcaattgtacgtgttcttcaggtcttggttgtgctgtcgctatatccttgagcacacgtgtgtgctgagctgttttgttgacaatgcgcatcgtaatactggatctttttttaataaactacacgatttgcagttagttgtt

SEQ ID NO: 2129 - DNA, 2402 bp, Setaria italica
tcatcactccccatctttcatctttaccgcctctttgttttctgttttacctattctctcaggcatgttgttgtatattatgatacagtcagtcaaccatgtacttgattaatttcaaaacgtgatgagacttgttcattgtgctctgcatgtatttggagctttcagtgaatggaacctatttgatgttttcgccattctctatttgggcactagctgatggatctccacatgaaacttctcctggcctccctcagctgtgttcttctgatgcaggcagcatcatgtgatggcaccacgggcgaaactgtaacgacaaattggacatgtatatgtgcagctcatccgctaggtgaatctaactctaacagcagcctgctgtccaattgctcttcgtcctgccactgtcaacaagatgaggatggtggaacggggtcatggaactgcacatgtgcctctgacaagacccttctgaaagaagaacacgctgtgctacgtgataggagttgcttcacttcctgtaactgcacatccggaagttcagaggaagggaaaaggcatgtctccagtaaaacggtcataattacgctcctagtgtgtgtggttctcacaactactgctttccttgtcaccaccgtatactactttcgccgcaaggatgcgctctctccccggtcacagatatactcctttgataaatacactagctggagcagcagatcataccttgtcagccatcgatcatctcctcttccccaactgaaaccgaaaccgaggctcagtgttctcaaagagtttctgtgtagctgccccatcatttgtgggggtgaaagtggcacgttccctggtgttatcatccggttttcgtacgcagagttggaggaagcaactgggaaattctcagaggagcatcttattggagtcgggggttcaagcaaggtataccgaggccagcttagcgatggcaaggttgttgccgtgaagaagcttaggcccctaggaggcgcagatgaagatttcgagttcctgtcagagatcgagctgctgtcgaggctgaaccactgccacgtggtgccattgctgggttactgctcggagatccagggccggcagctggagaggctgctggtgttcgagtgcatgtccaacggcaacctgagggactgcctggacctgaagcaagggaggaaacccatggactggcagacccgggtgagcatcgcgctcggcgcggcgaggggcctggagtacctgcacgaggccgcggcgccgcggatcctccatcgcgacatcaagtccaccaacatcctcctggatgacaagttcagagccaagatcactgatcttggcatggccaagtgcctgatgaacgacggcgtgacgagctgctcgagctcgccggcgcggatgctgggcacgttcgggtacttcgcgccggagtatgcgatcgtggggaaggcgtcgctcaagtcggacgtgttcagcttcggcgtcgtgatcctggagctcatcaccggccggccgcccatccacaagtcgtcctccaccagggccgacgagagcctcgtcatctgggcgacgtcgcggctgcgggacagccggctggtggtggcggagctgccggacccgactctggagagcaagttcccggcggaggagatgcagatcatggcgcacttggcgagggagtgcctgcagtgggaccccgaggccaggcccaccatgaccgaggtcgtccagatcctctccactatcgccccgccactccacggcgccaagcgccggaacctccccatcgccgccgccttcaacctcacgccgtctccgcacgtagggaggtgtgacccagagcccgtcgacatcgaggcgccgcaggagtgctcgacggcgtccttccggtggcagcaagaaccgtgcgcgccgccgccgccgggccgtgcgtcgtggcccggcgacaggcacaagggcgcggcgagtggcggtgcggtggtgtcgggcgagctggtgaacgggatgctgctgatgagcccccacggtcggagcagctggcggccgccgccgggcgacgaggaggaggaggaggcggtggacctgacggagccccggctggagacgttcacgcagccagcattgttcagatgataaagtgaattcctggtaggagatagtgatgcggcggtgccattagcaataagctcgaggccggggaggactgcatcttgttcgtgtcctcaccatccacactgcatctctgcatctgcacccatgaatgtacagtacagaggcaaacgccattagattgagaaatgaaacaaaatgttagtgaggtcatcgtgctgcgtctgcgttgttcatcgcttcgtctgccgtcgccgccgtggctcatccaccatggcccaccg

SEQ ID NO: 2130 - DNA, 3400 bp, Panicum virgatum
ttcttttttttcggaaatttgataaccctgtcttttgggtttatctctagcctaccccaactcgtttgggacaaagggctatgttgttgttgttgttgtagcatgttgctgtgaacaagttgaaccttgggaataatctgtgcccatcattcaaaacttcttgtgaacattcttctgccattttcttgcacaggctggctttcagaagtctgttccagcctgagatctctgatcacctccagacttggcaactgtcgcacccaacattatgggccagatgtccttttaagtataatccagtgttgaatgcccctattagaacattgcacctgcacctaagtacaggcattctcgttttagccttttaggcctactactacctcctactgtatatatagtgccgtaggttgagatgtctcctatcttgcaagctgctgcactgagtgtgctaatattcttttggaagcaaacgtatatttgtcaaactagtgtttgacagcttctgccactttattggaatttcctgtattgcatacaagctgcccctctttgtctatctgttcttaagccttcatctctcctccacctttcatctttcctgcctcttttgttttttgttttacctattctcctaggcatgctgtggtatattatgatacagccagtcaaccatgtacttgcttaatttcaaaacgtgatgagacttgttcattgtgctctgcatgtatttggagattgcactgaatgggacctatttgatgttttccccattctctatttgggcgctagctgatggatctccacatgaaacttctccttgtctccctcagctgtgttcttctgatgcaggcagcatcatgtgatggaaccacgggggaaactgaaatgacaaattggacatgtgtatgcgcagctcatccgctaggtgaatctaactctaacagcagcttgttgtccaattgctcttcgtcctgtcgttgccagcaagatgagaatggtggcacggggtcatggaactgcacatgtgcctctgacaagacccgtcagaaagaagaacatgctatgctacacgataggagttgcttcacttcctgtaactgtacatccggaagttcagaggaagggaaaagacatgtctccagtaaaacagtcataattacgctcctagtgtgcgtggttctcaccactactgcttttcttgtcaccactgtatactacattcgccgcaaggatgcgctctctcctcgttctcagatatactcctttgataaatacactagctggagcagcagatcaaaccttgtcagccatcgatcatctcctctcccccaactgaaaccgaaaccaaggctcagagttctcaaagagtttctatgtagctgccctatcatttgtgggagtgaaagtggcacattcccaggtgttgtcatcaggttttcgtactcagagttggatgaagcaactgggaaattctcagatgagcatcttattggagttggtggatcaagcaaggtataccgaggccagcttagcgatggcaaagttgttgccgtgaaaaagcttaggcccctgggaggtgccgacgaagacttcgagttcctgtctgagatcgagctgctgtcgaggctgaaccactgccacgtggtgccactgctggggtactgttcggagatccagagccggcagctggagagactgctggtgtttgagtgcatgtccaacggcaacctcagggactgtctggacctgaaacaaggtaggaagcccatggactggcagacccgggtgagcatcgcgcttggcgccgccaggggggtggagtacctgcacgaggcggcagcgccacggatcctccaccgcgatatcaagtccaccaacatcctcctggatgacaagttcagagccaagatcactgaccttggcatggccaagtgcttgatgaacgacggcgtgacgagctgctcgagctccccggcgcggatgttgggcacgttcgggtacttcgcgccggagtacgccatcgtgggcaaggcgtcactcaagtcggacgtgttcagcttcggcgtcgtgatcctggagctcatcaccggccggccgcccatcctcaagtcgtcgtccaccaggactgacgagagcctcgtcatctgggcaacgtcgcggctgcgagacagcaggctggtggtgacggagctgccggacccgacgctgcagggcaagttcccggcggaggagatgcagatcatggcgcacctggcgcgggagtgcctgcagtgggacccggaggccaggcccaccatgaccgaggtcgtccaaatcctctccaccatcgccccgacactccatggaacaaagcgccggaacctccccatcgccgccgccttcaacctcacgccgtcgccgcatgtcggaagatacgatccagagcccgccgacatcgagaggcagcaggagtgctcgacgacgtccgcgcagtggcagcaagggcggtgcgcgccgccgccgggccgcgcgtcctggcccggcgacaggaacaagggcgcggcgggcggcggtgcggtggtgtcgggcgagctagtgaatgggatgctactgatgatgagcccccatgggcggagcagctggcggccgccgccgggcgacgacgacgaggaggtggtggacctgacggagccccgactggagacgttcacgccggcattgttcagatgattcattacttcgtttgccgtcgtcgccgccgtggctcatccagctggctgcagcgcgcccatgctcggctcccgttcgcatcctccgctccgcctccacgcgcgctttgcggtcgcggccttgtcggccatcaccggcggcaccggcgtcggtcaccattctccaacatacctgacgtgggcggcacccgatgaatattccagccgtaccgacaaatcctaatagcaaaacagctcaaacagttgataatctctacagagtaatcaaattcttttgattgcatttcaacatgcaactgatagtttcaaaatcaagtattccctgaaagttccgatcccgacggaggaggtgtgcagatcatggcgcacctggcttgggagtgcatgcagcgggaggctaggccctccaaatcctctccaacatcgctagcaacggctcatttagtactagatgttgagctttttgcaactagcaatagtgtcaactgaatcggaaactagcttaccatctgtatagactgaatgttcaagtgaaattcgggttactgaatgttgtttgcttaatatctccaggaagttcagaggaagggaaaaggcatgtctccagtaaaaacagtcatagttacgctcctagtgtgcgtggttctcaccactactgctttccttgtcaccactgtatactactctcgccc

SEQ ID NO: 2131 - DNA, 2705 bp, Zea mays
cagtgcacggcctggcctgcctggtatcactgccaccgccaccgcacctcacctccttgcattggttattatctatttatttattatttcagttcacgcacagacacagtgcagtgcattcaatctcaaataaaaagccctgctacagtgctagcagtactcggatccacgaccttctccctccctccgctgctgctccgtcaaggaagggaggaaagaaagggcaggggaatggaggtggaggaagacggccgagccgcccgagtgctgctgagctcccagtgtctctgtctctgatgagatgactggacttatttgatgctcttgccgttctcgacttggggcgcgagccgatggatctcctccggatgaaacttctcctgccctccttcatcagctgccttcttctgatgcaggcagcactatgtgatggcgccgccgccaccaccaccaccaccggcgaaaacggaacggcaaactggacatgtgtgtgcgcagctcatcctctcggtgaaccagactccaacagcagcttgctgtccaattgctcttcctcctgccattgccaccgagatgagaacggcggcggcggcggcggcggcgcaggctcgtggaactgcacgtgtgcctctggtgatgagggccttcagaaggaagagcatgctgagctacgtgacgggagctgtttcacttcctgcaactgcacgtcgggtactggaacttcagaggaagggagaaagcgtgtctcaagcaaaacagtcatagctacgctcctggtctgcgtggttctcaccaccaccgctttcctcgtcaccaccgtatactacttccgccgcaaggacgccctctctccgcgatcgcagatatactccttcgatagatacactactagctggagcagcaggtcgaacctcgtcagcagtcgatcgtctccgcttccccagatgaaacccaaaccaaagcttggtggtctgaaagagtttctgtgcagctgcaatcttgtcatctgtgggggagagagcggcgcattccccggtgtcgtcgcccggttctcgtacgcagagctggagcaagcgaccgggagattctcggacgaccaccttatcggagtcggtgggtcaagcaaggtgtaccgcggccagctcggcgatggcagagtcgttgccgtgaagaagcttaggccgctaggaggcacggacgaagacttggagttcctgtcagagatcgagctgctgtcgaggctgaaccactgccacgtggtgccgttgctggggtactgctcggagagccagggccggcagctggagcggctgctggtgttcgagtgcatggccaacggcaacctgagggactgcctagacctgaagcgagggaggaagcccatggactggcagacgcgggtgagcgtcgcgctcggcgccgcgagggggctggagtacctgcacgaggcggcggcgccgcgcatcctccaccgcgacatcaagtccaccaacatcctcctggacgacaagttcagagccaagatcactgacctcggcatggccaagtgcctgatgaacgacggcgtgaccagctgctcgagctccccggcgcggatgctgggcacgttcggctacttcgcaccggagtacgccatcgtgggcaaggcgtcgctcaagtccgacgtcttcagcttcggcgtcgttgtgctggagctcatcaccggccggcagcccatccacaagtcgtcgtcgacgagggccgacgagagcctcgtactctgggcgacgtcgcggctgcgggacagcgggctggtggtcacggagctgccggacccgacgctgcagggcaagttcccggcggaggagatgcagatcatggcgcacctggcgcgggagtgcctgcagtgggaccccgaggccaggcccaccatgacggaggtcgtgcacatcctcgccaccatcgcaccactccagcacggcgccaagcgtcggaaccttcccatcgccaccgccttcaacctcacgccatcgccgcacgtcgggcggtgtgacccggagcctaaagacgacgacatcgagaggcagatgcagcagcaggagtgctcgccgacgacggctgtccagtggcaacaacaacaagcgcgctgcacccacgcgccaacgggccgcgcgtcgtggcccggcgacagggggaacgttgtgagcagaggcgcggcggtgtcgggcgagctggtgaacgggacggtgctgatgaacccccacgggcggggcagctggcggcggccgccgccgcttggcgacgaggaggcagtggacgtggatctgacggagccccggatggaggcgttcacgcagccggcggcgtttcagcctttcaggtgacggaaggattaggatcaggtggtggtggttctgattggtgcggcggcggcgggtgctgctgtacatcttcttgttcgtgcctccacgatccacaccaggatcatctgcttctgcatctgcgttcatgaatgtacagtacaggcaaatacatctagattggcaacgggaaaagaaaagaaaggcatcgagatcgttatgggatataggacctagattgaacacgagatcaatgcatgaatctgaatccacggcgcgcgtcattggacacatcactgttgtacacaagcaaacagacaatgagtgttcacagaagcaaaaaatataagaccgagttcaatgcat

SEQ ID NO: 2132 - DNA, 1547 bp, Sorghum bicolor
gacgaaacgtcttcatcatgtaaaggtcccctactaggctactacctactacctagagcactataaattgtacctcacagagatggtataatcccaagctcacggacaactaatttgatactgctagtgaagcaagtcaatatactcctgggaacccctcatagaaattaatataagatatgattttcatatggctgatggggaaggagaatggagctactccaagaattctaggcgtccagaaatatattttcgtgagaccaagccagtggttgagaatgccataaaagaagtgtacacaactcttctccccaaaactatgatcattggcgacctagcatgcgctgcggggccaaacacattgctcttcatgtccagtgttataagcaccattgttgaacactgtaaatctagtagggatgattccgtggaacttcaattcttcttgaatgaccttcccggcaacgactttaacgaactatttcggttaattgagaagttcagaaggccaaatataacgggtgaaagggcacatctaccacctttttattatattcaagggttaccagaatcctattataacaggctttttccccgtgaaagtgtccacatattccactcttcatacggtcttcattggcgctcccaggaacttgagggactagagtcgtggagaaaaacttatctaaatgaagacaacatttacattacaaagaccacaacaccttttgtggtgaaacaattccagaagctgttctataaggacttctccctcttcctaaagttgcgtcacgaagaacttgtgcatggagggcaaatggttcttatatttaatgggagaaaggatgaggatgtatacaatggtgatcttaataaactttttgcattggttgcaatagcattaaagtctcttgttttgaagggccttgtggacaaggaaaagctacaatctttcaatctaccagtctacgggccatcagttggagaagtgaaagaactagtcatgcaaagccatttatttaacatgaatctaatcaaacaatttgagacgaactgggatccttttgatgattcagaaggtgatgatgttgaagataatgcctgcagtagcatgaacattgctaagtttataagacctgcactaaagtctttaattgttcgccatttcggagaaaccataattgacgcatggtttaccgagttcaagagccttgttgctgagcaccttgaaaaggagaagaccaagttcaccatcatcgtcatgtccttgaagaaagaataatatagatcgatgtgggtgttgtttctcaaatttcttttactcaaataccaaagaattatataatatatagacatgtgtgtagctactcctatatgtgtatctcaagattcagggtgtatatgagccaatgaagtgtatgtacatgcaatatatactatagaccatttgggatagtatgtatgccatatatgaaagtatacacagagtatattgttatatttatttatatactataataatggtattaatatatatagtattacta

SEQ ID NO: 2133 - DNA, 1622 bp, Saccharum officinarum
gcgagccccacgagaaggtctgcgtctgccctctccctccggctctccctcccctcctccggtcctccccgttgctgtccgtcccgccggcgtcgaggctcgagagaaggcggcggcgggtgagcgagagcgcctggccgcggggtgtgtccggtgagctagctgcggacgcgccggctcgtgttgacctggaagctctggaggcgctgaaagcggctggcgggcgggcgatggggtgggcttcctgctgctggtcggacggggctgaacctggtaggaggaagaagaagaaggacacgacgtggcggatcttctcactgaaggagcttcagtcagcaacgaacaatttcaattatgataacaagctcggcgagggtgggtttggaagtgtctattggggccagctctgggatggatcacagattgctgtgaagaggctcaagagttggagcaacaaagctgaaacagaatttgctgtcgaagtggagattttagcacgagtgaggcacaagagccttttaagcttacgcggttattgtgctgaaggacaggaacgcttgatagtctatgattatatgccaaatctgagcatacactctcaacttcatggacagcacgcagcagagtgcaatcttagttgggagagaagaatgaagatcgccgtcgactctgcagaaggaatagcttatctgcatcactatgcgacaccgcatatcattcatagagacgtcaaggcgagcaatgttctcctagattcgaatttccaagctcgggttgctgactttgggtttgccaagctaattccagatggtgcaacgcatgtcaccacaaaggtgaaaggcacactcggttatctcgcaccaaagtatgcaatgcttgggaaggcctctgaaagctgcgatgtcttcagttttggaattatgctcctagagcttgccagcgggaagaagccagttgagaagcttaaccccaccacgaagaaaaccataactgagtgggctcttcctctagctcgtgacaaaaagttcaaggaaattgctgatccaaagctcaaggatagcttcatcgaggatgagctgaagcgaatggtgcttgttgggctcgcctgttctcaggacaagccagagcagagacctataatgtctgaagtcgttgagctgctcaaaggagaatctactgagaagctttccaacctggagaatgatgatctgttcaagcctgatagctcattccagagctcatccggacctgatagctcagattgcgtcaccgaggagaggagttccaaagctgatgcgatagaggaggcagttgattcaagtgagacagttccctcagcaaggtagtgtgatgcatagtggtattgtcaataggtgccctgagctccctgcctgggagaaatgtgtttatcagtgtatttttgtggttattccttgctattagcaagttaatttgggagcttccttgcccaattctcctatgtgctgtcatctcttcgtgttggcatggttctcttggcttgtaaaattctgtaaatctgggcctgattccatctgtagcaagctgttcactgcattgctgtgagcatttagctactaatgtccattaatgatttgtgtgct

SEQ ID NO: 2134 - DNA, 1734 bp, Setaria italica
cagacaaacccctgagaaggaagactcctctccccccgccccgctccgctactctattcttcctctcctctccgttcctgtcccgggggccgtcgccggcgtcgagaggaagggccgtcgggcgagctagtggacgcggcggctcgtgctgatttgggggtactggaggcgctgcaggctgtcggacgggcgatggggtgggcttcctgctgcaagcggtcggacggggccgaaccgggtaggaagaagaagaagaaggacacagcatggcgggttttctcgctgaaggaactccagttggcgacgaacaattttaattacgataacaagcttggcgagggtgggttcggcagcgtctactggggccagctctgggacggatcacagattgcagtaaaaaggctcaagagttggagcaacaaggctgaaactgaatttgctgtcgaggtgaagattttggcacaagtgaggcacaaaagccttttgagcttgcgtggatattgttctgaaggccaagaacggttgatagtctatgattatatgccaaacctgagcatacattctcaacttcatggacagcatgcagccgaatgcaatctgggttgggaaagaagaatgaagattgccatagattctgcagaagggatcgcttatcttcatcactatgcaacaccgcacatcattcacagagatgtcaaggcaagcaatgtcctcctagactcaaatttccaagctcgggtcgctgatttcgggttcgctaagctcattccagatggtgcaacacatgtcaccacaaaggtaaaaggcacactgggttaccttgcaccagagtatgcgatgcttgggaaggcctccgaaagctgcgacgtcttcagctttggaatcatgctcctagagctcgccagcgggaagaagccagtcgaaaagctaaaccccaccacaaaaagaaccatagccgagtgggctcttcctctagctcgcgacaaaaagttcaaggaaatcgccgatccaaagctcaatggtaacttcatcgaggatgagctgaagcgaatggtgcttgtgggactcgcatgttctcagaacaagccagagcagagaccgataatgtctgaagttgttgagttgctcaaaggagaatctgccgagaagttgtccaacctggagaatgatgagctgttcaagcctgaacagaccagctcgttccagggctcatccgggcctgatagctcggattgcatcaccgaggagaagagctccaaagcagatgccatagaggcagcagttgattcaagtgagacagttccctcggcaaggtagtagatgcatagagtggtattgtcagcaggcgtcctgagctccctgcctgggagaaatgtttttttatatgagtgcatctttattactaggaggttaatttgggtgcttccttgccagttcacagatatgcttatctgcgtactgtcaatttgtgttggtatggttttcctatggcttgtaaaattctgtacatctggggctgattctgacagtaacaaactgttcactgtactgtcgttagcgtttagctacctcaatccatgaatgatttgtgtgccactgccaatccgtaattcatcaggttatttggtacttccaaggcattcatatgtaagggaaaaagtttgaactttcatcatgtagaacctatcgtgacttccatatgtatttagatgttaaagtgcttctttagcaaac

SEQ ID NO: 2135 - DNA, 1865 bp, Zea mays
catgtgcctacgacagctcgggacttcgggagccgcgggtgatcggaccgcgccccggccgggtggccttgcgtacggcagtggaaagtggtgatgcgctcagccgacacacacaccgcaaaaggcccacgagaagaccccgccggcccgccctctccctccccacctctactccacctccaatcctccccgttgctgtcccgccggcgtcgaagctcgagagaagggtgagcaccttgccgcgaggtgtgtccggtgagctagctagggacgcgccagctcgtgctgatctgacctggaagctctggaggcgatgaaagcgctcggacgggcgatgaggtgggcttcctgctgcaagctctcggacggggatgaaccaggtaggaggaagaaggacgcatcgtggcggatcttttcactgaaggagcttcagtcagcaacgaacaatttcaattacgataacaaggtcggcgagggtgggtttggcagtgtctattggggccagctctgggatgggtcacaggttgctgtgaagaggctcaagagttggagcaacaaagctgaaacagaatttgctgtcgaggtggagattctggcacgggtgaggcacaagagccttttaagcttgcgcggatattgtgctgaaggccaggaacgcttgatagtctatgattatatgccaaacctgagcatacacgcccaacttcatggacagcacgcagcagagtgcaatctcagttgggaaagaaggatgaagatcgccgtcgattccgcagaagggatcgcttatctgcatcaccatgcgacgccacacatcattcatagagatgtcaaggcgagcaacgttctcctggattcgaatttccaagctcgggttgctgactttgggttcgccaagctagttccagacggcgcgacgcatgtcaccacaagggtgaaaggcacactcggttatctcgcaccagagtacgcgatgcttgggaaggcctctgaaagctgcgatgtcttcagtctcggagtcatgctcctagagcttgccagcgggaaaaagccagtggagaagcttaaccccaccacgaagcgaaccatagctgagtgggctcttcctctagctcgggacaggaagttcaaggaaattgccgatccaaagctcaatggtagcttcgtcgaggacgagctgaagcgaatggtgctcgttgggctcgcctgttcccaggacaagccagagcagagacccgtaatgtctgaagtcgtcgagctgctcagaggagaatctaccgagaggctttccaggctggagaatggtgatctgttcaagcctgatatctcgttccatggctcatccggacctgatagctcggactgcgtcacggaggagaggagtcccaaggcagatgcgacagaggaggctgttgattcaagtgagacggttccctcagcaaggtagtgtgatgcacggtggtgtactgtcagtaggtgccctgagctccttgcctgggggaaatgtgtttatcagttcatttttgtggttattccttgctatttagcaagttaatctgggagcctccttgcccggttctcttgtgtggtgtcattccttcgtgttggcatggttctatggcttgtaaaattctgtatgtaaatctgggcctggttccatcccttcgtgtagcaagcagttcactgcactgtggttagcgttttagctacttcagtccattaatgatttgtgtgtaagtctgtaatatgtatttttttaggtttttatgatggaacttcgtttttctaaaagatttttattttttcaagggacaatgaactaatttttttggaaaatagaaatctattatgaaaatgaggttctc

SEQ ID NO: 2136 - DNA, 1662 bp, Panicum virgatum
gcgggccgtcgccggcgggtgggttagtgcggccgggtgaggcgctcggacctcggaggagctaggggacgcggcggctcgcgctgatttggggagttctggaggcgatgcgaggtctcggacgggtgatgcggtgggcttcctgctgcaagctgtcggacgggggcgaaccgggtaggaggaagaagaagaagggcgcagcatggcgcatcttctcgctgaaggagcttcagttggcgacaaacaatttcaattacgacaacaagcttggtgagggtgggtttggcagcgtctactggggccagctctgggatggatcacagatagcagtgaaaaggctcaagagttggagcaacaaggctgaaaaagaatttgctgttgaggtggagattttggcacgagtgaggcacaaaagccttttgagcttgcgtggatattgtgctgaaggccaagaacgcttgatagtctatgattatatgccaaatctgagcatacactctcagcttcatggacagcacgcagcggaatgcaatctcggttgggaaagaagaatgaagatcgccatagattctgcagaagggatcgcttatcttcatcactacgcaacaccacatatcattcatagagatgtcaaggcgagcaatgtccttctggactcaaatttccaagctcgggttgctgattttgggttcgctaagctcattccagatggtgcaacacatgtcaccacaaaggtaaaaggcacacttggttaccttgcaccagagtatgcgatgcttgggaaggcctctgaaagctgcgatgtcttcagctttggaatcatgctcctagagcttgcaagcggtaagaagccagtcgagaaggtaaaccccaccacaaaacgaaccataaccgagtgggctcttcctctagcccgtgacaaaaagttcaaggaaatcgctgatccaaagctcaatggtaacttcatcgaggatgagctgaagcgattggtgcttgtcgggctcgcatgttctcagaacaagccagagcagagaccgataatgtctgaagttgttgagttgcttaaaggagaatctgctgagaagttgtccaacctggagaacgatgagctgttcaagcctgaacagaccagttcgttccagggctcatctggacccaatagctcggactgcatcactgaggagaagagctccaaaacagatgtgaaagaggaggcagttgattcaagtgagacggtaccctcagcaaggtagtgtgctgcacttcagcagacagcaggtgtccagagctccctacctgggtggtagaaatgtgttttataagtgcgttttcgtggttatttcttgttcttaggaggttaatttgggtgcttccttgcctagttcacagatatgcttatctgtgcaagtcaatttgtgttgctatggttctcctatggcttgtaaaattatgcagatctggggctgattccgacagtaacaagctgttcactgtactgttgctagcgatttgtgtgccactgccaatccgtaatccatgagattattttgtacttccaaggcattcaaatgtgagggagaaagtttaaaatttcattatgtagaacctatcacgacttttttatgtacttataattttatatgttacaagtgctttcgcaac

SEQ ID NO: 2137 - DNA, 1455 bp, Pennisetum glaucum
ggccgtcgggggagctaggggacgccgcggctcgtgctgattcggaggggttctggagacgctgctgctggcggtcgggtgagcgggcgatggggtgggcttcctgctgcaagcggtcggacggggcccaaccgggtaggaggaagaagaagaaggacacagcgtggcgggttttctcgctgaaggaactccagtcggcgacgaacaatttcaattatgataacaagctcggtgagggtgggttcggcagcgtctactggggccagctctgggacggatcacagattgcagtaaaaaggctgaagagttggagcaacaaggctgaaactgaatttgctgtcgaggtggagattttggcacgagtgaggcacaaaagccttttgagcttgcgtggatattgttctgaaggtcaagaacgcttgatagtctatgattatatgccaaacctgagcatacattctcaacttcatggacagcatgcagccgaatgcaatctgggttgggaaagaagaatgaagattgccatagattctgcagaagggatcgcttatcttcatcactacgcaacaccgcacatcattcatagagatgtcaaggcgagcaatgtcctcctggactcgaatttccaagctcgggttgctgatttcgggtttgctaagctcattccagatggtgcaacacatgtcaccacgaaggtaaaaggcacactgggttaccttgcaccagagtatgcgatgcttgggaaggccaacgaaagctgcgacgtcttcagctttggaatcatgctcctagagctcgccagcgggaagaggccagtcgagaagctaaaccccaccacaaaacgaaccatagctgagtgggctcttcctctagctcgcgacaaaaagttcatggaaatcgctgatccgaagtttaatggtaacttcgtcgaggatgagctgaagcgaatggtgctcgtgggactcgcatgttctcagaacaagccagagcagagaccgataatgactgaagttgttgagttgctcaaaggagaatctgctgagaagctgttgaacctggagaatgatgagatgttcaagcctgaacagaccaactcgttccaaggctcatccgggcctaatagttcggattgcatcacggaggagaagagctccaaagcagatgccatagaggcagcagttgattcaagtgaaacaatcccctcagcaaggtagtagagatgcagagtcagcaggtgtcctgagctccctgcctgggagaaaaagtgttttatgagtgcattttcatggttattctctgttactaggaggttaatttggtgcttcgttgcccagttcacagatatgcttatctgtgttttgtcaatttgtgttggtatgattttcctatggcttgtaaaattctgcacatctggggctgattctgacagtaaagcttgcgtttagctacctcaac

SEQ ID NO: 2138 - DNA, 1953 bp, Panicum virgatum
aactcgagctattcacttcattgttgtgttcttaggggcgaaccaggtaggaggaagaagaagaagggcgcagcatggcgcatcttctcgctgaaggagcttcagttggcgacaaacaatttcaattacgacaacaagcttggtgagggtgggtttggcagcgtctactggggccagctctgggatggatcacagatagcagtgaaaaggctcaagagttggagcaacaaggctgaaaaagaatttgctgttgaggtggagattttggcacgagtgaggcacaaaagccttttgagcttgcgtggatattgtgctgaaggccaagaacgcttgatagtctatgattatatgccaaatctgagcatacactctcagcttcatggacagcacgcagcagaatgcaatctcggttgggaaagaagaatgaagatcgccatagattctgcagaagggatcgcttatcttcatcactacgcaacaccacatatcattcatagagatgtcaaggcgagcaatgtccttctggactcgaatttccaagctcgcgttgctgattttgggttcgctaagctcattccagatggtgcaacacatgtcaccacaaaggtaaaaggcacactcggttaccttgcaccagagtatgcgatgcttgggaaggcctctgaaagctgtgacgtcttcagctttggaatcatgctcctagagcttgcaagcgggaagaggccagtcgagaaggtaaaccccaccacaaaacgaaccataaccgagtgggctcttcctctagcccgcgacaaaaagttcaaggaaatagctgatccaaagctcaatggtaacttcatcgaggatgagctgaagcaagtggtgcttgtcgggctcgcatgttctcagaacaagccagagcagagaccgataatgtctgaagttgttgagttgctcaaaggagaatctgctgagaagttgtccgacctggagaacgatgagctgttcaagcctgaacagaccagttcgttccagggctcatccggacctgatagctcggactgcatcactgaggagaagagctccaaaacagacgtgaaagaggaggcagttgattcaagtgagacggttccctcagcaaggtagtgtgctgcacgtcagcagacagcaggtgcccagagctccttgcctgggagaaatgtgttttatatgttttttttattagtaggttaatttgggtgcttccttgcctagttcacagatatgcgtatctgtgtattgtcaatttgtattgctatggttctcctatggcttgtaaagttctgcagatctggggctgattccgacagtaacaagctattcactgtactgttgctagcgtttagctacctcgatccatgaatgatttgtgtgccactgccaatccgtaatccatgagattatttggtacttccaaggcattcgtatgtgagggagaaagtttgaactttcattatgtagaacctagcacggctttcatatgtatttataattttatatgttatacaagtgcttctttcgcaactatgatggctagaaatgcaagactgatttctttactcttggcaagaaatctgtgcaatgaattaagcaaacatgctagtccatggctgaaacgacctgccgtcaatcatgctagtcccatgcaagattaagaagctggagaaacatgctagtctcaagaaacaatcaaatggctgtgtttagatgtttaggtgtaaaatttttgaaagggaatcttgttatttcggagtactaataaagtctatttacaattttttttgtatagatgggttgtaaatcgcgagacgaatctaaataggctaattaatccatgattagcggatggttactgcagcaccactgttgcaaattatggattaagtaggctcattagattcgtctcgcgatttacaacccatctgcgtaaaaaga

SEQ ID NO: 2139 - DNA, 1643 bp, Triticum aestivum
ctctccctccactgagtctcctgtgctgcccccgctgacctgcggccaccgacggcgagtggaggcggacgacgggttcccgcctcgcaggctctccggcggcgccgcggtagggttcgcgcgggctggtgctgatttgagggagattcgaggttggagccgacgcggcctctggggatggggtggctttcctgctgcaagcggtcgaacggggcccaacccggcaggaagaagaagaagaaggacacgacatggcgcatcttctcactgaaagagcttcagttggcgaccaacaattttaactatgataacaagcttggtgaaggtggattcggcagtgtctactggggccagctctgggacggatcacagattgcggtgaaaaggctcaagagttggagcaacaaggctgaaaaggagtttgctgtcgaggtcgaggttttggcacgagtgcggcataagagcctcttgagcttacgtggatattgcgctgaaggccaggagcgcctgatagtctacgactatatgcagaacctgagcttgcactctcacctgcacggacagcatgcagctgaatgccatcttggttgggagcgaagaatgaacatcgccattgattcggctgagggcatcgcttatcttcatcaccatgcgatcccacatatcatccatagagacgtcaaggcgagcaacgttctcctggacgcgaatttccaagcacgggtcgccgatttcgggtttgcgaaactcataccagacggtgcgacccatgtcaccacaaaggtgaaaggcactctcggttacctcgcgccggagtatgcgatgcttggcaaggccaaagagagctgcgatgtctacagcttcggagtgctcctgctagagcttgccagcggaaagaagccggtcgagaagataaaccctacgacaaagctcaccatcaccgagtgggcgcttccactcgctcgcgagcagaagttcaaggagatggctgacccaaagctgggggatagctttgtcgaggccgaggtgaagcggatggtgctcgtcgggcttgcttgcactcagaccaagccagaacagaggccggtgatgtccgaggttgtggagatgctcaagggggaatctgccgagaagttctccatcttggagaatgacgatctgttcaagcctcaaccgaccagctctgtccagggcacctctggcccctgcagctcggacgccatcaccgaagagaaggaatcgaaagaggatacgatcgaggaggcgactgattcgagcgagacggtgccctcagctaggtagtgtgatgcacaaaggtgtgtatatcccttcctgggatgtgtgatttgtgtatgtctgtgcgtatggttgtttcttgttgttggcaggttacttgggcccttcaccagtccagagatgtacttgtggttccgtgtattgttgatttcttttggcaatggttgtgatgtggcttgtaagattcttattggactggttccgacaataacaagttgttcatgtgttcctgtactcacccaatttaactcatcaattatctggtatgacaaaaaagtaaaacgtaccgtactgcgtggccgtctcgtctggaacgtactggaccaaaggcaacaacgagggatagg

SEQ ID NO: 2140 - DNA, 1558 bp, Secale cereale
ctccactgagtctcctgtgctgcccccgctgacctgcggccaccgacggcgagtagaggcggagggcgggttccagccgcggccgccttgccgcgggctctccggcggcgacgcgtcagggtttgcgcgggctggtgctgatttgggggagattcgaagccggagccagcgcggcctctcgggggatggggtggctctcctgctgcaagcggtccaacggggcccagcccggcaggaagaagaagaagaaggacacgacatggcggatcttctcactgaaggagcttcagttggcgaccaacaatttcaactacgataacaagcttggtgaaggtggattcggcagtgtctactggggccagctctgggacggatcacagattgctgtgaaaaggctcaagagttggagcaacaaggctgaaaaggagtttgctgtcgaggttgaggttttggcacgagtgcggcataagagcctcttgagcttacgtgggtattgtgctgaaggccaggagcgtctgattgtctacgactatatgcagaacctgagcttgcactctcacctgcacggacagcatgcagctgaatgccatcttggttgggagcgcagaatgagtatcgccattgattcggctgagggcatcgcttatcttcatcaccatgcgatcccacatatcatccatagagacgtcaaggcgagcaacgttctcttggacgcgaatttccaagcgcgggtcgccgatttcgggtttgcgaaactcataccagacggtgcgacccatgtcaccacaaaggtgaaaggcacgctcggttacctcgcgccggagtatgcgatgcttggcaaggccaaagaaagctgcgatgtctacagcttcggagtgctgctgctagagcttgccagcggaaagaagccggtggagaagataaaccctacgaccaagctcaccatcaccgagtgggcgcttccactcgctcgcgagcagaagttcaaggagatggctgacccgaagctgggggatagctttgccgaggcggaggtgaagcggatggtgcttgtcgggcttgcttgcactcagaccaagccagaacagaggccagtgatgtctgaagttgtggagatgctcaagggagaatctgctgacaagttctccatcttggagaatgacgatctgttcaagcctcaacagaccagctctgtccagggcacctctggcccctgcagctcggacgccatcaccgaagagaaggaatcgaaagaggatacgatcgaggaggcgactgattcgagcgaggcggtgccctcagctaggtagtgtgatgcacaaaggtgtgtatatcccttcctgggatgtgttgtgtggtttgtgtctgcctgtgcgtatggttgtttcttgttggcaggttacttgggccatttaccaatccgtgtatggttgatttcttctggcaatggttgcgatatggcttgtaagattcttattgtactggttgcgacaataacaagttgttccatctattcctgtacccaatttaactcatccattatctggtgtgcaaagtc

SEQ ID NO: 2141 - DNA, 1544 bp, Leymus cinereus x Leymus triticoides
  misc_feature (68)..(68): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (98)..(98): n is a, c, g, or t
  misc_feature (100)..(101): n is a, c, g, or t
  misc_feature (105)..(105): n is a, c, g, or t
  misc_feature (121)..(121): n is a, c, g, or t
  misc_feature (123)..(124): n is a, c, g, or t
  misc_feature (129)..(129): n is a, c, g, or t
  misc_feature (167)..(167): n is a, c, g, or t
  misc_feature (173)..(173): n is a, c, g, or t
  misc_feature (188)..(188): n is a, c, g, or t
  misc_feature (193)..(193): n is a, c, g, or t
  misc_feature (218)..(218): n is a, c, g, or t
  misc_feature (281)..(281): n is a, c, g, or t
  misc_feature (287)..(287): n is a, c, g, or t
  misc_feature (329)..(329): n is a, c, g, or t
  misc_feature (332)..(332): n is a, c, g, or t
  misc_feature (335)..(335): n is a, c, g, or t
  misc_feature (374)..(374): n is a, c, g, or t
  misc_feature (466)..(466): n is a, c, g, or t
  misc_feature (530)..(530): n is a, c, g, or t
  misc_feature (545)..(545): n is a, c, g, or t
  misc_feature (569)..(569): n is a, c, g, or t
  misc_feature (587)..(587): n is a, c, g, or t
  misc_feature (635)..(635): n is a, c, g, or t
  misc_feature (644)..(644): n is a, c, g, or t
  misc_feature (650)..(650): n is a, c, g, or t
  misc_feature (1388)..(1388): n is a, c, g, or t
  misc_feature (1501)..(1501): n is a, c, g, or t
  misc_feature (1515)..(1515): n is a, c, g, or t
  misc_feature (1524)..(1524): n is a, c, g, or t
  misc_feature (1528)..(1528): n is a, c, g, or t
cctctctctccactgagtctcctgtgctgcccctgctgacctgcggccaccgacggcgagtggaggcngangncnggttcccgccgcgaccgccttgncnngggntctccggcggcgccgngnnagggntcgcgcgggctggtgctgatttgggagattcgaggccngagccngcgcggcctcggggnatggngtggctttcctgctgcaagcggtcnaacggggcccaacccggcaggaagaagaagaagaaggacacgacatggcggatcttctcactnaaggancttcagttggcgaccaacaatttcaactacgataacaagctnggnganggtggattcggcagtgtctactggggccagctctggganggatcacagattgctgtgaaaaggctcaagagttggagcaacaaggctgaaaaggagtttgctgtcgaggtcgaggttttggcacgagtgcngcataagagcctcttgagcttacgtgggtattgcgctgaaggccaggagcgtctgatagtctangactatatgcagaanctgagcttgcactctcacctgcanggacagcatgcagctgantgccatcttggttgggagcgaagaatgaatatcgctattgattcggcngagggcatngcttancttcatcaccatgcgatcccacatatcatccatagagatgtcaaggcgagcaatgttctcttggacgcgaatttccaagcgcgggtcgccgatttcgggtttgcgaaactcataccagacggtgcgacccatgtcaccacaaaggtgaaaggcacgctcggttacctcgcgccggagtatgcgatgcttggcaaggccaaagaaagctgcgacgtctacagcttcggagtgctcctgctagagcttgccagcggaaagaagccggtcgagaagataaaccctactacgaagctcaccatcaccgagtgggcgcttccactcgctcgcgagcagaagttcaaggagatggctgacccgaagctgcaggatagctttgccgaggccgaggtgaagcggatggtgctcgtcgggcttgcttgcactcagaacaagccagaacagaggccggtgatgtctgaggttgtggagatgctcaagggagaatctgccgagaagttctccatcttagagaatgacgagctgttcaagcctcaacagaccagctctgtccagggcacctctggcccctgtagctcggacgccatcaccgaagagaaggaatcgaaagaggatacgatagaggaggcgactgattcgagcgagacggtaccctcagctaggtagtgtgatgcacaaaggtgtgtatatcccttcctgggatgtgttgtgtggtttgtgtctgtctgtgcgtatgtatcntgtctggttgatttcttttggcaatggttgcggtatggattgtaagattcttattggactggttccgacaataacaagttgttccatgtattcctgtactcacccaatttaantcatcaattatctngtgtgcaanaccnacgggttagcgactta

SEQ ID NO: 2142 - DNA, 1776 bp, Brachypodium distachyon
gagtactagagcctagcggctcaacgccagcgagtgagcggaccgcgccgagctgctttgcgtgcggtagtgggggagcggtgcgcggagcggagccgacacccacccggagaagagaagactctcctccctctctctcgctatctcctgtgctcctgccgccaccgccgtcataagagtcagagagaggcggaggacgggtttccctaggagaccgcctggtttgcgggctctccggcgaggcagggaccgcgcggggtctggtgctgatttgggagcttcgcggagccggcgcgaagacctcaggggatggggtggctttgctgctgcaaacggccggacgggaagaaaaagaggaaggatacaacatggcggatcttctcgctgaaggaactacagtccgcaacgaacaatttcaactacgataacaagcttggcgagggcgggttcggcagtgtctactggggccagctttgggacggatcacagattgctgtgaaaaggcttaagagttggagcaacaaggctgaaaaggagtttgccatcgaggttgaggttttggcacgagtgcggcacaagagccttttgagcctacgtggatattgtgctgaaggccaggagcgtctgatagtctatgactatatgcagaacctgagcttacactctcacctacatggacagcacgcagctgaatgccatcttagttgggaacgaagaatgaatatcgccattgattcagctgagggcattgcctatcttcatcatcatgcgatcccacatatcattcatagagatgtcaaggcaagcaatgttctcttggatgcgaatttccaagcacgggtagctgattttggttttgcaaagctcattccagagggtgtaacccatgtcaccacgaaggtgaaaggtacgctcggttaccttgcaccagagtatgccatgcttggtaaggccaaagaaagctgtgacgtctacagcttcggagtactgctgcttgagcttgccagtggaaagaagccagttgagaagataaaccccactacaaagctaaccatcaccgagtgggctcttccactcgcttgcgacaagaagttcaaggaaatggctgatccaaagctgaaggacagcttcattgaggctgaagtgaagcggatggtgctcgtcgggcttgcttgtacccagaagaagccagaacaaagaccaataatgtctgaagttgttgagttgctcaagggagaatctgctgaaaagttatccaacttggagaacggtgagctgttcaagcctgagcaggccagctcttgccagggaacatctggtcctaatagctcagatgttatcactgaagagaaggattcaaaagaagatacgatagaggaggcaacggattcaagtgagacagtaccctcagttaggtagttttatccacaaaggcgaaaggtgttgtatatcccttcatgggaaagtatggtttgtctgtgtatcattgtgtgcgtgtctgactgctccttgttgttggtaccttacttgggtcgcttccagtccagtgtatggttgatttgttttcgtatgattgtgctatggattgtaaaattctgcatgggctggttccaacagtaaatgttgaatgtattcatgttgttaccgtttagctaatgtaactcatcaattattggtgtgcaaagcctataattggtgtgcaaagtgtgtaattcaacaacttgatgcttctgagtatattttggctgcgcagaattcagcaagatttatattatt

SEQ ID NO: 2143 - DNA, 1244 bp, Festuca arundinacea
  misc_feature (698)..(698): n is a, c, g, or t
  misc_feature (749)..(749): n is a, c, g, or t
  misc_feature (788)..(788): n is a, c, g, or t
ggcacgagggcggcgtcgtggggatgaggtggttttcctgctgcaagcggtctgacggggctcaacctggcaggaagaagaagaagaaggacacgacatggcggatcttctcgctcaaggagctacagtcggcgacgaacaattttaactacgataacaagcttggcgagggcggattcggcagtgtctactggggccagctctgggacggatcgcagattgccgtgaaaaggctgaagagctggagcaacaaagctgaaaaggagtttgctgttgaggtggaggttttggcacgagtgaggcacaagagcctgttgagcttacgtggctactgcgctgaaggccaggagcgtctgatagtctatgactatatgcagaacctgagcttgcactctcacctacatggacagcacgcggctgaatgccaacttagttgggagcgaagaatgaatatcgctattgattcagcagagggcattgcttatcttcatcaccatgcgatcccacatatcatccatagagacgtcaaggcgagcaatgttctcttggacgcgaatttccaagcacgggtcgctgatttcggttttgcgaaactcataccagatggcgcaacccatgtgaccacaaaggtgaaaggcacgctgggttaccttgcaccggagtatgccatgcttggtaaggccaaggaaagctgtgangtctacagcttcggagtactgctgttagagcttgccagtggaaagaggccngtcgagaagataaaccccactacgaagctgaccatcacngagtgggcgcttccattcgcccgcgacatgaagttcaaggaaatggctgatccgaagctgagcgatagctttgatgaggctgaggtgaagcgaatggtagttatcgggcttgcttgtactcagaagacaccagaacgaagaccaataatgtctgaagttgttgagcttctcaggggagaatccgcggagaagttctctgaattggagaatggtgacctgttcaagctggaacagaccagctctggccagagacagcccggtcatggtatctcggatgccatttcggaagagaaggattcgaaggaggatgcgatagaggaggcggttgagtcaattgagactgtaccaacagctaggtagtttgatggacgaaggtggagtccatctgtgtgcgcgtgtatgataattcctcgttaccctttcccctttccacatccagaaacgcatctgtgtatc

SEQ ID NO: 2144 - DNA, 1762 bp, Zea mays
cgggagcccgcgggtgagcggaccgcgccccggctgcctgtcgctgagcctggcttagtggctttgcttgcgtacgatagtggggaagcggtggtgcgctcgtcagccgatgagccgacacacacacagacacagcacaggacacacggcccccggtttctccccgttgctgctgtcccgccggcgtccagtctcggcggggctctagctggggacgcgccggctcgcgctgtgacctgggagctctggactctggaggcgctgcaggcggtcgggcgggcgatggggtgggcttcctgctgcaagcggtctgacggggctgaacctggcaggaggaggaggaagaagaaggacacggcgtggcggatcttctcactcaaggagctccagtcagcgacgaacaatttcaattacgacaacaagctcggcgagggcgggttcggcagtgtgtactggggccagctctgggacggatcacagatcgccgtgaagaggctcaagagctggagcaacaaggccgaaacggagttcgctgtcgaggtggaggttctggcacgcgtgcggcacaggagccttctaagcctgcgcgggtactgcgccgaaggccaggagcgcctgatagtctacgattacatgccgaacctgagcatacactctcagctccatgggcagcacgcggcggagtgcaacctcagctgggagaggaggatgaggatcgctgtggactccgcggaagggatcgcctacctgcaccacagcgcgacgccgcacatcatccacagagacgtgaaggcgagcaacgtgctcctggacgccgacttccaggcgcgggtcgccgacttcggcttcgccaagctggtcccggacggcgcgacgcacgtcaccaccaaggtgaaaggcacgctgggctacctggcgccggagtacgcgatgctcgggaaggcctccgagagctgcgacgtcttcagcttcggggtcacgctgctggagctggccagcgggaggaggcccgtggagaagctgagccccaccgccgccgcgaagcagaccgtgacggagtgggcgctcccgctggcccgcgccaggaggttcggcgagatcgccgaccccaagctcggcggcggattcgtcgaggaggagctcaagcgggtggtgctcgtcgggctcgtctgcgcccaggacaggccggagcttcggcccacgatgtctgaggtcgtccagctgctcaagggagagtctgctgagaagctcgacagcctggagaacgactgcctgttcaagcctggtggtggctcgttccagggctcggactgcgtcggcgagggcgagggcgagggcgaggggaggagccccggagcagatggagggatacaggaggcagttgattcgagcgagacagtttcctcagcaagctagtgtgtggtattggcagtagctggttcctcagcaagacagcagctccctgcctctgggagaaacgtgtgttgatcagtgtattttttgtgtggttaatccttgctattagcgagttaattcgggagtttcattgcccagttctcctatgtgactgtcatctcttcgtgttggcatggttctatcttctatggttccagatgttcactgcactggtgttagcgtttcgctacttcagtgcatcaatggttttgtgtgcaagtccgtaataatacatttttgaggttttcatcatgcaaggttcatttcttcgagcacgagtactgcaatgaagttttcagacaaaaca

SEQ ID NO: 2145 - DNA, 2099 bp, Zea mays
gtgcagcggtggcgttgtatactccaccactctgctaaagagtaaagacccaagcagacatagatcagtgggtcctcgtcaagcagcacggtgatccacgcttccacgggcgcacagggctttttgccggccattacagaggagaggaggccgacaaaggcgtggcagaggtcccatccatgggagaggaagcggccgcggccacggccacggccaccgtggcggcagggaacgcacctccgcacctgctcctggtatgcttcccggggcagggtcacgtgaacccgatggtccgcctggccaagcgcatcgcggccaagggcccccttgtgaccttctcctcgctctccagcatcggggcgaagctcaccgcgtccgcgggcgtatcggccggcggcgacggcgtgccggtgggccggggccgcgtccggttcgagttcatggacgacgaggaccccgggcctgacctggacgacctcatgcgccacatcgccaaggacggcccgccggcgctggccgagctgctggggcggcaggcacgggccgggcggcccgtggcgtgcgtggtggtgaacccgttcatgccgtgggcggtcgacgtggccgccgacgccgggatcccctcggcggtgctgtgggtgcagtcgtgcgcggtgttctcgctctactaccaccacgtgcacggcctcgtggagttcccgcccgaggacgacctggacgcgcgcttcacgctgccgggcctccccgagatgtccgtcgccgacgtgccgtcgttcctgctcccgtccaacccgtacaagctgctggtggacgcgatcatcgcccagttccacaacatccaccgcgcgtcgtgggtgctcgccaactccttcacggagctggagcccgacgtggcggcggcgctcccgggcgtgacgccgcggccgccggagctcatccccgtgggcccgctcatcgaggtcggcggcgggcgggacgacgacgagggcgcggtgcgcggcgacctgatgaaggccgcggacggctgcgtggagtggctggacgcgcaggccccgcgctccgtggtgtacgcgtcggtgggcagcgtggtgcggctgaacgcggaggaggtgggggagatggcgcacgggctcgcgtccacggggcggcccttcctgtgggtggtccgccccgacacccggccgctgctgccggacgggttcctggactccgtggccgggcgcggcgcggtggtgccttggagcccccaggaccgcgtgctggcgcacccgtccaccgcctgcttcctcacgcactgcgggtggaactccaccctggagaccatcgcggcgggcgtgcccgtggtggccttcccgcagtggggcgaccagtgcacggacgccaagttcctggtggacgagctcgggatgggtgtccgcctccgcgggccgctgcggcgggacgccgtgcgggaggcggtggacgccgcagtggcggggcccgaggccgacgcgatgctcgccagcgccaggaggtggagcgcggcggcgcgggaggccgtggcgcccggcgggtcctcggacgcgcacgtccaggcgttcgtggacgaggtgtcccggcgagcttgtggcgtgcaagtggctaaggtcgtgccgccgtcgtcagaggagcttcaccagtcaccggtcagagtccaaacctgatcagcagtcatcccgtgttggttggtattgttaccgtctgtctgatacgaaccaattttttgcttcctctaccgtcttgacgccatttgtggactgtggccggcggtcgcgcagcgtatactgaatcacgagtatagcttgggtttagctggcgtctcgccggccgcgtggctttcattttccgggaaaaactattcttttttaagaacttgtttggatgcacaatgtaatcctttattatatagtctagcaaggtattatatacctctcaatcttctccaataataattatgcatccaaacaaacctataaggtcaccaatggtactcgaaacttttatttatgtacatattttacggataaaatgtatcctcatattttctcaaaaggttataaatctgtgtgtgtataatattt

SEQ ID NO: 2146 - DNA, 3207 bp, Zea mays
atgtacatgtgcagcggcgttgtatactgcatgttggtaagaccagatatcagtactcgtcaagccaaggcaagctcacggcctcacggggaggccgacgaagtcgtagcagagatccgatacatgggagaggaagagggcgcgcccaccgtggcagcagcggcagagagcgctccgccgcacctgctcctgatatgcttcccggggcagggccacgtgaacccgatgctccgcctggccaagcgcatcgcggccaagggcctcctggtgaccttctcctcgatctccagagtcggggcgatgctcgccgcgtccgtgggcgtgtcggccggcggtgacggcgtgcctgtgggccggggccgcgtccggttcgagttcatggacgatgaagaccccgggcctgacctggacgacctcttgcggcacctcgcgaaggacggcccgccggcgtttgccgagctgctggagcggcaggcggacgccgggcggcctgtggcgtgcgtggtggtaaacccgttcatgccgtgggcggtcgacgtggccgccgacgcggggatcccttcggcggtgctgtgggtgcagtcgtgcgcggtgttctccctctactaccaccacgtgcacggcctcgtggagttccctcccgaggacgacctggacgcgcggttcacgctgcctggcctccccgagatgtccgtcgccgacgttccgtcgttcctgctcccgtccaacccgtacaagctgctggtggacgcgatcatcgcccagttccacaccatcgaccgcgcgtcgtgggtgctcgtcaactccttcacggagctggaacccgacgtggcggcggcgctcccgggcgtgacgccgcggccgccagagctcatccccgtgggcccgctcatcgaggtcgacgagcagcacgacggcgacggcgacggcgcggggtcgggcgcggtgcgtggcgacctgatgaaggccgcggacgactgcgtggagtggctagacgcgcaggcgccgcgctccatggtgtacgcatcggtgggcagcgtggtacggctcaacgcggaggaggtgggcgagatggcgcacgggctcgcgtccacggggcggcccttcctgtgggttgtccgtcccgatacccggccgctcctcccagagggattcctggactccgtggccgggcgcggcacggtggtgccgtggagcccccaggaccgcgtgctggcgcacccgtccatcgcctgcttcctgacgcactgcggctggaactctaccctggagaccatcgcagcgggcgtaccagtggtggccttcccgcagtggggcgaccagtgcactgacgccaagttcctggtggaggaactcaggattggggtccgcctccgcgggccgctgcggcgggacgccgtgcgggaggcggtagacgccgccgtggcggggcccgaggccgacgcgatgctcgccaacgccaggaggtggagcgcggcggcgcgggaggccgtggcgctcggcgggtcctcggacgcgcatatccaagcgttcgtggacgaggatgttaacgagactcgagaggaggaggcgaggggtgaggatgcggctgattacgatgcggccgatgcagactatgagcaggaagatgatgctggaggtggaggtggagatgggtggtcttccggtggtggtcagtttgagggtggatggtcagcaggcggatgggactcatggcctagcagtgatgctggagcttctagtggtggagggtcttctcgggcacggaagtcgaggaaaacacattgggtgcctcctcctaaagttcctgctcgtgaggaggataagattttgatcgtaccgtgtggcgacgagtcttggattgatgcatcttttcaaggtcaaggacgtcgcacacaggtgaataaagttttgggaagtatatgcaaatatctctggcctggtgtagtgatggagaaaggcgttgaggtgccttgtatgtcttgggatcagtacgggctcgcgttcaatgcggaacataggaatgcccaaggtgctgtgtggcatgagttctggaaacgttacaagttgcctgaagatggaagtatgaacgatcgtgcacggatcgtttttaacaagagcgcgactaccttggttagggatcagatgtattatgctcggatccaggccacttctgattacatattaaggcaggaaggacgtcggccacgttccaaaagtgaggcatcaaacaaatacttaaccgaagaagaatatcttgagttttcagactcggtgccatggatggcatcaaatgaggctggttggcgggctgtatgcaaatattgggcaacagatggatttaaaggtgtttcaatgagaaacagctcaaatcgtgggcatgatgttcaccacagatatggtggtgatggccacgttcgtttggcaaagcgcatggaagctagttctggtgttacgccgagtgatgttcaggtttaccttagaggtcacagggggtcggatcctacaaatccagaacagttgtgttctcagtcagctgctgagcgtgtggtgagactttcgcaactagttacaatgcacttctattctaagagtcgagaaaaatataactgcattatttattatttgtcaggcctcatatggtgcttccatgatgtcggagcatgggcaagactatgattggatgaatcagcctatcgatcctcaggttgtgtatgctagtggaggcggaaaacctcatggacggtgagtttgctattattaattcgtcgatttgatcttttctaacatgatgtgttgcgtgtttaacttctttctatttttttctagttaccccatgtttggtagtgttatcgactcgactcaggtgaggcctgaaaggtctcgtccatcgaggtcgtctagccgtggtcctcgctctagtacccaaggaaacgccgagctgatccggatgcaggaagctttgaggcggcaggaggagtataacaagcaacaacaagagtactgggctgctcaatttgcacgacagcaggagatgatgcaggtaattagatcctcgtgagcctctactataattggagcacatattttctaatatatcctcgtaacatagctttcaatttctttcagcaaatagcactagggcaacgtccagatttttcagcgatgactatgccacctcctccacctatcccgcagtttgtaccg

SEQ ID NO: 2147 - DNA, 1842 bp, Panicum virgatum
caagcagctgcagctccgagaaggccgacggcgaccaagaagatcgaggccgatccgaccctgggagctcgcgcgcacagtgcgcggccatgggtgaggaagcggcggccgtgccccatgccgtggcggcggcgagcgccccgccgcacctggtgctgatatgcttcccggggcagggccacgtgaaccccatgctccgcctggccaagcgcgtcgcggccaagggcctcctcgtgaccttctcctcgctggccagcgtgggcgcgaggctggccgccgccgcgggggtgtcggccggcggcgacggcgtgcccgtgggccggggccgcgtccggttcgagttcctggaggacggcgaccccgggtcccacctggacgacctcatgcggcacctcgagacggccgggcccccggcgttcgcggcgctgctgcggcgccaggcggaggagggccggcccgtggcgtgcgtggtggtgaacccgttcatgccgtgggcgagcgacgtggccgccggcgaggggatcccgacggcggtgctgtgggtgcagtcgtgcgcggtgttctcgctctactaccaccaagtgcacggcctggtggagttcccgcccgaggacgacccggaggcgcggttccagctcccgggcctgccggagatgtccgccgccgacgtgccgtcgttcctgctcccgtccaacccgttcaagctcctcgccgacgcgatcatcacgcagttccgcaccatcgagcgggcctcgtgggtgctggtgaactcgttcgcggagctggagccggacgtggtggccgcgctccccggcgtgacgccgcgcccgccggagctcatctccgtgggtcctctcatcgagctccagcagcaggagggtcaggaggacgacgatgcggtgcgcggggacctgatcaaaggccgccgacgactgcgtggagtggctggacgcgcagccgccgcggtccgtggtgtacgcgtcggtgggcagcgtggtggtgctgtcccccggcgaggtcgcggagatggcgcacgggctggcgtcaacggggcggccgttcctgtgggtggtgcggccgggacacgcagccgcacctgcccgaggggttcctggactccgtgtccgggcgcggcgcggtggtggcgtggagcccgcaggagcgcgtgctggcgcacccgtcgacggcgtgcttcctgacgcactgcgggtggaactcgacgctggagacggtggcggcgggggtgcccgtggtggcgttcccgcagtggggggaccagtgcacggacgcgcggttcctggtggaggagctcgggatgggcgtgcgcctgcgcggcgcgcggcgggaggccgtgcgcgaggccgtggaggccgccgtggcggggccctgcgcgggggacatgctcgcgagcgccaggcggtggagcgctgcggccagggccgccgtggcgcccggcgggtcctcggacgcccacgtccaggcgttcgtggacgaggtggcgcggcgggcgcgtggtggcggggcggctaaggcccgggcccaggcgcagccccctcccgccgtcgtcacggaggcctagcggagccgagcctcgagcctgagcagcaggtcgcgtcgtgacttgagctcagagagagggtaatagtgctggctagggtaaaccaaagccactcgcaggtacggagccaggaagtcgattttttcgggatcaatcatataaatttatataaaaatttaatcaaaatttaaatttctaatgtaaatttgaggacggcttggcccctgtctccgcccctggccacgcgtggcggtaaaaaaagaaaaggtgaacagtaaataatt

SEQ ID NO: 2148 - DNA, 2872 bp, Panicum virgatum
gcaaagcattagtagtatgtgacaagcaccgttggtaccaggtcccagcgtccctgctgcgcaaaccaagtactctagcgaatcgacctcctgcgttgtcttttgtgctagcgtttcttcttccactgaacaaagagaggagccaacttagatccctctagctccgcgacacacacaagatagccagccgtcatccatggctgtcacatgtcagtctctgtccgtgtgtgcagcatccgtggtcacctcggacgtcatcacgctcagcagggccatcgtcctctcccatataaatgtacaggaccagtagccttgtaccactacgttgcttaaggagttcgatcgagagctgagtcatcaagtagcttcagctccgagaaggccgacggcgacccagaagatcgtggccgatccgaccctgggagctcgcgcgcacagtgcgcggccatgggtgaggaagcggcggccgtgccccatgccgtggcggcggcgagcgccccgccgcacctggtgctgatatgcttcccggggcagggccacgtgaaccccatgctccgcctggccaagcgcgtcgcggccaagggcctcctcgtgaccttctcctcgctggccagcgtgggcgcgaggctggccgccgccgcgggggtgtcggccggcggcgacggcgtgcccgtgggccggggccgcgtgcggttcgagttcctggaggacggcgaccccgggcccgacctggacgacctcatgcggcacctcgacacggccggcccgccggcgttcgcggcgctgctgcggcgccaggcggaggagggccggcccgtggcgtgcgtggtggcgaacccgttcatgccgtgggcgagcgacgtcgccgccggcgaggggatcctgacggcggtgctgtgggtgcagtcgtgcacggtgttctcgctctactaccaccacgtgcacggcctggtggagttcccgcccgaggacgacccggaggcgcggttccggctgccgggcctgccggagatgtcggccgccgacgtgccgtcgttcctgctcccgtccaacccgttcaagctcctcgccgacgcgatcatcacgcagttccgcaccatcgggcgggcctcgtgggtgctggtgaactcgttcgcggagctggagggggacgtggtggccgcgctccccggcgtgacgccgcgcccgccggagctcatccccgtgggcccgctcatcgagctccagcagcaggcgggccaggaggaggaggacgcggtgcgcggggacctgatcaaggccgccgacgactgcgtggagtggctggacgcgcagccgccgcggtccgtggtgtacgcgtcggtgggcagcgtggtgctgctgtcccccggcgaggtcgcggagatggcgcacgggctggtgtcgacggggcggccgttcctgtgggtggtgcggctggacacgcagccgcacctgccggcggggttcgtggagtccgtgtccgggcgcggcgcggtggtggcgtggagcccgcaggagcgcgtgctggcgcacccgtcgacggcgtgcttcctgacgcactgcgggtggaactcgacgctggagacggtggcggcgggggtgcccgtggtggcgttcccgcagtggggggaccagtgcacggacgcgcgcttcctggtggaggagctcggcatgggcgtgcgcctgcggggcgcccggcgggaggccgtgcgagaggccgtggaggccgccgtggcggggccccgcgcgggggagatgctcgcgagcgccaggcggtggagcgccgcggccagggccgccgtggcgcccggcggttcctcggacgcccacgtccaggcgttcgtggacgaggtggcgcgccgggcgcgtggcggcggagcggctaaggccgaggcccaggcggcccagcctcctcccgccgtcgccacagaggcctcctagcgtcgagacgtgatctccagaggcagagagggtgctagtgctaggctgctagctagggtaaatggcggtaaaaaaagggaacagtaaataattaatcgtgcggctaccgcgaatttgatttcgttttttcacggttttgcactgctcaattcgattccaaccagcagattctgtgtgttctgctcctaccgtggttgggctgccaatcttgttgcgttccgtggtgtccgcgtgttggcggaaggttcggaggcgacgacgcgtgtggtgccggcgagccgccgcgccagccaaacgagagagcctggaagctttttgccggaaaactaaagttaagttacgggcgactggtcgaggtgcgcccgcccacggacgacggcaggagggccgcgggcagcaggaacgtacgggccacggacgagccgacggcgacgtcgcggccacgggcacaaatggcgcggcgcggcggtttcccgggcggcggggatgggtcgcgtcaggccactcaagtctccacacatgcatgcgagctagaacaggtctgccgtgatcgccgggcaaacgctcagggtcagggagccgcccgcccccccggaccaatcatccacgagaccactcatgtgtcggcgaaagacaggcccgagcagatgcttccgtcctggaaggatcagagggtgtgcacgctctcgtgtcgaggcacgtactcgcaggtgctgttcctcgtgttcctcgtggcccagcgaaccctgtgaggaggagtaatcagcttggtggccgggccctcgtgccataccggccttcatggtggcggagccgctgaagccgacggctgccgacgtccggccaccatcactatcagcaagctaatatatatagtgtccctatctagttaataaagcactctctttacccataaaaaacgatttataga

SEQ ID NO: 2149 - DNA, 807 bp, Saccharum officinarum
ataaactagtgctaggggagaggaattagaaaacaaaatcaaatcacaaagctagggcggagatgaacgttgcggaggaggaggaggtgagcatggagggggagcagaagggtggcgctagcggcggtgttcgcgatggcgaggtgaggacggcggcggcggcggcggcggtgagcctggagacgctgcggaagcggatggcggacttcgcaacggagcgggactgggagcagttccactcccccaggaacctccttctcgccctggtaggggaggtaggggagctgtctgagatattccaatggaaaggggaggtgcccaaggggctgccaggctgggacgatggtgagaaggagcacttgggtgaggaactcgccgatgtgctcctctatctggtgcggctgtcggacatgtgcggcgtcgacctcggcaaggctgccctgcgcaagatggagatcaatgcccgcaaatacccagttgggcagtgcaagggttcatccaagaagcacactcactacggttccactaacaatgttagcgacagcgacaatgctaacaccccgaacaaggagaacaacaatggcgtctaaaacgacgactcgagctccttgaatgatagtttggctggtcggacatgatctaaggttatgtgctgatgaaatagggatgctctatttgggtggtaagggaacagtatttgggttcaagttcccttattagatgcctaatgacccaagggttaccaccaagcctttgaaggtgtagttcccctatatttttaatgaactggctttttctaaaaaaaat

SEQ ID NO: 2150 - DNA, 1117 bp, Zea mays
tcttcctcgccgcattgacctattcacttcctccataataactagtgctactaggtcccccacggccgaggaggaattagaaaacaaaattaaatctcaagtctagggcggagatgaatgttgcggaggaggaggtgagcatggagagggaggagaagggcggcaatgttcgcgatggcgaggtgaggacgacggcggcggcggcggcagctgtgagcctggagacgctgcggaagcggatggctgacttcgcgacggagcgggactgggagcagttccactcccccaggaacctccttctcgccctggtaggggaggtgggggagctgtctgagatattccaatggaaaggggaggtgcccaaggggctgccaggctgggacgatgccgagaaggagcacttgggcgaggagctcgccgacgtgctcctctatctggtgcgcctgtcggacatgtgcggcgtcgacctcggcaaggctgccctgcgcaagatggagatcaacgcccgcaaatacccagttggacagtgcaagggttcatccaagaagcacactcactacggctccactaacaatgttggcgacagcgacaaagctaatgccgcgaacaaggagcagcatagctgtggtgtctaaaatgactcggagctccttgaatggtaatttggatggtcgggcatgatctaggttacgtgtgctgatgaaacagggatgctctattttggtgggaaagggacaagttgcgtgggttcaagttcccctatatattagatggctaatgaaccaagtgttaaccacaaagcttcgtaggctgtagctcccctatgtctaatgtgtactggggcattctgattctgctggttcagttatgcagcttcatatgatgcgaaagcaaagctgactattgcagtagtactaatgagtactgacagtactttatgatgcaaaagctttctgacagtgcaaagttgtcagtgtagtctttgagctggtgttggactgtcggtgattggtgaatgtcattgacgctctagtccttatttcagtacaatgaacaaagattattatggggcctttatgaacgtcatggtaagtggacccgagtcctgactatggac

SEQ ID NO: 2151 - DNA, 1489 bp, Panicum virgatum
acccctcattactgctgcctcaccaacaaaggagagaggttgagtggaggcagagattaaagaaaaaaaaatcaaccagagaagcagagagcggagatgaacggtggagtggaggaggtgagcgtggaggaggggaagtgcggcgatggcggcgcggttcgtgacggcgagatggggacggcgacggaggcggaggcggcggcggcggtgagcctggaggcgctgcggaagcggatggcggacttcgccagggagagggactgggagcagttccactcccctaggaacctgctcctcgccctggttggggaggtgggggagctatctgagatattccaatggaaaggggaggtgcccaaggggctgccaggctgggacgaggctgagaaggtgcacttgggcgaggagctcgccgacgtgctcctctacctggtccggctgtcggacatgtgcggtgtcgaccttggcaaggctgccctgcgcaagatggagatcaatgcatgcaagtacccagttggccagtgcaagggctcatccaagaagcacacccactatggctccactaacagcgttagcgccaacgataatgttaacaccatgaacaaggagcataacaatgggatctaaaaagacgccaaagctccttgaaatggttgttcggctggtcttgtgttgcataaccaaggttaaatgctgatgaaatagggatcctctattttggtggtaaaggaacaagtatgtaagttcatgttcccctatatattgatgccgaaagtaccaagtgttaaaccataaagctctgtaggctacatgtgtaattggactggcatttagcttgtgctgtttcagttgtccagctgcatatgatgcaaaaacaaatctagctgctattgacactgctttgtgatgcaaagctgctttctggcaattttgcatatgaagcgaagtcatcaattgtgtctatgcatggcattgacacagtcacagtaccagtacaggtgaacgaagattatcatgagatctttatgaagagaggctgacaagtggacctgacatgtccaggttcagcaagctttgctggttggtgaagtccaatggattcctactgccccatttacttgctgcttgggggaccgccggactggagccactgggtgccaattgtgggggcttttttctgggtgtatgctgccaagttacctgactatggcaggccctgatcagcaatttcatgacggatcatctccttccataatgaaataaatgccaaattgttagtatgatccatgtaacgtggtgatgcctttcttgatgttattactcatttggaagaaggttatgtagatttctggctgcagtacaatgagggcatacatgatgtgcaggggacatggtttgatttgtcctgggctacttctcgtacatgctgttgcatagaaaatgttaaaccaagctgctatgagggttaacagtgctactgctacattgc

SEQ ID NO: 2152 - DNA, 1066 bp, Setaria italica
attactgctgcctcaccaacggggagagagaagggagaaattaaaaaaacaaaatcaaaccagagagcggagatgaacggtggtgtggaggaggcgagcgcggagggggaggggaagggcggcgtcggcggcggtgctcgtggtggcgagatggggacggcgacagaggcggtggcggcggtgagcctggaggcgctgcggaagcggatggcggacttcgccagggagagggactgggagcagttccactcccctaggaacctgctcctcgccctggttggagagatgggggagctatctgagatattccaatggaaaggggaggtgcccaaggggctgccaggctgggatgaggccgagaaggagcacttgggcgaggagcttgccgacgtgctcctctacctggtccggctgtcggacatgtgtggagtcgaccttggcaaggctgccctgcgcaagatggagatcaatgcacgcaaatacccagttggccagtgcaagggctcatccaagaagcacacccactatggctccactaacagtgttaccgctagcgccagggacaatgttaacaccatgaacaaggaggataacaatggagtctaaacagacccagagatccttgaatggttggctggtccctgcgttacatgatctaggttaagtgctgatgaaagagggatcctctattttggtggtaaatgaacaagtatgtgggttcaagttccactagatattagatggctaaagaaccaagtgttaaccataatgctttgtaggctacatatctaattggactggcatttagcttctgctgtttcagttatgcagctgcatatgatgcaaaagcaaatctggctactatttacttgcagtagtagtactactgacattgctttatggtgcaaagctgctttctgacaactttacatcttgcatatgatgaaaagttgtcaatggagactatgcatggtattgacgctctagtccttgtatcagtacaaatgaatgaagattattatgagatctttatgaacagagtctgtcaagtggaccttacatgtcc

SEQ ID NO: 2153 - DNA, 795 bp, Panicum virgatum
ggtggagtggaggaggtgagcgtggaggaggggaagtgcggcgatggcggcgcggttcgtgacggcgagatggggacggcgacggaggcggaggcggcggcggcggtgagcctggaggcgctgcggaagcggatggcggacttcgccagggagagggactgggagcagttccactcccctaggaacctgctcctcgccctggttggggaggtgggggagctatctgagatattccaatggaaaggggaggtgcccaaggggctgccaggctgggacgaggctgagaaggtgcacttgggcgaggagctcgccgacgtgctcctctacctggtccggctgtcggacatgtgcggtgtcgaccttggcaaggctgccctgcgcaagatggagatcaatgcatgcaagtacccagttggccagtgcaagggctcatccaagaagcacacccactatggctccactaacagcgttagcgccaacgataatgttaacaccatgaacaaggagcataacaatggggtctaaaaagacgccaaagctccttgaaatggttgttcggctggtcttgtgttgcataacctaggttaaatgctgatgaaatagggatcctctattttggtggtaaaggaacaagtatgtaagttcatgttcccctatatattgatgccgaaagtaccaagtgttaaaccataaagctctgtaggctacatgtgtaattggactggcatttagcttgtgctgtttcagttgtccagctgcatatgatgcaaaaacaaatctagctgctattgcaaa

SEQ ID NO: 2154 - DNA, 2358 bp, Zea mays
gcgctaccaaaaaagaacgcctgcgcggtcgcggcgcacgctgcctcacatgcatgaccacacgtagacgccgtagcagcctagcaggaggcaggtagcaccggcgccgcggccccccccccccccccccccccccaaggccccagcggacacgccagctttacagtacctcgctcggcacgcccatcgaaacccgcttgctcgcctccgctgtctgctctatccaccacccccgcccacatcaccagagcacccgaggcttgtcttccttcctctcacatccgtacatagaaaaaaaaagaagaaatagggataccggagccgaactccggcggaccatctggtattctggtctggcactctggcgtgagaaaaggaaactgaattgaagcacagatcgatcgagagaggcgaacggcagtcggcaggcgagaaagaagtgctgacgcctcgtttccgtcgcacgcaccactactactcgcccagtccgccgctctcccgcggatccttcacctccactccattccgaggatctcattagcacgctctccggcgcggcggcggcccttcctccgagaccaggagctcgccgccggagtcagtgagtgaggggtacgtggtcgccgtccgtttccgacagtccgcggggcccgcggagcgtaaagcaaggacgcagccaagggagagagggggagggaagcaagtggatctgtgctagctgttgcggtattctccggaacactctccaccaggcacagagcaggtgtgctcagaatatgcagtcatctgcgatggcgttcttccctagcgttgccacggcgaagctggagctgaactctctgtacaggaagtacgtggacatgttcggtgtatcatcaaacaactctaccgttggctctcacaccatccacaagatgtcgcaccttcctgtcctgctggtcgatcgtacattcttcagcaccggtactgctattcagagcattgccatcagctatggagctcttattcgtaggtggttactgggcggaacttctgttgcacagcacgcgatgatatcccgtgctgctatgaactcgcttccttgctgtgccttcctgccattctttgccagcgttggtgctctaatgaccaagctctgtggctgcactatgattccagaccgtttttctggttggcaatctgtccttggccaaagtgctaacctccgtggagaaccagttctggtcgtggacaataatgagctgggcaatgatcagacattatcgagctttcttgggcgcaagcgagattacgtcggtctcggtctagcgcttcagtgcatctgttaccctgcatgtctgaaggttgctgagttcccccagaagaatctcagcttcagcaggcagtggatgcgaagtggccatgacacgagcgcaatctggagggccatggcgaggaatgagcaatacctggcattcgtcgtagtcctggcggccttgcagctcttcctgcggctagcccgggtgaacgtcaccatcctgttcctgccaatgctgtcccaggccgtgagttccaggagcagcccagcggtgatcggcaacgttctgctggttctggtgacctcctgcggagttcttggatctgcactctcagtgaaacagttcggccgggaggtgacgttcgctatcggtgccatcgtgatggtaatttgccaggtcgcgattccactgatcatggaagtccagatcggggttggcggaggaacgcgcatgccggtgggttacacggccgcgacgttcgccctgacgtgcgtcgtgtcctgcggcctcagctggtcgtggggctcgttcttctggaccttacctggcaggaaggttcactcggccggacacgttctggccgtggctctgaacctgggcgtctgcttcgcccagatgcggtacttcctgctgatgctgtgcaggctgaagaacgccacccttgcgtactatgcgctgtggatctggtcgtgattgggattcagctgagggagaatgcgtagctagatgagtgcgtgttaactctggttacttgagtaggaggctagtttggtggatgtaaatacttctcttggcttggcttgtacagagttctggcgctatttctgatggctccgtagatagcaactgtagggcttggttgcacttcctatgctaatggctgttctactaactgtgtggcgctcaataaagctgttatggttggcatggtcgctacagggttatcaattaagcggatatgtggctgaccaatcggacactttcaaattcagggatgggatataattttttttctcccacgggtaattttttatgtctaaggtttgttattcaattcgag

SEQ ID NO: 2155 - DNA, 1742 bp, Panicum virgatum
acggagagcaacggggtttatggttggtctagaagcaataaccgaagtgacggagaagagaccgcaactgcaaggcaccgcacaagaactcgccaggaagcgacgacgcggaaagccaagagaagccacccgccgctgttggattgttccgttcttcgattcccccgcggaggaccggagtcttctctcctcggggatcgtcggcgccctcttatccgcgccctctactggtgctggactgccgtggggtggagatcggcttgaatcaactcttcttgtagtctgttggtgctgcgaaaatgagtgacaacttgatggacaaggttagcgcctttggcgagcgcctcaagatcactgggacggaggtcagcaagaagatgacggccggcatgagctccatgagcttcaagatgaaggaattgttccaggggcagactccggccgacaagatcgttgaggatgccacttcggagaacctggatgggcctgactggaacttgaacttggagatttgcgacctgatcaacactgagaaggttaacagtgtggagctcatccgtggcatcaagaagcagatcatgctgaaggatgcgaggatccagtacctctccttaatcctgctcgagactattgtgaagaactgcgagaaggccttctcggaggttgcggctgagcgggttcttgacgagatggttaggctgattgatgaccctcagacagttgtcaataacaggaacaaggcccttatgctgattgaagcgtggggggagtctggtgatgagctacgctacctgccagtctatgaggaaacctacaagagcttgaaatcaagaggagtgcggtttcctggacgtgacaatgagagcttggctcccatatttactcccccacgatcagttgctgaagctgacattgatgcaaacttgccccagcaggcttttgaagacgtgcatgttcatacatatactgccgaagaaacaaaagaagcattcgatgttgctcgtaacagcatagaacttctttcgactgttctttcctcttcccctgagcaggatgctttgcaggatgacttaacagccactcttgtgcaacaatgctaccaatctcagcacactatccagagaattattgagacggttggtgacaacgaagctgtgctctttgaggccttgagtgtgaatgatgagatccagaaagtgctatccaaatatgaagagatgaagcaacccagggcctcggagcaagcagaacagcgtccagtggtcataccgattgccacagaacacgaagattccactgccgttggcactgaagatgccctggtcagaaaaccagttgctgctagggcaaggtcaggtggagatgacgatatccttgatgatctcgacgagatgatatttggcaagaagggaggtagcagttcgcaggaagcacccaaaaagccagatccgaagaaagatgaccttatcagcttttaagcaccttcgcaccccgtacttgctattttatggtgctgtactcagtcggtagaagattgcagattctgtaggatttggatcgcttgtttattctcatacgatcatacctgccccttttctcagtttgtccagttgttaagttgctgcactctctcaatcatctggtttcatggaggagtcccatgaatgtatttgatggtgaattctgccttgatgggaaaaatattttaactaaatctttgctcctcccttcaggccctgttt

SEQ ID NO: 2156 - DNA, 1793 bp, Panicum virgatum
actagttctagatcgcggaaagccaagagaagccacccgccgctgttggattgttccgttcttcgattcccccgcggaggtacgctccgcaccccacccaacccctgctcctaatccgcctctcctgctcccccggaaattccgcgtccagtgctcggatcttctcccgccgcttcccccgattttcctcacagcccgtttcgtctcctctcccgtccgccgccgccgccccgcggaggaccggagtcttctctcctcggggatcgtcggcgccctcttatccgcgccctctactggtgctggactgccgtggggtggagatcggcttgaatcaactcttcttgtagtctgttggtgctgcgaaaatgagtgacaacttgatggacaaggttagcgcctttggcgagcgcctcaagatcactgggacggaggtcagcaagaagatgacggccggcatgagctccatgagcttcaagatgaaggaattgttccaggggcagactccggccgacaagatcgttgaggatgccacttcggagaacctggatgggcctgactggaacttgaacttggagatttgcgacctgatcaacactgagaaggttaacagtgtggagctcatccgtggcatcaagaagcagatcatgctgaaggatgcgaggatccagtacctctccttaatcctgctcgagactattgtgaagaactgcgagaaggccttctcggaggttgcggctgagcgggttcttgacgagatggttaggctgattgatgaccctcagacagttgtcaataacaggaacaaggcccttatgctgattgaagcgtggggggagtctggtgatgagctacgctacctgccagtctatgaggaaacctacaagagcttgaaatcaagaggagtgcggtttcctggacgtgacaatgagagcttggctcccatatttactcccccacgatcagttgctgaagctgacattgatgcaaacttgccccagcaggcttttgaagacatgcatgttcatacatatactgccgaagaaacaaaagaagcattcgatgttgctcgtaacagcatagaacttctttcgactgttctttcctcttcccctgagcaggatgctttgcaggatgacttaacagccactcttgtgcaacaatgctaccaatctcagcacactatccagagaattattgagacggttggtgacaacgaagctgtgctctttgaggccttgagtgtgaatgatgagatccagaaagtgctatccaaatatgaagagatgaagcaacccagggcctcggagcaagcagaacagcgtccagtggtcataccgattgccacagaacacgaagattccactgccgttggcactgaagatgccctggtcagaaaaccagttgctgctagggcaaggtcaggtggagatgacgatatccttgatgatctcgacgagatgatatttggcaagaagggaggtagcagttcgcaggaagcacccaaaaagccagatccgaagaaagatgaccttatcagcttttaagcaccttcgcaccccgtacttgctattttatggtgctgtactcagtcggtagaagattgcagattctgtaggatttggatcgcttgtttattctcatacgatcatacctgccccttttctcagtttgtccagttgttaagttgctgcactctctcaatcatctggtttcatggaggagtcccatgaatgtatttgatggtgaattctgccttgatgggaaaaatattttaactaaatctttgctcctcc

SEQ ID NO: 2157 - DNA, 1662 bp, Setaria italica
aagcaataaccggggtggcaacaaaagaggccgcaactacaaggcaccgcaggagaactcgccgcgaagcaacgacgcggaaagacaaatccagccaagaggagccgctcgccgctgttggattattccgttcctcaattccgtcgcggagcgaaaatgagtgacaacctgatggacaaggttagcgcctttggggagcgcctcaagatcaccgggacggaggtcagcaagaagatgacggccggcatgagctccatgagcttcaagatgaaggagctgttccaggggcagactccggccgacaagattgtcgaggacgccacttcggagaacctggacgggcctgactggaactcaaacttggagatttgcgacctagtcaacacggagaaggttaacagcgtggagctcatccgtggcatcaagaagcggatcatgctgaaggatgccaggatccagtacctctccttgatcctgcttgagactattgtgaagaactgcgagaaggccttctcggaggttgcggctgagcgggttcttgatgagatggttaggttgattgatgaccctcagacagttgtgaataacaggaacaaggcccttatgctgattgaagcgtggggggagtctggtgatgagctacgctacctgccggtctatgaggagacctacaagagcttgaaatcaagagtgcggtttcctggacgtgacaatgagagcttggcccccatatttactcccccacgatcagttgctgaagctgacattgatgcaaacttgcagcagcaggcatttgaagatgtgcatgttcatacatatactgctgaagaaacaaaagaagcatttgatgttgctcgtaacagcatagaacttctttcaactgttctttcctcttcccctgagcaggatgctttgcaggatgacttaacatccactcttgtgcaacaatgccaccaatctcagcacactatccagagaatcatcgagacggttggtgacaatgaagctgtgctctttgaggccttgagtgtgaacgatgagatccagaaagtgctgtccaaatacgaagagatgaagcaacccagggcctcggagaatgcagaacaacgtccagtggttataccgattgccacggaacacgaagattccgctgctgttggcaatgaagatgccctggtcagaaaaccagctgctgcaagggcaaggtcaggtggggatgatgatatcctggatgatctcgacgagatgatatttggcaagaagggaggtagcagttcccaggaagcgccgaaaaagccagatccgaagaaagatgatctcatcagcttttaagcacatttccaatatcgcagccagtacttgctattttatggtgctgcactcagtcggtagaagattgcagattctgtaggatttggatcgcttgtttatttgcatacgatcatacctgccccttttacagtttgttcagttgttaagttgctgcactctctgaatcctctggtttcatgggtgagcccatgaatgtattggatggtgaattatgctctgatggaaaaaaaatatgttgactgaatctttgctcctcccttgggtaagcacatcacggctccaagctcatgtcttctgctctggctaatcgagcaaatgttcgtatatgcc

SEQ ID NO: 2158 - DNA, 1635 bp, Zea mays
acaagccgctcttgttgattattccgttcgttagttccgtcgcggagctacgctaagcctacgcccatcggcccctgttttcctaatccgcttctcctgcttccggggaaatttcgtgtccagtatcttgatcttccgccgccgcgcttcacgccagggctccttccaccggcgtcctccttaccgtcgtcctctactggtgctggactgctgcgggggtggagatcggcttagatcaactcttaattttgccgggactctttagagggcgcgtgcgctggtacagcaaaaaatgagtgataacctgatggaaaaggttagcgcctttggtgagcgcctgaagatcaccgggacggaggtcagcaagaagatgacggccggaatgagctccatgagcttcaagatgaaggagttgttccaggggcagactcccgctgataagattgttgaggacgccacctcggagaatctggacgggcctgattggaactcaaacttggagatttgcgacttgatcaacacagagaaagttaacagtgtggaacttatacatgggatcaagaagaggatcatgatgaaggatgcgagagttcagtacctctcattggtcctgcttgagactattgttaagaactgtgagaaggccttctcagaagttgcggccgaacgggttcttgatgagatggtcaggttgattgatgatcctcagaccgtggtgaataacaggaacaaggcccttatgctgattgaagcatggggagagtccggtgatgaactccgctatctgccagtctatgaggaaacgtacaagagcttgaaatcaagagtgcggtttcctggacgtgacaatgagagcttggctcccatatttactcccccacgatcagttgctgaagctgatgttgaaaccagcttgccccagcaggcgttcgaagacgtccatgttcatacatatactgctgaagaaacaaaagaagcgtttgatgtagctcgtaacagcatagaacttctttcgactgttctttcctcttcccctgagcaggatgcttcgcaggatgacttgacggccacactcgtgcaacaatgctaccaatctcagcacactatccagaggattattgagaccgtcggagacaacgaagctgtgctcttcgaggccttgagcgtgaacgacgagatccagaaagtgttgtcaaagtacgaggagatgaagcagcccagggcctcggagcatgcagaacagagagcagttgtcataccggttgccacagaacatgaagatctgactgctgccgtcaatgaagacgcccttgtcagaaaaccagctgccgcgagaacaaggtcaggtggggatgatgatatccttgatgatctggacgagatgatattcggcaagaagggaggtagcagctcccaggaagggccgaagaagccagatccaaagaaggatgacctgataactttttaagcgtacccttctataattgcagcctttgcttgctattttctggtgatgtacccactcggtagattgaagattccttaggatttggatcgattgtctattcgcatacgattcgtatctgccccctttcggtttgttcagtaaagtcgctgcactttctcagtcttgtt

SEQ ID NO: 2159 - DNA, 1627 bp, Panicum virgatum
ggaagtgacagaaaagagaccgcaactgcaaggcaccgtacaagaactcgccaggaagcaacgtagcggaaaaggcaaatccaggggccaagccaagagaagccgctcgcccctgttggattgttccgttcttcgattccctcgcggagcgaaaatgagtgacaacctgatggacaaggttagcgcctttggcgagcgcctcaagatcaccgggacggaggtcagcaagaagatgacggccggcatgagctccatgagcttcaagatgaaggaattgttccaggggcagactccggccgacaagatcgtcgaggacgccacttctgagaaccttgatgggcctgactggaacttgaacttggagatatgtgacatgattaacaccgagaaggttaacagtgtggagctcatccgtggcatcaagaagcggatcatgctgaaggatgcaaggatccagtacctctccttgatcctgctcgagactattgtgaagaactgcgagaaggccttctcagaggttgcggctgaacgggttcttgatgagatggttaggctgattgatgaccctcagacagttgtcaataacaggaacaaggcccttatgctgattgaagcatggggggagtctggtgatgaactacgctacctgccagtctatgaggaaacctacaagagcttgaaatcaagaggagtgcggtttcctggacgtgacaatgagagcttggctcccatatttactcccccacgatcagttgctgaagctgacattcatgcaaacttgccccagcaggcttttgaagacgtgcatgttcatacatatactgccgaagaaacaaaagaagcatttgatgttgctcgtaacagcatagaacttctttcaactgttctttcctcttcccctgagcaggatgctttgcaggatgacttaacagccactcttgtgcaacaatgctaccaatctcagcacactatccagagaatcattgagacagttggtgacaatgaagctgtgctctttgaggccttgagtgtgaatgatgagatccagaaagtgctatccaaatatgaagagatgaagcaacccatggcctcggagcaagcagaacagcgtccagtggtcataccgattgccacagaacacgaggattccactgctgctggcactgaagatgccctggtcagaaaaccagctgctgctagggcaaggtcaggtggagatgacgatatccttgatgatctcgacgagatgatatttggcaagaaggggggtagcagttcgcatgaagcgcccaaaaagccggatccgaagaaagatgacctgatcagcttttaaggaccttcccgtaatcgcacctcgaacttgctattttatggtgctgtactcagttggtagaagattgcagattctgtaggatttggatcgcttgtttattctgatacgatcatacctgccccttttctcagtttgtccagttgttaagttgctgcactctctcaatcatctgttctggtttggctaatcgagcaggtctggaacatagtgttgtttatcactggtctctctatatatgccactatgccagcgatgtgaactttgagatggggtcaaaatctgccaatcttattg

SEQ ID NO: 2160 - DNA, 1579 bp, Pennisetum glaucum
aagcaataaccggagcggcaacaaaagaggccgcaactgcaaggcaccgcaggaagagaactcgccgcgaagcaacgacgcggaaggacaaatccaggtgccagccagccaagggggagcccgctcgccgctgttggattattccgttcctcaattccgtcgcggagcgaaaatgagtgacaacctgatggacaaggttagcgcctttggcgaacgcctcaagatcactgggacggaggtcagcaagaagatgacggcaggcatgagctccatgagcttcaagatgaaggagttgttccaggggcagactccggccgacaagattgtcgaggacgccacttcagagaacctggatggaccggactggaacttgaacttggaaatttgcgacctggtcaacactgagaaggttaacagtgtggagctcatccgtggcatcaagaagcggatcatgctgaaggacgcgaggatccagtacctctccttgatcctgctcgagactattgtgaagaactgcgagaaggcgttctcagaggttgcggccgagcgggttcttgatgagatggttaggttgattgatgaccctcagacagttgtgaataacaggaacaaggcccttatgctgattgaagcgtggggggagtctggtgatgagctacgctacctgccagtctatgaggaaacctacaagagcttgaagtcaagaggagtgcggtttcctggacgtgacaatgagagcttggcccctatatttactcccccacgatcagttgctgaagctgacattgatgcaaacttgccccagcaggcttttgaagatgtgcatgttcacacatatactgctgaagaaacaaaagaagcatttgatgttgctcgtaacagcatagaacttctttcaactgttctttcctcttcccctgagcaggatgctttgcaggatgacttaacatccactcttgtgcaacaatgccaccaatctcagcacactatccagagaatcatcgagacggttggtgacaatgaagctgtgctctttgaggccttgagtgtgaatgatgagatccagaaagtgctatccaaatacgaagagatgaagcaacccagggcctccgagaatgcagaacaacgtccagtggtcataccgattgccacggaacacgaagattccgctgctgttggcaatgaagatgccctggtcagaaaaccagctggtgcaaggtcaaggtcaggtggggatgatgatatcctggatgatctcgacgagatgatatttggcaagaagggaggtagcagctcccaggaagcgccgaaaaagacagattcgaagaaagatgatctgatcagcttttaagcacattttcaatatcgcagccagtacttgccattttatggtgctgtactcagtcaggtagaagattgcagattatgtaggatttggatcgcttgtttattcgcatacgatcatacctaccccttttacagtttgttcagttgttaagttgctgcactctctcaatcctctggtttcatgggtgtattggattgtgaattatgccccgatggaaaaaaatatgttgac

SEQ ID NO: 2161 - DNA, 1677 bp, Zea mays
gggttggtctagaagcaataaccggggtggcagaaaagaggccgcaactgcaaggcaccgcaggagagaagaagatcaccagcaacaccaagcaactactcgtacgcggaaagagaaacccagaagccggtcttgttggattattccgttcgtcagttccgtccggagcggcggaggctctgttggtggtgcaaaaatgagtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacatgatcaacacagagaaggttgacagtgtggaactcatccgtgggatcaagaagaggatcatgctgaaggatgcgagggtccagtacctctccttggtcctgcttgagaccattgtcaagaactgtgacaaggccttctcggaagttgcggccgagcgggttcttgatgagatggtcaggttgattgatgatcctcaaaccgtggttaataacaggaacaaggcccttatgctcattgaagcatggggggagtctggtgatgaactccgttatctgccagtctatgaggaaacatacaagagcttgaaatcaagaggagtgcggtttcctggacgtgacaatgagagcttggctcctatatttactcccgcgcgatcagttgctgaagctgatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatccagatgattattgagaccgttggagacaatgaagctgtgctctttgaggccttgagcgtgaacgatgagatccagaaagtattatcgaagtacgaggagatgaagcagcccagggcctccgagcatgcagaacatgtaccagttgtcataccgattgctgcggagcatgaagatttgaatgctgttggcaatgaagacgcccttgtcagaaaaccagctgccgcgagagcaacgtcaggtggagatgatgacatccttgatgatctcgacgagatgatatttggcaagaagggaggtagcagctcccaggaaggtccgaaaaagccagatccgaagaaggatgacctgatcagcttttaattacctttccataatcgcagccagtacttgctattgtctggtgctgtacccactcggtagattgaagatttttattcgcatacgattcataccggtttgttcagttaagtcgctacactttgtcaatcttgtttcatggctgggtcccatgaccatgaatgtattgtattggatggtggattatgcgagacggcgggaaagtgtccaatgtgggtgaatctttattcttcgctacagtagccattttttttaaactcatatcttatgcttcggctaatcaagtagatctcttataatgccgc

SEQ ID NO: 2162 - DNA, 2147 bp, Oryza sativa
cctttgcaataagctcggcttgtgtcattttaacggtcaatcacgctcacaatatgccgttcatgtcattgtcatcatcacagagtgtgccgtctgcctaatgtatccgtacataaaaataacatatccatgcatacttgccgttgttaatttagtactaatgtacacggagaaaactatgttaagacaccagataaaaaaaattataataacgtgttaaaagagggattaggaacgcgaacaacacagagagaggaaagggaagtctttgaaagtctgagaaggaagcaacaactgaccaacacagtaggtggcaccaaagaaaaccgcaactccaaggcaccgtcgacacgaacttcacaagaactccaccgagaggagaggagaggagaggaaacgacgacacctcctccggcgcggcgagacgaatctacgcgtaccgagtaccgacgcggcgaccgcctcgctccgtccctatcctcgccgctccggctgattccgtcgcggagcgcgcgcggccggcgaggagtcctgggagggcgaccgacgcagtcggcctccttccatctcggttcgaatcgaatcgaattgaagcctgccagtgaaaatgagtgacaatctgatggacaaggttagcgcctttggcgagcgtctgaagatcactgggtcagaggttagcaagaagatgacggctggcatgtcctccatgagcttcaagatgaaggagatcttccaggggcagactcccgcggacaagattgtggaggaggccacctcagagaatttggacgggcctgattggtcggcaaacctggaaatctgtgacttgatcaacacggagaaagttaacagtgtcgagctgatccgtgggatcaagaagcggatcatgctgaaggatgctagggtccagtacctctccttggttcttcttgagaccattgtgaagaactgtgagaaggccttctcggaggttgctgctgagagggttcttgatgagatggtcaggttgattgatgatcctcagacagtggtaaataacaggaacaaagcccttatgcttattgaggcatggggagagtctggtgatgagcttcggtacttgcctgtctatgaggaaacctacaagagcctgaaatcaagaggagtgcggttccctgggcgtgacaatgagagcttggcccccatatttactcctgcgcgttcagtagctgaagctgaagttgatgcaaacttttcccagcagaccttcgaagatgtgcaagtgcatacatatactgctgaagaaacgaaggaagcttttgatgtggctcgtaacagcatagaacttctttcaactgttctttcatcctctcctcagcaggatgctttgcaggatgacttgacatccactcttgtgcaacaatgctaccaatctcagcacactatccagagaatgattgagactgctggagacaatgaggccatgctttttgaggccttgagtgtgaatgatgagatccaaaaggtgctgtccaaatatgaacagatgaagaaacccgcagcgtctgagaacgcagaacaacggccggtagtcataccaattgccacagaacatgaagattctgctacggtcggcaatgaagatgccctggtcagaaaaccagctggttctcgagcaaggtcaggtggagatgatgatatccttgatgatctcgatgagatgatatttggcaagaagggaggaagcagttcccaagaagggcccaaaaagcaggatccgaagaaagatgacctaatcagcttttaaataccgttctggccagttcctcgtggaatcagaagatgtttgctgtttcatagtgccgaacgatatctgtattcatccccgtagaagatttcacattcgccaggatttggatcgcttgtttatttgcatacgatctatcatacttgtctgtcacagtttgttcggttgatttaagttgcttcacccttcacatcctctggttgcatgattgcatctgcattggatggctaattatctcttgatggaaaaacacgtccagtataatgaatgagcctcagctcctattcattgctctttgcttttatggttctacctttacaagtttcctattcattgatctgtagttctggctgcaggattc

SEQ ID NO: 2163 - DNA, 3245 bp, Brachypodium distachyon
gtgtatgtgcaggatcgtgccgtctgcctaatgtaggcgtgaataaataaaggggatatactcctactaagtaacaaaccgacttttttttaaagaagaagggaagcgtgaaaagaaagagagaagtcctcaaagtacaacagttgttggcacttggcagttggcagtagcaccaaaggagacctcgactcgaaggcaccgcgcaggaactccatcgaacaaacgacgcggacgggacggcagctcgaatccgcgcgtgcgaggcctcgctccagttcgattcgactcccttctcctccgcctcctccaatttccttcgcggaagtgaaaaatgggtgacaatttaatggagaaagttaacgctcttggtgaacgtctgaagatcactgggtcggaggtcagcaagcagatggcggccggcatgagctccatgagcttcaagatgaaggagctcttccaagcgccgactccggcggacaagattgttgaggacgccaccgcggagaatttggaggggcccgattggtccgccaacctggaaatctgcgacttgatcaacacggagaaggtcaacagtgtggacctgattcgtgggatcaagaagcggattgtgctgaaggaggctagggttcagttcctctccttgttccttcttgagaccattgtgaagaactgtgagaaggccttctcggaggttgcagcagagagggttctcgatgagatggtcaagttgattgatgacccacagacagtggtgaataacaggaacaaggcccttatgctgattgaagcgtggggagagtctggtgatgagctccggtacttgccagtctatgaggaaacctacaagagcctgaaatcaagaggtgtgcggtttcccggacgtgacaatgagagcctggtcccgatatttactccaccacgctcagttgctgaagctgaagctgatgcaaacttctcccaacagacctttgaagatgtgcatgtgcacacgtatactgccgaggaaacaaaggaagcttttgatgtagctcgtaacagcatggaacttctttccactgttctttcatcttcccctcagcaggatgctttacaggatgacctgacaaccactcttgtgcaacaatgctaccaatctcaacacactatccagagattcgttgagacagctggagacaatgaggcaatgctatttgaggccttgagtgtgaacgatgagatccagaaagtgctatccaaatatgaagagatgaagaaacccatgatatctgagcatgcagaacagccagtggtcataccaattgccacagagcacgaagattctgcaacagttggcaatgaagatgccctggtcagaaaaccagctggttctcgtgcaatgtcaggtggagatgatgatatcctcgatgatctcgatgagatgatatttggcaagaagggaggaagcagttcccaggaagtgcccaaaaggcaggatccaaagaaagatgacttaatcaacttttagatagcgtccaagcgagttacagatttcctcatgggattggaacttcagaagatgtctctgctgctttatactgctgaatgatgtctgtattcatccattagaagattacacgatccagttaggatttgagtctcttgtttatttgcatatgatgatacttgtgctccagggtttgttcagtcgagaagttgctgcacgcttctcatcagtttgttcaattgaaaagttgctgcacgctgctcatcgtctggtttcatggtttcatgcattggatgctgaattatttgttgatggaaaatatgttcagtatatgaagtatgtgaacgaaccttcttctttcatcgtctgtagctcgtttttttctgtctgcggttactcaggcaatttgctatgcctgcgaaaccattgctggatgctatttttgagttcagtcaagcacttgaaatataacaggatttcttattggagaatggtgacatcaaaatgaaccatctttaacattatcatggacccaacccaatacatggttctcctcaattgtgagagtagtcgcatacaaaaacatatagacacacaatttcatcccccatttccacacactgcacaaggtgtatcttgaattgccgttctcaagtgattggaatggagcaatgcaaggtctcttgtaaacaaactcttcaggctgtggctggggaggcgagtttggctctgagttccttcctcagaatcttccctgacgccgactttgggatcgcgtgggtgaagtacaccttgtgcagcctcttgtaaaacaccacctgagaattggccggaggaagaaaaaaattacgggtcagagatagcatagactcgtcaaccaaagatgtcgtcgcttgtaggtagctactactgtgagtgcggaactacctgcttggacacgaactccttgatagcctgctcggtgacgtcggaatctgcggcgcgcactacgaaggcgaccggaacctcaccggcggcgtcatccttttgcctgccaattttacatgcatgcttccagttcattaccccgagcagtacattctgcttatgatacaactgatcgttgaacgatatcgaaggaccgggagagtgtggtcttacgagacgacggccgcgtcggcgatggacggatgcgcgatgagcagagcctccagctcggccggcggcacctacagggccaccacacaagtgcactgcttgttcagaaggcagtaacatacgctgaagactggcacacgctgttttgcagatgtcgtgtttgttgttggtacctggaagcccttgaacttgatgagctccttgacgcggtcgacgatgaacacctcgtcgtcgtcgtcgacgtagccgatgtcgccggtgtggagccacccctcgacgtcgatggtcgcggcggtggcctcggggtcgttcaagtagcctgcacggtcgcacaaagttgcagctgtcagttggcgttcgttcggtaccccgcctagtcgcctacgataacagccgaatggtagcactacctttcatgatctgtgggccgcggatgcagatctcgccggggaggttccgggcgagggagaagcccgtgtcggggtcgaccaccttgagctgggcgttgcgcaccaccgtgccgcacgacccggacttggccggcgtcggctccctggcgaacgcggggcacatggacagcaccggcccggcctccgtcatcccgtacccctgcaacgtaccg

SEQ ID NO: 2164 - DNA, 1627 bp, Avena sativa
cacttggcactttggcagtagcaaggagacctcgactcgaaggcaggcaccggcaggcgcaagaactccaacggaacgaacaaacgacgcgggcggggcggctggtcaaatctacgcgtgctccacttcgattcgaccccccctcctccgcctccttcgattttcgtcgcggaagcgaaaatgagtgacaatctgatggagaaagtgaacgccctcggcgagcgtctgaagatcaccgggacggaggtcagcaagcagatggcggccggcatgagctccatgagcttcaagatgaaggagctcttccaggcgcagactccggccgacaagatcgtcgaggacgccaccgcggagaacttggaggggcccgattgggccgccaacctggaaatctgcgacctcatcaacacggagaaggtcaacagcgtcgacctgatccgcgggatcaagaagcggatcatgctcaaggaggctagggttcagttcctcgccctcttccttctcgagaccatcgtcaagaactgcgagaaggccttctccgaggttgcggccgagagggttctcgatgagatggtcaggctgattgatgacccccagacggtggtgaataacaggaacaaggcacttacactgattgaggcgtggggagagtctggtaatgagctccgctacctgccagtctatgaggaaacatacaagagcctgaaatcaagaggagtgaggtttcctggacgtgacaatgagagcctggcccccatatttactccaccacgctcagtcgctgaagctgaagttgaagcaaacttctcccaccaggcatttgaagatgtgcatgtgcatacatatactgccgaagaaacaaaggaagctctggatgtggctcgtaacagcatggaacttctttcaactgttctttcatcttctcctcagcaggatgttttgcaggatgacttgacaaccactcttgtgcaacaatgctaccaatctcaacacactatccagagattcatcgagacggctggagacgacgaggccctgctctttgaggccttgagtgtgaacgatgagatccagaaaatgctatccaaatatgaagagatgaagaaacccacggcgccgacgcatacagaacagccagttgtcataccaattgccacggagcatgaagaccccggatttgttggcaatgaagatgccctggtaagaaaaccagctgcttctcgagcaatgtcaggcggagatgacgatatccttgatgatcttgatgagatgatatttggcaagaagggaggagggagcagttcccaggaagggcccaaaaggcaggacccaaagaaagatgacctgatcaacttttaaataccgtcccagcaagtcagggagttcctctagggatacacaacacatgtctgctgctttttatgttgctgaacgatgtctgtattcatccagtagaagatttcacattcaattaggatttgggtcggttgtttgtttgcatacgatgatacttgtcctccacagtttgtcagttgatatatgttgctgcaaacttctcatctcttggtttcattgttgcatgcattagatgctgcattatttcctgatggaaaatatgtttcatatg

SEQ ID NO: 2165 - DNA, 1686 bp, Triticum aestivum
ccccccaaaagccgaaggagacctcgactggaaggcaccgccgggcgcaagaactccaacgaacaaaccacgcggggcggccggtcaaatctacgccaccaggcgtgcgagggcctcgccgcagttcgattcgactcccccctcctccgcctccctcgattctcgccgcggaagcgaaaatgagcgacaatctcatggaaaaagtgaacgctctcggcgagcgcctcaagatcaccgggtcggaggtgagcaagcagatgcaggccggcatgagctccatgagcttcaagatgaaggagctcttccaggcgcagactccggccgacaagatcgtcgaggacgctaccgccgagaccctcgaggggcccgactgggccgccaacctcgaaatctgcgacctgatcaacaccgagaaggtgaacagcgtcgacctgatccgcgggatcaagaagcggatcatgctcaaggaggccagggttcagttcctcgccctcttcctcctcgagaccatcgtcaagaactgcgagaaggccttctccgaggttgcggccgagaggattctcgatgagatggtcaggctgattgatgacccccagacggtggtcaataacaggaacaaggcccttacgctcattgaggcatggggagagtctggtgatgagctccgctacttgccggtctatgagcaaacctacaagagcctgaaatcaagaggaattcggtttcctggacgtgacaatgagagcctggcccccatatttactccaccacgctctgttgctgaagctgaagttgctgcaaatttctcccagcagatattcgaagatgtacatgtgcatacatatactgctgaagaaacaaaggaagctttcgatgtggcccgtaacagcatggaacttctttcaactgttctttcatcctcccctcagcaggatgctttgcaggatgacttaacaaccactcttgtgcaacaatgctaccaatctcaacatactatccagagattcatcgagacggctggagacaatgaggccttgctctttgaggccttgagtgtgaatgatgaggtcctgaaagtgctatccaaatacgaagagatgaagaagcccatggcgtcggcgcgtacagaacagccagtggtcataccaattgccacggagcatgaagattccgtgactgttggcaatgaggatgccctggtcagaaaaccagctgctgctcgagcaatgtcaggcggcgatgatgatatcctcgatgatcttgatgagatgatatttggcaagaagggaggaagcagttcccaggacgtgtccaaaaggcaggacccaaagaaggatgacctaatcaacttctaaataccgtcccagcaagttgcggagttcctctagggatacacagcatgtctgctgctttttatactgctgaacgatgtctgtattcatccggtagaagactgcactgcacgtacattcagttagggatttgggtcgcttgtttatttgcatacgatgataccttgtcctccagagtttgttcagttgataagttgctgcatacttctcgtcttctggtttcatggttatatgcgtcagatgctgaattttactccctccatcccgaattaagtgtctcaacttaactttaggacaactttgtatttaagttagtacaaagttgagatactta

SEQ ID NO: 2166 - DNA, 1696 bp, Brachypodium distachyon
cgcccagaggttatgagctctttcgcccctagccaagcgtcctgtttctcgcgagcgagcgcgaccttcgggagtaccaagactcgtcgtttcaaccgccgttcgccagatctgacgcctccttcccctgcggccggcgagggcagcaaagatgaatgacaatctgatggacaaagtcacagcactgagtgagcgcctcaagatcactgggtcagaggtcagcaagaagatgacggcgggcatgagctccatgagcttcaagatgaaggagctcttccaagcgcagacccccgcagacaagttcgtcgaggaggccacctcggagaacctggacggtcctgactggtctgcgaacctcgaaatctgcgacttgataaactcggagaaggtcaacagcgtggacctgatccgtgggatcaagaagcggatcgtgctcaaggacgccagagttcagttcctctccttgttccttctcgagaccgtcgccaagaactgcgagaaggccttctcggagattgcagctgagagggttcttgatgagatggtcaggctgattgatgatccccagactgtggtcaataacaggaacaaggcacttatgctgattgaagcgtggggtgagtctggtgaggagctccgatatctgccggtctatgaggaaacctacaagagcctgaaatcaagaggagtgaggttccctggacgtgacaatgagagcttggtccccatatttactccaccacgttcagttgctgaagctgaagttcaagcaaacttcacgcaacagaccttcgaagatgtgcatgtgcatacatatactgccgaagaaacaaaggaagcttttgatgttgcgcgtaacagcattgaacttctttcgactgttctttcatcttcccctcagcaggatgctttgcaggatgacttgacaaccactcttgtgcaacaatgctaccaatcccaacacaccatccagagattcgtcgagacggctggagacaacgaggccatgcttttcgaggccctgagcgtgaatgatgagatccagaaagtgctatctagatacgaagagatgaagaaacccttggcgtcggcaaacgctgaacacgagccggtggtcataccgatcgccacggaacatgaggattctgccaccgtcgggagcgaagacgcccttgtcagaaaaccagccggttctcgagcaaggcccggggcggacgatgatatcctcgatgatctggatgagatgatattcggcaagaagggaggaagcagctcccaggaagggccccaaaagcaggatcccaagaaagatgacctgatcaacttctgaacaccatcccagttattagtccctgggatctgaagatacttgctgcttttagctgtgaattattcatcagggcaaacctttagggtttgaaggtcacttgtttagctgtttgcatatgtgatcattcatacatgtgatccacggtcttgagttggtaagtcctttgatcatcatccggtttcacgcattggatgctggattactcttgatgaagaacttgtgttagtatgtgaatgaagcttgattagatctttcttgtgccatcatatttatatggtcgagttgaacccttctgtggttgcatgctctaattggatacaaaagaatcaataaaagcttccattgtctggagaatacagcttttat

SEQ ID NO: 2167 - DNA, 1756 bp, Hordeum vulgare
gttttagtctcttgaatccaagcagctgtagagttgttggcacttggccaaaagcccaccaaaatctgaaggagacctcgactggaaggcaccggcgggcgggcgggcgaactccaaccaacaaaccacgcggggcggccggccaaatccacgccaccacccacgcctgcgagggcctcgccgccgcagtccgattcgactcccctcctcaccccgcctccctcgatccccgccgcggaagcgaaaatgagcgacaatctgatggagaaagtgaacgccctcggcgagcgcctcaagatcaccgggtcggaggtgagcaagcagatgcaggccggcatgagctccatgagcttcaagatgaaggagctcttccaggcgcagaccccggccgacaagatcgtcgaggacgccaccgccgagagcctcgaggggcccgactgggccgccaacctcgaaatctgcgacctcatcaacaccgagcaggtgaacagcgtcgacctgatccgcgggatcaagaagcggatcgtgctcaaggaggccagggtccagttcctcgccctcttcctcctcgagaccatcgtcaagaactgcgagaaggccttctccgaggttgcggccgagaagatcctcgatgagatggtcaggctgattgatgacccccagacggtggtcaataacaggaacaaggcccttacgctcattgaagcgtggggagagtctggtgatgagctccgctacttgcccgtttatgagcaaacctacaagagcctgaaatcaagaggaatacggtttccgggacgtgacaatgagagcctggcccccatatttactcctccacgctctgttgctgaagctgaagctgctgcaaatttctcccagcaggcattcgaagatgtacatgtgcatacatatactgctgaagaaacaaaggaagcttttgatgtggcccgtaacagcatggagcttctttcaactgttctttcatcctcccctcagcaggatgctttgcaggatgacttaacaaccactcttgtgcaacaatgctaccaatctcaacatactatccagagattcatcgagacggctggagacaacgaggccttgctctttgaggccttgagtgtgaacgatgaggtacagaaagtgctatccaaatacgaagagatgaagaagcccatggcatctgcgcgtacagaacagccagtggtcataccaattgccacggagcatgaagattccgtgactgttggcaacgaggatgccctggtcagaaaaccagctgctgctcgagcaatgtcaggcggcgatgatgatatcctcgatgatctcgatgagatgatatttggcaagaagggaggaagcagttcccaggacgtgtccaaaaggcaggacccaaagaaagatgacctaatcaacttctaaataccgtctcagcaggttgggaagttcctctagggatgcgcaacatgtctgctgcttttatactgctgaacgatgtctgtattcatccggtagaagactgcactgcacgtacattcagttagggattgggtcgcttgtttatttgcatacgatgatactttgtcctccagagcttgttcagttgataagttgctgcaaacttctcatcttcctgtttcatggttatatgggttagatgatgaatttttttatttctcatggaatgaatagctcttgttccgtcgtcgtccgtagtcattcgcttttctgtctggtcactcaggcgattgcttgt

SEQ ID NO: 2168 - DNA, 1337 bp, Cenchrus ciliaris
ttcaagatgaaggagctgttccaggggcagactccggccgacaagattgtcgaggacgccacttcagagaacctggacggaccggactggaacttaaacttggagatttgcgacctggtcaacacggagaaggtcaacagcgtggagctcatccgtggcatcaagaagcggatcatgctgaaggacgcgaggatccagtacctctccttgattctgctcgagaccatcgtgaagaactgtgagaaggccttctcagaggttgcggctgagcgggttcttgatgagatggttaggttgattgatgaccctcagacagttgtgaacaacaggaacaaggcccttatgcttattgaagcgtggggggagtctggtgatgagctacgctacctgccagtctatgaggaaacctacaagagcttgaaatcaagaggagtgcggttccctggacgtgacaacgagagcttggcccccatatttactcccccacgatcagttgctgaagctgacattgatgcaaacttgccccagcaggcttttgaagacgtgcatgttcatacatatactgcggaagaaacaaaagaagcatttgatgttgctcgtaacagcatagaacttctttcaactgttctttcctcttcccctgagcaggatgctttgcaggatgacttaacatccactcttgtgcaacaatgccaccaatctcggcacactatccagagaatcatcgagacggttagtgacaatgaagctgtgctctttgaggccttgagtgtgaacgatgagatccagaaagttctatccaaatacgaagagatgaagcaacccagagcctcggagaatgcagaacaacgcccagtggtcataccgattgccacggaacatgaagattctgctgctgttggcaatgaagatgccctggtcaggaaaccagctggtgcaagggcaaggtcaagtggggatgatgatatcctggatgatctcgacgagatgatatttggcaagaaaggaggtagcagttcccaggaagcgccaaaaaagccggatccgaagaaagatgatctgatcagcttttaagcacctttccaacatcgcagccagtacttgctattttatggtgcgctgtactcagtcggtagaagattgcagactctgtaggatttggatcgcttgtttattgggatacgatcattcctgccccttttacagtttgttcagttgttaagttgctgcactctctcaatcctctggtttcatgggtgagcggtgagcccatgaatgtattggatggtgaattatgccccgatggaaaaaatatgtttgactgaatctttgctcca

SEQ ID NO: 2169 - DNA, 1658 bp, Secale cereale
cacaacagttgttggcacttggcagccgcaccaaaagccccccaaaaagccgaaggaaccctcgactggaaggcaccggcgggggaacgcaagaactccaacgaacaaacgacgcgggcggccggccggtcaaatccactccacgcgtgcgagcgcctcgccgcagtccgattcgactcccctcctctcccccgcggccctcgatcctcaccgcggaagcgaaaatgagcgacaatctgatggagaaggtgaacgcgctcggcgagcggctcaagatcaccgggtcggaggtgggcaagcagatgcaggccggcatgagctccatgagcttcaagatgaaggagctcttccaggcgcagaccccggcggacaagatcgtcgaggacgccaccgccgagggcctggaggggcccgactgggccgccaacctcgaaatctgcgacctggtcaacaccgagagggtcaacagcgtcgacctgatccgcgggatcaagaagcggatcatgctcaaggaggccagggttcagttcctcgccctcttcctcctcgagaccatcgtcaagaactgcgagaaggccttctccgaggttgcggccgagaggattctcgatgagatggtcaggctcattgatgacccccagacggtggtgaacaacaggaacaaggccctcacgctcattgaggcctggggagagtctggtgatgagctccgctacttgccggtctatgagcaaacctacaagagcctgaaatcaagaggaatacggtttcctggacgtgacaatgagagcctggcccccatctttactccaccacgctctgttgctgaagctgaagttgctgcaaatttctcccagcagacattcgaagatgtgcatgtgcatacatacactgctgaagagactaaggaagctttcgatgtggcccgtaacagcatggaacttctttcaactgttctttcatcctcccctcagcaggatgctttgcaggatgacttaacaaccactcttgtgcaacaatgctaccaatctcaacatactatccagagattcatcgagacggctggagacaatgaggccttgctcttcgaggccttgagtgtaaacgatgaggtccagaaagtgctatctaaatacgatgagatgaagaagcccatggcgtcggcgcgtacagaacaaccagtcgtcataccaatcgccactgagcatgaagattccggggctgttggcaacgaagatgccctggtccgaaaaccagctgctgctcgagcaatgtcaggtggcgatgatgatatcctcgatgatctcgacgagatgatatttggcaagaagggaggaagcagttcccaggaagcgtccaaaaggcaggacctaaagaaggatgacctaatcaacttctaaataccgccccagcaagttccggagttcctctagggatacacagcatgtctgctgcttttatactgctgaacgatgtctgtaatcatccggtagaagactgcactgcacgtacattcagttagggattgggtcgcttgtttatttgcatacggtgatgctttgtcctccatatttgttcagttgataagttgctgcatatttctgtcttctggtttcatggttatatgcgtcagatgctgaattttatttcttaaagtc

SEQ ID NO: 2170 - DNA, 1668 bp, Secale cereale
gcagtactcagtggagtcaagtgagtgtgcggccgcacgtgtgggagttcgccacgaacagaactggagcaccagccgccgccccgccgctgactttcctctccgccgccgccgccagatctggtttggtctgccacccccttccccggaccccgccgcggtggttggtttaattagcagcggagaagatgggcgacaacctgatggacaaggtgacggcgctgagcgagcagctgaagatcaccgggacggaggtcggcaagaagatgacggccggcatgagctccatgagcttcaagatgagggagctcttcctggggcagactccggccgacaagatcgtcgaggacgccacctccgagagcctggaggggcctgactgggccatgaacctggagatctgtgacctgatcaatgccgagaaggtgaacagcgtggatctggtccgcgggatcaagaagcggcttgtgctcaaggatgcaagggttcagttcctctccctgtcccttctcgagaccgtcaccaagaactgcgagaaggtgttctccgaggttgccgccgagaaggttctcgatgagatggtcaggttggtggatgatccgctgaccgtggtgaataacaggaacaaggcgcttatgctgattgaggcttggggagagtccggcgaggagctccgctacctgccggtctacgaggaaacctacaagagtctgaaatcaagaggagtgcggtttcctggacgcgacaacgagagcttggtccccatatttactccaccacgctcagttgctgaagctgaagctggtgcaaacttcacgcaacagacgtttgaagatgtgcatatgcatacatatactgctgaagaaacaaaagaagcttttgatgttgcgcggaacagcatagagcttctttcaactgttctttcatcttcacctcagcaggatgctttgcaggatgacttgacgaacacccttgtgcaacaatgctaccaatcccaacacaccatccagagattcgtcgagacggccggggacaacgaggccatgctcttcgaggccctgaccgtgaacgatgagatccagaaagtgctatccagatacgaagagatgaagaaacccgtggcgccagcgcacacggagcaagagccggtggtcataccgatcgccgcagaagcagagcacgaggatgccgccgccgtcgggagcgaagaggccctggtcagaaaaccggccggtgctcgagcaaagcttggggaagacgacggtatgctcgatgacctcgatgagatgatattcggcaagaagggaggggacagcagctcctcccaggaggacgcggatggggcccaaaagcaggacaagaagaaagatgacctgattaacctctgaacaccggacgtcctccaaagccagttcctgggatgagaaggcacgcaagttttagactaccacagaaatgctcctgactgtatttcatctagatctagtagaggattggacattcattagggttcaggtctttcatctacttatctgcacccgatcgatcatcggtagctcagtagttgtgccgcggttatttgcgtcatcttctggttttgtggatgcatctcgatcaatctatgtagtatgtaccaccaatacatgcatctttttagacagttgtgaa

SEQ ID NO: 2171 - DNA, 908 bp, Zea mays
atctccacccctcgcgcgtgtccgctgactctcgcctcccgtcgcgttcttatccatccaccccgtccggcacccatttatatcctgtcgtccctccctccctccttcggccacaccgtgtcacaccgctgcttgcttgcttgcgatcgggtttggatttggggagcatcatggaggcctacttcttgttccacagcgggagggcgcacgagttcgcgtacgcggagcaggaggaggacatcggctcgccgtcggattccgaacccccgtccacgtccacgtcgagggagtccgcgggctcgtcggcggagctcgacgacgacgccacctcctccggctccggctccggctcggaccgcttcgagatgtccgccctcatgacgcagctccctcccttcaagcggggcctgtccaggttcttcgacggcaagtcgcagtccttcgcctcgctcgccgccgtggggtcgctagaggacctgcccaagccggcccggaagcgcctcaagccgtcgcggagctgcggcggcgccctcgacgcgcaccgcggacgcctcctctcgccgcgcaggcattattgcaccaagcccaccgctaggactaggaaggcagccgcgaggagcggcacgttgtcggttctcgcggccggcgcgccgaggatgccgccggcggtggcgagggccgagggcgtggccgccaaggttctgatcgtcagttgagccgcggatcggcctgcctgagctcaacatcgacgcacacactcgcaggctcagctagtacggaccgccgcatccacccctctgcctgaagctgttcggttttctttttgtttcccaatgcgtctgtgatctgatctctttgtaatgaaaacgcgcagctcaattagaatgaacttcagttggaaactcaca

SEQ ID NO: 2172 - DNA, 1321 bp, Saccharum officinarum
gtgtctccgtcgaccacgcgtccgcagtcacgcgcgcgcgcgccacggcagaccagaccaccacgcccgcccgccactgagctccgcccccctggtactggtaccacccctgcccagcccagcggctccaagattgacgccacgatgggcttccccgtggggtactcggagatgctgctcccgcgcgtgctgctgcaggtgctcctcatcctctgccacctccaccgcttcctcctctgggccttccacgccgtggggctcggcgacctcatcgacctcggctgcaactaccccccgccgccttcctccgcgcccacaacggcggcagcgcaggagcaccagcaccagcaccaggggcgcgacgacgtggccgcgccgctgcagcaccggcggccggacttccggtccgtcccggcggtgctcgtcgacgaggcgctccccgtggtgcggttcgacgagctggccgggaccgcgtgcggggacggcgactgcgcggtgtgcctcagcggcatcggcggcggcgacgaggtgcggcggctcaacaactgccgccacgccttccaccgcgcctgcctcgaccgctggatggcgcacgaccagcgcacctgcccgctctgccgcgcgccgctcatccccggggccgcggacccctgggcagccggcgtggcgccgtggcccgacgcgggcgactacgacatgtcctacccgtcttccctgccgtccacgccgctgctggcgttgcccaccccgacgctgctgcggcctcacgagctgctgctcaccggcctcggcggcttccagtgagctgctgcgcctgcgtgtgcgtggctggcggttgggcaggccacgcgaatcggatccgtggcaaggcaaaccgcgtcctgtcctcatgtgcggcccaccccgcccggtcggtcagacgggtgaccgccgcccaaattcccctgctcggccgtcactcaagtcttcggtcgtgtctccgttggtgaaaggcgaaaccaacggcagaggagaccgccctggtttttacagcggctcccaacagtttaaaaagcgaggcgaaacagataaggcaccaggaaactagccaatttggttgatgtgtaggccgattccgtcttccaaacctgtggagttgtgaatccttttgcagattattattattatataaactagaatctgttaacaagagctctagatcccgtgcagtctggctccatttgtgttgcgccattccgcatcgatggatcactcgaccctgtttgtccagctaagacaaatctaactcgatatctatggtttccacctggtttatataagc

SEQ ID NO: 2173 - DNA, 1574 bp, Panicum virgatum
ccgagcccacaagaccaccgctcgcccaatcccaagagagagaagagaccaacgcgcccgcacacgcaaaccaaccaaccacggagtactctccccgcggccgtcaccgatgcttccgcgttactccccgcactccccctgcagcgctgctccgctcgccgctttataaacgagctgcccccgctcagtcctccactcctcctccacgcacgcacgagcgcggcagcaccaccacgccccgccacgccaccacggagctccgctccggtccgcagcccaccggcggctccaaccaagatcgacgcgacgatgggcttccccgtggggtacccggagatgctgctcccgcgcgcgctgctgcaggcgctcctcctcctgggccacctccaccgcttcctcctctgggccttccacgccgtggggctcggcgacctcatcgacctcggctgcaacgactactactaccccgcgccgccctccgcggcggcggagcgaacaaccgggcgcgacgcggccgcgccgccgctgcagcaccggcggccggagttcaggcccgtccccgcggtgctcgtcgaggaggcgctccccgtggtgcggttcgaggagctggcggccccggcgtgcgggggcggcgactgcgcggtgtgcctgagcggcatcggcgccgccgacgaggtgcaccggctcagcaactgccgccacgccttccaccgcggctgcctcgaccgctggatggcgcacgaccagcgcacctgcccgctctgccgcgcgccgctcatcccgggatccgccgccgcgggggaccccggctgggcagccgccgccgcgccgtgggccgacgctgccaccgactacgacatgtcctacccgtcgtcgctgccgtcgacgccgctgctgatggtgcccaccccgacgctgctgcggccgcacgagctgctgctcaccggcctgggcggcttccagtgagccgctgccgctgcgtggctggcagactggcaggtcacgcgggatccgtggcgaggcaaaccgcgtcgtcgtcatgtgcggcccgcaccgcccggtcggtcagacgggtgaccgccgccaaagctggtcacccaccgcccaagcccgctgcagcagcacacggttggcctcgtgccgtgtcatcgtcttccacgacggcctcggcccgtcggccggcgaaaccaacggcaaaggagaccgccccggtttttacagcggctccggcaaaagattgaaaaaaaaagaaaatttaggaaattaattacgcaagtaggttgccgtgtaggatgattccatcttccaagccagtggagttgcgaatctttatgtagatgatatgaaatttgctgaacatgaactctggatcccgtgcagttttaattttgctccgctcgagccgtttcttcgcctcaaatcattcgaattatatatttcccccgacccatttgcccgtgtccagctaagaagatggatatgagggtatccggcgccacgctgaagacaaacccgactcgagatattctaacctgacgaggaaaacaagcctggttcttcgtattttctttacg

SEQ ID NO: 2174 - DNA, 1755 bp, Panicum virgatum
tcccgcggactggggctgatttagcgagggaggagtattgtagcggctcattactatagaaaaaattaatgtagagttctaaatatcgagaatttgatcatatgcggtggttcggctggacaagccaacaaacagcgtgaccgatgtttcctcgttaactcccctgcagcgcagctccgctcgccgctttatatacgagcagccccccgctcaggttcagtcctcctccacgcacgcacgcacacgagcgcggcagcaccaccacgccaccactgagctccggtccgcagcccatcggctggcagctcgaagatcgacgcgaccatgggcttccccgtggggtactcggagatgctgcttccgcgcgcgctgctgcaggtgctcctcctcctggggcacctccaccgcttcctcctctgggccttccacgccgtggggctcggcgacctcatcgacctcgcctgcaacgactaccccgcgccgccctccgcggcggtggcggagcgagccgtcgcgccgccgctgcagcaccggcggccggagttcaggcccgtccccgcggtgctcgtcgaggaggcgctccccgtggtgcggttcgaggagctggcgggcacggcgtgcgggggcggcgactgcgcggtgtgcctgagcggcatcggcgccggcgacgaggtgcggcggctcagcaactgccgccacgccttccaccgcggctgcctcgaccactggatggcgcacgaccagcgcacctgcccgctctgccgcgcaccgctcatcccggggtccgtcgccgcgggggaccccaccggctgggccgccgccgccgcgccgtggtccgacgccgccgccgagtacgacatgtcctacccgtcgtcgctgccgtcgacgccgctgctgatggtgcccaccccgacgctgctgcggccgcacgagctgctgctcaacggcctgggcggcttccagtgagccgctgccgctgcgtgcgtggctggcagactggcaggtcacgcggatccgtggcgaggcaaaccgcgtcgtcatgtgcggcccacaccggccggtcggtcagacgggtgtccgccgccaaaggcccaaagctggtcacccaccggccaccgcccaagtctgctgcagcagcgcacgggttggcctcgtgccatcatcgtcttcgacgacctcgacccgtccgtcggccggcgaaaccaacggcaaaggagaccgccccggtttttacagcggctccggaaaggaatacgaatgaaaaaagagaaaaaaattaggaaattaattaagcaggtagtaggttgctgtgtaggccgattccatcttccaagccagtggagttgcgaatctttttcaagtgattcaatttcggcttgtctcgacttatctcctctcacataatactattcattctaccagccgaatactattcactggatcagccgaacagcctcgaaatgaaatttgctgaacatgaactctggatcccgtgcagttttcgctccactcgggccgtttcttcgcctcaaatcattcgaattatatattccccccacccatctaagaagataaatatccgacccggcgccacgccgaagacaaatccagctcgagatattccaacctgacgaggaaaacaaacccggttctccgtcttttctttgcggtttccacctggtttatttaacgacaatttaagtgaccgggattagcaagctgatgaccgacgatccgatcacgtttgagtgtttg

SEQ ID NO: 2175 - DNA, 1094 bp, Setaria italica
cgatgtttccgcgttcctcctcgcactcctgctcagctccccgctttataaacgacctgcccccggttcagtcctccacctccacgccacgcacgaacgcgccaggcaccacatcgcccgccaccactaagctccgctccgcagctccatccaagatcgacgcgacgatgggattccccgtggggtactcggagatgctgctcccgcgcgtgctgctccaggtcctgctcctcctggggcacctccaccgcttcctcctctgggccttccacgccgtggggctcggcgacctcatcgacctcggctgcaacaattacccgctgccagcctccgcggcggcggcggtgcaggagcagcccgggcgcgacgcggtcctcgcgccgctgcagcaccggcggccggagttcaggaccgtcccggcggtgcacatcgaggaggcgctccccgtggtgcggttcgaggagctggccggcacggcctgcggtggcggcgactgcgcggtgtgcctgagcggcatcggcgccggcgacgaggtgcggcggctcagcaactgccgacacgccttccaccggggctgcctcgaccactggatggcacacgaccagcgcacctgcccgctctgccgcgcgccgctcatccccggagccgccggcgccgccgccggggacccctggggcgcctccgccgccgactacgacatgtcatacccgtcgtccctgccgtccacgccgctgctgacggtgcccaccccgacgctgctgcggccgcacgagctgctgctcaacggcctgggcggcttccagtgagccgctgcccctgcgcgcgtggctggcaggccacgcgaaaccgtggcgaggcaaaccgcgtcctcatgtgcggcccacgccggccggtcggtcagaagggtgaccgccgccaaagctgctcaaccaccactcgagtctgcagcagtagcagtggagcacacggttggcctcgtgcccctcggtcttcgacggcctcggccgccggcgaagggcgaaaccaacggcaaaggagcccgccccggtttttacagcggctccccaaggggatagaaaaaaaaagtactaaaa

SEQ ID NO: 2176 - DNA, 2099 bp, Zea mays
gcagcaccggcggcactcactctcgccaaccacgcataaattattcggttctctttgccactaccgtcgcctccgcgacggagacagcgcgctatagcctgcgcgtttcgggactcgcgcagcggcagtcctcagctcccgagacgtccctctctccctccgagacgcaggtagagcggcgcgttcccctgcttcgggtatgtcgtactgcgccggcgccacggcggcgttccgggacgccgacggtgccggcgaggaggccctgaccgcctgtttgctccccaaaaccgaggtccggctagcggttgaggacctgccgccggtgctcacgagcaagccgccaggccggttcgcgagggcggtgaaggaagcctggtccgtctcgctgtccgtcacattccccatgatgccgtcgatgtcggccggcgcagcgggcgcggaggcgcggtccatcctgagcctcgcgctgccgatgatcctcacggggctgctgctatacctccgctccatgatctcgatgctcttcctcggtcgcctaagcgggctggcgctggccggcggctcccttgccatcggcttcgctaacatcacgggatactctgtgctgtccggcctcgccatgggcatggagccaatctgcgggcaggccttcggcgcgggccactacgagctcctcggcgtcaccacgcagcgaggcgtgctgatgctgctcgcggccgccgtgcccatcggtggtttgtgggtgcacatccggcctctgctcctgctctgcggccaggacgccggcatcgccgcggtcgccgagacatacattcttgcctccctgccggacctactcctccaggcgttcctccaccccgtccgcatctacctacggacgcagtccatcaacctgcctcttaccctgtgcgccacgctcgccattgcgctccaccttcccatcaactacgtgctcgtctctgtcctgggcctcggcatcaggggggtggcattggcctccgtactcgccaacttgaacctcctcctctttctcttcgcttacatcctcttcaagggcgtccacaagcgcaccggcggcttcgcgctgtcggccgagagcttccgcggctggggcgagctcgtcagcctcgccctgccgagctgcgtcagcgtctgcctcgagtggtggtggtacgagatcatgatcctcctgtgcggcctcctcgcgaacccgcaggcaacggtggctagcatgggcatcctcatccagaccacgtcactcatctacatcttcccttcctcgctgggcttgggcgtctcgacgcgcgtcagcaacgagctcggcgcgaaccggcccgaccacgcgggccgtgcggccacggttggcctcatgctcgggttcgcgttcggcggcgtggcgtccgcgttcgcgtacctcgtgcgcggcgcgtgggcgaccatgttcacggccgacccggcgatcgtcgcgctcaccgcggccgtgctgcccatcctgggcgcttgcgagctcggtaactgcccgcagacgaccggctgcggcgtgctgcggggcagcgcgcggcccaaggacgccgccagcatcaacctccggtccttctacctggtgggcacgcccgtggcgctcgtcctcgccttctggtaccactacgacttccagggcctgtggttgggcctcctcgcggcgcaggcgacctgcgtggtgcgcatgctgctggtgatcggggggacggattgggtcgccgaggccaagcgcgcgcagcagctcaccggagcacgcacggtggaggaaacgaaagagagcagcggcaagagcagtcacgtcgttgaagtcacagcagccggcggagacgaggagctgggcttgcctatcgacgttgtgatcgatagaccaaaggatcagtgctgacatccaacgcaagcatctgcttgccattcaacatttggagcgattttttgttatataatttttggcgggagggagaggaaccgcaagctgacagagtgacaattttgtttcgaattggttgtttgtaaatgattattttcgatggttattagaggaaatgagattattgacaggaaaacgaaacatatacttt

SEQ ID NO: 2177 - DNA, 2115 bp, Setaria italica
gcagcaccggcggcaggggcagcactctcgccatccacgcataatttattcaattctccttgtcagcaccgtcgcggcgtcgcctccgcgccggagacagctcgctcgctagcctgcacgtttcgggactcgcgagcgagtaacggggctcctctcctctccctgcgaaacgcacgcggaggcagagcgtttcctctgtttcgggcatgtcgttgtcttgcggcgccgccacggtggcgtgccgggatgccgccggcgaagaggccctcctcgcggcctccctcctcctccccaaggccgaggtcctcgtgccggtggaggacgagctgacggcgccaccggtgctcacgcgcaagccgaggggccggctcgccagggcggtgaaggaagcctggtccgtgtccctgtccgtcacattccccatgatgccgtccatgtcggccggcgcggcgggcgcggaggcgcggtccatcctgggcctggcgctgccgatgatcctcacggggctgttgctgtacctccgctccatgatctccatgctcttcctcggccgcctcggcgggctggcgctcgccggcggctccctcgccatcggcttcgccaacatcacggggtactccgtgctgtcggggctcgccatgggcatggagcccatctgcgggcaggccttcggcgcgggccactacgagctcctcggcgtcaccacgcagcgcaccgtgctgatgctcctcgcggccgccgtgcccatcggcgggctgtgggcgcacatgcggcccctgctcctgctttgcggacaggacgccggcatcgccgccgtagccgagacctacattctcgcctccctccccgacctgctcctccaggcgttcctccaccccgtccgcatctacctccggacgcagtccatcaacctgcccctcaccctgtgcgccgcgctcgccatcgcgctccacctgcccatcaactatgtgctcgtctccgtcctcggcctcggcatcaggggggtcgcattggcctccgtgctcgccaacctgaacctccttctcttcctcctcgcctacatcctgttcaagggcgtgcaccggcgcaccggcggcttcgcgctctcggccgagagcttccgcggctggggcgagcttgccggcctcgcgctgccgagctgcgtcagcgtctgcctcgagtggtggtggtacgagatcatgatcctcctctgcggcctgctcgccgacccgcaggcgacggtggccagcatgggcatcctcatccagaccacgtcgctcatctacatcttcccttcctcgctcggcttcggcgtctcgacgcgcgtcagcaacgagctcggtgcgaaccgccccgaccaagccggccgcgcggccacggccggcctcatgctcgggttcgcgttcggcggcgtggcgtccgcgttcgcgtggctcgtgcggggcgcgtgggcgaccatgttcacggccgacccggcgatcgtggcgctcaccgcgtccgtgctgccgatcctgggcgcctgcgagctcggcaactgcccgcagaccgccggctgcggcgtgctgcggggcagcgctcggcccaaggacgccgccagcatcaacctccgatccttctatctggtgggcacgcccgttgcgctcgtcctcgccttctggtaccactacgacttccagggcctgtggctgggcctcctcgcggcgcaggcagcctgcgtcgtgcgcatgctgctggtgatcggccggacggattgggccgccgaggccaagcgcgcgcagcagctcgccggagctgctggcgcggtggagaccaaagagggcatggaagttggaggagacgacaagccgggcgtgactatcgacgtagtgatcgagcgaccaaaggatcaatgctgacacaagggcaggcaaccgtgtgtgcgccaatcgacatttcgagccattcttttgtcatattttttggcgggagaggaaccagaggctgacagagcgaaaattttgtttccaattggttgtttgtaaatgatttcttttcttttcttttctttttctgatgatggatattatagaagatgagaacattgacaggaaatatcgaagggattcgttttcttct

SEQ ID NO: 2178 - DNA, 2047 bp, Panicum virgatum
gcgcgcatagtttattcaattccccggtgtcagttccgtcgcctccgcgccggagacagctcgcccgctcgctaccccgcacgtttccggacgactagcccagctcccgaaacgtccctctctcctcgcccctccctgcgaaaacgctcgtggaggcagagccattcctctgtttcgggcatgtcgtcttgcgcagccgccgccgccgccggcgaggaggcgctcctcacggcgcccctgctcgcccccgtggtggccgtggcgggagagctgctgcccccggtgctgcccgcgcgcaagccgcgggggcggctcgccagggcggtgaaggaagcctggtccgtgtccctgtccgtcacgttccccatggcgccgtccgtgtcggcggccgcggcgggcgcggaggcgcgctccatcctgggcctcgcgctgccgatgatcctcacgggcctgctgctctacctccgctccatgatctccatgctcttcctcggccgcctcggcgggctcgcgctcgcggggggctccctcgccatcggcttcgccaacatcacgggctactccgtgctctcgggcctcgccatggggatggagccaatctgcggccaggccttcggcgccggccacaacaccctcctcggcgtcaccacgcagcgcaccgtgctcatgctcctcgccgccgccgtgcccatcgccggcctctgggcgcacatgcggcccctgctcctgctctgcggccaggacgccggcatcgccgccgccgccgagacctacattctcgcctccctcccggacctgctcctccaggcgctcctccaccccgtccgcatctacctccgcgcgcagtccatcaacctgcctctcaccctctgcgccgcgctcgccatcgcgctccacctccccatcaactacgtgctcgtctctgtcctcgggctcggcatccgcggggtggcattcgcctccgtcctggccaacctcaacctcgtcctcttcctcctcgcctacatcctcatcaggggcgtgcaccgccgcaccgacggcttcgcgctctcgcccgagagcttccgcggctggggcgagctcgccggcctcgcgctgccgagctgcgtcagcgtctgcctcgagtggtggtggtacgagatcatgatcctgctgtgcggcctgctcgccaacccgcaggcgacggtggccagcatgggcatcctcatccagaccacgtcgctcatctacatcttcccttcctcgctcggcttcggcgtctccacgcgcgtcagcaacgagctcggcgccaaccgccccgcccacgccgcccgcgcggcgacggtcggcctcgtgcttgggttcgcgttcggcggcgcggcgtccgcattcgcgtacctcgtgcggggcgcctgggcggccatgttcacggccgacccggcgatcgtcgcgctcaccgcgtccgtgctgcccatcctgggcgcctgcgagctcggcaactgcccgcagaccgccggctgcggcgtgctgcgcggcagcgcgcgacccaaggacgccgccagcatcaacctccgctccttctacctggtgggcacgcccgtggcgctcgtcctcgccttctggtaccactacgacttccagggcctgtggctgggcctcctcgcggcgcaggcggcttgcgtcgtgcgcatgcttctggtgatcggccggacggattgggccgccgaggccaagcgcgcgcagcagctcgccggagcaggaggcgcggtggagatcaaagacggcatggaggttggagcggccgggggggacgacgagccgagcatgcctatcgtcgtggtgatcgagcgaccgcccaaggatcagtgctgattgaactgctgacacagcgcacccgtgtgtgccattcgacatttcgagccattcttttgtcaaaaattttggcgggaggggtacgagaggctgacagagtgaaattttgtttgcaattggttatttgtaaatgatttcttttttctccttgtatggatattatagaagatgagaacattgacaagaaacatcaaga

SEQ ID NO: 2179 - DNA, 2059 bp, Panicum virgatum
cgcatagtttattcgattccccggtgtcagttccgtcgcttccgcgccggagacagctcgctcgctaccccgcacgtttccttagcccggctcccgaaacgtccctctcctctccctgcgaaacgcgcgcggaggcagagcgattcctctgtttcgggcatgtcgtctcgcgccgccgccgcggtggcgtgcggggatgccgccggcgccggcgaggcgacgctcttcactgcgcccctgctagcccccgaggccggggagggagagatgccgccgcccccggtgctgctctcgcgcaagccgcggggccggctcgccagggcggtgaaggaagcctggtccgtgtccctgtccgtcacattccccatggcgccgtccgtgtcggtggccgcggcgggcgcggaggcgcgctccatcctgggcctcgcgctgccgatgatcctcacgggcctgctgctctacctccgctccatgatctccatgctcttcctcggccgcctcggcgggctcgcgctcgccggggggtccctcgccatcggcttcgccaacatcacggggtactccgtgctgtcgggcctcgccatggggatggagcccatctgcgggcaggccttcggcgcgggccaccacgggctcctcggcgtcaccacgcagcgcaccgtgctgatgctcctcgccgccgccgtgcccatcggcgggctctgggcgcacatgcggcccctgctcctgctctgcggccaggacgccggcatcgccgcggccgccgagacctacattctcgcctccctcccggacctgctcctccaggcgctcctccaccccgtccgcatctacctccgggcgcagtccatcaacctgcctctcaccctctgcgctgcgctcgccatcgcgctccacctgcccatcaactacgtgctcgtctccgtcctcgggctcggcatccgcggggtggcattggcctccgtgctggccaacctgaacctcgtcctcttcctcttcgcctacatcctgatctggggcgtgcaccggcgcaccggcggcttcgcgctctccgccgagagcttccgcggctggggcgagctcgccggcctcgcgctgccgagctgcgtcagcgtctgcctcgagtggtggtggtacgagatcatgatcctgctgtgcggcctgctcgccaacccgcaggcgacggtggccagcatgggcatcctcatccagaccacgtcgctcatctacatcttcccttcctcgctcggcttgggcgtctcgacgcgcgtcagcaacgagctcggcgcgaaccgcccggaccacgcggcccgcgcggcgacggtcggcctcgtgctcgggttcgcgttcggcggcgtggcgtccacgttcgcgtacctcgtgcggggcgcctgggcggccatgttcacggccgacccggcgatcgtcgcgctcaccgcgtccgtgctgcccatcctgggcgcctgcgagctcggcaactgcccgcagaccgccggctgcggcgtgctgcggggcagcgcgcggcccaaggacgccgccagcatcaacctccgctccttctacttggtgggcacgcccgtggcgctcgtcctcgccttctggtaccactacgacttccagggcctgtggctcggcctcctcgcggcgcaggcggcctgcgtcgtgcgcatgctgctggtgatcggccggacggattggaccgccgaggccaagcgcgcgcagcagctcgccggagcaggaggcgcgctggagatcaaagacggcatggaagttggagcggccgggggagacgacgacccgggcatgcctatcgtcgtagtgatcgagcgaccaaaggatcagtgctgaactgctgactcagcgcacccgtgtgtgccattcgatattgcgagccattcttttgtcaaaatttttggcgggaggggaacgagaggctgacagagtgcaattttggttgcaattggttatttgtaaatgatttcttttttcccattttttatggatattatagaagatgagaacattgacaggaaacaaacatcaagggttcctctttttt

SEQ ID NO: 2180 - DNA, 2065 bp, Brachypodium distachyon
tcttttttccaacgcctcgccgccggagacagcggccttgtgtgtttgttttcgtctttcggaactcccgtgggagacggaacggagtcaatccaggaatcatcaatcctgaaacgtccctctccctcgacagcgcggggcagagcagcaagcttccctgtctcgggagagaggccatgtcgtcccgctctgacgccacggtggcgtgccgagatggctctcctgcgggccatggcgtcacggcctccttgctctccaaagcggagttcgtcgtgcccgtgcccgtgcccgtggaggaggagctgctgcctccagtgctcacgagcaagccgacgccatcggctgatcggctcgccagagcggtgaaggaagcctggtccgtttctctgtccgttacattccccatgctgccgtccatgtcggccgccgcggcaggggaggaggcgcgctccatcctgggcctcgccatgcccatgatcctgacggggctgctcctctacctccggtccatgatctcgatgctcttcctgggccgcctcggtggcctggcactcgccggcgggtccctcgccatcggcttcgccaacatcaccggctactctgttctgtccggcctcgccatgggcatggagcccatctgcgggcaggccttcggcgcgggccactacgagctcctgggcgtgaccatgcagcgcaccgtgctgctgctcgtggcggccgcggtcccgatcggcgggctatggatgcacatgcggcccctgctcctgctctgcggccaggacgtgggcatcgcggccgtcgccgagacctacattctcgcctcgctcccggacctcctgctccaggcgttcctccaccccgtccgcatctacctccgtacgcagtccatcaacctgccgctcaccgtgtgcgccgcgctcgccattgcgctccacctgcccatcaactacgtgctcgtctccgtcctcggccacggcatcaggggcgtggcattggcctctgttctcgccaacctaaacttcctcctcctcctcttgggctacatactgtgcaagggcgtgcaccggcgcaccggcagcttcttcgcgctctcggctgacagcttccgcgggtggggcgagctcgtcagcctcgcgctgccgagctgcgtcggcgtctgcctcgagtggtggtggtacgagatcatgatcctgctctgcggcctgctggccaacccgcaggccaccgtggcgtccatgggcatcctgatccagaccacgtcgctcatctacatcttcccttcctcgctgggcttcggcgtgtccacccgcgtcagcaacgagctcggcgcgaaccgggccgagcgggccggccgggctgccacggtgggcctcatgctcgggttcgcgttcggcggcgcggcctcggcgttcgcgtacgccgtgcggggctcgtgggccgccatgttcacggcggacccggcgatcgtggcgctcacggcgtccgtgctgccgatcctgggcgcgtgcgagctcggcaactgcccgcagacggccggctgcggggtgctgcgcggcagcgcgcggcccaaggacgccgccagcatcaacctccggtccttctacctcgtgggcacgcccgtggcgctcgtgctcgcgttctggttccgctatgactttcagggcctgtggctcggcctcctcgcggcgcaggcggcatgcgtggtgcgcatgctgctagtgatcggccggacggattgggaagcagaggccaagcgcgcgcagcagctcacggcagcaggctgcgtcgtggcagcaccggtggtatacacgaaacagagcagcggcaaaggcattcacgtcgcgagagtgccggcagccggcggtgacgaggagtcggggctgcttgtagacgttgtgatcgagcaaccaaaagatgagtgctgacccctacgtcatgttccagatttcgggccattctattttttttttcttcttcatatttttggcgggagaggaatcggaggctgaaaattttgttacccattggtaatatgtaaagatttgttttctctgattattatcat

SEQ ID NO: 2181 - DNA, 2105 bp, Triticum aestivum
ctctcaccaaccaagcacgaatctgtttcttctgccaacgattccgtcgcctcggcgccggacacagcggcttgtctcgtggcagacggaacggagtcaatccaacaatcaaccgggcggatcccgagacgtccctctccctcctgagctcggggcagcggagcagctagctcctctgcttcgcggaggccatgtcgtcctgctccgactccacggtcaccatgtcgtaccgacatggtgagcatgcgggcgatggcatcacggcccctttgctccccaaggcggaggtggtcgtgcccatggaggagctgccgccagtgctcacttgcaagccgccaggtcggcttgccagagcggtgaaggaagcctggtccgtttctttgtccttggcattccccatgctgccgtcgatgtcggccgccgcggccggggaggaagcgcggtccatactgggcctcgcgatgccgatgatcctcacggggctgctgctctacctccggtccatgatttcgatgctcttcctcggccgcctcgggggcctggcactcgccggcgggtcactcgccatcggcttcgccaacatcaccggctactccgtgctgtctggcctcgccatgggcatggagccgatctgtgggcaggccttcggcgcaggccattacgagctcctcggcgtcaccatgcagcgcaccgtgctgctgctcgcgcgccgctgttcccatcggcgggctgtggatgcatatgcgacctctgctcttgctctgcggccaggacgtcggcatcgcagcggtcgccgagacctacattctttcctccctgccggacctcctcctccaggcattcctccaccccgtccgcatctacctccggacgcaatccatcaacttgccgctcaccgtgtgcgccgcgctcgccattgcactccacctgcccatcaactacgtgctcgtctccgtcctcggacacggcatcaggggggtggcatttgcctctgttctcgccaacctaaacttccttctcctccttcttggttacatattggtcaagggagtgcataagcgcaccggcggctttgtgttctcggccgagagcttccgtggctggggagagctcgtaagcctcgccctgccgagctgcgtcagcgtctgcctcgagtggtggtggtacgagatcatgatcctcatgtgcggcctgctcgccaacccacaggccactgtggcctccatgggaatcttgatccagacgacgtcactcatctacatcttcccttcctcgcttggcttcggcgtgtccacccgcgtcagcaacgaactcggcgcaaaccgtgccgagcgcgcgggccgtgccgccacggttggcctcatgctcgggttcgcgttcggcggcgcggcatcggcgttcgcgtacatggtgcggggctcgtgggctggcatgttcacggcggacccggcgatcatcacgctcaccgcgtccgtgctgccgatcctgggagcatgcgagctcggtaactgtccgcagacggcggggtgcggcgtgctgcggggcagcgcgcggcccaaggacgccgccagcatcaacctccggtccttctacctcgtcggcacgccggtggcgctcatcctcgcgttctggtaccactacgacttccagggcctgtggctcggcctcctcgcggcgcaggccgcctgcatggtgcgcatgctgctggtcatcgggcggacagattgggcgcggaggccaagcgcgcgcagcagctcaccggagcaggcacagtaacggtggcagtggacacaaaaccgagcagcggcaaaggcattcacgtcgtgagagtcgcggccggcggcggcgatgagaactccgggctgcttatcgatgttgtcatcgagcaaccaaacgatcagcgctgacagctacggcctatttacgatttcggacaactctttttttttccttcatacttttggcgggagaggaatcggaggctgacagagtgacaatttttgttagccattggtaatctgtatagagttttttaatcttctgatatatcggtgcagtattacagaagtcgaaaggattcgattgcaatatgaaagttatctttt

SEQ ID NO: 2182 - DNA, 1800 bp, Hordeum vulgare
gccatgtcgtcctgctccaacgccacggtcacggtgtcgtgccgacatggcgaggatgcgggcgatggcatcacggcctctttgctccccattgccgaggtggtcgttcctgtggaggagccgccgccggttctcacttgcaagcctccaggtcggcttgccatagcggtgaaggaagcctggtccgtttctttgtccttgacatttctcatgctgccgtcgatgtcggccgccgcggctggggaggaggcgcggtccatactgggactcgcgatgccgatgatcctcacggggctgctgctctacctccggtccatgatttcgatgctcttcctcggccgcctcgggggcttggcactcgccggcggctcactcgccatcggcttcgccaacatcaccggctactccgtgctttctggcctcgccatgggcatggagcccatctgcgggcaggccttcggcgcaggccattacgagctcctcggcgtgactatgcagcgaaccgtgctgctgctcgtcgcggccgctgttcccatcggcgggctgtggatgcatatgcgacctctgctcttgctctgcggccaggacgtcggcatcgcagcggtcgccgagacctacattcttgcctccctgccggacctcctcctccaggcgttcctgcaccccgtccgcatctatctccggtcgcagtccatcaacctgccgctcaccgtctgcgccgcgctcgccattgcactccacctgcccatcaactacctgctcgtctccgtcctcggacacggcatcaggggggtggcagtggcatccgtgctggccaatctaaactttctcctcttcctccttggctacgtattgtacaagggagtgcacaagcgcaccggcggctttgcgttctcggccgagagcttccgtggctggggagagctcgtaagactcgccgtgccgagctgcgtcagcgtctgcctcgagtggtggtggtacgagatcatgatcctcctgtgcggcctgctcgccaacccacagtccactgtggcctccatgggaatcttgattcagacgacgtcactcatctacatcttcccttcctcgcttggcttcggcgtgtccactcgcgtcagcaacgaactcggcgcaaaccgtgccgtgcgcgcgggccgtgccgccacggtgggtctcatgctcgggtttgcgttcggcgccgtggcgtcggcgttcgcgtacctggtgcggggctcgtgggctaccattttcacggcggacccggccatcatcgcgctcaccgcgtccgtcctgccgatcctgggagcatgcgagctcggtaactgtccgcagacggcggggtgcggcgtgctgcggggcagcgcgcggcccaaggacgccgccagcatcaacctccggtcgttctacctcgtcggcacgccggtggcgctcgtcctcgcgttctggtaccactacgacttccagggcctgtggctcggcctcctcgcggcgcaggcggcctgcatggtgcgcatgctgctggtgatcgggcggacggattgggctgcggaggccaagcgggcgcagcagctcaccggagcaggcgtggtaacggtggcagtggacacaaaaccgagcagcggcgaaggcattcacgtcgtcagaatcgcggccggcggcggcgatgagaactccgggctgcttgtcgatgttgtggtcgagcaaccaaacgatcagcgctgacagctacggcctacttacgatttcggacaactcttttttttccttcacagttttggcgggagaggaatcagaggctga

SEQ ID NO: 2183 - DNA, 2129 bp, Oryza sativa
caccaaccaaacaagctgttttttgtcaaccattcctctgctcctcccccggcctggggagtggagcgccaaatcgtccatcgcgagctagcctccgaaccggagacaagaagcgccccacgcccacgcgcgtgcgtttccgagccgaaacgtaacgcccccgcgcggcgcgttgcgttgttccacctgtttcggctatgtcgtcgccgcgccgagatggccgtggcgcggtcgacgacctcacggcgtccttgctccacaagggggatggtggggaggcggtgttcgtcgtcgtcgttgttcccccggtggcggaggaggaggagccgccgccggtgctcacgtgcaagccgcctggacggtttgctagagcggtgaaggaagcctggtccgtcccgttcccgatgatgccgtccatgtcggccggcgcggcgggcgccgaggcccggtcgatactggggctcgcgctgcccatgatcttgacagggctgctgctttacctccggtcaatgatttcgatgcttttcctcggccgcctaggtggtctggcgctcgctggcgggtccctcgccatcggcttcgctaacataacaggatattcagtgctgtctggcctcgccatgggtatggagcccatctgcgggcaagccttcggcgcgggccattacgatctcctcggcgtcaccatgcagcgcaccgtgctcctgctcgtcgcggcctccgtccccatcgccgggctgtgggtgcacatgcggcctctgctcctgctctgcggtcaggacgccgccatcgcggcggtcgccgagacctacattcttgcttctcttccggacctcctcctgcaggcgttcctccaccccgtacgcatctacctccggacgcagtccataaaccttccgctcaccgtgtgcgcggcgctcgccattgctctccaccttccgatcaactacgtggccgtctctgtcctcgggctcggcatcaaaggggtggcattggcctctgttctggccaatctaaacctcgtcctcttcctctttggctacatatggttcaagggcgtgcacaagcgcaccggcggcttcgcgctctcagcggattgcttacgcggctggggcgagctcgtcagcctcgccctgccgagctgcatcagcgtctgcctcgagtggtggtggtacgagatcatgatcctcctgtgcgggctgctcgcgaacccgcaggccaccgtggcgtccatgggcatcctgatccagaccacgtcgctcatctacatcttcccttcctcgctcggcttcggcgtctccacccgcgtcagcaacgagctcggcgcgaaccggcccgagcgcgcctgccgagccgcgacggtgggcctcatgctcgggttcgcgttcggcggcgtggcgtccgcgttcgcgtgccacgtgcgcggcgcgtgggcgaccatgttcaccgccgacccggcgatcgtcgcgctcaccgcgtccgtgctgccgatcctgggcgcctgcgagctcggcaactgcccccagacgaccgggtgcggcgtgctccgcggcagcgcgcggcccaaggacgccgcaagcatcaacctccggtcgttctacctcgtcggcacaccggtggcgctcatcctcgcgttctggtaccactacgacttcaggggactctggctcggcctcctcgcggcgcaggcgacctgcgtggtgcgcatgctcctcgtgatcggggagacggactggaccgcggaggccaagcgcgcgcagcagctcaccggagcggcggacatcaaggattgcggcggcaaaggcgatcacgtcgcagtgattgagcaaccagatgagcagtgttgacaagctacgggcgttcaacattgccgtcggctcctcggcttaccttttttttttccatatttttggcgggagagaaaccagaggctaacatatgacaattttgttaccaattggtaatctgtaaagattcttttctgatggttattacagaaggtgaaaaaattcaaaggaaatatcaaagattttttcctctgacaaaaagtcaccctaacagtaacatttcgctaaagctgccatccctggtcaaagtgtgcattggcggcttatgtttgcagataaacg

SEQ ID NO: 2184 - DNA, 2002 bp, Triticum aestivum
cgtacttgagtaggcggtaaattgcccgggagttacaccgcccggcgccgtaaaagctctgcggaaccgcacgagcggcagggccgctcctctgtttccatccatgacgtcctgcggaggcgccaccgcggcatgcccggacggccgcgtcatcaccgcccccctgctcgccaagccgggggaggtcgtcgtccaggtctgcggtgacgaggcggccgcgccggtgctcacgtgcaagccgcccggccggcttgccagggcggtgaaggaagcctggtccgtttctttgggcatcgcgctcccgatgatgccgcccgtgtcggccaccgcggcccgcgacgaggcgcgctccattctcggcctcgcattcccgatgatcctcaccgggctgctgctctacctccgctccatgatttcgatgctcttcctcggccgtctcggcgggctggcgctcgccggcggttccctcgccatcggcttcgccaacatcaccggatactctgtcctctccggcctcgccatgggcatggagccgatatgtggccaggcattcggcgcgggtaactactcgctcattggtgtcaccgtgcagcggacggtgctcctcctcatcgcggccgccgtccctatcggtggcctgtggatgcacatgcggcctctgctcctcctctgcggacaggacgccgccatcgccgccgtggcggagacctacattcttgcctcactgcctgacctcctcctccaggcattcctccatcccgtgaggatatatctccggatgcagtccataaacctgccactcaccgtgtgcgccacgctcgccattgccatccacctgcccatcaactacgtgctggtgaccgtgctcggcctcggcgtcaagggagtggcaatggcgtccgtgctggccaacctgaacctgctcctcttgcttctcgcttacatcttcttcaaaggcgtccacaagcgcacgggcggcttcgcactctccgccgagagcttccgtggctggggcgagctcatcagcctggctctgccgagctgcgtgagcgtgtgcctcgagtggtggtggtacgagatcatgatcctgctgtgcggcctgctcctgaacccgcaggccacggtggcgtccatgggcatcctgatccagaccacgtcgctcatatacatcttcccttcgtcgctcagcttcggcgtgtcgacgcgcgtcagcaacgagctgggcgccgggcagcccgagcaggcgagccgcgccgcgacggcggggatcatgctcggcttcgcgttcggcgccttcgcctccgcgttcgcattcctcgtccggaacgtgtgggcgagcatgttcacggccgacccggcgatcatcgcgctcaccgcgtcggtgctgccgatcctgggcctgtgcgagctgggcaactgcccgcagacgacggggtgcggcgtgctgcgcggcagcgcgcggccaaaggacgcggccaacatcaacctccggtcgttctacctggtggggacgccggtggcgctggtgctggccttctggttccactacgacttcgagggcctgtggctggggctgctggcggcgcaggccacctgcatggtgcgcatgctcctggtgatcgggcggacggactgggcgggcgaggccaagcggtcgaagcagctcaccggctccgacgcccagggcaaagttggcgcggccgacggagacgagaagtcgcggctgcttatcgacgacgcggacatcgagcggccgaacgatcggtgttgatagctacacagggggggcgtgtgcattgtaatctactccctcttcttatttttaccatttttatttcctcccccgttggccatattttgggcggtgggggaggagctaggggctgacaaattttgttcacatttgctaatgtagccatgtaaagattttgctgattgttattggagaagatggggaaaatatctactcctcctagtacgtagtggtacttgttcgaaggaa

SEQ ID NO: 2185 - DNA, 2245 bp, Hordeum vulgare
gacaaaagtatcccgagaaagaagtgtgaattgtaaaacgcccctcctctcctctgccttcccgcgcctatataagaggcgcctccgagcttcccatttccccgcgcggcgcagagctccaccaaccaagcactacccgcctccggagaggagacaagaggcaaagaaaaaaaaacgctccttctctctccccccccccgcctgctcccctccggagttaaacggcgtcctacttgtaaatcgcccgggggagttacaccgcccggcgccgtaaaagctctgcgagaccgcacgagcggcagggcgctcctctgtttttcatcccatgacgtcctgcggaggcgccaccgcggcatgccccgatggctgcgccatcaccgcccccttgctcgccaaggccggggaggtcgtcatcccggtctacgccgacgaggcggccgcgccggtgctcacgtgcaagccgcccggccggcttgccacggcggtgaaggaagcctggtccgtttctttgggcatcgcgctcccgatgatgccgcccgtgtccgccgccgcggcccgggacgaggcgcggtctattcttggcctcgcattcccgatgatcctcaccggcctgctgctctacctccgctccatgatctcgatgctcttcctcggccgtctcggcgggctggcgctcgccggcggctccctcgccatcggcttcgcgaatatcaccggctactctgtcctctccggcctcgccatgggcatggagccgatatgtgggcaggcattcggcgcgggcaattactcgctcattggcctcaccgtgcagaggacggtgctcctcctcatcgcggccgccgtccccatcggtggcctgtggatgcacatgcggcctctcctcctcctctgcggacaggacgccggcatcgccgccgtcgccgagacctacattcttgcctcgctacctgacctcctcctccaggcattccttcatcccgtgaggatatacctccggatgcagtccgtaaacctgcccctcaccgtgtgcgccacgctcgccattgccatccacctgcccatcaactacgtgctggtgaccgtcctcggcctcggcgtcaagggggtggcaatggcgtccgtgctggccaacctgaacctgctcctcttgcttcttgcctacatcttcttcaagggcgtccacaagcgcaccggcggcttcgcgctctccgccgagagcttccgtggctggggcgagctcatcagcctggccctgccgagctgcgtcagcgtgtgcctcgagtggtggtggtacgagatcatgatcctgctgtgcggcctgctcctgaacccgcaggccacggtggcgtccatgggcatcctgatccagaccacgtcgctcatctacatcttcccttcgtcgctcagcttcggcgtgtcgacccgcgtgagcaacgagctgggagccgggcagccggagcaggcgagccgcgcggcgacggcggggatcatgctcggcttcgcgttcggcgccttggcctccgcgttcgcgttcctggtgcgggacgtgtgggccagcatgttcacggccgacccggcgatcatcgcgctcaccgcgtcggtgctgccgatcctgggcctgtgcgagctcggcaactgcccgcagacgacggggtgtggcgtgctgcgcggcagcgcgcggccaaaggacgccgccaacatcaacctccggtccttctacctcgtcgggacgccggtggcgctggtgctggccttctggttccactacgacttcaagggcctgtggttcgggctgctggcggcgcaggcgacctgcatggtgcgcatgctgctggtcatcgggcggacggactgggcggccgaggccaagcgctcgaagcagctcaccggccaggacaaagttggcgcggccgacggagacgagaagtcgcgcctgcttatcgacgcagcagacatcgagcagccgaatgatcggtgttgatagctacgctacgcagcgcgagggagccgggggggcgtgtgcattgtaatctactccccctgcttcttatttttaccatttttatttccttcccctgctggccatattttggccggggcgggggggaggagcttagggcgctgacagggtgacaaattttggttcgcatttgctaatgtagccatgtaaagattttgctgattgttacttattattagagatggggaaaaaatatcttgttgaaagcaagctttgagacac

SEQ ID NO: 2186 - DNA, 1354 bp, Saccharum officinarum
ccgaaatcgtcgcttccgacgcaccagggccgcgcggcgccggtgatcttccccgtggcccttctacagaaccgacccgtgccggagccccgccgtcggatgcgacggagacggcgtcaatggcgtcctcctctgccgccgagcccagctcccgcatctccgatcgagcgaggaggtcgtcgctgggactcagattcatggtgctcctgatgcacgtgctgttcgttggagctgtcttcatcctcgatccaaccctcgactggcgaatccacgagcagccgtggtatatagggttgtatggagtgcttgtcctgctcacgttagtgcaatacttctacacagctggctcatctccagggtatgttattgatgtaatgagagctggttccatgatgcatgcaaccttcgtcaacactgctgctctttcgaagcagtcaaattcaagaaatggaaacacaaattccccgacgagtcgtgctcaactacagaaacttagcacggtgactcctacatcatcatgggcacagatggttatggatctttatcctccagggtcaagcagcagggattggacttgcgcttactgcagggttgttcagccacctcgtacccggcactgccatgactgtgataaatgtgtccttcaatttgatcatcactgcatatggcttggaacatgcattggcaaaaagaaccattgtcgtttttggtggtacatatttgaagaaacaatcttgtgtatctggactgctgctctctacatcgaatcattgcgtttagatgtggacaaggcctggtggaaggactttgttggtgtaatcctgttggcagtgcttatctttatccttatattcctactactattgtggttgtttcattcgtacattgctgtaacaaatcaaacaacctacgaagttgccagaagaaagcgaatattctacctaaggggagtacctgaaagagttcatccattcagtagaggcatatgcagaaatctctatgacttctgctgttctagccagaagggatatattctggaagctgtgcccccaagtgaggagctggaagctagagctgctcgttacacgtgccgagatgtcatttgctgccattgctgctgataggctgtaccatagcattctgcccatatagccagttccgctgttctttgttcaacctttcgctaatggaagcaaattttagtgacctgcgaccgttagatactctagagttcattatttgtgcatagtcatttgtacatttcactcagaaaatgtgtgccctgagatcaagttgttcacagtttgtctgtaaaattctgtatggccctgcattcaaataggctttcaggaca

SEQ ID NO: 2187 - DNA, 1562 bp, Setaria italica
gagacaatagtatgttctgtctgccaggcaggccccgccgggacggatccccctcccccgcttcttctaccgaaatcgtcgcttccgacgcctcagagccgcgcggcgccggtgaccttccttccccgggtcctcctactgagccgacgacccccgccgcagccccgccgtcggatgcgacggcgacggagacggcgtcaatggcgtcctcctccgccgccgagcccggcacccgcctttcggatcgagtgaggaggtcgtccctggggctcagattcatggtgctcctgatgcacgtgctcttcgtcggcgccgtcttcttcctcgatccgactctcgactggcgaatccatgaggagccgtggtatattggggtgtacggagtgcttgttctgctcacgctagttcagtacttctacacagctggctcatctccagggtatgttgttgatgtaatgagagctggttcctcaatgcatgcgaccttcgtcaatactgctgctctttcaaagcagtcaaattcaagaaatggaaacataagttccccgaccagccgtgctcaactacagaaacttagcacaatgacaccttcatcgtcatgggcgcagatggttatggatctatatcctccagggtcaagcagcagggattggacttgcacctactgcagggttgttcagccacctcgtacaaggcactgccatgactgcgataaatgtgtccttcaattcgatcatcactgcatatggcttggaacatgcattggcaaaaagaatcattgccgtttttggtggtacatatttcaagaaacaatactgtgtatctggactgctgctctctacatcgagtcattacgtttagatgtggacaaggcctggtggaaggactttgttggtgtaatattgctggcagtgttgatatttatccttatattcctactgctattgttggggtttcattcgtacattgctctaacaaatcaaacaacctatgaagttgccagaaggaagcgcatattctacttaaggggagtacctgaaagagttcatccattcagtaaaggcatatgcagaaatctctacgacttctgctgttccagccagaaaggatatattctggaagctttgcccccagctgaggatctggaagctagagctgctcgttacacatgccgagatgtcatttgctgccgttgctgctgataggctgtgccataggattctctgcccatctagccagttcctcagttctttgttcaacagttcgctaatggaagcaaattttagtgacctgcagccgttagatgctctcggagttcattatttgtgcatagccatttgtacattttcactcagaaaatgtgtgccctgagatccagttgctcagagttcatctgtaattctctatgccctttctttcacataggttttcaggacagatagaattggactgtacttgtgtcgagatgtacattcgaggtgtggtttgtagtttcagaatttagtctacaaatcctgagcagttcttgtttgtgttaccttttttttttttgcaaggtttgc

SEQ ID NO: 2188 - DNA, 1589 bp, Zea mays
gtctgccaggtaggacccgccggaacggatcccctgcttcttctaccgaaaatccgaaatcggcgccggtgaccttcccgtggcccttgtacaaaactgacccccgtcggagcaccgccatcggatgcgacggagacggcgtcaatggcgtcctcatctgctgtcgagcccagtttccgcctctctgatcgagagaggaggtcatcgctgggactcagattcacggtgctcctgatgcacgtcgtgttcgttggcgctgtcttcatcctcgatccgaccctcgactggcgaatccacgaggagccgtggtatatagggttgtatggagtgctggttctgctcacgctagtgcaatacttctacacagctggctcatctccagggtatgttattgatgtaatgagagctggttccatgatgcatgcaaccttcgtcaacactgctgctctttcaaagcagtcaaattcaagaaatggaaacacaaattctccaacgagtcatgctcaactacagaaacttagcgcgatgactcctacatcatgggcacagatggttgtggatctttatcctccagggtcaaacagcagggattggacttgcactcactgcagggttgttcagccacctcgtactcggcactgccatgactgtgataaatgcgtccttcaatttgatcatcactgcatatggcttggaacatgcattggcaaaaagaaccattgtcgtttttggtggtacatatctgaagaaacaatcttgtgtatctggactgctgttctctacattgagtcattgcgtttagatgtcgacaaggcctggtggaaggattttgtcggtgtgatcctgttggcagtgcttatctttatcctgatattcctactactattgtggttgtttcattcgtacattgctgtaacaaatcaaacaacctacgaagttgccagaaggaagcgaatattctacctaaggggagtacctgaaagagtccacccattcagtagaggcatatgcagaaatctctatgacttctgctgttctagccagaagggatatattctggaagctgtgcccccaagggaggagctggaagctagagctgctcgttacacgtgccgagacgtcatttgctgccgttgctgctgatagctgtactaccatagcattgtgcccatatagccagttccactgttctttgttcaaacctttcgttaatggaagcaaattttagtgacctgcggccgttagtgaactctcggagttcactatttgtgcatatgtcatttaaacagtgagaaaaatgtgtgccctttggtccagctgttcacagtttgtctgtaaaattctgtgtggccttgcatccaaataggttttcaggacaggtagaattgatctgcacattcgaggtctggttggtaatttcggaatttagtctaccgttttaaagcctttcttatttgtgttactagcgaaatattttatttatcttgataggtttttgtaacgttgtactgatacatcatgtggtactatttgcataatttgttgtttcggcattttagatgatgaatatagctgcaggctgtaaagca

SEQ ID NO: 2189 - DNA, 1472 bp, Zea mays
gaaacaaaagtatgttctgtctgccaggtaggtcccgccggaacggatcccctgcttcttctaccgaaatcgttgcttccgacgcaccagggccgcgcgccgccggcgaccttgccgtggcccttctacaaaaccgacccgcgccggagctccgccgtcggatgtggcggagacggcgtcaatggcgtcctcctctgctgccgagtccagctcccgcctctctgatcgagcgaggaggtcggcgctgggactcagattcatggtgctcctgatgcacgtgctgttcgttggcgctgtcttcatcctcgatccgaccctcgactggcgaatccacggggagccgtggtatatagggttgtatggagtgcttgttctgctcacgctagtgcaatacttctatacagctggctcatgtccagggtatgttattgatgtaatgagagctggttccatgatgcatgcaaccttcgtcaacactgctgctctttcaaagcagtcaaattcaagaaatggaaacataaattctccgacgagtcgtgctcaactacagaaacttagcacgatgactcctacatcttcatgggcacagatggttatggatctttatcctccagggtcaagcagcagggattggacttgcacttactgcaggattgttcagccacctcgcacccgacactgccatgactgtgataaatgtgtccttcaatttgatcatcactgtatatggcttggaacatgcattggcaaaaggaaccattgtcgttttttgtggtacatatttgaagaaacaatcttgtgtatctggactgctgctctctgcatcgagtcattgtgtttagatgtggacaaggcctggtggaaggactttgttggtgttatcctgttggcagcgcttatccttatcctgatattcctactactattgtggttatttcattcgtacattgctctaacaaatcaaacaacctacgaaattgccagaaggaagcgaatattctacctaaggggagtccctgaaagagttcttccattcagcaaaggcatatgcagaaatctctacgatttctgctgttctagccagaagggatatattctggaagctgtgcccccaagtgaagagctggaagctagagctgcccgttacacgtgccgagatgtcatttgctgtcgttgctgctgataggttgtaccatagcattctgcccgtatagcccagttgcgctgttctctgttcaaggttaagttaatggaagcaaattttagtgacctgcgaccgttagatgcccccagagttcattatttgtgcatagtcatttgtacatttcactcagaaaaatgtgcgctctgagatccagttgttcacattctgtatggctttgaattcaaataggttttcaggacagagaactgatctgtacttcagttttttagtcgaaatgtgtgttggtaatttattttaagattttctt

SEQ ID NO: 2190 - DNA, 1943 bp, Panicum virgatum
ctgagcggatgactagacctcccggctcagaagccgaatgccaaaagagcgacgccgccgccgagagccagcgccaggacggacgccatggacgctaggagatccacctcgtgtgcggggagggcgtcgtcaaggaggtcgggcatggagtcgaaggtgaagctgagctccgggaggagcgcccagacatggcaccagtggcggtagaggacgctggtccgcgcggcggccactttgtccgctccggctcccttcccgtcgccctcgccgggctcggggagcgcgctgaggcatccctcgccgacggcttcggaggaggaaagccgcgcggcgccggtgaccctccccttccccgggcccctcctccgacccgacccccgccgtcggatgcgacggcgacggagacggcgtcaatggcgtcctcctccgccgccgagatcggcacccgcgtcttctccgatcgagcgaggaggtcgtcggtgggactcagattcatggtgctcctgatgcacgtgctcttcgtcggcgccgtcttcgtcctcgatccgactctcggccggcgaatccatgaggagccgtggtatataggggtgtatggagtgcttgttctgctcacgttagtgcagtacttctacacagctggctcatctccagggtatgttgtcgatgtaatgagagctggttcaacgatgcatgcgacctttgtcaatactgccactctttcaaagcagtcaaattcaagaaatggaaacataagttccccaacgagccgtgctcagctacagaaacttaccacgatgactcctacttcatcatgggcacagatggttatggatctatatcctccagggtcaagctgcagggattggacttgcacttactgcagggtcgttcagccacctcgtaccaggcactgccatgactgcgataaatgtgtccttcaattcgatcatcactgcatatggcttggaacatgcattggcaaaaagaaccattgccgtttttggtggtacatatttgaagaaacaattctgtgtatctggactgctgctctctacattgagtcattacgtttagatgtggacaaggcctggtggaaggactttgttggtgtaatattgctggcagtgttgatctttatccttatattcctactgctgttattggggtttcatacgtacattgctctaacaaatcaaacaacctacgaagttgctagaaggaagcgcatatcctacttaaggggagtacctgaaagagttcatccattcagtaaaggcatatgcagaaatctgtacgacttctgctgttctagccagaaaggatatattttagaagctttgcccccaactgaggagctggaagctagagctgctcgttacacattccgagatgtcatttgctgccgatgctgctgataggctgtgccatagaattctgcccatttagccagatccacagttctttgttcaacagttcgctaatggaagcaaattttagtgacctgcaaccgttaggtgctcccaggagttcattatttgtgcatagtcatttgtacatcttcagctgctcagagttcatctgtaattctgtatgacctttctttcaaataggttcaggacagatagaattgtactcgtgtcaaaaatgtacattcgaggtgtggctggtagtttcagaatttagtctacgacatgagccgttcttgtttgctttactcaccaccaccgtctggtatttgcaaattttaccttaatagttttgtttttgtgattttttaccgatatgtggggtataatttgaatagttccttttgattatcttctaaagccaatttgttttggcattttcagatgatgattgtataaggctttaagcatcgaaagatgccagggctagactcaaatcgtttattttcatgagaatggtatgttcgctgatca

SEQ ID NO: 2191 - DNA, 1666 bp, Pennisetum glaucum
tccccctcccccctcttcttctaccgaaatcgtcgcttccgacgccccagagccgcgcgcctccggtgaccttccttccccggggtcctcctgctgagccaccgacccccgctgcagccccgccgtcggatgcgacggcgacggagacggcctcaatggcgtcctcctcctccgccgagcccggcacccgcctctcggatcgagtgaggaggtcgtcgctggggctcagattcatggtgctcctcatgcacgtgcttttcgtcagcgccgtcttcttcctcgatccgactctggactggcgaatccaggaggagccctggtatattggtgtgtacggagtgctcgttctgctcgcgctagttcagtacttctacacagctggttcatctccagggtatgttgttgatgtaatgagagctggttccacgatgcatgcgaccttcgtcaatactgctgctctttccaagcagtcaaattcaagaaatggaaatataagttccccgaccagccgtgctcaactacagaaacttagcacaatgacaccttcatcctcatgggcacagatggttatggatctatatcctccagggtcaaacagcagggattggacttgcacttactgcagggttgttcagccacctcgtacaaggcactgccatgactgtgataaatgtgtccttcaattcgaccatcactgcatatggcttggaacatgcattggcaaaaagaatcattgccgtttttggtggtatatatttgaagaaacaatactgtctatctggaccgctgctctctacatcgagtcaatacgtttagatgtggacaaggcctggtggaaggactttgttggtgtaatattgctggcagtattgatctttatccttgtattcctactgttattgttggggtttcattcgtacattgctctaacaaatcaaacgacctatgaagttgccagaaggaagcgcatattctatttaaggggagtacctgaaagagttcacccattcagtaagggcatatgcagaaatctctatgacttctgctgttccagccagaaaggatatatcctggaagctttgcccccagttgaggatctggaagctagagctgctcgttacacatgccaagatgtcatttgctgccgttgctgctgataggctgtgccatattattctctgcctatctagccagttccgcagttcgttgttcaacagctaatggaagcaaattttagcgaccagcagccgttagattctctcggagttcattatttgtgcatagccatttgtacattttcactcagaaaatgtgtgccctgagatccagttgctcagagttcatctgtaattctgtatgtcctttctttcacataggttttcaggactgagagaattggactgtacttgtgtcgagatgtacattcgaggtgtggcttgtagtttcagaatttagtctacaaccctgagcagtccttgtttgcgttactttccatcaggtatttctgtatctcatctccgtagtttttcttgtatttttgtaccaatatgtgggtataagttcgcaacaatttctgtactattatcttcaaaagccaatatatttcaatatttccaaacaaaaaaaaaaaaaaaaagtaaactactagcgttgataccaactgctt

SEQ ID NO: 2192 - DNA, 1388 bp, Panicum virgatum
gcggcgccggtgaccctccccttccccgggcccctcctccgacccgacccccgccgtcggatgcgacggcgacggagacggcgtcaatggcgtcctcctccgccgccgagatcggcacccgcgtcttctccgatcgagcgaggaggtcgtcggtgggactcagattcatggtgctcctgatgcacgtgctcttcgtcggcgccgtcttcgtcctcgatccgactctcggccggcgaatccatgaggagccgtggtatataggggtgtatggagtgcttgttctgctcacgttagtgcagtacttctacacagctggctcatctccagggtatgttgtcgatgtaatgagagctggttcaacgatgcatgcgacctttgtcaatactgccactctttcaaagcagtcaaattcaagaaatggaaacataagttccccaacgagccgtgcccaactacagaaacttaccacgatgactcctacttcgtcatgggcgcagatagttatggatctatatcctccagggtcaagcagcagggattggacttgcacttactgcagggttgttcagccacctcgtaccaggcactgtcatgactgcgataaatgtgtccttcaattcgatcatcactgcatatggcttggaacatgcattggcaaaaagaatcattgccgtttttggtggtacatatttgaagaaacaatcctgtgtatctggactgttgctctctacatcgagtcattatgtttagatttggacaaggcctggtggaaggactttgttggtgtaatattgctggcagtgttgatctttatccttatattcctactgctgttattggggtttcatacgtacattgctctaacaaatcaaacaacctacgaagttgctagaaggaagcgcatattctacttaaggggagtacctgaaagagttcatccattcagtaaaggcatatgccgaaatctgtacgacttctgttgttctagccagaaaggatttattttagaagctttgcccccaaccgaggagctggaagctagagctgctctttacacatgccgagatgtcatttgctgccgatgctgctgataggctgtgccatagaattctgcccatctagccagatccacagttctctgttcaacagtgcgctaatggaagcaaattttagtgacctgcaaccgttaggtgctcccaggagttcattatttgtgcatagtcatttgtacatcttcactcagaaaatgtgtgccctgagattcagttgctcagagttcatctgtaattctctatgacctttctttcaaataggttcaggacagatagaattgtacttgtttcaaaatgtacattcgaggtgtggctggtagtatcagaatttagtct

SEQ ID NO: 2193 - DNA, 1835 bp, Panicum virgatum
caagacgcgcaggagtgctgcagccgcaaaacgagccaccatcgggcatgagggctgggcgagtgagccatcatcgttggatcctgtttgcgcggccagattgctgttccaacaaatccagccggggctcggacctgaatttgttgctctcacttccagatgggccccacccaccgcgaggagacatgagacaatagtgtgttctgtctgccaggtaggccccgccgggacggatccctcgccccgcttcttctaccgaaatcgtcgcttccgacgccccagagccgcgcggcgccggtgaccttcccttccccgggcccctccaccgagccggcccctgccgtcggatgcgacggcgacggagacggcgtcaatggcatcctactccgccgccgagcccggcatccgcctcaccgatcgagcgaggaggtcgtcggtgggactcagattcatggtgctcctgatgcacgtgctcttcgtcggcgccgtcttcgtcctcgatccgtctctcggctggcgaatccatgaggagccgtggtatataggggtgtatggagtgcttgtcctgctcacgctagtgcagtacttatacacagctggctcatctccagggtatgttattgatgtaatgagagctggttcaacgatgcatgcgaccttcgtcaatactgctactctttcaaagcagtcaaattcaagaaatggaaacataagttccccaacgagccgtgcccaactacagaaacttaccacgatgactcctacttcgtcatgggcgcagatagttatggatctatatcctccagggtcaagcagcagggattggacttgcacttactgcagggttgttcagccacctcgtaccaggcactgtcatgactgcgataaatgtgtccttcaattcgatcatcactgcatatggcttggaacatgcattggcaaaaagaatcattgccgtttttggtggtacatatttgaagaaacaatcctgtgtatctggactgttgctctctacatcgagtcattatgtttagatttggacaaggcctggtggaaggactttgttggtgtaatattgctggcagtgttgatctttatccttatattcctactgctgttattggggtttcatacgtacattgctctaacaaatcaaacaacctacgaagttgctagaaggaagcgcatattctacttaaggggagtacctgaaagagttcatccattcagtaaaggcatatgccgaaatctgtacgacttctgttgttctagccagaaaggatttattttagaagctttgcccccaaccgaggagctggaagctagagctgctctttacacatgccgagatgtcatttgctgccgatgctgctgataggctgtgccatagaattctgcccatctagccagatccacagttctctgttcaacagtgcgctaatggaagcaaattttagtgacctgcaaccgttaggtgctcccaggagttcattatttgtgcatagtcatttgtacatcttcactcagaaaatgtgtgccctgagattcagttgctcagagttcatctgtaattctctatgacctttctttcaaataggttcaggacagatataatttacttgtttcaaaatgtacattcgaggtgtggctggtagtatcagaatttagtctatgacctgagccgttcttgtttgtgttactcaccatcaccatcaggtatttgcaaactttatcttcatagttttgtttttgtgattttttcccgatatgtgggtataattcgaatagttcctttaagattatcttctaaagccaatttgttttggcattttcag

SEQ ID NO: 2194 - DNA, 3505 bp, Zea mays
tccacttcaaatattttttaggctgcttcaaaaaacatggtttagaagtgctctaaatacttcaagtcaactccgttctagatgaacgctcgtttccctcccggcgactacttgcatccattaccggctattgcttccattaccgtccgcgcttagcactaaccacagtgaaaactgcgccactaaccgcagctttaaccccaattccatcaattagcggcgactgataaagtaattaagccggtggcgaagcatcctcgtccgcgtccgcatccgcaccgatccggtacgggagttctcggctccgacgccccacgcggccccgcctcgcgctccttcctcgaacacctcgccgccggctctcctcagctccgccgactcgcttcgctgtcctcctcgcccccagcctcctcctgatcccagattcgcctcgccggcccccggcgcccgccacgagcgccgtcaagcgaagccgttcttccctggcgcgcgccgctggcgtagctgccaggctccttccgccgaagcacatcgcggccagctggcgctcgtcgtccaccgtcgtcgcggcggacttcgtcctcctcccggaagcacagatccgcacaggctcggctgcatttctccacttgctggtaaggaagctcgctccgatggattactccgagggttagttccgccctggtcttccgtttctacgctgccagcaatcaagttccaacaagtcgtcgatggactgcgatttgttcgctgcgtggtggagcagcagcaccagattagtctccaggatttttcgggggtcagctgatgccccgggcccgtcgccagcgaggccagccatgccgcttcaccagaagcaggcggggctcgctgctagcaagctgggcgtggggacctcgaagaaacacagggcttttgtcgcaagcgatgagcagtggtacaacaagatttttgatccgtcaagcgacttcatcttgacatggaaccgcattttcctcttctcctgcttcgtcgcgctatttatagaccccctctatttctatgtgcccaagatcagctacggcagccccaaattctgtatcggaacagacacccgtttcgccgtcggtgttacattcttcagatcgattgcggatttattgtatgtcctgcacatcataataaagttcagaacagcatatatcaatccaagctcgactctgagggtgtttggaagaggggatcttgtcacaaatcccaaggaaattgcgtggaaatatatcagatctgacttagctgttgatgtggcagctgctttgcctttgccacagattattgtctggtttgtgataccagctataaagtattcctctgctgagcacaacaataacattctggtgctcatagttcttgctcagtatcttccaagattgtatctcatattccccttaacttatgaaattgtcaaagctactggagttgttgcaaagactgcttgggaaggagctgcatacaacatggtgctctatctgatagctagtcatgtgctaggtgcactgtggtatttgctatctgttgatcgccagacattctgctggaagacgaactgcctgaatgaaactggttgtgatcttaagtacctagattgtgacacgacaccaaatgctacatgggcgaatacgactgctgtcttcagtaattgtaatgctagcgataccaatataagttttgattttggcatgttcgagcctgcattgtctaatcaagcccctgctcaaagttttgcgatgaagtatttctattccctctggtggggattgcagaatttaagctgctacggtcagactcttactgtgagcacctatcttggcgagacgctgtattgtatattcttggcggtacttggtcttgtcttgtttgcgcatttgattggaaatgtgcagacctacctgcaatctattactgtgagggttgaggaatggagattaaagcaaagagatactgaggaatggatgagacatcgtcagcttccttgtgaactgcgggaaagggtgagacgatttatccagtacaagtggcttgcaacaagaggagtgaacgaagagtcaatattgcatgctctgcctgcagaccttcgacgtgacattaagcgccacctttgcctgggtcttgttcgacgggttccttttttctcccagatggatgatcagcttcttgatgccatctgtgagcgtcttgtatcatcactgtgcacaaaaggcacatacattgtccgtgagggtgatccggtgacagagatgctcttcatcatccgtggaaaactggaaagctccacaacaaatggtggccgcactggcttcttcaattcaatcaccctgaaacccggtgatttctgtggcgaggagcttcttggatgggctcttgtccccaggcctactacaaatttgccgtcatccactcggacagtgaaggcactgatagaagtagaggcctttgcgctccaggcggaggatctcaagtttgttgccagccagttcaggcggctgcacagcaagaaactgcagcacactttccggtactactcgcaccactggaggacgtgggcctcatgcttcatccaagctgcctggagacggtacaagcgaaggaagatggcaaaggacctgagtatgagggagtcattcaactccgttagattagacgaagtggataacgaagatgacgattctccgcccaagaatagccttgctctaaaattcatagctaggactagaaaagtgcctcagaacatgaaagagttgccgaagataacgaagccagacgagccagatttctcagctgaacccgaagactaaagttgtctttgcttatgctatcatgtacagtggtcatagctgactattgtgaattgctagtcctatttggttcgtgatggaggttacaagccaactaggtatggtgggtgaattgaacttgggttgacggtgccatctgtggatgtgaggaaggtaactcagaatatcaatgaaagcgtaatgaagcttctgactggtatatagactgaatggttgtaagttaactagttgctacgttcatgttgtatattcagacatctctgtgcctatagatttcttgaaaaaaaaaggaaagaaaaaacaagaatacatcattacatagactgtaatcttaaacatctgacataagggtgtggctacgttgtccgtggccgtggaggactgtaaatcatgagggtgtggcttctggtaaaatggctagcaccacgcagtgatgagagatatctcgttgagtcatcagggcgcagattcgaacaggggcggagctaggccgcggattcgaacaggcgcagagctaggcctgtttatcggtgtcagctgacaccggcggctttttgcaaaatcaatgagaaatatttgatatgcgttgtttatccatagagctgatatcagtgtctagtggaatcggctccttcagctggcttcgctccgcatttgtgagacaaaggttt

SEQ ID NO: 2195 - DNA, 4300 bp, Panicum virgatum
attaacccagagcgcggaggcatccgcattcccccgggagtttctgctccctcgcccgccccgactccctccttcctcgaactcctcgccgccggctcttcccaactccgccgactcgcctcgctggccccccctgcccctgcctgctcctggtgacctggtcccggattcgcctggccggtctcctgcacctcgccggcggccgggtcgtcgccctcaccgctgggtggctgtcaccaccaaacaatccccccatcgcctgagcgcatcccgagcgctccgcgagagttgacttcccaagcacgccggttcgaatcgccctctccagttcccctctccgtcctcctcccctgtgcccgccggcgctactcctgtgcgaagtgcagatccattgggactcggaagcacatctccttttgctggtaaggaagcagctggatggatcgttcagagggttagtcctgttctattcttcagtttatttgccacgagcagtcaaatccgggtcttcccttgcgggatggactgcgatttgtttgctgcgtggtggagaagctcaacaggattgttctccagaatttttcggggatcggctgatcccctggggccgctgccaatgaagccagccataccgcttcaccagaagcaggcggggctcgcggcgagcaagctcggtgtggggacctcgaagaagcacagggcttttgtagccggcgatgagcagtggtacaacaagatttttgatccgtcaagcgacttcatcttgacatggaaccgcgtcttcctcgtctcctgcttcgccgcgctatttatagaccctctctacttctatgtgcccaagatcagctacggtagccccaattcctgtgttgggacagacacccatttagccgtcattgttaccttgcttcgatcagtcgccgatttgctatacgtcatgcacatcataatcaagttcagaaccgcatatatcaatccaagcgcaactctgagggtgtttggaagaggagatcttgtcacaaatcccaaggaaattgcgtggaagtatttgagatctgactgtgcagttgatgtggtggctgcattgcctttgccacagatcattatctggtttgtgataccagctataaagtattccacttctgagcataacaataacattctggttcttattgttcttgctcagtatctcccaagattgtatctcatattccccttaacttatgaaattgtcaaagctactggagttgtcgcaaagactgcttgggaaggggccgcatacaacctggtgctctatctgatagctagtcatgttctcggtgcactatggtatttgctatctgttgatcgccagacagcctgctggaagatgaattgcagggatgaaattggttgtgctattaagttcctagattgtgatgacacaccgaatgaaacttgggcaaatactacgaccaccttcagtaaatgtaatgctagcaatggcaccatcgattttgattttggcatgttcctgcctgcgctgcaaaatcaagcacctgctaaaagttttgtgatgaagtatttctactccctctggtggggtttgcaaaatttaagctgctatggccagactcttgttgtgagtacctatcttggtgagactctgtattgtatattcttggcggtacttggtcttgtcttgtttgcgcatttgattggaaacgtgcagacctacctgcaatctatcaccgtgagggttgaggaatggagattaaagcaaagagatactgaagagtggatgagacatcgccaactgcctcatgagctgcgggaaagggtgagacgatttatccagtacaagtggcttgccactcggggtgtgaatgaagagtcaatattgcaggccctaccagcagatcttcggcgtgacattaaacgccacctttgcttgggtcttgttcgacgggttccatttttctcccagatggatgatcaacttcttgacgccatcaatgagcgtcttgtatcatcactttgcacaaagggcacatatatcgtccgtgaaggtgacccggtgactgagatgctgtttatcattcgtgggaaactggaaagctccacaacaaatggtggccgcacaggctttttcaattcaattactctgaaacctggtgatttctgcggtgaggaacttcttggatgggctcttgtccccaagcctactaccaacttgccttcatccactcggactgtgaaggccctcatagaagttgaggccttttccctccaggctgaggatctcaagtttgttgccagtcagttcaggcggttgcacagcaagaagttgcagcacactttccggtactactcgcaccactggcgaacctgggcctcgtgcttcatccaagctgcttggcggcggtacaagaggaggaagatggcaaaggacttgagtatgagggagtcattcaattccattagattagatgaagtggatgaggaagatgaatctccagccaagaatagtctggcactcaaattcatagctaggactaggaaagtgcctcagagcacgaaagaattgcctaagctaaggaagccagacgaaccggatttctccgctgaacctgatgactaaggtcgtacgctcgatacagtggttatatctgcatctgccgctgactctgctgcagcatgaaattggtctacaagcgaacttgatgagaccatgaattgaatcggggtcgtcggtaccatttgttgatgtgaggaaggtaactcgaagctttgaattgtgatgacactcctgactgactacagagataggttgaactgttgcaagttaacttgatgttgttctcatgttgtaaaaattcagacgccttgtgcctatagaattcttgaaaccaaaggaaaagtacacgtctacatagagttgcttacgaatctaacattgaagcctgtgattacgatgtctgtaactgtggagtctgtaaattgttaaggctggttggctgtatttccttcagagaaaaatgtttcacagattgctactgtcaagttcgtgtgtgtctgcggtcagaaggccaatgtaatatcgtgcacgctcatcatctatccctttgaagctgtaagatgttggacgtaattcttttttagaaaaatgatatcaaatgggtattgttggttactatgcgtatgctccatctccattccatgttcgtgcaagaagttggccatgttgctgaccgggggcgccatgacagtcaggcaggcgtgggcgaggctgcactggaaggctcggctgcgcgcagcgcgcgcttagcggcggcaggcgccgaggcgtgtgttgccgggcaggcacgttcggcatctgggacgaaggctgggagtgcggcgaggggctgcggggatgccggtatcggaggagaccggtgcaagccagcaggaagctgcagggtgcctgggttgattcgacggcgcgggttccggcaagcgctgacgacacgcgtctcaggcagacccctgctcctctgaaatggaaaggcaggccgtggagcaatagagggacagggaccagcccatgcggccgagaaatttcgatatttgacattagatacgcacgcctcgtgtgatttgacattaaattcgcgagactttcgaaatatgacactgcacatgtgaattctttctaaacaggggatttcggcttttttttctcaatttcgcgaattttgcttgtgttttccttttattaggtacttgaattacccgttctgcccctgaccccatcagctacaatcgattggatccatacgtccgtgttcatctctgtctctcctctctctcactgcgtggcgcaagaactgccgccgcggtcccaggccggagcgggagcgccgccgcccgccgctgctccaaggctgcgggagcgcctgcggccgtgttcctcgccaagctccgcggcgggatctgcaccacggaggcgacgacgatggcatcaggcgcagcggccatgtggcctccgccgttgccgtgctgctctcgaccccgtcgaacctgtgaagacctgtccttgtgatgcttttgtattttaagagactcggctgtgaacctgtgatgctttcgtgctactagaatctgttactttaatctaagaacctatcattgcgaacctgtgagtttaatatgagatcctgtcattgtaaatatgtcagtttaatttgtgaacctatcaagttccttactttcttgcctcacatatgtgttactgatcatgttgattcatccctcaatgcaacaaatatgggtatagaaa

SEQ ID NO: 2196 - DNA, 3376 bp, Panicum virgatum
cccggacccccaaaagaaaacctccatttaccgccgctcttagcactaaccacggtgaaaacaaccccactaaccccaggttttaacccaaagcccgtcaattagcagagacaataaagtaattaacccagagcgcggaggcacccgcaccccccgggagtttctgctccctcccccaccccgccccgcccccctcctttctcgaactcctcgccgccggctcttcccaactccgccgactcgcctagctgtcctccctgcccctgcctgctcctgctcccggattggcctggccggtctccggcacctcgccggcgcccgggtcgtcgccctcacctctgggtgccaggctgccagccaccaccaaacaagacccccatcgcctgcccgcgccgccgagcgcatccgagcgccccgcgagagttgattccccaggcacgccggctcgaatcgccctctccagttcccctctccgtcctcgtccgctgcggccgccgccgctactcctgtgtcaagtgcagatccattgggactcggaagcacttctcctattgctggtaaggaagcaactggatggatcgttctgagggttagccctgttctagtcttcagtttatttgccacgagcagtcaaatccgggacttcccttgtgggatggactgcgatttgtttgctgcgtggtggggcagcgcaaccagattgttctccagaatttttcggggatcgtctgatcccccggggcagccgccaatgaagccagccataccgcttcaccagaagcaggcggggctcgcggcgagcaagctcggtgtggggacctcgaagaagcacagggcttttgtagccggcgatgagcagtggtacaacaagatttttgatccgtcaagcgacttcatcttgacatggcaccgcgtcttcctcgtctcctgcttcgcggcgctatttatagaccctctctacttctatgtgcccaagatcagctacagtagctccatttcttgtgttgggacagacacccatttagccgtcattgttaccttgcttcgatcagtcaccgatttgctatacgtcttgcacatcataatcaagttcagaaccgcgtatatcaatccgagcgcgactctgagggtgtttggaagaggagatcttgtcacaaatcccagggaaattgcatggaagtatttgagatctgactttgcagttgatgtggtggctgcattgcctttgccacagatcattatctggtttgtgataccagctataaagtattccacttctgagcataacaataacattctggttcttatagttcttgctcagtatctcccaagattgtatctcatattccccttaacttatgaaattgtcaaagctactggagttgtcgcaaagactgcttgggaaggggctgcatacaacctggtgctctatctgatagctagtcatgttcttggtgcactatggtatttgctatctgttgatcgccagacagcctgctggaagaagaattgcagggatgaaattggttgtgctattaagttcctagattgtgacacaccaaatagaacttgggcaaatactactaccatcttcaagaaatgtaatgctagcgatgacaccatcgattttgattttggcatgttcctgcctgcactgacaaatcaagcacctgctgaaagttttgtgatgaagtatttctactccctctggtggggtttgcagaatttaagctgctatggccagactcttgttgtgagtacctatcttggtgagactctgtattgtatattcttggcggtacttggtcttgtcttgtttgcgcatttgattggaaacgtgcagacctacctgcaatctataaccgtgagggttgaggaatggagattaaagcaaagagatactgaagagtggatgagacaccgccaactgcctcatgagctgcgggaaagggtgaggcgatttatccagtacaagtggcttgccactcggggtgtgaatgaagaatcaatattgcaggccctaccagcagatcttcggcgtgacattaagcgccacctttgcttgggtcttgttcgacgggttccatttttctcccagatggatgatcagcttcttgacgccatctgtgagcgtcttgtatcatcactttgcacaaagggcacatatatcgtccgtgaaggtgacccagtgactgagatgctctttatcattcgtgggaaactggaaagctccacaacaaatggtggccgcacaggctttttcaattcaattactctgaaacctggtgatttctgcggcgaggaacttcttggatgggctcttgtccccaagcctactaccaacttgccttcatccactcggactgtgaaggccctcatagaagttgaggccttttccctccaggctgaggacctcaagtttgtcgccagtcagttcagacggttgcacagcaagaagttgcaacacactttccggtactactcgcaccactggcgaacctgggcctcgtgcttcatccaagctgcttggcggcggtacaagaggaggaagatggcaaaggacttgagtatgagggagtcattcaattccgttagattagatgaagtggatgaggaagatgaatctccagccaagaatagtctggcactcaaattcatagctaggactaggaaagtgcctcagagcacgaaagaattgcctaagctaaggaagccagacgaaccggatttctcagccgaacctgatgactaaaggtcctacgctcgatacagtggttatttctgcatctgctgctgcatgaaatgggtctacaagcgaacttgataagaccatgaatcgaatcgggtcgttggtaactcgaagcttgaattgtgatgacactcctgactgagataggttgaacgattgtaagttaactagatgttctcatgttgtaaaaattcagacaccttgtgcctatagaattcttaaaaccaaaggaaaagtacactgctacatagagtgatagcttacgaatctaacattgaagcctgtgattacgctgtctgtaactgtggagtctgtaaattgttaaagctggttggctgtatttccttcagagaaaaaggttacacagattgctgtcaagtaagtgtgtgtgtctgtggtcagaaggccaatgtaatattgtaacacccaaaaattcaaattttgttttgaattcaaaagaatttattcaaatgagtttgagttataaaaaaaaacttctttcttctctctccctcctctcagcctggcccatctttcatcccaccctccccttctcttttctcctgcaaggcccagtcggcccatctgagccggcccagaatccccatcccacctctctcccctctc

SEQ ID NO: 2197 - DNA, 3229 bp, Setaria italica
tccatttaccgccgctcttagcactaaacacagtgaaaactaccccactaacccccaggttttaacccgaagcccgtctattagcggcgtctaataaagtaattaagccacaggcgaagcatccgcatcccccgggagtttccgctcccacgcccgccccgcctccctccttcctcgaactcctcgccgccggctcttcccaactccgccgactcgcctcgctgtcctccctgccccctgcctcctcctgatcccagattcgcctggccggtctccggcgcctcgccggcggccgggtcgtcgccctcaccgctggcgcctgccactaccaaacgagcccgtcctcgcctggccgcgccaccgagcgctccttgagagttgactacctccaccgaagcacgccggctcgaatacccctctgtagttcccctctccatcctcctccactgccgccgccactgtagccacgtccgggcttgtacaggaagtgcagatccattcggaggtagtcgggcgcatttctccttttgttggtaaggaagcagctggatggatcgttctgagggtcagttctagtcttcagtttgctacgagtaatcagatacaagtcttccattccgggatggattgcgatttgttcgctgcgtggtggagcagcagcaccagattattctccagaatttttcgggggtcgtctgatcccccggggccggcgccaatgaagccagcaataccgctccaccagaagcaggcggggctcgctgctagcaagctcggtgtggggacctcgaagaagcacagggcttttgtagcgggcgatgagcagtggtacaagaagattttcgatccgtcaagcgacttcatcttgacatggaaccgcgtcttcctcgtctcctgcttcgccgcactatttatagaccctctctacttctatgttcccaagatcacctacggtagctcggtttcttgtgttgggacagacatccatttagccgtcattgtcactttcctccgatcagttgctgatttgttatatgtcctgcacatcataatcaagttcagaacagcgtatatcaatccgagcgcgactctgagggtgtttggaagaggagatcttgtcacgaatcccaaggaaattgcatggaagtatttgagatctgactttgcagttgatgtggtggctgcattgcctttgccacagatcattatctggtttgtgataccagctataaagtattccacttctgaacataacaataacattctggtgcttatagttcttgctcagtatctcccaaggttgtatctcatattccccttaacctatgaaattgtcaaaactactggagttgttgccaagactgcttgggaaggggctgcatacaacctggtgctctatctgatagctagtcatgttctcggtgcactgtggtatttgctatctgtcgatcgccagacagcctgctggaagaagaattgcagggatgaaactggttgtgatattaagttcctagattgtgatgacaccccagatagtacttgggcaaataccactaccatcttcagtaactgtaatgctagcaatacctccatcagttttgattttggcatgttcctgcctgcattgacgaatcaagcacctgctgaacgttttgtaatgaagtatttctattccctctggtggggtttgcagaatttaagctgctatggccagactcttactgtgagtacctatcttggtgagactctgtattgtatattcttggcagtacttggtcttgtcttgtttgcgcatttgattggaaatgtgcagacctacctgcaatctatcactgtgagggttgaggaatggagattaaagcaaagagatactgaggagtggatgagacaccgccaactgcctcatgaactgcgggaaagggtgagacgatttatccagtacaagtggcttgccactcggggtgtgaatgaagagtcaatattgcaggccctaccagcagatcttcggcgtgacattaagcgccacctttgcttgggtcttgttcgacgggttccatttttctcccagatggatgatcagcttcttgatgccatctgtgagcgtcttgtatcatcactttgcacaaagggcacgcatatcgtccgtgagggtgacccagtgactgagatgctctttatcattcgtgggaaactggaaagctccacaacgaatggtggccgctcgggcttcttcaattcaatcactctaaaacctggtgatttctgtggcgaggaacttcttggatgggctcttgccccgaagcctaccaccaacttgccttcatccactcggaccgtgaaggcactcatagaagtagaagcctttgccctccaggctgaggatctcaagtttgttgccaatcagttcaggcggctgcacagcaagaagttgcagcacactttccggtactactcgcaccactggcgaacttgggcctcgtgcttcatccaagctgcttggcggcggtacaagaggaggaagatggcaaaggacttgagtatgagggagtcattcaattccgtcagattagatgaagtggatgaggaagatgaatctccacccaagaatagcctcgcactcaaattcatagctaggactaggaaagctcctcagagaacgaaggaattgccaaagctaaggaagccagacgaaccggatttctcagctgaacctgatgactaaggtcctatgctacattcgtggttatttctgcatctgctgctgactctgctgccagttgctctatttacgcatgacactacaagccaacttgatacaatgaattgaattgggtgttgatgcgaggaaggtaactcaaagctcgaaatgcgatgacgcttctgactgagataggttgaacggttgtaagttaactagatgttgttctggtgttatcatgttgtaaattcagacgccctgtgcctatagaattcttgaaaccgaagaaaagtacattatttacatagactgatagcttacgaatctaacattgaagcctgtgagtacgttgcctgtaactgtggagtctgtaaattgtaaggctggatgtatttctttcgggaaaaaaaaatgttgcaccacacagattgctgtgtcagatgcctgtgtatctgtggtcagaaggccataatgtaatatcacgcacactgcacacacatccatccctgcttcagaggttgtaaattttac

SEQ ID NO: 2198 - DNA, 3082 bp, Oryza sativa
aaaaaactcattttatttctcatacccttcttcccctcgacgaccacctaccacccaccttctcatctctcccttctgataatcgccaaagaagagagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgatccccaccgctgcgctgaccaccctcctcgtgccgatgctgcgcagaagatcggtctttggccgcctccccgccagattcggccggtgaagctgccaaggctgctgcgcggtgtggttgacgagttcttgctcgctgactcgctgtagctgatgccatgtttggggcggggaaggtggacgatgagatggcgctcaagaggcagagaaccgtgaggttctatgatgagaaggcaaaaccaactataccaactcaccagaaacaggcagggttcgctgctagtaaacttggtgtggcaagctcaggaaagaacaaaatttttgtgccaggagaagagctgtggtacaaaaggattttggacccatcaagtgacttcatcttgacatggaaccacattttccttttttcgtgcttcgttgctctatttatagaccctctgtacttctacgtgccaaaaatctcctatggcaccccaaattcgtgtattgggacagacaggcatttagccatcactgttacattcttccgatcaatctctgatttactatatttcactcacattataataaagtttagaacggcatatattaatccgagctcaaccatgagggtatttggaagaggagaccttatcacggatccaaaggaaattgcgtggcaatatttgagatctgacttcgtagtcgatgcagtggctgcattgcctttaccacagatcttaatctggtttgtgataccagctattaagtattccactgatgagcataacaacaatattctggtgctgatagttcttgctcagtattttccaagactatacctcatattccccttgacttatgaaattgtcaaaactactggagttgtcgcaaagactgcttggcaaggggctgcatacaatatgttgctttacatgatagccagtcatgtactaggtgctctatggtatttgctatctgtcgatcgccaaactgcctgctggaagagcaattgcaagaatgaaactggctgtgatattaaatttctagattgtgatgtgataccaaatcaaaactgggcaagcaaaactgctatcttcaatacctgtgacgcaactaacacttcaatcagttttgattatggcatgtttcagcctgcattgtttaatcaagccccagggcaacgtttcttgatgaagtatttctattccctttggtggggtttgcagaatctgagttgctatggccagactattactgtgagtacctatattggtgagactctatactgtatattcttggcagtacttggtctcgtcttgtttgcacatttgattggaaatgtacagacctacttgcaatctatcactgtgagggttgaggaatggagattaaaacaaagagatacagaggagtggatgaggcatcgtcaactcccacatgaactacgagaaagggtgagacggtttatccagtacaagtggctcgcaactcgaggagtgaatgaagaatcaatattacaggctcttcctgcagatcttcgtcgtgacattaaacgtcacctttgcttgggtcttgttcgccgggttcctttcttctcccagatggacaatcaacttttggacgccatctgtgagcgtcttgtatcatcgttgtgcacacagggcacatacattgtccgtgagggtgatccagtgaccgagatgctcttcatcattcgtgggaaactcgaaagctctacaacaaatggtggccgcactggcttcttcaattcaactaccctgaaatccggtgatttctgcggcgaggaactgcttgggtgggctcttgtccccaaacctactgttaatttgccgtcatccactcggacagtgaaggcactcatagaagttgaggcattcgcactccaagctgaggatctcaagtttgttgcaaaccaattcaggcgtctgcacagcaaaagattgcaacacactttccggtactactcgcaccactggagaacttgggcctcatgcttcatccaagctgcttggcggcgatacaagaggaggaagatggcaagggacctgagcatgagggagtcattctgctccatgagatcagatgactcaaatggtgaagatgactcgccacctaagcagaatctcgctatgaagatcatgagtgggagtaggaaaggacctcagaacatgaaagagttgcctaagctaagaaagccggatgagccagatttttcagctgaaccctgtgagtaaggtctaaaatgcaacagccattgcttctgctaactctgctgctaccagttaaccattgctatactaccatatactgttggatcgacggcacgagttgtccaattgttgatgagaaagttcattaacttggaaactaaaaaacatggagaagcagcgaattcacgaagggatcgaggctttgagttgactagatgttttaggcgttggcaacttgtacatccagatatacacgtctgtgcttgtaacattcttgagatcttagaaacggccgcacccttacatttgactgcagagaaagagcgtaaaagaactgaagaaagatcaaacgtaaaggcagtctgtatttttgggagtctgtaaagcgttagggcggctattttttgcttttaactgatagacatttcgttgtattgtgcaatgtatttttgtggccaaaactgcaggttaacatctatactgtgcatacgttgtgcctcctttgtggctctctctcttgaacatatatactgtgctgtggtctgtggaatgaggagctgttccatttggtaacaaaccatggatacaatcagctgggctgcg

SEQ ID NO: 2199 - DNA, 2438 bp, Secale cereale
atggcgctcggcaggcagaggaccgtcaggttctatgacgagagggcaaagccagcgataccgattcaacagaaacaggctgcattcgctgctagtaagcttggcgtcgcgagctcagggaagaacaggattttcgtgggaggggatgcgcagcagaacaagattttcgatccatctagcgacttcatcttgatgtggaaccgcattttccttttttcgtgcttccttgctctatttatagaccccctgtacttctacgtgccgaaaatcgtctatggcgacacctattcctgtgttgggacagacacacatttaaccatcatcattacattcttccgatcaattgccgatctcttgtatgtgattcacatcataatgaagttcagaactgcatttgttaaaactagctcaaccttgcgggtttttggaagaggagatcttgtcacagaccctaaagagattgcatggaaatatttgagatctgactttgcaattgatgtggtggctgctttgcctttgccacagatcataatctggtatgtgataccagccatcaagtattccactgctgagcataacaataacattctggtgcttatagttcttgctcaatatcttccaagactatatctcatattccctttaacttatgaaattgtcaaagctactggagttgtcgcaaagactgcctgggaaggggctgtatacaacctgctactttacttgatagccagtcatgttcttggtgccctgtggtacctgctatctgttgatcgccaaacagcctgctggaaaatgagttgcaggaatgaaactgggtgtagtattaggtacctcgactgtgatacaccaaatcagacatgggctagtacaagtagtgtcttcagcaaatgcaatgctagtgatgacaaaatctcctttgactatggcatgtttcagcctgcactgtcaaatcaagcgcctgctcagggtttcttgagaaagttcttctattccctttggtggggtttacagaatctaagttgctacggccagacactttctgtgagcacctacattggtgagacactgtactgtatattcttggcagtactcggtcttgtcttgtttgcgcatttgattggaaatgtgcagacctacttgcaatctatcactgtgagggtcgaggagtggagattaaagcaaagagatacggaggagtggatgagacatcgtcaacttcctgatgaactgcgggagagagttagacgatttatccagtacaagtggcttgcgactcgtggtgtgaatgaagagtctatattacaggttctaccagcggatctacgacgtgacattaaacgccacctttgcttggatcttgttcgccgggtaccgtttttctcccagatggatgaccaacttctagatgccatctgtgtgcgtcttgtttcatcactgtgcacaaagggcacatatattgtccgtgagggtgatccggtgactgagatgcttttcatcatccgtgggaaactagagagctccacaacgaatggtggccgcacaggctttttcaattcaactacactgaaagctggtgatttctgcggcgaggaacttcttgggtgggctcttgtcccgaagcctaccgctagtttgccatcatccactcgcacggtgaaggcacaaatagaagtggaggccttttcactccaggctgaggatctcaagtttgtggccagccaatttaggcggttgcacagcaagaagttgcagcacactttccgatactactcacaccattggagaacgtggggcgcgtgcttcatccaagctgcttggaggcggtacagaaggaggaagatggcgaaggacctgagtatgagggagtcattcccttccatgagatcagaggactcggatggtgaagatgaccctccacccaagaagaatatctctctaagaatgatggccgggaaagtcatggctgggaacaggaaagggcttcaggccataaaagagttgccgacactaaagaagccggatgagccagatttctcggtcgaaccctacgagtaaggtataatgctctatccaaaacgctcactgatcctctagctctgctaccaagttggtcgtcttgctgcatcgaggagactgtaatccggttggaatttggattcacctgaaccggttgttgatgcgagaactctaattaacactgaatcccaaatgcatggcgggggaccttacgaagagatgctaaacagatatatatactacacatagatattctagtcatcgttacgttgtacattcagatgtttacctgtgtttgtaaaattcttggtgcctcagcacagggcgccgctacactgactgcctgagcttcaaagaaatcctgacattgaagccatagtatgaagtaccttttttggagttctttttattacgaggtt

SEQ ID NO: 2200 - DNA, 1482 bp, Sorghum bicolor
ggcccagcggctctcggtataaatacgggcagccaccatacatcccagggtcaccacacaacacaagaccaacacacatctgtcgacgagagtaagagagatcgagggactcaactgttccaattccacacacattccactagctgcagcttaagcatcggcacttggagcagcaccgcatcaccatgtcgtccaactgcggtgaggagaaggagctggtctgcgtgaccggcgccggcggcttcatcggctcctgggtggtcaaggagttgctccagcgtggctaccgtgtcaggggaactgcgagggaccctgcggacagcaagaacgcccacctgctggctctggatggcgccaaggagcgcctcaccctgtgccgcgccgacgtcctcgaccgcgcctccctccacgccgccttcgccggctgcaacggcgtcttccacgtcgcctccccggtctccaacgacccggagctggtgccggtggcggtggagggcacccggaacgtcatcaacgccgcggcggacgaaggcgcgcgccgcgtcgtcttcacctcctcctacggcgccgtccacatggaccccaaccgtagccccgacgccgtcctcgacgagacatgctggagcgactacgacttctgcaagcgatcagacaacctgtactgctgcgccaagatgatggcggagatcacggcgacggaggaggcggcggcgcgggggctgcagctggccgtggtgcttccctgcatgaccatgggccccatgctgcagcagacgctcaacttcagcaccaaccacgtcgcgcgctacctcatgggcaccaagcgctccatccccaacgccgtcgccgcctacgtcgacgtccgcgacgtcgcgcgcgcgcacgtcctcgcctacgagcgccccagcgcgtgcggacgctacctctgcatcggcaccgtgctgcaccgcgaacagctcgtcgccatgctcaaggaactcttcccgcagtaccccgtcacagccaagtgcgaggacgacggcaagccgatggcgaagccgttcaagttctccaaccagaggctcagggacctgggcttggagttcactccgctcaggaagagcttgtacgagaccgtggtgtgcctgcagcagaagggtcacctgcctgtcatccaacaacagcagcgcgcgtacttgtaaaccagaccagaggacatgccgggatttctcagataaaagtgaacatggcaaacaacacacagaaagagaagcacaagaagatgatatgaggaatttgtaaacttcgtatactcttttttttttcttttctatacaagtgtattacgttgttcacacacacacacacacacacacacacataaaatctacagttgtatgatccattcttattctgtatcatggcacatgtaaagtcgttaatgtgacgaattgtataagtattatataaattaatcgcattcctttcgcatcaaattactac

SEQ ID NO: 2201 - DNA, 1413 bp, Zea mays
catctgtcgactggtagcagagagaagagatagaccgagagagggagggagagagagaacctgacactgagactgaagcatcggcgctagctagcttgggcagcaacatcacgatgtcgtccaactgcggcgaggatgagaaggagctggtgtgcgtgaccggcgccggcggcttcatcggctcgtgggtggtgaatgagctgctccagcggggttaccgcgtcaggggaaccgcgagggaccctgcggacagcaagaacgcgcacctgctggctctggagggagccaaggagcgcctcaccctgtgccgcgccgacgtcctcgaccgcgcctccctgcgcgccgccttcgccggctgccacggcgtcttccacgtcgcctccccggtgtccaacgacccggagcttgtcccggtggcggtggagggcaccaggaacgtcatcaacgccgcggcggacgagggcgcgcgccgtgtcgtcttcacctcctcctatggcgccgtgcacatggaccccagccggagccccgacgccgtcctcgacgagacctgctggagcgactacgacttctgcaagcgaaccgacaacctgtactgctgcgccaagatgatggcggaggtgacggcggcggcggaggcggacgcgcggggcctgcagctggccgtggtgctgccctgcatgaccacgggccccatgctgcagcagacgctcaacttcagcaccaaccacgtcgcgcgctacctcatgggcaccaagcgctccatccccaacgccgtcgccgcctacgtcgacgtccgcgacgtcgcgcgcgcgcacgtgctcgcctacgagcgccccggagccaggggccggtacctctgcatcggcaccgtgctgcaccgcgccgacctcgtcgacatgctcagagacctctttccgcagtaccccgtcacggccaagtgcgaggaggacggcaagccaatggcgaagccgttcaagttctccaaccagaggctcagggacctggggctggagttcactccgctgaggaagagcctgtacgagaccgtgctgtgcctgcagcagaagggccacctgcctgtcatccaaccgcagcagcgcgcgtacctgtgatgtgaaacaaccgacatatataaacatgcatgcaatgaggcaaacgacacacacgtcagtggaagaacgagaagatgacataaggaatctgagaactttttattaagtgtatattcatgttacttttcagtatctacgggtgtattacgttttacgttcttaaaacaaaagcttttgctgttgtacaattattatatagacaagttacttatgaatagtaagttttatttagacaactattaaaacaaaaacctagagggttcacattaagaaagaccgtcgaagatactctgacaaaaac

SEQ ID NO: 2202 - DNA, 1328 bp, Setaria italica
gattgatagtttgatacaagagcaacagagagatcgagacagagtactgatctggtctggcctggtctatcccaaacacattcttctagcgattcagattaggaagtttcaccatgtcgtcctattccaaggccagcaatggtgaggaacagcagcagctggtctgcgtgacgggagcaggcggcttcatcgggtcgtgggtggtgaaggagctcctgctgcgcggctaccgagtcaggggaaccgcaagagaccctgccgacagcaagaacgcgcacttgcttgctctggagggggccaaggagaggctcaccctgtgccgcgccgatgtcctcgatttcgactccctccgcgccgccttcaccggctgccacggcgtatttcacgtcgcctccccggtgtccaacgaccctgagctggtgccggtggccgtggagggcaccaggaacgtgatcagcgccgcggcggacgagggcgttcgccgggtggtcttcacctcctcgtacggcgcggtgcacatggaccccaaccggagccccgacgccatcctcgacgagacctgctggagcgactacgacttctgcaagcagacggataacctgtactgctgcgccaagatgatggcggagatcacggcgacggaggaggcggcgcggcgcggcctgcagctggcggtggtggtgccctgcatgaccatgggcccgatgctgcagcagacgctcaacttcagcagcaaccacgtggcgcgctacctcatgggcaccaagaggtcctaccccaacgccgtcgccgcctacgtcgacgtccgcgacgtcgcgcgcgcgcacgtcctcgccttcgagcgccccgaagcccgcggccgatacctctgcattggcaccgtgctccaccgcgcccagctcatcgccatgctcagggagctcttcccgcagtaccccgtcaccgccaagtgtgaagatgacggcaagccaatggcgaagccgtacaggttctccaaccagagggtcaaggacctgggcatggagttcactccgctgaagaaaagtttgtatgaagcggtggtgagcatgcagaagaaggggcacctgcctgtgatcagagagcagcagcgtgcgtacttgtaaaatcctgggacgttgggatttcccagatgaaataaacagggaaaacgaagcaaaagtgaagggacagagatgatacaagcatataaggagatttgaaatttaacacagttattcaggtgtattactttcttggtaacaaaattctatcagtgtgtataagcattcttaattatttgatatcatgtaaacctttaagtcaggatg

SEQ ID NO: 2203 - DNA, 1409 bp, Panicum virgatum
ccacaactagtactagcactgcctggtggtataaatacgggcagctaccatacaggccaaggtcacacaagaaaacaagatcgatcgagaagagcaacagagagaccgaggctggtccatcccaaccaaactccacattccaaatagcaattccgagttgacaaaatcaccatgtcgtcctattccaagcccaacaatggtgaggagcagctggtctgcgtcaccggggcaggcggcttcatcggatcgtgggtggtgaaggagctcctcctgcgcgggtaccgtgtcaggggaactgcaagggaccctgctgacagcaagaacgcgcacttgcttgcgctggagggggccagggagaggctcaccctctgccgcgccgacgtcctggactacgagtccctccgcgccgcgttcagcggctgccatggcgttttccacgtcgcctccccggtgtccaacgaccctgagctcgtgccggtggccgtggagggcaccaggaacgtgatcaacgccgccgcggacgagggcgcgcgccgggtggtcttcacctcctcgtacggcgccgtgcacatggaccccaaccggagccccgacgccgtcctcgacgagacctgctggagcgactacgaattctgcaagcggacagataacctctactgctgcgccaagatgatggcggagatcacggcgacggaggaggcggcggcgcgcgggctgcagctggcggtggtggtcccctgcatgaccatgggcccgatgctgcagcagacgctcaacttcagcagcaaccacgtggcgcgctacctcatgggcaccaagaggacctaccccaacgccgtcgccgcctacgtcgacgtccgcgacgtcgcgcgcgcgcatgtcctggcctacgagcgccccgacgcgcgcggccgctacctctgcatcggcaccgtgctccaccgcgcccagctcatcgccatgctcagggagctcttcccgcagtaccccgtcacggccaagtgtgaggacgacggcaagccaatggcgaagccgttcaagttctccaatcagaggctcaagaacctgggcttggaattcactccgctgaagaaaagcttgtatgaagcagtggtgtgcatgcagcagaaggggcacctgccggtcatcagggagcagcagcgtgcatacttgtaaaatccggccgcgcgggggatttccaagatgaaataaacacaaggacattgcgaatttagtatacatatttttcagttattcatcaggtctatctattacgtttttgggaaaaaaatcattcttatttttttctatttggtgaaaaaggaggggtattccttactggaagcattcttgtttgatatcatactcatgtaaaactgttaatgtgatgggtaataaggtgcttaaaa

SEQ ID NO: 2204 - DNA, 1970 bp, Panicum virgatum
aagaaacacgtccaaagggtccacggctctcaactagagtactccacgtagtagtcaaatttctcaaacatggggcaccactataccacagaagtacaaccctggcaaccgcaaccactttccggccgttccaggaaaagcagttccgccgtcaacgcccagccattcctggctcgtattctagtcagctctttgccgctttgggaatcaagtactcctacagaaacagaatattcactcctgattacctgatttaccccccccccgttgacccttcaaaaaaaaaacttgttccggcccgcaggcagaagattctcaaggttttgccgttttggacacgagtaccctaccccaccccacgacgaagacgaaggtgccaaaattgccttgctgatccccttccgaggacgaagacgacggaatctttggcgcgctctccacgcggccgcaatgcccctgaattcgcccataccggcccaccggcggcgtggcctggcctcgtgctgctcccgccgctgaataagtataaacagagttgtattatcaaataaataaaataaacagaggagtgagtgcaccggaaacctctagtctggttcgcttgcgactcccacaaccaagacctctcttctcgactcctctctctgcccgctggctggtggtataaatacgggcggagctaccatacaggccaaggtcacacaagaaaacaagatcgagcaacagagagactccacattccactagcaattcagacttgacagaatcaccatgtcgtcctattccaaggccagcaatggtggtgggaagctggtctgcgtcaccggcgcaggcggcttcatcggctcgtgggtggtcaaggagctgctcctgcgcgggtaccgtgtcaggggaactgcaagggaccctgctgacagcaagaacgcgcacttgcttgcgctggagggggccaaggagaggctcaccctctgccgcgccgacgtcctggactacgagtccctccgcgccgcgttcagcggatgccatggcgtcttccacgtcgcctccccggtgtccaacgaccctgagctcgtgccggtggccgtggagggcaccaggaacgcgatcgacgccgcggcggacgagggcgttcgccgcgtggtcttcacctcctcgtacggcgccgtgcacatggaccccaaccggagccccgacgccgtcctcgacgagacctgctggagcgactacgaattctgcaagcagacagataacctgtactgctgcgccaagatgatggcggagatcacggcgacggaggaggcggcggcgcgcgggctccagctggcggtggtggtcccctgcatgaccatgggccccatgctgcagcaggcgctcaacttcagcagcaaccacgtggcgcgctacctcatgggcaccaagaggtcctaccccaacgccgtcgccgcctacgtcgacgtccgcgacgtcgcgcgcgcgcacgtcctggcgtacgagcgccccggcgcgcgcggccgctacctctgcatcggcaccgtgctgcatcgcgctcagctcatcgccatgctcagggagctcttcccgcagtaccccgtcacggccaagtgtgaggacgacggcaagccgatggcgaagccgtacaagttctccaaccagaggctcaaggacctgggcttggagttcactccgctgaagaaaagcttgtatgaagcagtggtgtgcatgcagcagaaggggcacctgccagtcatcagggagcagcctgcatacttgtaaaatccggcccggcgcgctggggacttcctggatgaaataaacacaaggacattgcaaatttagtacatatttttttaagttattcttgaaaaaaaatctacaagtatttggtgaaacaggaggggtattccttactgtaagcattcttgtatgatatcatactacatgtaaaactgttaatgtgatgggtaataagg

SEQ ID NO: 2205 - DNA, 1370 bp, Pennisetum glaucum
agaggaacagagaccagcgagacacacagacagacagacagacagtcacattctcttccactagcaattcgcctctccaagttctcaccatgtcgtcccatcccgaggccagcaatggtgacgagcagcagcagcagcagctggtgtgcgtgacgggagcaggcggcttcatcggttcctgggtggtcaaggagctcctcctgcgcggataccgcgtcagggggaccgcaagggaccccgaggacagcaagaacgcgcacctgcttgcgctggggggcgccgaggagaggctcaccctgtgccgcgccgatctcctcgacctggactccctccgcgccgccttcaccggctgccacggcgtcttccacgtcgcgtccccggtgtccaacgacccggagctggtgcccgtggccgtggagggcacacggaacgtgataaacgccgccgccggcgagggcgttcgccgggtggtgttcacctcctcgtacggcgcggtgcacatggaccccaaccggagccccgacgccgtcctcgacgagacctgctggagcgactacgacttctgcgagaagacggataacctctactgctgcgccaagatgacggcggagatcacggcgacggaggaggcggcgcggcgcgggctgcagctggcggtggtggtgccgtgcatgaccacgggccccatgctgcagcaggcgctcaacttcagcagcaaccacgtggcgcgctacctcatgggcaccaagaggacctacccgaacgccgtcgccgcctacgtcgacgtccgcgacgtcgcgcgcgcgcacgtcctcgcctacgagcgccccggcgcccgcggccggtacctctgcatcggcgccgtgctccaccgctcccagctcatcgccatgctcagggacctcttcccccagtaccccgtcacggccaagtgtgaagatgacggcacgccgatggcgaagccgtacaggttttcgaaccagagggtcaaggacctgggcttggagttcaccccgctgaagaagagcttgtatgaagcggtggtgtgcatgcagaagaaggggcacctgcctgtgttgagagacgtgcgtacttgtaagatcctgggacgttgggatttcgcagatgaaataaacagggaaaacgaagcaaaagtgtaggcacatatagatgatagtacatacaagcttataaggacattgcaaatttagcatatactgtgttttttcagtcattctggtgtattgctttcttgaagaaaattattctacaagtgcgtataagcattatttgatatacgaagatgtaaacatttaagtcaggatgtctgcctatacgaagatttgccggatgagctttgtgtctttagg

SEQ ID NO: 2206 - DNA, 1636 bp, Saccharum officinarum
ccattgtacagactcgataggtgaccataaaagaggagagctaagcactatggctcctgaagaaagaatgaagacagaggcaagtcacaaggcgatagcagcaggtggcaagatgacggtgctccatgctccggttggagtaaggagcatcgtgacctcattggtggctttcttcatcttagccagctccatcgtcttcctcttcgacaaaggccaggaagagcgagtgcaaatggcagtcgagcatggacgccaagaagtgcagttgaagctggaagctgggctccaagaaccagcgatcagagggacaactgaagagggggacaccagcaacgaggagtgcaactggtcaagggggcggtgggtgtacgacaacgtgtctcggccattgtacaacgggctcaagtgtgccttcatcttccccgaggtggcctgtgacaaatatggcaggaaggatgtcatgtaccagcactggagatggcagcctcatggatgcgacctcccaagattcgatgccatcaagctgcttgaaaagctgaggaacaagagattggtgtttgtgggtgactcagtcaataggaaccaatgggtctctctcgtgtgcatggtggaggcctcaatacctgatgacaggctcaagatacgcatcttcaatggctcactcatctccttcaaggcattggaatacaatgcaacaatagatttctactggtcaccactactggttgagtctaacagcgacaaccccattattcaccgggtggagtaccggatcataagggcagacagaattgagaagcatgccagtgtctggagggatgctgacatcattgtcttcaattcttacctgtggtggaggaagcagaaggatgacatgaggatgaaggtcatgtatggctcatttgaagatggtgatgcaaagttagacgaaatggaaatggtcgatggtttcgagatagctctcaagaaactaaccgaatggcttggagagaatattgacaagaacaagactaggatcttttttgcaggatcatcaccaacacattcctgggctagcaactggggaggagaagacaagaataaatgtctcaacgaaacagagccgatctacaaaaccgggtacaaagctgcaactacggactacagcttgatggccacggccaagtcctattttcgaacattggagccgaaaggcatacatgttcagatactgaacatcacagagctttctgactaccggaaggacgggcatccgacggtgttcaggaaacaatttgctcctctaaccaaagagcaaattgctgaaccagccagctacgcggattgcacgcattggtgcctccctggagttcctgatgtctggaacgagtttttatatggctacctcgtgcacaaatgatgtgtaaaatgtcaggtttgttttaccccttatatataatgtacaaatgacatactccatttagattcggatgctcttgtgcagagaatggttggacctattacatttacatgtagagacagagaaaaggagaaaagcaaggatctgtctgtgcatcacctaatgggatcagtgtactatttgtttacatcaaacagagcaacatgattttgtaaatttcgaagaaatttgtcatgg

SEQ ID NO: 2207 - DNA, 1906 bp, Setaria italica
cacatgcatgatactcatctgcagatgattatgcaaattccgaggctaattcaattgtaaaaaacaagcattatatataagggctaatctacctcgaccagcaaaacttttcagttctacgactacactccaaacagtctgccaccacattcctttttgtggttagcgcaagggtcagcgtccagattgcttgagtagcactactttttctagacctgggccatctagccatgtgcaggcgcgttgctcccattgtcattgtagagactccagaggtgaccataaaagaggagagctaagcactatggttttctgaagaaaaaatgaagacagagagcactcacaagacgatagcagcaggtggcaagatgacagtcccccaatctcctgttggagtgaggagcatcgtgacctccttagtggctttcttcatcttagccagctccatcgttttcctcttagacagaggccaggaagagcaagtgcaaatggcagtcgagcatggacgccaagaagtgcaggtgaaggtggaagctgggctccaagaaccagcgatgagagggacaactgaggcggaggacaccagcaatgaggagtgcaactggtcgagggggcagtgggtgtacgacaatgtatcccggccattgtactccgggctcaagtgcgccttcatcttccctgaggtggcttgtgacaaatatggcaggaaggatgtcatgtaccagcactggagatggaagcctcatggatgcgatcttccaagattcaacgcaactaggctgcttgaaaagctgaggaacaagagattagtgtttgtgggcgactcagtcaacaggaaccaatgggtttctctggtgtgcatggtggaggcctcaatacctgatgacaggctcaagacgcgtatcttcaatggctctctgatatccttcaaggcattggaatacaatgcaacaatagatttctactggtcaccgttgcttgtggagtccaacagcgacaacccaattatccaccgggtggagtaccggatcataagggcagacagaattgagaagcatgccagtgtctggagggatgctgacatcattgtcttcaattcttacctgtggtggaggaagcagaaggatgacatgaggatgaaggttatgtatggttcatttgaagatggcgatgcaaggttagatgaaatggaaatggtcgatggtttcgagatagctctgaagaaactaactgaatggctcggagagaatattgacaagaacaagactagaatctttttcgcaggatcatcaccaacacattcctgggctagcagctggggtggagaagacagcaacaagtgcctcaacgaaacagagccgatctacaaagtcgggtacaaaacggcaactacagattacagcttgatggccaaggctaagtcatattttagaacattggagccgaaaggtatacatgttcagatactgaacatcacagagctgtctgactaccgcaaggacgggcatcctacagtgttcaggagacaatttgttcctctaacgaaagagcagattgcgaacccagccagctacgcggattgcacgcattggtgcctcccgggcgttcctgatgtctggaacgagtttttatacggctacctcatgtacaaatgatacttgacatcccaatataaaatgtacaaatggcatactgcatctagattaggctactttgctttgttttatgcagagaatgactggccccatcacatttacatgtagagacagacaagaggatccgtctgtgcaccacctcactaaaggagacattcaaagtgaacattgtatatcatcagtgtactacagtatttgttttcatctgacagggtaacataattctgcaaatttaaaagaaatttaccatg

SEQ ID NO: 2208 - DNA, 2791 bp, Zea mays
ggagaactcatgatactcacatctatagatgattttgcaaattcagacagtaactgtagcaccgacgtatactgtatacacacacaaaaaaaaaactttccgtttctgatttccgtacaaggggtacaacgacattccaatccgaatactccgacactgccctactttttgtggttagcgcaagggtcagtgttctaggttggttgcttcagtatcactacttttcctagagctgggccacatagccatgtgcaggcaggagtgttgctagtagccctgccagtgtactacagactcgataggtggccataaaagaggagagccaataagcacaatggcgcctgaagagaggatgaagacagaggccagtcacaaggcgatagcagcaggtggtggcaagatgacggtgctccactctccggttggagttaggagcatcgtgacctccttggtggctttcttcatcctagccagctccatcgtgttcctcctcgacagaggccaggaagagcaagtgcaagtggcagtcgagcatggacgccaagaagtgcaggtgaagctggaatccgggctgcaagaaccggcgataagagggacaacccaagagggggacgccagcaacgaggagtgcaactggtccaggggaaggtgggtgtacgacaacgtgtcccgcccattgtacagcgggctcaagtgctccttcatcttccccgaggtggcctgtgacaagtatggcaggaaggatgccatgtaccagcactggagatggcagcctcatggtcatggatgcgacctcccaagatttgatgccatcaagctgcttgaaaatctgagaaacaagagaatggtgtttgtgggcgactcagtcaacaggaaccaatgggtctctctcgtgtgcatggtggaggcctcaatacctgacgacaggctcaagatacgcaccttcaatggctcactcatctccttcaaggcattggaatacaacgcaacgatagatttctactggtcaccactactggtggaatctaacagcgacaaccccattatccaccgggtggagtaccggatcataagggcagacagaattgagaagcatgccagtgtctggagggatgccgacatcattgtcttcaattcttacctgtggtggaggaagcagaaggatgacatgaggatgaaggtcatgtatggttcattcgaagatggtgatgcaaagttagacgagatggaaatggtcgatggtttcgagatagctctcaagaaactaaccgaatggctgggggagaatattgacaagaacaagactaggatatttttcgcaggatcgtcaccaacacattcctgggctagcaactggggtggagaagacaagaacaagtgccttaacgaaacagagccgatctacaaaaccggatacaaagctgcaactacagactacagcttgatggccaaagctaagcactactttcgaacattggagccgaaaggcatacatgttcagatactgaacatcaccgagctgtctgactaccgcaaggacgggcatcctacggtgtacaggaaacagtttgctcctctgacgaaagagcaaatcgcagacccagccagttacgcggattgcacgcactggtgcctccccggagttccagatgtctggaacgagtttttatatggctacctcgtgcaaaaatgatgtacaaaactgtcagtcaggttcgttttgccccttatatataatgtacaaatggcatactccatttagattaggatgctcgctcattctcttgtgcagagaatggttggacctcttacatttaccccgtgcagtgcagagacagacagaaggagaaaagcaagggtctgtctgtacatcacttattaatgggatcagtgtactatttgtttacatctaacagggcgacatgattttgcaattttcgaagaaatttgtcatgcaaaaaggaacagtttaagaatgcccctaaaattcagttcagttcaattcaattcagtcataccggcaggcaggcaacaaaagcacattccacatctgattggtgggtaatataggttagggagagaggagcaacctgaatctgctatcgccacaggttccagttgtcgtcggcccgccgcaccgcgtgcaggaccaccccgccatggccaccggacaccctcgccggcgcgtcgcgcagttacaggctacagctactacctggaaggccaggccagccccagcccatgcagtaacacttggatgatgtggcccgacaacggcccaagtttaacggtctcaaagcttagaggcctcacattgccaaaattatgaataaccgaaatggtacaagtttcttatatatgaaacgcggttcaaaacacggcttctagggctatccacgtcgacttttattttttcagccgttagattcacaatcgaaggacaagcaaacgcgatgtcgtttctatcctccacagatgacacgatgtttccagaaatcgcttcttctttccttcctctgggcatctctctcccgaggctacgggcctacggcttcgatgttaagccagtggagttcctccgcagctgacggcgatggcggagaccacctgcttctccgtgttacgccacagatcttggctgccacggtctcgcgcttgccgactgtaatacccaatttgtaaattgtaagaaataatacaaatggagaaaacaatttctccttatgtgagtttaacctttgtgcatcatcacatgtgtacaccctaggtataaacaaataattaataccct

SEQ ID NO: 2209 - DNA, 1560 bp, Setaria italica
aaggaagaatgaagacagaagccactcccaagatgacggtgctccatgctccggttggagtgaggagcatcgtgagctccctagtggccttcttcatcgtcgccagctccgtcacgttcttgcttgaccgaggccaggaagcacaagtgcaaatggcagtcgagcatggacgccaagaaatgcaggtgaaggtggaggctgggctccaagaaccagccatgagagggactactgagtcgggggacgctggtgaggagtgcaactggtcgaggggaaggtgggtgtacgacaacgtgtcccggccattgtactccgggctcaagtgcgccttcatcttccctgaggtggcttgcgacaaatatggaaggaaggatgtcatgtaccagcactggagatggcagcctcagggatgcgaccttccaagattcaacgcaactaggctgcttgaaaagctgaggaacaagagattagtgtttgtgggcgactcagtcaacaggaaccaatgggtttctctggtgtgcatggtggaggcctcaatacctgatgacaggctcaagacgcgtatcttcaatggctctctcatatccttcaaggcattggaatacaatgcaacaatagatttctactggtcaccgttgcttgtggagtccaacagcgacaacccaattatccaccgggtggagtaccggatcataagggcagacagaattgagaagcatgccagtgtctggagggatgctgacatcattgtcttcaattcttacctgtggtggaggaagcagaaggatgacatgaggatgaaggttatgtatggttcatttgaagatggcgatgcaaggttagatgaaatggaaatggtcgatggtttcgagatagctctgaagaaactaactgaatggctgggagagaatattgacaagaacaagactagaatctttttcgcaggatcatcaccaacacattcctgggctagcaactggggtggagaagacagcaacaagtgcctcaacgaaacagagccgatctacaaagtcgggtacaaagcggcaactacagactacagcttgatggccaaggctaagtcatattttagaacactggagcccaagggtatacatgttcagatactgaacatcacagagctgtccgactaccgcaaggacgggcatcctacggtgttcaggagacaattcgttcctctaacgaaagagcagattgcgaacccagccagctacgcggattgcacgcattggtgcctcccgggcgttcctgatgtctggaacgagtttttatacggctacctcatgtacaaatgatacttcacataccatcccaatatatagtgtagaaatgacatactgcatctagattaggctgctttgctttgctttgttttgtgcagagaatggctggccccatcacatttacatgtagagacagacaaaaggatctggttgtgcaccacctcactacaggagacattcagagtgaacagtgtatatcatcagtgtactatttgttttgatctgacagggcaacataattctgcaaattcttttt

SEQ ID NO: 2210 - DNA, 1585 bp, Panicum virgatum
gaagagaggtgcaacataaaagaggggggccaagctaagcaccacacttttctgaagaaagaatgaagacagaaaccactcccaagatgacggtgctccatgctccggttggagtgaggagcatcgtgagctcccttgtggccttcttcattgtcgccagctctgtcaccttcttgcttgaccgaggccaggaagcgcaagtgcaaatggcggtcgagcatggacgccaagaaatgcaggtgaagttggaggctggactccaagaaccagcgatgagagggactactgatgcgggcgatgccggtgaggaggagtgcaactggtcgaggggacggtgggtgtacgacaacatgtccaggccattatactccgggctcaagtgtgctttcatctttcctgaggtggcttgcgacaaatatggaaggaaggatgtcatgtatcagcactggagatggcagcctcatggatgcgaccttccaagattcgatgccaccaagctgcttgaaaagctgaggaacaagagattagtatttgtgggcgattcagtcaacaggaaccaatgggtctctcttgtgtgcatggtagaggcctcaatacctgatgacaggctcaagatgcgcatcttcaatggctctctcatctccttcaaggcactggaatacaatgcaacaatagatttctactggtcaccactgcttgtggagtccaacagcgacaccccataatccaccgtgtggagtatcggatcataagggcagacagaattgagaggcatgccagtgtctggagggatgcagacatcattgtcttcaattcttacttgtggtggaggaagcagaaggatgacatgaggatgaaggtgatgtatggctcatttgaagatggcgatgcaaggttagacgaaatggaaatgattgatggtttcgagatagctctcaagaaacttactgaatggcttggagagaatattgacaagaacaagacaagaatctttttcgcaggatcatcacctacacattcctgggctagcaactggggtggagaagacagcaacaagtgcctcaacgaaacagagccgatatacaaaatcggatacaaagccgcaactacagattacagtctgatggccaaggctaagtcatattttaaaacattggagccgaaaggtatgcatgttcagatactgaacatcacagagctttctgactaccgcaaggacgggcatcctactgtgttcaggagacagtttgttcctctgacaaaagagcagattgcgaacccagccagctacgcggattgcacgcattggtgcctccccggcgttcctgatgtctggaacgagtttttatatggctacctcatgtacaaatgatacaccatgccagattttgtccccccaacaaatataatgtacaaatgacatactgcatctagattaggctgctttatttagtgcagagaatggttggcctcatcacatttacatgcagagacagacaaaaggatctgtcggtgtaccatctcactaaatcactaaaggagacattcaaagtgaacagtgtatagcagtgtgctgtttgttttc

SEQ ID NO: 2211 - DNA, 2195 bp, Panicum virgatum
tcgatgattcagaacaggtggacactacctcccttatgtggttagctcaggggtcactggtcagtttatttgattaccagacctgggccacttagccatgtgcaagtctaataccccatcgcagagaagagaggtgcaacataaaagaggggggccaagctaagcaccacacttttctgaagaaagaatgaagacagaaaccactcccaaggtgatggtgctccatgctccggttggagtgaggagcatcgtgagctcccttgtggccttcttcatcgtcgccagctctgtcaccttcttgcttgaccgaggccaggaagcgcaagtgcaaatggcggtcgagcatggacgccaagaaatgcaggtgaaattggaggctggactccaagaaccagcgatgagagggactactgatgcgggcgatgccggtgaggagtgcaactggtcgaggggaaggtgggtgtacgacaacatgtccaggccattatactccgggctcaagtgtgctttcatctttcctgaggtggcttgcgacaaatatggaaggaaggatgtcatgtatcagcactggagatggcagcctcatgcatgcgaccttccaagatttgatgccaccaagctgcttgaaaagctgaggaacaagagattagtatttgtgggcgattcagtcaacaggaaccaatgggtttctcttgtgtgcatggtagaggcctcaatacctgatgacaggctcaagatgcgcatcttcaatggctctctcatctccttcaaggcactggaatacaatgcaacaatagatttctactggtcaccactgcttgtggagtccaacagcgacaaccccataatccaccgtgtggagtatcggatcataagggcagacagaattgagaggcatgccaatgtctggaaggatgctgacatcattgtcttcaattcttacttgtggtggaggaagcagaaggatgacatgaggatgaaggtgatgtatggctcatttgaagatggcgatgcaaggttagacgaaatggaaatgattgatggtttcgagatagctctcaagaaacttactgaatggcttggagagaatattgacaagaacaagactagaatctttttcgcaggatcatcacctacacattcctgggctagcgactggggtggagaagacagcaacaagtgtctcaacgaaacagagccgatatacaaaaccggatacaaagctgcaactacagattacagtctgatggccaaggctaaatcatattttaaaacattggagccgaaaggtatacatgttcagatactgaacatcacagagctgtctgactaccgcaaggatgggcatcctactgtgttcaggagacagtttgttcctctgacaaaagagcagattgcgaacccagccagctacgcggattgcacgcattggtgccttcccggggttcctgatgtctggaacgagtttttatacggctacctcatgtacaaatgatacaccatgccagattttgtccccccaacatatataatgtacaaacgacatactgcatctagattaggctgctttatttagtgcagagaatggttggccccatcacatttacatgcagagacagacaaaaggatctgtcggtgtaccatctcactaaatcactaaaggagacattcaaagtggacagtgtgctattcgttttcatctgacagagcaacataactctgcaaattttaacaaaaatttaccatgaaaatgaacaacttaagagtgaaacactgtcatagatgtctctaaaattgaattcattcagactggcaggcaggcaagcaagaaaaaactacacatttgagaggtggatcaacgagagaagagcgacctgaacaataagggctgccgtcactgaaccagctgcaggttccacgctgtcgccggctcgcccacgcagcagcatacggcaccgcggaggggtacacgacgccatcatcccgcgcaggccaccgccaagcgcaccggcatgggcatggctactggattcgcaccgcaactcggaaaagctgccggcctccgccgccgtggaatggtcatcggttcaagcttggctgctttttttttttgaagcctctcatctgggtacagttgtagtatctgttcgtacacgtgcactcacacccactctacgcacacacaccacactcac

SEQ ID NO: 2212 - DNA, 2047 bp, Sorghum bicolor
ccactcacaaggcaatagcaacaggtggcaagatgacggtgctccattctccagttggagtgaggagcatcgtgacctccttggtggctttcttcatcttggctagctccatcgtcttcctccttgacagaggccaggaacagcaagtgcaaatggcagtcgagcatggacgccaagaagtgcagggggacgccagcaacgaggagtgcaactggtcgagggggcggtgggtgtacgacaacgtgtcccggccattgtacaacgggctcaagtgcgccttcatcttccccgaggtggcctgtgacaagtatggcaggaaggatgtcatgtatcagcactggagatggcagcctcatggatgcgacctcccaagatttgatgccatcaagctgcttgaaaagctgaggaacaagagattggtgtttgtgggtgactcagtcaacaggaaccaatgggtgtctctcgtgtgcatggtggaggcctcaatacctgatgacaggctcaagatacgcatcttcaatggctcactcatctccttcaaggcattggaatacaatgcaacaatagatttctactggtcgccactactggtggagtctaatagcgacaaccccattatccaccgggtggagtaccgaattataagggcagacagaattgagaagcatgccagtgtctggagggatgctgacatcatagtcttcaattcttacctgtggtggaggaagcagaaggatgacatgaggatgaaggtcatgtatggctcatttgaagatggtgatgcaaaattagatgaaatggaaatggtcgatggtttcgagatagctctcaagaaactaaccgaatggcttggagagaatattgacaggaacaagactaggatcttttttgcaggatcgtcaccaacacattcctgggctagcaactggggtggagaagacaagaacaaatgtcttaatgaaacggagccaatctacaaaaaaggttacaaagctgcaactacggactacagcttgatggccacggccaagtcctatttccgaacattggagccaaaaggcatacatgttcagatactgaacatcactgaactgtctgactaccgcaaggacgggcatcctacggtgtacaggaaacaatttgttcctctaacgaaggagcaaattgcagacccagccagttatgcagattgcacacattggtgcctccccggagttcctgatgtgtggaacgagtttttatatggctacctcgtgcacaaatgatgtacaaaatgtcaggttccttttaccccttatataaatatatgtacagatgacatacaccatctagattaggctgctttcatttgtgcagagaattgttgccccattacacttacattacatgtattgtagagacaaaaggagaaaagcaagagtctatctgtaaagattggaaacattcagagaatgacatgtgcagcgatgtactatttgtaggcatctgacagggcaacatatttctgcaaatctcaaagaaatgtagcatggcaaagaacaccaatgtcctggaatcctggatgtctctgaaatggattcagttcatccagaccggcaggcaggcgaggaagaaaagcaggacatttgaccggtgggtaaggagaggagcaacctgagcaaaaagtgctattccacgttgtcgctggcccgccgcgcgcagtagcagcagcagcagcagcatacggaacccgtggagggagcacgacgccatcgccgcgcgcaggcccacatcgaaacgcgccaccatggccactggtcaccgccggcggccgccgcaactcggcaaagcttacgggctacgggtggatgccgtgacatttgacagacgaagcccaaattaattgggcctcagcagttacaagacgagcagcccatatatgggagggtaccgtacattcacatggattgcgagagagagagagagagagctatattgcgagaatgtgcatatgtaacggtaaactatagaaaatgtcttatttatttatttattattaatgagggag

SEQ ID NO: 2213 - DNA, 1353 bp, Saccharum officinarum
caagatgacggtgctccatgctccagttggagtgaggagcatcgtgacctccttggtggctttcttcatcttggccagctccatcgtcttcctccttgacagaggccaggaagagcaagtgcaaatggcagtcagagggacaactgaagatggggatgctagcaacgaggagtgcaactggtcgagggggcggtgggtgtacgacaatgtgtcccggccattgtacaacgggctcaagtgcgccttcatcttccccgaggtggcctgtgacaagtatggcaggaaggatgtcatgtaccagcactggagatggcaacctcatggatgcgacctcccaagattcgatgccatcaagctgcttgaaaagctgaggaacaagagattggtgtttgtgggtgactccgtcaacaggaaccaatgggtctctctcatgtgcatggtggaggcctcaatacctgatgacaggctcaagatacgcatcttcaatggctcactcatcttcttcagggcattggaatacaatgcaacaatagatttctactggtcaccactactggtggagtctaacagcgacaaccccattatccaccgggtggagtaccggatcataagagcagacagaattgagaagcatgccagtgtctggagggatgctgacatcattgtcttcaattcttacctgtggtggaggaagcagaaggatgacatgaggatgaaggtcatgtatggctcatttgaagatggtgatgcaaaattagacgaaatggaaatggtcgatggtttcaagatagctctcaagaaactaaccgaatggcttggagagaatattgacaagaacaagactaggatcttttttgcaggatcatcaccggatcattcctgggctagcaactggggtggagaagacaagaacaaatgcctcaacgaaacggagccgatctacaaaaccggatacaaagctgcaactacggactacagcttgatggccacggccaagtcctatttccgaacattggagccgaaaggcatacatgttcagatactgaacatcaccgagctgtctgactaccggaaggacgggcatccgacggtgttcaggagacaatttgttcctctaacgaaagagcaaattgcggacccagccagctacgcggattgcacgcattggtgcctccccggagttcctgatgtctggaatgagtttttatatggctaccttgtgcacaaatgatgtacagaatgtcaggttcctttttcctcttatatataatgtacaaatgacaaattccatttagattaggatgctcttgtgcagagaatggttggacctattacatttacatgtagagacag

SEQ ID NO: 2214 - DNA, 1979 bp, Sorghum bicolor
atgggatcaacgtgtaggtaactttgaaaatttagattgactgtataacaacctgtaaactgatatcaagaaaattgaatttcttgttttttttttccttttttggctaactggaccttctcatacttatttaccaaaaattcagatgaatcaaagcaggcagacattaccacccatatgtggttagcccaggggtcagtgttcagtttgtttgatgagcagtagaccttggccacttagccatgtgcaaatgcaatgtccccatcgcagagaagacaggtgcaccataaaagaggggagccaagctaagaaccacaatttttctgaaggaacaatgaaatcagaagcctctcacaagatgacagtgctccatgctccagttggagtgaggagcatcgtgacctccttggtggctttcttcatcctagccagctccatcgtcttcctccttgacagaggccaggaagcgcaagtgcaaatggctgtcgagagaactgaagaggaggacgcgagcaacgaggagtgcaactggtcgagggggcggtgggtgtacaacaacgtctcccggccattgtacaacggcctcaagtgcgccttcatcttccccgaggtggcctgtgacaaatatggcaggaaggatgtcatgtaccagcactggagatggcagcctcatggatgcgacctcccaagatttgatgccatcaagctgcttgaaaagctgaggaacaagagattggtgtttgtgggtgactcagtcaacaggaaccaatgggtctctcttgtgtgcatggtggaggcctcaatacctgacgacaggctcaagatacgcatcttcaatggctcactgatctccttcaaggcgttggaatacaatgcaacaatagatttctactggtcaccactactggtggagtctaacagcgacaatcccattatccaccgggtggagtaccgaatcataagggcagacagaattgagaagcatgccagtgtctggagggatgctgacatcatagtcttcaattcttacctgtggtggaggaagcagaaggatgacatgaggatgaaggtcatgtatggttcatttgaagatggtgatgcaaagttagacgaaatggaaatggtcgatggttttgagatagctatcaagaaactaacggaatggcttggagagaatattgacaagaacaagactaggatcttttttgcaggatcatcaccaacacattcctgggccagcaactggggtggagaagacaagaacaaatgccttaatgaaacggagccaatctacaaaaaaggttacaaagctgcaactacggactacagcttgatggccacggccaagtcctattttcgaacattggagccaaaaggcatacatgttcagatactgaacatcactgaactgtctgactaccgcaaggacgggcatcctacggtgtacaggaaacaatttgttcctctaacgaaggagcaaattgcagatccagccagctatgctgattgcacgcattggtgcctcccaggagttcccgatgtctggaacgagtttttatatggctacctcgtgcacaaatgatgtacaaaatgacaggttccttttatcccttttataaatatgtacaaatgacatactccatttagattaggattctcttgtgcagagaatggttggacctattacatttacatgtagagacagataaaaggagaaaagaaaggatctgtctgtgcatcacctaataggatcggtgtactatttgtttacatctaacagggtgacatgattgtaaatttagaagaaatttgtcatggcaaagaacagcttaagaatgattaactgtcctagactcctagatgtcccttatatatatatatatgtacaactccatatagattaggctgctttaatttgtgcagagaattgttgccccattacacttacattacatatagatacaaaaggagaaaagaag

SEQ ID NO: 2215 - DNA, 1618 bp, Pennisetum glaucum
gccacaaggaagaatgaagacagaagccactcccaagatgacggtgctccatgctccggttgcagtgaggagcatcgtgagctccctagtggccttcttcatcgtcgccagctccgtcaccttcttgctcgacggaggccaggaagcacgagtgcaaatggcggtcgagcatggccgccaagaaatgcagttgttgaaggtggaggctgggctccaagaaccagcgatgaggggcactactgacgcggcggacgccggcgaggaggagtgcaactggtcgagggggcgatgggtgtacgacaacatgtcccggccattgtactccggcctcaagtgtgccttcatcttccccgaggtggcttgcgacaaatatggaaggaaggatgtcatgtaccagcactggagatggcagcctcagggatgcgaccttccaagattcaacgcaactaggctgcttgaaaagctgaggaacaagagactggtgtttgtgggcgactcagtcaacaggaaccaatgggtttctctggtgtgcatggtggaggcctcaatacctgatgacaggctcaagacacgcatctacaatggctctctgatatccttcaaggcactggagtacaatgcgacaatagatttctactggtcgccgctgctggtggagtccaacagcgacaacccaatcatccaccgggtggagtaccggatcataagggcggacaggattgagaagcacgccagcgtctggagggatgctgacatccttgtcttcaattcttacctgtggtggaggaagcagaaggacgacatgaggatgaaagtgatgtatggttcatttgaagatggtgatgcaaggatagatgaaatggaaatggtcgatggttttgagatagccgtcaagaaactaactgaatggcttggagagaacatcgacaagaacaagactagaatatttttcgcaggatcatcaccagaacattcctgggcgagcaactggggtggagaagacagcaacaaatgcctcaacgaaacagagcctgtctacaaagtcgggtacaaagctgcaacaacggattacagcttgatggccaaggctaagtcgtattttgaaacactggagccaaaaggtatacatgtcaagatactgaacatcacagagctgtctgactaccgcaaggacgggcatccaacggtgttcaggaaacaatacgttcctctaacgaaagagcagattgccaacccagccagctatgcggactgcacgcattggtgcctcccgggcgttcctgatgtctggaacgagtttttgtacggctacctcatgtacaaatgatacttgatatcccaaatataaaatgtacaaatgacatttataatgcatctagattaggctgctttgctttgctttgctttgttttgtgcagagaatggctggccccgtcacattttacattacgtgtagggacagacaaaaagatctgtgtatttgttttgatctgacagggcagtgtaattctgcaaaggagacactcaaagtgaacagtgtataccatcagtgtactatttgttttttgaatccgacagggcagtgtaactctgcaaatcgagcataggtttatatata

SEQ ID NO: 2216 - DNA, 1698 bp, Setaria italica
ctgcaaatgattttgcaaattcagaggttaatacaattgcggaacaaacatgataccggtatatacacaaaacctttccatttccgtactgcattccaaacagcctggcaccacatacctttttgtggttagcccgagggtcagtgtccatgttgcctgtcattgcagagactcgagaagtggccataaaagaggagagctaatcactatggtttctgaagaaagaacagcaggtaccaagatgacgattctgcaaactccggttggagcgaggagcatcgtgacctgcttagtggctttcttcatcttagccagttccatcgtcttcctccttgacaaaggccaggaagtgcaaatggcagtcgagcaccgacaccaacaagtgcaggtgaaggttgaagctagactccaagaaccagccatgggaggggcaactgaggtggacacgagcgaggaggattgcaactggtcgagggggcggtgggtgtacgacaacgtgtcccggccattgtactccggcttcaagtgcgccttcatcttccgggaggtggcttgtgacaaatatggcaggaaggatgtgatgtaccagcactggagatggcagcctcatggatgcaaacttccaagattcgatgccatcaagctgcttgaaaagctgaggaacaagagattggtgtttgtgggtgactcggtcaacaggaaccaatgggtgtccctcgtgtgcttggtggaggcctcaatacctgacgacaggctcaagatgcgcgtattcaatggttcgctcatctccttcaaggcattggagtacaatgcaaccatagatttctactggtcaccgctgctcgtggaatccaacagcgacaaccccattatccaccgggtggattaccggatcatacgggctgacagaatcgagaagcatgccaatgtctggagggatgctgacatcattgttttcaattcttacctatggtggaggaagcagagggatgacatgacgatgaaggtcatgtatggttcattcgaagatggtgatgcaaggttagatgaagtggaaatgacagagggattcgagatagctcttaagaaactaacggaatggcttggtgagaatattgataagaacaagactagaatcttttttgtaggatcatcaccaacacatttgagggctagcaagtggggtggagaagacagcaacaagtgtctcaatgaaacagaaccgatctacaaagacggatacgcagctgcagattacagcttgatggcaaaggctaagtcgtattttcaaacattggagccaaaaggtatacatgttcagatactaaacatcactgagctgtctgaataccgcaaggacgggcatcctacggtgttcaggggacagttcgttcctctgactaaagagcagattgcgaacccggccagctatgcagattgcacgcattggtgcctccctggcgttcctgatgtctggaacgagtttttatatgggtacctcatatagaaatgatatacagtaatgtcagatgtaactatattataatgtacaaatgacatactccgtctagattagggtgctactgtgcagagaattactgaagacgaaacagtcaaaatgaacagtatgtatcagtgactgtactatttgttttcatctgacagagcaacataatgtatcatggcaaagaacaactt

SEQ ID NO: 2217 - DNA, 3404 bp, Zea mays
ttttttttttttggttagcacttctactacactgccctcttttttctggttagcgcgagggtcagtgttctaggttgcttgggtagcactactttttcctagagctggggcatgcatataaccatgtgcaggagcagtgttgctagcagcattggatttgccccagtgtactacagactcgacaggtacggtgagcataaaagaggagagccgataagcacaatggcgcctgaggaaaggatgaagcagacagagggcagtcacaaggtggtaacagcagcagcagcaggtggcaagatggcggtgctccactctccggtcggagtgaggagcatcgtgacctccctggtggctttcttcatcctagccagctccgtggtgttcctcctcctcgacagagaagccgggctccaagaagaaccggcgataagagccggcggcggcggcggcgacgaggagtgcagctggtctcgggggcgctgggtgtacgacaacgtgtcccggccgctgtacgacgggctcaagtgcgccttcatcttccccgaggtggcctgtgacaagtatggcaggaaggatgtcatgtaccagcactggagatggcagcctcatggtcatggatgcgacctcccaagattcgatgccatgaagctgcttgaagagctgaggaacaagagactggtgtttgtgggtgactcggtgaacaggaaccaatgggtctctctcgtgtgcatggtggaggcctcgatacctgacgacaggctcaagatgcgcatcttcaatggctcgctcatctccttcaaggcactggagtacaacgcgacgatagatttctactggtcgccgctgctggtggagtctaacagcgacaaccccatcatccaccgggtggagtaccggatcataagggcagacaggatcgagaagcacgccagcgtgtggagggacgccgacgtcatcgtcttcaactcttacctgtggtggaggaagcagaaggatgacatgaggatgaaggtcatgtacggttcatttgaagatggtgacgcaaagctagacgagatggaaatggcggatggtttcgagatagctatcaagaaactgacggaatggcttgcaaagaacattgacaagaacaagactaggatatttttcgcaggatcatcaccaacacattcctgggctagcaactggggcggacaagacaagaacaagtgcctgaacgaaacggagccgatcagctacagacccggcggcgggtacaaggctgcaaccacggactacagcctgatggccatggccaggtcctacttccggcggacgctggagccgagaggcatacgcgtccagatactcaacatcacggagctgtccgactaccgcaaggacgggcatcccacggtgttcaggaggcagttcgttcccctgaccaaggagcagatcgcggacccggccagctacgcggactgcacgcactggtgcctcccaggcgtccccgacgtctggaacgagttcctgtatggctacctcacgcagcagagcaaatgacgatgcattattacaagaatggccttgttatatgtagtagtgtacagtgcagtacagattgccagctgctccgtttagattattagggatggacctgctgttacatgtagagagagacagacaggagatctgtcttgcccaacattaattctagtatctgtaaatcttgttcttcttgtccaacattaattctaggatctgctgctaaccattttttttggatttatgtaaactgagtgattatctgaaatagaatgatctgagtttgctgttccagtactgagcaagtaaaaaaaccaaaaaaacaaatcgcccaccgtggggctcgaacccacgaccacaaggttaagagccttgcgctctaccgactgagctagacgggcttgttttccctttttttttctttggctataaattggatccgcatcagtcagctcaacacttgttacggagcaactaaacatagagagagagagagagggtggatgacgaggacggcctactgctttctttgagacagcatgcatgcatggcctgagcttgctttgagccctcctcgctcgctcgctcaccttcttatctcctccatccatccaaaaatatctccatgcgctcagacggggacgagacgacgggagaaggaggaggagggcgcccgcccgccacgcgcctcctccaaatcccagccgtccacgtgtcccagtccgcgacccccacgcgcctatatccatccatcatcctattcctatcccgccacatagtccaccaccacctattattccgctcccgacgcccagaattcacgagaacgcacccgcccgcctcctccttccgtccccatccagatgatgcttagggtttccgcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtatcagaacaaacgcggaggcagggtgaggctccagtcgattgtggcgcctttgaccgagtttgaccaccccgagaaaggcgatgctctgtacgctatggagctgactctggctctggaaaagctggttaatgagaagctgcacagcctgcatggtgtggcaacaaggtgcaatgatcctcagctgatagacttcatcgagagtgagttcctcgaggagcaggtggaagccataaataaggtctccaagtatgtcgcgcagctgaggagagtgggcaacaaggggcacggggtgtggcactttgatcagatgctgcttcaggaaggggcctgaaggccaacaagggtggcgtggacggagctgagctctgggtggtgtattcttttctttttcttttctttccagttggttagtgttttagttgtagaacggtgttgcgttgcccacatgacatgatggatgttacgtggaggattgtctcttatatttgaacattatattgtcgttcgtttttggcatggctctgcaactgtcgtgagaagatctggactaagaatagatcctaacccaataagtagaaaaataacaaga

SEQ ID NO: 2218 - DNA, 2020 bp, Panicum virgatum
gcaatagtgatggaaaggaacgcaaagaaaaagccacggctaatcattgatggtgtttgcacaaagctacatttttcagcaccctactctttaaaggaattcacaccgcaccgtgtggaaatgagatgcactccgacatcacttatttgtaattttgtattgacgcacagatagaccatagaataggggagacaagctatgaaccacacttttctgaagaaagattgacgacagaagctactcccaagatgacggtgctccatgctccggttggagtgaggagcatcgtgagcttcctagtggccttcttcatcgttgccagctccatcgtcttcctcttcgacagaggtcaggaagcgcaggtgcaaatggtggtcgatcatggacaccaagaagtgaaggagaaggcggaagctgggctccttggagggtcaactgaggccgccgacaccagcaaggaggagtgcaactggtcaagggggcagtgggtttacgacaatgtgtcccagccattgtactccgggctcaagtgcaccttcatcttccctgaggtggcttgtgaaaagtatggcaggaaggattccatgtaccagcactggagatggcagcctcatggatgcgacattccaagattcgatgccatcaggttgcttgaaaggctgaggaacaagagattagtgtttgtgggtgactcggtgaacaggaaccaatgggtttccctggtgtgcatggtggaggcttcaatacctgatgacaggctcaagacgcgcatcttcaatggctctctcatctccttcaaggcactggaatacaatgcaacgatagatttctactggtcaccgttgctggtggagtccaacagcgacaaccccattatccaccgggtggactaccggatcataagggctgacagaatcgagaagcatgccagtgtctggagggatgctgacatcattgtcttcaattcttatctatggtggaggaagcagaatgatgacatgaggatgaaggtcatgtatggttcatttgaagatggtgatgccaggttagatgaaatggaaatgatggacggattcgaggtagctattaagaaactaacggaatggcttggtgagtatattgacaagaacaagactagaatctttttcgcgggatcatcaccaacacatttccgggctagcaactggggtggggaagacagcaacaagtgtctgaatgaaacagaaccgatctacagagtcggatacaaatccgcagattacagcttgatggccatggcgaagtcgtattttgagagattagaggcaaaaggtatacatgttgagatactgaacatcacagagctgtctgactaccgcaaggacgggcatccgacggtgttcaggaaacagtatgttgctctgacgaaagagcagattgcgaagccagccagctacgcggattgcacgcattggtgcctccccggcgttcctgatgtctggaaccagttcttatacggctacctcatcatgtacaaatgacaaaaatatatataccactgcacatctagagataattcaattagggtgctccagtttgttttgcagacgctgctggtgagggtcagcgataatgtgaccgcaggcatttgtactcatgtgcatgtgtgcacagtaggatgggatccctgagtttgttcgtcgacaactggacatgaagcatcacgaaagcctttttcaaatgcacgcccaagttgcatcactctgccacatccaaatggatcggaagacctgatcgagtacctcacctactagattcctaagctttctgtaagatcgacgtgtgtcctactttgctctgctgggttgcacaaggccttggccttgtttgcttcacgctagggtttctagtgcacacaagtcgagaaaagaatctcacatgtatggagtagtaaataaagtatatttgtaaaacttttttagggatgagtataatttttcgcgacgaatctaatgacggcaattaatcggtgattggctac

SEQ ID NO: 2219 - DNA, 1876 bp, Panicum virgatum
gtaattttgtattgacgcacagatagaccatagaataggggagacaagctatgaaccacacttttctgaagaaagattgacgacagaagctactcccaagatgacggtgctccatgctccggttggagtgaggagcatcgtgagcttcctagtggccttcttcatcgttgccagctccatcgtcttcctcttcgacagaggtcaggaagcgcaggtgcaaatggtggtcgatcatggacaccaagaagtgaaggagaaggcggaagctgggctccttggagggtcaactgaggccgccgacaccagcaaggaggagtgcaactggtcaagggggcaatgggtttacgacaatgtgtcccagccattgtactccgggctcaagtgcaccttcatcttccctgaggtggcttgtgaaaagtatggcaggaaggattccatgtaccagcactggagatggcagcctcatggatgcgacattccaagattcgatgccatcaggttgcttgaaaggctgaggaacaagagattagtgtttgtgggtgactcggtgaacaggaaccaatgggtttccctggtgtgcatggtggaggcttcaatacctgatgacaggctcaagacgcgcatcttcaatggctctctcatctccttcaaggcactggaatacaatgcaacgatagatttctactggtcaccgttgctggtggagtccaacagcgacaaccccattatccaccgggtggactaccggatcataagggctgacagaatcgagaagcatgccagtgtctggagggatgctgacatcattgtcttcaattcttatctatggtggaggaagcagaatgatgacatgaggatgaaggtcatgtatggttcatttgaagatggtgatgccaggttagatgaaatggaaatgatggacggattcgaggtagctattaagaaactaacggaatggcttggtgagtatattgacaagaacaagactagaatctttttcgcgggatcatcaccaacacatttccgggctagcaactggggtggggaagacagcaacaagtgtctgaatgaaacagaaccgatctacagagtcggatacaaatccgcagattacagcttgatggccatggcgaagtcgtattttgagagattagaggcaaaaggtatacatgttgagatactgaacatcacagagctgtctgactaccgcaaggatgggcatccgacggtgttcaggaaacagtatgttgctctgacgaaagagcagattgcgaagccagccagctacgcggattgcacgcattggtgcctccccggcgttcctgatgtctggaaccagtttttatacggctacctcatcatgtacaaatgacaaaaatatatataccactgcacatctagagataattcaattagggtgctccagtttgttttgcagacgctgctgctgaggagtcagcgataatgtgaccgcaggcatttgttggactcatgtgcatgtgtgcacagtaggatgggatccctgagtttgttcgtcgacaactggacatgaagcatcaagaaagcctttttcaaatgcacgcccaagttgcatcactctgccacatccaaatggatcggaagacctgatcgactacctcacctactagattcctaagctttctgtaagatcgacgtgtgtcctactttgctctgctgggttgcacaaggccttggccttgtttgcttcacgctagggtttttagtgcacacaagtcgagaaaagaatctcacatgtatggagtagtaaataaagtatatttgtaaaacttttttagggatgagtataatttttcgcgacgaatttaatgacggcaattaatcggtgattggctac

SEQ ID NO: 2220 - DNA, 2246 bp, Sorghum bicolor
cacggtgaaggagccaacagaaaaaacaaagcatcatcaaaacccgggcataaaaccccagatttatcacgaccatgcatttgcagggtttttaatcggcttcgctgtgcgttcggtcgaataactgatcgccacgtagcaggggcacccctctatttaaatccccgatccgcagctcggcgaggccacacacatcccattcccctcttctcaattctcatccccccatcccatctcatagagaggagaagaagaaccagagaaaagctgagcacacacgcaagccgaaacaaaaagccatccaagatgcggagcccaaggggcgtcggcagcggctgctaccgcggcgccggcggccaagaccagcacgtcgacctgatcccgggtatccccgacgacgtggccgtggactgcctggcgcgcgtcccgcacgcctcccaccgcgccatgcgccgggtctgccgcggctggcggagcgccgcttccaccccagccttcgcctccgcccgcgcgcaggcggacgccaacgaggacatcgtctacctcatgcagttcggcaacccgtccgccgccgctgacgacgccgaacccaagggcgacgacggtcccgccaacaccccggcctacggcgtcgcggtctacaacgtgacgaccggcgagtggcgccgtgaccgcggcgccccgcctgtggtgcccgtcttcgcgcagtgcgccgcggtggggacgcgcctggccgtgctcggcggctgggacccgcgcaccttcgagcccgtggccgacgtccacgtcctggacgccgcgacggggcggtggcgtcgaggcgcgccgatgcggtcggcgcggtccttcttcgcgtgcgccgaggccggcggcaagatctacgtggccggcgggcacgacaagcacaagaacgcgctcaagacggcggaggcctacgacccccgcgccgacgcgtgggacccgctgccggacatgtcggaggagcgcgacgagtgcgacggcatggccacggtcgcgggggaccggttcctggccgtcagcgggtaccgcacggcgcggcagggcgggttcgagcgcgacgccgagtggttcgacccggccgcccgggcctggcggaggctggagcgcgtccgggcgccgccctccgcggcgcacgtcgtcgtcaaaggccgcgtctggtgcatcgagggcaacgccgtcatggagtggatggggacccgccgcgggtggcgcgaggtcgggccgtacccgccggggctcaaggccggcacggcgcgcgcggtgtgcgtcggaggtggggagaaggtcgtggtcaccggcgcgcttgacggcgaggaaggcggtggaaggcacgccgtgtgggtgtttgatgtcaagagcaagagctggaccgtcgtgcgcccgccgccggagttcgccggcttcgtcttctccgtcgccgccgttcggatctgaggatctgttggatctatctctgagtatgtggatcttcttcgtcccgtcccgtccgcgaccaagagacgtaaaggctactagtagtactagtacgtactgtatgtccgtgcaccgtttccgccattgctggatctgatgaagttgaagacccgcccgagatctgttggtcggcgcacctgtgttgccctgccatcgagggaagggcaaggaggtggtcgacgccagccagatcagatccgtggagccatgggtgggtgtagaaacttgggaaaaagagagattcctgctgctttgttgctgctggtggtggtgagtcgagtgtgaaaattggatgagagatgagtgtggtgtttttgtcccgaggtgaaggacacagactgttttcttgttgctcttgtcctacagccccatgcttttgctgctgctattgcaatcgccgagtactagtactagtaataaaaaaccactgtacatagcactcaacaagttggcctgatctgcgttatttttgtgtgatctgggagcatggcgatgactgatgacgagcaattgtagcagctctcgtcccaaatgttccattgccagcgttgaaacagctgctgccgtcgttgaacacaatgggcgtcccatctcggaatcatggtctccaatttgtttaccatttttctccgactacacaagggctgtgcttgattgcaatgcaagctggctaacaatggaatcgaagcattggcgagctgacgttgctaggcgatattattgttatttttaattaaaaaaaaaaaaaaaaa

SEQ ID NO: 2221 - DNA, 2017 bp, Zea mays
tacacgctgtacaccacccaaaagaaaagatcagaccattcttctagacattgcacagacgacatgtaccaagaaaaaaaatgtttcggtcccatctgtaggttgcaagctttccatcctttctgtgtctgtgtgtgtttttttttctgcctgcttgaggagtccactaggcctagtagttttagcttaaagatgcaaacttttccacgacaaataaaaacagaaaaggcgtcgtcaaaaccgggcagaaaacaccagctttatactaaatgtttttatatcggcttcgctgtgcgttcggtccaataaccaagcgccacgtcgcacgggcactcctctatttaaccgcctagcagctgctatgcgaggccgcacagcacatcccattcccctcgtctcatctcaagagcgactagagagaggaagagaacaagcgataagctcatctcgcacgcaagatgcgggctccaaggggcggaggcggctgccgcggcggccaggagcatgtggagctgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctgatgcagttcgggaacccgtccggcgacgacgggcccaaggacggcgacgacgggcccggcagcaccccggcgtacggcgtggcggtgtacaacgtgacgacgggcgagtggcggcgggagcgcggcgcgccccccgtggtgccggtgttcgcgcagtgcgcggcggtggggacccgcgtggccgtgctgggcggctgggacccgcgcaccttcgagcccgtggcggacgtgcacgtgctggacgccgccacggggcggtggcgccgcgccgcgcccatgcggtcggcgcgctccttcttcgcctgcgccgaggccggcggcaagatctacgtggcgggcggccacgacaagcacaagaacgcgctcaagaccgccgaggcgtacgacgccggggccgacgcctgggacccgctgcccgacatgtcggaggagcgcgacgagtgcgacggcatggccaccgtggccggcgaccgcttcctggccgtcagcggctaccgcacggcgcgccagggtgggttcgagcgcgacgccgagtggttcgacccggcggcgcgcgcgtggcgcaggctcgaccgcgtgcgcgcgccgccctccgccgcgcacgtcgtcgtccgcggccgcgtctggtgcatcgagggcaacgccgtcatggagtggatgggcacccgccgcggctggcgcgaggtcggcccgtacccgccgggcctcaaggccggcaccgcgcgcgccgtctgcgtcggcggcggggagaaggtcgtggtcaccggcgcgctcgacggcgagggcggccgccacgcgctctgggtgttcgacgtcaagacaaagagctggaccgtggtccgcccgccgccggagttcgccggattcgtcttctccgtcgcgtccgtccggatctgaggatctccatcttcttcgccccgtccgtccgcccgcccgcagctgcttgtagtactagtacgtacgtgcactgttttcgtcgttgctggatccgaggaagactcaccccctccaagatctacgtttgcaatggatggatctgcgcatccgctgacttactagtccgccttgccttcgattcgtccaaggagacgatggtgatcgacgccaacaagaagagatacatggaggagtgggagccatgggcggttgtaaaatctgaaaaaaaagtggtgagagtgtgaatttggatctggtggtgagtgtgaatttggatgagtgtggtgtttttgtcccgaggtgaaggacacagactgttgtttgttgctcttgtcctacagccatgcttttgctatcgctagccaactgcttactagtaataaaaaccactgtacata

SEQ ID NO: 2222 - DNA, 1980 bp, Zea mays
aattatttgcaggtttttatatcggcttcgctgtgcgttcggtccaataaccgagtcccacgtagcacgcacacccctctatttaatcgcccactcgcctgtctgcgaggccgcacatcccattccccacatctcaagtgaagagaagtagaactagtggagagaggagaacaggagattagatcagctcgcacgcaagccaaaggaaaaggcaagatgcggagcccaaggggtggaggcggcctggagcacgtggatctgattcccggcatccccgacgacgtcgccgtggactgcctggcccgcgtcccgcacgcctcccaccgcgcgatgcgccgggtctgccgcggctggcgtagcgccgccgcggcgccggccttcgcgtcggcgcgcgccgcggcgggcgccaacgaggacctggtgtacctgatgcagttcgggaacccgtccgccgacgacgggcccaaggacggcgacgaggggccgggcaacgccccggcgtacggcgtggcggtgtacaacgtgacgacgggcgagtggcggcgggagcttggcgcgccgcccgtggtgccggtgttcgcgcagtgcgcggcggtggggacccggctggccgtgctgggcggctgggacccgctgaccttcgagcccgtggcggacgtgcacgtgctggacgcggcgacggggcggtggcggcgcggcgcgcccatgcggtcggcgcgctccttcttcgcgtgcgccgaggccggcggcaggatctacgtggcggggggccacgacaagcacaagaacgcgctcaagacggccgaggcctacgacgcggaggccgacgcctgggacccgctcccggacatgtcggaggagcgcgacgagtgcgacggcatggccaccgtggccggcgaccggttcctggccgtcagcgggtaccgcacggcgcggcagggcgggttcgagcgcgacgccgagtggttcgacccggcggcgcgggcctggcgcaggctggagcgcgtgcgcgcgccgccctccgccgcgcacgtcgtcgtccgcggccgcgtctggtgcatcgagggcaacgccgtcatggagtggatgggcacccgccgcgggtggcgcgaggtggggccctacccgccggggctcaaggccggcacggcgcgcgccgtctgcgtcggcggcggcgagaaggtggtcgtcaccggcgcgctcgacggcgtgggcggcggcggccggcacgccctctgggtgttcgatgtgaggagcaagagctggaccgtggtgcccccgccgccggagttcgccggcttcgtcttctccgttgcgtccgtccggatctgagaaaccctagatctgcttcgtcctgtccgtccctccgcgatcgatcaagagacgtaaaggctacttactgctagtgctagtacggtagtacctactgtatgtccgtgcgccattgctggatctgatgaacactactagttcgagatctgcgctcccgtgtaccatgggtctgggcatctgcttggtacccgtacgccctgccatcgattcgtccaaggaagtgtaaggtaaggtggtgacccgacgccagccagatgagatgagatccattgaagccgacagccgagggttgggtgtaaaatatgggtgtggtgtttttgtcccgaggtgaaggacacagactgttgttcgttgctcttgtcctacagccatgcttttggtactgcgatccgagtgcgtgtgatctggatggagcttggagatgacggaattgcgacggatcctcatgtgcctgcggctccgcctgcgctgaaccgctgtcatgcctaccatcgttgaacaaaggcagtttgtgttctgccgagcgtccatctcgagaacagaacataatgtaatctccacttggctatcaatcatttctctggctatcattgcaatccaagctggcgatttgtccgctaattgaacggaagttgacattgccacata

SEQ ID NO: 2223 - DNA, 2881 bp, Setaria italica
gcatcccattcccctcccttctagaggagagagagaagagataagctgagcttgcaagcaaagagagaagcggccaagatgaagaacccaagaggagtcggcggcggccgtggcggtcccatggagcacgtcgacctgatcccgggcatccccgacgacgtcgccgtcgactgcctggcgcgcgtcccccacgcctcctaccgcgctctgcgccgggtctgccgcggctggcggagcgccgccgccgcgccgtccttcgcctcggctcgcgccgcagcgggcgccaacgaggacctcgtctacatgctccagttcgggaacccgtccgccgacgacgggcccaaggacggcgacgcgccggccagcaccccggcgtacggcgtcgccgtgtacaacgtgaccacgggggagtggcgccgggagcccggcgctccgcccgtggtgcccgtgttcgcgcagtgcgcggcggtggggacccgcgtggcggtgctcggcggctgggacccgcgcaccttcgagcccgtcgccgacgtccacgtcctcgacgccgccaccggcgagtggcgccacggcgcgccgatgcggtccgcgcggtccttcttcgcctgcgccgaggcgggcggcaagatctacgtcgccggcgggcacgacaagcacaagaacgcgctcaagaccgccgaggcctacgacgcggaggccgacgcctgggacccgctcccggacatgtcggaggagcgcgacgagtgcgacggcatggcgactgtggcgggggaccgcttcctcgccgtcagcgggtaccgcacggcgaggcagggcgggttcgagcgcgacgccgagtggttcgacccggcggcgcgggcgtggcggaggctggagcgcgtccgggcgccgccgtcggccgcgcacgtcgtggtccggggccgcgtgtggtgcatcgaggggaacgctatgatggagtggatgggcacccgccgcgggtggaccgaggtcgggccgtacccgccggggctcaaggccggcaccgcgcgcgccgtctgcgtcggcggcggcgagaaggttgtggtcaccggcgccctcgacggcgagggcggcggcgcgcgacacgcggtctgggtgttcgacgtcaagaccaagaactggaccgtggtgcgcccgccgccggagttcgccggcttcgtcttctccgtcacgtccgtccgcatctgaacatctggatctcgccctcccctgatccagaccaagagaaaaggaaaaaaaaatcaaggctactgctagtacgtatatccctgcaccgtgtccgccattgctggatctgagatctgcgcatctgtccgcgactagtatgcccgtgccatcgaaggagctgaagaaggaaggagacccgatcgacgccagatcttggagccatgggtgtagaaaagcaaaaaaagattcctcctttgttgctggtggtgatgagagattagtgtggtggtgtttttgtcccgaggtgaaggacacagactattttcttgctgttcttgtcctagagccatgcttagctagccgagtaataacagctactgtacatactactactgctattgtactgtaagatccaaggtcgcctcttgtgatccactcccatctcgatccagatctgattcgtggcgatgagccgaggagcaattggagaggcagatctcgtcttgattgattcttccatggccggcgcctcgcaagcgttgaacagctgccgttgaacaagatgcggatttgccgggagagcatctcgatcacatcagctggaagctattgtttatgtttttctgactaaacaacgggcgatcctgatttgcgaccccccgctggcgtccagcgttccccatcaatcaatgaatgaaatcgatgaggaggagaagcttagagttgacatcgccgcgagatttttatttttcttcgccgggaggcgggggtgaagcgaagcttcgcctcctccaagggccaaccgccagccatccacctgtattgcatcatcattttcatcctcgcacgtctccatccgccattacattttctctccctcgtcctaaaataatggaaaggaaaggaaggaaaggccgagaagccaagcgacgcatccatcccatccgcagagagagagagataaggccgccacccgccagcggttttggcgtcccggctggggcttgattgacgccgacacgcagcgaggccggccggctggcggaggagctggttcgccgtctcttcgtccccgctccactcgctcccagccgtaccagggaccagcgtggcgaggaccaaggagatgatgccatgagctggcggccgcgttccttttccagctgggtttgcagcggcgttttccgtgccgggtctcggagtttcttttccccgtgcgtgcgattgtgcaaagcatctcgcccgagatctggcgaggaggataaggacacggaggccgcgatccgggcggtccagcccgtggtggtggggctgggggtggcgtccgccgctcgccaaccgatggaagacgacgagcggggtgagatgcgcctgcgcggcgttgtctgcccgtggcgtccggccgggggccacggatgctggcgacgcgaccccgtccctctgcttgcctgtgcctagtttgcttttgcgaaagctccggcgaacgaacttccactgtagctgcacctacgcctacgtgtgtttctttattagcactagcatcagtacttgtcggtgaacactgaacagtatgttcgttcgtgtttatgtgaagtggaagagtgttattttctactccgtacctacagttcgttcatagatacatttttagagatttttttttcatgagaaacaatcaaagaattattttggctgg

SEQ ID NO: 2224 - DNA, 1781 bp, Panicum virgatum
ccttccagaggagagagagagagagaagaaaagataagctcaggctcagctcgcaagcaagtggagatgcggagcccacgaggagcagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgccaccgaggacctcgtctacctcctgcagttcggcaacccctccgccgccgacgacgacggggcgcctaaggacggcgccgacgcgccgccgcccagcgcgccggcctacggcgtcgccgtctacaacgtgaccacgggcgagtggcgccgggagcgcggcgcgccgcccgtgctccccgtcttcgcgcagtgcgccgcggtgggcacccgcgtggccgtgctcggcggctgggacccgcgcaccttcgagcccgtcgccgacgtgcacgtcctcgacgccgccaccggcgcgtggcgccgcgccgcgccgatgcggtccgcgcggtccttcttcgcgtgcgccgaggccggcggcaagatctacgtcgccggcgggcacgacaagcacaagaacgcgctcaagacggccgaggcctacgacgccggcgccgacgcctgggacccgctcccggacatgtcggaggagcgcgacgagtgcgacggcatggccaccgtggcgggcgaccgcttcctcgccgtcagcgggtaccgcacggcgcggcagggcgggttcgagcgcgacgccgagtggttcgaccccgccgcccgggagtggcggcggctggagcgcgtccgggcgccgccctccgcggcgcacgtcgtggtccggggccgcgtctggtgcatcgagggcagcgccgtgatggagtggatgggcacccgccgcgggtggcgcgaggtcgggccctacccgccggggctcaaggccggcacggcgcgcgccgtctgcgtcggcagcggcgagaaggtggtcgtcacgggggccctcgacggggagggcggccggcacgcgctctgggtgttcgacgtcaggaccaagagctggactgtggtgcgcccgccgccggagttcgccggcttcgtcttctccgtcgcgtccgtccgcatctgaagatctggatctcggccgccccagccccgatccgcccccatcgaccaagaaacaaaagaagaaatcaaggctactacgactactagtgtgtgtccgtgcaccgtgcccgccattgctggatctgagatctgcgcgtcggccatggatctctgcatctgcttggatactagtatgcccgtcccataatcctacatcgaaggagttgaaggagagcccccgatcgacgccagatccacggatcgagccgtgggtgtgagaaaaaagccaaaaaaaaagatgaagattcctgctttgttgcgggtggtgagtgttcgttcccgatgagagatgagagatttgagtgtggtgtttttgtcccgaggtgaaggacgcagactattttcttgctgttcttgtcctactacagccatgctttgctttgctagccgagtaataacagctactgtacatactactactacttctgctaccaccactgctattgtaagatccaaggccatgtacgtgtcccatcaaaatttcacaagaaaacgaacttccgcatgaagtattaatactaaatgaagtttatttgt

SEQ ID NO: 2225 - DNA, 1817 bp, Panicum virgatum
cattcccctcccccttctagatggagagatagagaagaaaagataagctcagctcagctcgcaagcaagaggtggagatgcggagcccacgaggaggagggcgcgcccatgagcacgtcgacctgatcccgggcatccccgacgacgtcgccgtcgactgcctggcgcgcgtgccccacgcgtcccaccgcgcgctgcgccgtgtctgccgcggctggcggagcgccgccgccgcgccggccttcgccgcggcgcgcgccgccgcgggtgccaacgaggacctcgtctacatgctgcagttcgggaacccctccgccgccgccgacgccgacgacggcgggcccaaggactgcggcgcgccgcccagcgcgcccgcctacggcgtcgctgtctacaacgtgaccacgggcgagtggctccgggagcgcggcgcgccccccgtgctgcccgtgttcgcgcagtgcgccgcggtgggcacccgcgtcgcggtgctcgggggctgggacccgcgcaccttcgagcccgtcgccgacgtgcacgtcctcgacgccgccaagggcgcgtggcgccgcgccgcgccgatgcgctcggcgcggtccttcttcgcctgcgccgaggccggcggtaagatctacgtcgccggcgggcacgacaagcacaagaacgcgctcaagacggccgaggcctacgacgccgttgccgacgcctgggacccgctcccggacatgtcggaggagcgcgacgagtgcgacggcatggccaccgtggccggggaccgcttcctcgccgtcagcgggtaccgcacggcgcggcagggcgggttcgagcgcgacgccgagtggttcgacccggcggcccgggagtggcggcggctggagcgcgtccgggcgccgccctccgcggcgcacgtcgtcgtccgggggcgcgtctggtgcatcgagggcaacgccgtgatggagtggatcagcccccgccgcggctggcgcgaggtcgggccctacccgcccgggctcaaggccggcacggcgcgcgccgtctgcgtcggcggcggcgagaaggtggtcgtcacgggggccctcgacggggagggcggcggcggcgggcggcacgcgctctgggtgttcgaggtcaagaccaagaactggaccctggtgcgcccgccgccggagttcgccggcttcgtcttctccgtcgcgtccgtccgcatctgaagatctggatctcggccccccagccccgatccgcccccatcgaccaagaaaagaaacagaagaaaccaacgctactacctactagtacgtgtgtgtccgtgcaccgtgcccaccattgctggatgcctggatctgagatctgcgcgtccgccatggatcgaaggagtagaaggaaggaaggagaggccccgaggatcgacgccagatccacggatcgagccgtgggtgcaagaaaaagccagaaaaagatccctcctttgtcgccggtggtgagtgttcccgatgagatgagagattttggtgtggtgtttttgtcccgaggtgaaggacgcagacttttttcttgctgttcttgtcctacagccatatgctttgctagcccgagtaataacatctactgtacatactactactacttgtactaccaccactgcttttgtaagatccaagctcgcctcttgtgatcctgatctgattcatggcggcgaccggtgcgatgaggggccgtttagttcccaaaaattttcacctcccctttaaatacatacacatatatgaagtactaaatgtaattaaataacaagaataattacacagtttggatgt

SEQ ID NO: 2226 - DNA, 2282 bp, Oryza sativa
catgttgaaccggcagaaaaacaggctttccaaacaggttgctttcatttttaaaatttaattttcattaaatttcgttagcggtggagatccaccaatcagaaggcgccacgtagccttgagtgagctctatttaaaccactcctctccccccagagagaggcgacccacagatccagaagcagcaaaaaaaagagaaaaaaatcagagaaaaaaaaatgaggagcccgaggagccgtgcgctagagcgcgacgccggcggcgtcgccgtcgagcacgtcgagctcatcccggggatgcccgacgacgtcgccgtcgactgcctggcgcgcgtcccgcacggggctcaccgggcgatgcggcgcgtgtgccgcgggtggaggagcgcggcggcgacgcccgcgttcgccatggcgcgcgccgaggcgggcgccaacgaggatttggtttacctgctccagttcgcgaaccccgcggcggccgcggcggccgcggaggaggcgaaggaggacggcgacgcgccggcgaactccccggcgtacggggtggcggtgtacaacgtgacgacgggggagtggaggcgggagaaggcggcgccgccggtgcccatgttcgcgcagtgcgccgcggtggggacgcgcctggcggtgctcggcgggtgggaccccgagacgttcgagcccgtggcggacgtccacgtgctcgacgcctccaccggcgtgtggcggagcgcgccgccgatgcggtcggcgaggtccttcttcgcgtgcgcggaggccggcgggaggatctacgtggcgggcgggcacgacaagcacaagaacgcgctcaagacggcggaggcgtacgacgccgtggcggacgcgtgggacccgctcccggacatgtcggaggagcgggacgagtgcgacgggatggcgaccgtcgccggcgacaggttcctcgccgtgagcgggtaccgcacggcgaggcagggcgggttcgagcgcgacgccgagtggttcgacccggcggcgcgcgcgtggcgccgcctcgaccgcgtccgcgcccctccctccgccgcccacgtcgtggtccgcggccgcgtctggtgcatcgagggcgccgccgtgatggagtggctcggctcgcgcggcgggtggcgcgaggtcggcccctcccccccgggcctcaaggccggcaccgcccgcgccgtctgcgtcggcggcggcgagcgcgtcgtcgtcaccggcgccatcgaggactccgacggcgggtccggccgccacgccctctgggtgttcgacgtaaagaccaagaactggaccgtggttcgcccacctccagagttcgccggattcgccttctccgtcgccgccgtccgcatctgatccgatccgatccgccattgacgacgaaccccgccaagatccaagatctcgatctggatccagctgctccgcctcaaggagatctctactacacacaaccaaatactactctactctactagaacagtagtatgtgcacaagaaaagaatcacaaggagaagagaaggagaggaagctagtggtgagtttgtgaagctcctctcctctctctatctctccccaatctgttgttgttgtgaggatgatgatgatgatgagtgtggtgtttttgtccaagaaaaccatggaggaatcaaggggatgatcttggatctcctcctcatcctccatcgttcaaccatggttatggttatgagtagcaataatccaatccattgtacatattatgaccagccgtttgaggtgcagattgcagagtccatcttttgtctcaaaatgaaaccatctcgtcttatgatttcttgagaaatttgaatcagttcttgctgcaagagaaacacaagctgtggccggatttgcgccgggatcttggccggtgtagagtggttgacattggcgtttggatctggaggttgtagttaattggtcgattattggtaattaattagctgtggagcgttgcgtgaggcgatggaagcacgtcgccatcggcgaggaaggaaggaagggagataaggtcggcaccgagtaaacctcacatttgctttgcttgattgcttctcttttcgcccttcttttccttttcgtttttgtttttggttctcacatgggagatgacgagatcctctcgtttatggacttctccctctgtttttagctcccctatgtttcatcgtattgtatgacccgttttgattctttataccatgttgaaacttttaaagtttaaccaagtttcttgaaaattttag

SEQ ID NO: 2227 - DNA, 947 bp, Zea mays
agatccccacagctgccgccaagcgagcccggtccgacttggcctctcccccgccaaacaacgcctcgacgcgacgacccagcccagccccgcgccgcgatggccatgaccgtgatccgcctcgccgccatccgcccgccgtcggcctcttcctccgccgcgtccccgtcgctgtggccgcccgcgcggctgcgcctccgcgtgaggtgccgcgccggcggggacggagggatgaagaaggaggagggggaggccgaggcgcccgagtcgctcttcgccagggagctccggcggcgtgggatggcgccgggggccgccgcgcccgcgggcgctagcaaggaggccgaggagggggcgccggaggccggggccaagcgcggggtggcggccaccgagttcgagcgcggcgccgcggcggacggccagcgggagcgctccatggcgctcaacagcgagggcctcgagggtcttgttcctcgggcgaagttactgctatcacttggcagcaccttctttctggcgtttgggcccctgattcttgtcaccgtctcccttttcgctgttttatacgtgtactttggaccgagttttgtacacgatgcaagcaagacgccggtgtcgccgccaccgtacattgatccatacgagctactggaggacgagaggctcagccggccctccccagatgtgttctgaacatgaacagtgcaagaaccagtgcataattgattacaagaaatagtcatacatagcccaaaacttatcttttttactagacgtatagttgtaaatgcaactataaccatagagtgttataatcacttaatcagaagttttagcacgtagtattccatccatcgatttcagatctgaaacagttaaggtgtttggtttctagggctaaattttagtcctacattttattccattttagtctctaaattgtc

SEQ ID NO: 2228 - DNA, 907 bp, Sorghum bicolor
ccgtcgatgcacccgtcttccccttccgtccgccgcatccctgttccctactcctccgcccctctctctctctctctctctctctctctctctccagacgactgtgccgccgccgccctaggccaggtgctgaggctttccttggtctctgcgccggcgacgagcacccaccagggaaagtacctcattcccaaatgaagcacatattcaagattgctgcaatactggtagcaatctcagctatctggattgctctccttgaaacctcaactgttcctcgaagttatacttggctgcttcccatctacttggtagtggctcttggatgctacggcctttttatggttggatttggacttatgttcttcccaacttgtcctcaagaagctgtactactgcaacaggatattgtggaggcaaaggaattcttagcaaagaagggtgttgatgtgggctctgagtgagatcaattttgagtggttgacagtcatgactgtcttgaaggatcaccattctgttccttggaataggttgcttttttggaaactgtagataggaaacatatcattccactatgttcagctattactaacacagttttagtgagttggcatgttacagttatgtttttgtcaatgatgggtctcatattgacttgctggtgtttttcaagttttagaaagtttactgttctaggaatatttggtttctatcttgatttcccgtcagtggaccctttaccaattctgctgttctacgttgcttgtaccctcaagtctctttgaggattcagtgtttgaaatttgtgcagaacttctacagtttcttctgttcaatgtggcatgtcacaaattacagttaacagatgttctgatctgtttaatgccataattgctaacaacgagct

SEQ ID NO: 2229 - DNA, 937 bp, Panicum virgatum
ccaggctacaagagagaacctattcggatccccccggatctcaggctcagatcgacctcggctcgggaagcgatcgaactccagcttgaggtggcaggctcgctcgagctcggctcatggacagccctccccatcaggctcaggcttcccttctctctgactcccctcccttcgtcttctttccctggcggcgccgactgggcgagcggcagcgccattcgtcacgtcttcgcccagccctttgccggcgacgagcatccaccaggaaagcacctcgttctcaaatgaagcacatattcaagattgttgctatactggtagcaatctcagccatctgggttgcactccttgaaacctcaactgttcctcgaagttatacttggctgcttccaatctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggctaatttcagcaatcgacattcatgatcattttgaaggatcaccattctattccttggaatagactacattttggatactgtggctagaaatataccatttcactatgtgctgaactattactaacacagttttagtgagttgacatgttacactttgtcaaagattggggacatattgacgtggtgtttttaagtttcaacaagtgcattgctattctagggatatttgcttcctgcctcgattttgtatcaatgtattgtatcaattacgtcgtgtggtatcaccttatgatgttgcttgctcttgcaagcccttttgatgactcgttttttgaaattttgtgcagaactgtcatactagtatctttctgttgatataa

SEQ ID NO: 2230 - DNA, 955 bp, Zea mays
aaccttttcactgatccagcgaaggcatactgccgccgccgtttctgcatctcccatcttcgcaacgccggcgctccatcttgcgctccctccctcactcgctctcggtacgcaggcggcggcggcggcggcggtggcggctctcagattcgggctctcagcgacggcgtcagcagcttccactcccgcctctcgccagttgcctcgcgccctcgcctccggtcctccgcacaccgccggttacccttctaaaacacctcatccccaaatgaagcacatattcaagattgctgcaatactggtagcaatctctgctatctggattgctctccttgaaacctccactgttcctcgaagttatacttggctgcttcccatctacttggtagtggctcttggatgctatggcctttttatggttggatttggacttatgttcttcccaacttgtcctcgagaagctgtactactgcaacaggatattgtggaggcaaaggaattcttaggaaagaggggtgttgatgtgggctctgagtgagatcaattttaagtggttgacatacatgtctgttttgaaggatcaccattctgttccttggaataggttgcttttttgggtactgtagataggaaacatataattccactatgttcagctattactaacacggtttttgtgagttggcatgttatagttctgcttttgtcaatgatggggctcacattgacttgccggtgtttttcaagttttaaagactgaactgttctaggaatatttggtttctatcttgatttcccgtcagtggaccatttaccaattctgctgttcagtatgtcaccttatgcgttatgacatcacttgtactcgcaagtcccttcgaggattcagtgtttgaatttctctgcagtacttgcaaagtttctttcattcaatatggcatgttacaaactacag

SEQ ID NO: 2231 - DNA, 730 bp, Panicum virgatum
  misc_feature (726)..(726): n is a, c, g, or t
gattgacagccctccccatcaggctcaggcttcccttctctccgactcccctcccttcgtcttctttccctggcggcgccgactgggcgagcggcagcgccattcgtcacgtcttcgcccagccctttgccggcgacgagcatccaccaggaaagcacctcgttctcaaatgaagcacatattcaagattgttgctatactggtagcaatctcagccatctgggttgcactccttgaaacctcaactgttcctcgaagttatacttggctgcttccaatctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggctaatttcagcaatcgacattcatgatcattttgaaggatcaccattctattccttggaatagactacattttggatactgtagctagaaatataccatttcactatgtgctgaactattactaacacagttttagtgagttgacatgttacactttgtcaaagattggggacatattgacgtggtgtttttaagtttcaacaagtgcattgctattctagggatatttgcttcctgcctcgattttgtatcaatgtattgtatcaattacgtcgtgtggtatcncctc

SEQ ID NO: 2232 - DNA, 772 bp, Setaria italica
cttgttcctcccctcgtccgcgtgccccgcatcccggtttccgccatcgcccaacgaaccattccgcctgacctcgccgacgcacgcctcccgaaggatcctgcgacgggagctcgtcggctggaattccgctcctgttgtcgctgcccgccgcctcctgcgcgctgctgctgccccaggtgcgccgatcgatccggacctggattgattcatccgttgtggaaagcacaccattcccaaatgaagcacatattcaagattgttgcaatactggtagcgatctcatccatctggattgctctccttgaaacctcaactattcctcgaagttatacttggctgctccccatctacttggtagtggctcttggatgttacggactttttatggttggatttggacttatgttcttcccaacttgtcctcaagaagctatactactacaacaggatattgtggaagcaaaggaattcttagcaaagaagggtgttgatgtgggctctgagtgaggtcaatctcagcgattaacattcatgaccattttgaaggatcaccattctgttccttggaataggttcactatgttcagcactcttactaacacagatttagtgagttggcatgctacaattatgcttttaagatcctggtgttcttgaagcttcaacaagtgctttgttgttctagggacatttgcttggattttccatcagtggacatgtttgtatcagttgggccatgcagtatcaccttatgagttgcttgcacttg

SEQ ID NO: 2233 - DNA, 796 bp, Pennisetum glaucum
cccccctgccgctcctaccgctgccgggctccgtcggccttcgcctcctccgccacccccgacgaaccgccgccgacgctaatctcttggagctcgacgtcaccgccgcctccactgcctaaccgggggtccctcaccgccctgctctcgccacaaccgtcggccggcgagccgccccaaatccccctctaggtccggagatcacaggaaatcacttcgttcccaaatgaagcacatattcaagattattgctatactggtagcaatctcagccatctgggttgctctccttgaaacctcaactgttcctcgaagttatacttggttgcttccaatctacttggtagtggctcttggatgctacggccttttcatggttggatttggacttatgttcttcccaacttgccctcaagaagctttactactgcaacaggatgttgtggaggcaaaggaattcttagcaaagaagggtgttgacgtgggttccgagtgaagccaattttagtgattaacattcatggcagttttgaaggatcaccattatgttccttgcaataggctaccttttggatctatagcaagaaaatatatcactcactatgttcagaagtcagaactatttctaacacagtttttgtaagttgacatgttacactttgtcgaaggttggggatatgacgtggtgtttcactattttgttcaagggatgtttgtttcctatcttgatttcccatcagcgggcttgtatcaatggtgtcgtgcagtctcacattatgacgttgcttgcacttgc

SEQ ID NO: 2234 - DNA, 1137 bp, Panicum virgatum
ccacggcgaaggcgtgcggagctgcggcggggcgggtcggcggcacggcccgtgcggcggcggctgcgcggcgcgaggttgttggacggggcgggcccctcgccaccgtggcggcgtagcgggaggccgctagccccgattgatttggcggaccgctgcgcgtccgcaaaagatagcggaagcgatcgcgacccccgctgccgcgattttgtaggccaaaacctactgcagggtgggatggcgtacgtgcttgcggacccggtgcggacagcctcaaggtcagatcgacctcggctcgggattctatcgaactccagcttgaggcggcaggctcgctcgagctcggctcattgacagccctcccccttaggcttcccttctctctggctctctcctcccttggtcttccttccctggcggcgccgactgggcgagcagcagtgccattcgtcatcacgtcttcgtccagccctttgccggcgacgagcatccaccaggaaagcacctcattctcaaatgaagcatatatccaagattgttgctatactggtagcaatctcagccatctgggttgcactccttgaaacctcaactgttcctcgaagttatacttggctgcttccagtctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggccaatttcagcattcaacattcatgatcgttttgaaggatcaccattctgttccttggaatagactactttttggatactgtagctagaaaatatatcatttcactatgttctgaactattactaacacagttttagtgagttgacatgttacactttgtcaaagaatggagacatattgaggtggtgtttttaagtttcaaaaagtgcattgctgttctagggatatttgcttcgcacctcgattttgtattgtatcaattacggcatgcggtatcaccttatgatgttgcttgctcttgcaagccctttccatgtctcgttttttgaaattttgtacacaactgcca

SEQ ID NO: 2235 - DNA, 503 bp, Panicum virgatum
ccctctgtttctcttctcaaacctttcccttctctcgaagacaaactttctcctgatctcctcccttgctcgagatcttccttacctggcggcgacgactgggcgagcggcggcccagccctttgccagtgacgagcgcatcctccaggaaagcacctcattctcaaatgaagcacatattcaagattgttgctatactggtagcaatctcagccatctgggttacattccttgaaacctcaactgttcctcgaagttatacttggctgcttccaatctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggccaatttcagcattcaacattcatgatcattttgaaggatcaccattttgttccttagaatagg

SEQ ID NO: 2236 - DNA, 1850 bp, Brachypodium distachyon
gtcttttaattaattcttatctccttgccgagcgacccagacccctcgcaccgcggatctgacctggctgactttgggcggcgccgccactcatcacgctgccgagcgcccgagccccctagctcgtcttcctccgagcgcctccaccgcagaataatactgcatttcctaaatgaagcacatattcaagatcattgcggtgctggtggcgatctcagccttttgggttgccctccttgaaacttcaacggttcctcgcagttatacttggttgcttcccatctacttggtagtggcacttggatgctatggcctttttatggttggatttgggttgatgttcttccccacctgtcctcaagaagctatattactacaacaggatattgtggaggcaaaggaattcttagcaaaaaagggtgttgatgtgggctctgagtgaggtcaattctaatgatccgtattctatgaccagtccgaatcttctgggatactgtagctaggaaatacatatggcatttcagtatgtttagatatttttgctgacacagtttcggtgagtggtgtgttataattctgcttttgttagtttggtgtatgacctgtcacaatattactactgtcagaaaaacagttcgagatcaatgaatggatggtttgttaacaatctaccagtgttcgggggatgcttgctttgtttcttgatttcccatcacgggatatgtatcaattgtgctgtgcaagatcacctttggtgattcttggaattgcaagttcctttgatggttcagtttcagaatgccaaagtttctgtctggcgcggatatccttcattttgaactcaggaatgatttctaaaagttttgaaatttctgtaaagctctgtctcattatcacttgcaggctttcagcaaagaatgagcagcaaaaatatgtcccttaactaatatcactgcttattactccatgtttatgaaacaatgctctaattaaagaaccaggatacacctatacttttgatattatgccacgaacctatgtcaactcatgattctattttatatacatgttcagttacatgcaaagttcgcagcagacaattgtctactaccttcatgtagtcttgtcagaggctggtccatgatcttctccggcaccaggagctctccctgcagtctctgttcctatggcctcctcgtccattgcgccagcgacctgtgctgtgtcgtcggcctcgtccctggagcccctgcttgcagtagtcctcagttgtgagcatgggataatatcagagcagacagtactcaaggctgagatagtactggctatcatgaatgtttagagaaaacagcatatgaaaaggacagtacttgtatgagtagatgacgaggccaattgccgtgccggcgaaagcaacaaagtacatccagtcgacctgtggaggctcagtgtgctagcatcagttcaatttagaggcccatttgaaacataggaatttcacaggaagcaatttcaattttccacaagaatcagaaaagccttccatggtccaaacggggtctaagcacgacaatcaatatgagtccagaaagaagttgacgtgcacagaccttttcatggtaagcaaagatacggattagaacggcccacatgtccgaggttaggagtgagaggttcagcatagttgcgccgcatatctgaaacaattaagtatgaaccaaattctgtgaaatatttcaggacgattaataatttgaccacaagaggatagtagtttaccttcaggataataggtactgtggagtagaacaagaacattgctagtgcaaatccaataaaagggagcagct

SEQ ID NO: 2237 - DNA, 1984 bp, Oryza sativa
cgaaggcagagtggagtaacgatggtgtggtgctggtgtatagagcgacagttagttgccagggatccaagaagtttatcgtcgtgagtactgctggcaagtggtttaccagttatcgtaaagaattttaaagtgaaaattttgagataaaaggtggagcactccgttatctcccccttcccttggcgtaaaacaaaatctcccgtctcgtcgtcgccgcctccgctccttgcgccatctcgcggctgaacaggggaggggcgccgatctccattggcgagcagagcagggcgcgggaggggaggggatcctgaaaacacttggtttcccaaatgaagcacatattcaagataattgctatgctggtggcagtctcagctatttggattgcccttcttgaaaccgcgactgttcctcgaagttatacttggttgcttcccatctacttggtagtggcacttggatgctatggcctttttatggttggatttgggcttatgttcttcccaacttgcccgcaagaagctgtactactacagcaggatatcttggaggcaaaggaattcctatcaaagaaaggtgttgatgttggctctgaataatgtcaagatcgatgatagatgacttgaggctagtttggggacaactttgtgctcccttatatgagttgttttgggggctttatagctaggtatatgtcacttcgtaatgatcattttgctaacacaatttttcatggtgagtccttgttacatactgaatttaagacctttttcttttaggaaatattttttatggaaaatgaaatatgattgtgaagtaggaatggtctgttgacaagtgcattactgttcagggtgtttgtctcctcatttctggatttccctctagtggttatgtatcaattgtgcagtgtaatattaccttgtccctggcacagtgctgaaaccgactgcctgaaatactctgtacatcagatcgtccatagaaatttctctgaatcttttgcattacaacttgtcaggcaggcacgaagccttgaccaatattacaaaacaatagtaaaatcagacatgatacacgtatacttttaaattatgcagtaaacctatgctagttcttaaccctatcttgcttatctgacagtaaaaatatcacacatcatcacagttcacaccaaaccttgcccctatgaaccagctatcacactgtacatagtaaaacattttcagttacagcacaattgtgtgcagatgcagcagacagaatcctacctactactaccttgaggtagtagcaaccaacgacgagacctccttattggaggctggttcatcatcgtctccgactctccgcctccttggagcccctgcttgcaagagttctcagtggtgagtagtgacatcgtcacagctggttgctactccctccgtcacaaaataaatcaattccttatgtgtaggtttgtggtcagaaattgatttattttggtatgaatgaagtatgtatcttatgtgcatgttcagaagcaatggcagatgaagaaggaaggcttgtatgagtagatgacaaggccagctgccatgccagcaaaagcaacgaagcaaatccaatcaacctgcaaatgctcaaaatttgattaatatcaatttcaattttaagattgaagtattggcatgaggttatggagggaggaattgatgttcagagacctcatggtaagcgaagataaggattagaacagcccacatgtccgaggtcaaaagcgagaggttgagcttcagcattgttgccccacatatctgaagcattcagcccacatatctgaagttacatacaacattcaggaattttatgaatttgtgcacaagaggatcatggttagtaccttcaatataatcggtattgttgagttgaagaagaatattgttaccgcaaaaaatccgatgaaaggtagaatctgaagaaaaaaaagagagagaag

SEQ ID NO: 2238 - DNA, 592 bp, Cenchrus ciliaris
gtactcttccgcttccccacgacctctcacaagtctccagcggcgacgacgggcgagcggcgccgcccgccaatcattcgccgggcgctttgccggcgacgagcatctgacagggtgtgcccgcccattctcctcccttactgtcctgctgcgcgagatcgaacacccaaacccctaacgtaaggaaaaaaggaattctcaggaggcactgttacccaagtgctcgtaaatcaattcgccatcccatgaagtcgaaccgagtattggcaagcatgtagaaaaatcacatcttcagttgatgctgctcgagtgctcggaaatcacttcgttcccaaatgaagcacatattcaagattgttgctatactggtagcaatctcagccatctgggttgctctccttgaaacctcaactgttcctcgaagttatacttggttgcttccaatctacttggtaatggctcttggatgctacggcctttttatggttggatttgggcttatgttcttcccaacttgccctcaagaagctttactgctgcaacaggatattgtagaggcaaaggaattcttagcaaagaaaggtgttgatgt

SEQ ID NO: 2239 - DNA, 1032 bp, Hordeum vulgare
cccgtggtcgagtctcgagcccgtctaagccgcatacgtggctcggcctgcagcgagcagagaccaagaaagcctcgccgccgtcgccccgtccccgacaaccacctctgcgcatcgctcgccggcggcgggggcacaccagcggagcgcgcggccagtgcaacgacgcgcggatccagcgcgggacagctcagccagctatctcgcccctccgaccaacgcctcgacctcgactcctccccgcggctcgccgtcttccacccaaggtcgacgagatctgcctcctcaccgtcaacaccactacagtccacaggtttccgcccggcgagggttgcatttttagatgaagcacatattcaagatcatcgcggtcctggcggcaatctccgctgtctgggttgcgctccttgaaacctcaaccgtacctcgcagttatacttggttgcttcccatctacttggtagtggcgcttggatgctacggcctttttatggttggatatgggctcatgttcttcccaacctgccctcaagaagcagtgttactacagcaggatattgtggaggcaaaggaattcctatcaaaaagaggtgttgatgtgagctctgattgaggtcaataccgacgatttatgtttcgtgaccagtttgaagcttcctggataccatatagaaaaaatatggcatttcaccatgtctagatatttgttactaacgcagtttttatgagtggcatgttacaattgtagattttttagttcagtggatggcttgtcacgatactagttatgtcacgagaacagtgtgagaacaactaattaatggtttgttaacaagtccatcagtgttcaagacatgtctgctattttacaatctggttttcatcactggatgtgtatcatttttttttgtgcagtatcatctttggtgattaggctaccccaacttgtttggggctaaaggctttgttgtcgttgtagtatcatctttggtgaatggtggtggctcgaattgcgagttcctttcatggttc

SEQ ID NO: 2240 - DNA, 773 bp, Pseudoroegneria spicata
cgcgggacggcttcaccttcgggctcgccctctcctccgccccgaaccagcttcgacgcctcaacctcggctcctcgtcgcagctcgccgtcttccaccccaaggtcgacgagatctcactcctcgccgtcagcaccaccacagtccacaggcgtcagccccacgagcgctgtgtgtcctagatgaagcacatattcaagatcatcgcggtgctggcagcaatctccgccatctgggttgcgctccttgaaacctcgacagtccctcgcagttttacttggttgctccccatctacttggtagtggcgcttggatgctacggcctttttatggttggatatgggctcatgttcttcccaacctgccctcaagaagcggtattactacagcaggatattgtggaggcaaaggaattcctatcaaaaagaggtgttgatgtgagctctgattgaggtggatgacttatgtttcatgaccaggatattgcggcgcaccaatgatttatgtttgatgaccagtttgaagcttcctggataccgtatagaattttttatgatatttcactatgtctagatatttgttactaacgcagtttttgtgagtggcatgttacaattctacattttgttagttcagtggatggcttgtcacgatactagttatgtcaggaaaacagtgcgagaacaactaatttatggtttgttaacaagtccatcagtgttactgttcaagacatgtttgctacctccctccgtctcatattaattgtggct

SEQ ID NO: 2241 - DNA, 557 bp, Festuca arundinacea
ggcacgaggttcaattcgattccatccccccgttcggcgacgcggcggcggagacccagaagaagaggagatggcggagaacccgcagctgttcgggaacgggatgccggtgcccttcaacggcgagatgttcgtcctcgcgcgcgacggcgtcgagttcaacgtcgacaagatcccctcgtacgttgatccaaatgatcctaccaagattttccttcagcagcctgctgcagaatcccagatgaggaggagaaactaccacggccctgctggccaacaccacgattcctggatgaagcacatatacaagatcatcgcggtgctggcggcgatcaccgccgtctgggttgcgcttcttgaaacctcgacggttcctcgcagctatgcttggttgcttcccatctacttggtagtggcgctcgggtgctacggcctttttatggttggatatgggctcatgttcttcccaacgtgtcctcaagaagccgtgctactacagcaggacattgcggaggctaaggaattcttagctaagaagggcgttgatgtgggctctg

SEQ ID NO: 2242 - DNA, 818 bp, Secale cereale
cacacgcggatccagcgcgggacggcttcaccttcgggctcgccctcccctccgcgcccgaaccagctccgacgcctacacctcggctcctggtcacggctcgttgtcttccaccccaaggtcgacgagatctcactcctcgccgtcagcaccaccacagtccacaggcgtcagcctcacgagcgcagcatttttaaatgaagcacatattcaagatcatcgccgtgctggcggcaatctccgccgtctgggttgcgctccttgaaacctcgacagtcccccgcagttttacttggttgcttcccatctacttggtagtggcgcttggatgctatggcctttttatggttggatatgggctcatgttcttcccaacctgccctcaagaagcggtattactacagcaggatattgtggaggcaaaggaattcctatcaaaaagaggtgtcgatgtgagctctgattgaggtcaataccaatgattatgtttcatgaccagtttgaagcttcctggataccgtatagaaaaaattatggcatttcaccatgtctagatatttgttactaacgcagtttttgtgagtggcatgttacaattctagattttgttaagttcacgatactagttgtgtcaggaaaacagtgcgagaacaactaattaatggtttgttaccaagtccatcactgttcaagacatgtctgctattttacaatctggttttcatcactggatgtgtatccattttttctgtgcagtatcatcttggtgattagcctaccccaacttgtttggggctaaagactttgtagttattgta

SEQ ID NO: 2243 - DNA, 1020 bp, Secale cereale
gactcgcatccgtctcacgcaggcccggccccgcagcgagcagagcccagaaagcctcgccgccgtcgccccgtccccgacaaccacctctgcacatcggtcgccggccgcggggagacgccagcgctgtacgagccgggcaggcacacgcggatccagcgcgggacggctccaccttcgggctcgccctcgcctcgccccccgaaccagcttcgacgcctcaacctcggctcctcgccacagctcgccgtcttccaccccgaggtcgacgagatctcactcctcgcgggcagcaccaccacagtccacaggcgtcagccccgaaatcagggcgtaaactggccgccctagttttcatttgctcttttgattgatggcagacgagcgccgcatttttaaatgaagcacatattcaagatcatcgccgtgctggcggcaatctccgccgtctgggttgcgctccttgaaacctcgacagtcccccgcagttttacttggttgcttcccatctacttggtagtggcacttggatgctatggcctttttatggttggatatgggctcatgttcttcccaacctgccctcaagaagcggtattactacaacaggatattgtggaggcaaaggaattcctatcaaaaagaggtgttgatgtgagctctgattgaggtcaataccaatgatttatgtttcatgaccagtttgaagcttcctggataccgtatagaaaaaattatggcatttcaccatgtctagatatttgttactaacgcagtttttgtgagtggcatgctacaattctagattttgttagttcacgatactagttatgtcagggaaacagtgcgagaacaactaattaatggtttgttaccaagtccatcggtgttcaagacatgtctgctattttacaatccggttttcatcactggatgtgtatcctattttctctgtgcagtatcatcattggtgattagcctacccacttgtttggggctaaagtctttgtagttgttgta

SEQ ID NO: 2244 - DNA, 874 bp, Triticum aestivum
ctgcccatcggtcgccggccgcggggagacaccagcgctgtacgagccgggcagccacacgcggatccagcgcgggacggcttcacctccgggctcgccctcgcctccgcccccgaaccagctccgacgcctcaacctcggctcctcgtcacagctcgccgtctcccaccccaaggtcgacgagatctcactcctcgccgtcagcaccaccacagtccacaggcgtcagccccacaagcgctgcgttccctagatgaagcacatattcaagatcatcgcggtgctggcagcaatctccgccgtctgggttgcgctccttgaaacctcgacagtccctcgcagttttacttggttgcttcccatctacttggtagtggcgcttggatgctacggccttttcatggttggatatgggctcatgttcttcccaacctgccctcaagaagcggtgttactacagcaggatattgtggaggcaaaggaattcctatcaaaaagaggtgttgatgtgagctctgattgaggtcaataccaatgatttatgtttcatgaccagtttgaagcttcctggataccatatagaaaaaatatggcatttcaccatgtctagatatttgttactaacgcagtttttgtgagtggcatgttacaattctagattttgttagttcagtggatggcttgtcacgatactagttatgtcaggaaaacagtgcgagaacaactaattaatggtttgttagcaagtccatcagtgttcaagacatgtctgctattttagcaatctggttttcatcactggatgtgtatccattttttctgtgcagtatcatctttggtgatgcttcgaattgcgagctactttgatggttca

SEQ ID NO: 2245 - DNA, 329 bp, Triticum aestivum
ttcctagatgaagcacatattcaagatcatcacggtgctggcggcgatctcggccgtctgggctgcgctccttgaaacctcgacagttcctcacagttacacctggctgcttcccatctatttggtagtggcgcttggatgctacggcctttttatggttgggtacgggctgatgttctttcccacctgtcctcaagaagccatactactacaacaggatattatggaggctaaggaattcttatccaaaaggggtgttgatgtgggctctgactgaggtcgattccaatgtttaatattttgtggccagtttgaagcttcctggatac

SEQ ID NO: 2246 - DNA, 402 bp, Saccharum officinarum
caccaccataagcaccaacggaaaagcagtgttggctgcagcgccgcgggcagtagatcgagccttctgtccccggtccggcggcccccctgttgcaacttgcaagaacgtgctgccgacgatcgactcttgcggactcggttgtgtgccatggctctggatgcgaggtcccttccgacggtagtgtccgtccccgccctcgaagtctgctcagggatgccgagaaccgggaacggtggcggcgtttcgtccgcgacggccggcgcggcggaggtgtccgtcgtggacgtgccggcgctgtggaccgacgaggggaggatgaagcgggagctggtcgcgtgggccaaggccgtggcgtccatggccatcagggaaacgatgatgcagtgctgactgctgaag

SEQ ID NO: 2247 - DNA, 1826 bp, Panicum virgatum
ccattattttcacccgctcaagtcaatgaacgtcattagtgacgacagcacctggattgtattccatgcctcccttcgtcgcttgtctgtttccagggatcgatccctatccgatcctgatgtctcccgactcggcgacccggttgccatcgatgccctcgcctgtcctctaacgagacaagccacatgatgccattgccagtcagccaccaccaccgattgtgtgcgccaacgactctcttccggtgtcgcaaagattggtggcgtccacttcgactcttcgaggtgtactacagagctaccgtgccgtgcggtccaacgagtttccacttgctgattggcctgctgccgcttcacagtttcttcccgatcagctggctacgcgatccgatggcaagaaaagccaagccttgacgtggaacgcgcggtgtgtcggtcgcctgtctcaccaaaccggcgagcgagcagggaggtcgtggcgtggcgccgcagggctcacggtgccgcccgccccgacaagcggcggcgcccgtgctccccaccgcagccgcgcctctaaactaaatacagcaccaggcccggcaccgagcgaggccaagccagtcccgcggtgcgtccggtccgggggagtagagccggccggctccggcagcggggatggcggtggagatcccgttgatcgacctgcgcctggccggcgcggcgccggaggagtccgcgcgcctgcgggccgcgtgcgagcggctgggctgcttccgcgtgaccggccacggcgtgcccggggggctcctggccgagatgaaggccgccgtgcgcgcgctcttcgacctccccgacgacgccaagcgccgcaacgccgacgtcatccccgggagcggctacgtcgcgcccagcgccgccaacccgctctacgaggccttcgggctcctcgacgccgccgcgcccgccgacgtcgacgccttctgcgcgcgcctcgacgcgccgccgcacctcagggagaccgtcaaggcctacgcggagaagatgcacgacgtgatcgtcgacgtcgccggcaagctggcctccagccttgggctggcggagcactcgttcgaggactggccgtgccagttccgcatcaaccggtacaactacacgcaggacacggtgggctcctccggcgtgcagacccacacggactcgggcttcctcaccgtgctccaggaggacgagtgcgtcggcggcctcgaggtgctggacccggccaccggcgagtacgtgcccgtcgaccccgtcgccggctccttcctcgtcaacatcggcgacgtcggcacggcgtggagcaacgggaggctgcacaacgtgaagcaccgggtgcgctgcgtcgcgccggtgccgcgcatctccgtcgccatgttcctcctcgcgcccaaggacgacagggtgagcgcgccggaggcgttcgtggacgcggaccacccgcgccgctacagggagttcaactacgacgactacaggaggctccggctgtccaccggcgagcgcgccggcgaggcgctcgcccggttggcggcgtgacgtgggccacgcggccggctgcaaattgggagctgttgattactcctatacactagtgctactccgtatcggctgtctcgttgacccgttgtgaattggtatggagaagaaggattggcaattatgtcgccatgtgaattggtatggagtcttgatcaataaaatctcgtgtcatttgaaagtcgcacacacgtgcagccatcagcttgcgcatatatttttgaaactattgcggatataaatatataatgaagcaaaagttgctccta

SEQ ID NO: 2248 - DNA, 1793 bp, Panicum virgatum
cggccactgattggaattggatggtgccacgaggcaaccaaagctatgtgcgcaggagaggtttagaggtactacagattaattattttcacccgctcaagtcaatgaacgtcatcagtttttttttgataataatgaacgtcattagtgaaagcacctggattgtattccatgcctcagtgggatcgcgaccccttcctagcttgtctgtttccactactccagggatccctacccgatcctgatgtctcccgactcggcgacccggtgccattcgccgcccgcgcctgtcctataaacagacaagcgacatgatgccagccaccacgaccgaaactccgaaagtgtgcgccgacgtctctcttcacagttttccgtatcaactggctacgcgatccgatggcgagaaaagccagccttgacgtggaacgcgcggcgtgtcggtcgcttgtctcaccaaaccggcgagcgagcagggaggtcgtcgcgtgtcgccgcaggcctctcggtgccgtccgccccgacaagcggcgccgcccgtgctccccccgcggccgcgcctctaaatacagccccaggcggccaggcccggcaccgagcgaggccaagccagtcccgcggcgcgcgcgcaagtcgattcgggcggcgcgtccgggggagcagagccggccggctccggcagcggggatggcggtggagatcccggtgatcgacctgcgcctggccggcgcggcgccggaggagtccgcgcgcctgcgggccgcgtgcgagcggctgggctgcttccgggtgaccggccacggcgtgcccggggggctcctggccgagatgaaggccgccgtgcgcgcgctcttcgacctccccgacgacgccaagcgccgcaacgccgacgtcatcccagggagcggctacgtcgcgcccagcgccgccaacccgctctacgaggccttcgggctcctcgacgccgccgcgcccgccgacgtcgacgccttctgtgcgcgccttgacgcgccgccgcacctcagggagaccgtcaaggcctacgcggagaagatgcacgacgtgatcgtcgacgtcgccggcgtgctggcctccagccttgggctggcggagcactcgttcaaggactggccgtgccagttccgcatcaaccggtacaactacacgcaggacacggtgggctcctccggcgtgcagacccacacggactcgggcttcctcaccgtgctccaggaggacgagtgcgtcggcggcctcgaggtgctggatccggccacctgcgagtacgtgcccgtcgaccccgtcgcgggctccttcctcgtcaacattggcgacgtcggcacggcgtggagcaacgggaggctgcacaacgtgaagcaccgggtgcgctgcgtcgcgccggtgccgcgcatctccgtcgccatgttcctgctcgcgcccaaggacgacagggtgagcgcgccggaggcgttcgtggacgccgaccacccgcgccgctacagggagttcaactacgacgactacaggaggctccggctgtccaccggcgagcgcgccggcgaggcgctcgcccggttggcggcgtgacgtggcccacgtgaccggctgcaaactgggagccgttaattatactccgtatcggctgtctcgttgacccgttgcgttgtaacttggggagaaggatggctattgtagtggcttgtgaattgctattgagtcttatcaataagggttaattagatctgtgccattataattttttcgttttttgaaatacaccattactattcaag

SEQ ID NO: 2249 - DNA, 1397 bp, Panicum virgatum
gtggaacgcgcggtgtgtcggtcgcctgtctcaccaaaccggcgagcgagcagggaggtcgtggcgtggcgccgcagggctcacggtgccgcccgccccgacaagcggcgccgcccgtgctcccccccgcagccgcgcctctaaactaaatacagcaccaggcccggcaccgagcgaggccaagccagtcccgcggtgcgtccggtccgggggagtagagccggccggctccggcagcggggatggcggtggagatcccgttgatcgacctgcgcctggccggcgcggcgccggaggagtccgcgcgcctgcgggccgcgtgcgagcggctgggctgcttccgcgtgaccggccacggcgtgcccggggggctcctggccgagatgaaggccgccgtgcgcgcgctcttcgacctccccgacgacgccaagcgccgcaacgccgacgtcatccccgggagcggctacgtcgcgcccagcgccgccaacccgctctacgaggccttcgggctcctcgacgccgccgcgcccgccgacgtcgacgccttctgcgcgcgcctcgacgcgccgccgcacctcagggagaccgtcaaggcctacgcggagaagatgcacgacgtgatcgtcgacgtcgccggcaagctggcctccagccttgggctggcggagcactcgttcgaggactggccgtgccagttccgcatcaaccggtacaactacacgcaggacacggtgggctcctccggcgtgcagacccacacggactcgggcttcctcaccgtgctccaggaggacgagtgcgtcggcggcctcgaggtgctggacccggccaccggcgagtacgtgcccgtcgaccccgtcgccggctccttcctcgtcaacatcggcgacgtcggcacggcgtggagcaacgggaggctgcacaacgtgaagcaccgggtgcgctgcgtcgcgccggtgccgcgcatctccgtcgccatgttcctcctcgcgcccaaggacgacagggtgagcgcgccggaggcgttcgtggacgcggaccacccgcgccgctacagggagttcaactacgacgactacaggaggctccggctgtccaccggcgagcgcgccggcgaggcgctcgcccggttggcggcgtgacgtgggccacgcggccggctgcaaattgggagctgttgattactcctatacactagtgctactccgtatcggctgtctcgttgacccgttgtgaattggtatggagaagaaggattggcaattatgtcgccatgtgaattggtatggagtcttgatcaataaaatctcgtgtcatttgaaagtcgcacacacgtgcagccatcagcttgcgcatatatttttgaaactattgcggatataaatatataatgaagc

SEQ ID NO: 2250 - DNA, 1313 bp, Zea mays
gtgtgtcggtctcttgtctcaccaaaccggcgacatggtacatggaggccagcccgtcgcttggcgccacaagtctcggtgccgtccgtccgacaagcggcgccagcgcacgctggctgctcgtgcacgcctctaaatacggccccggacccgccaccaagcgaaggccaatcccgtccgccgccccccaccaaccacgaaccacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtgatgtcgtcacgcacgtgcaagccgttaattataggctcgcgcatgcatacgcctacacgagaggttgtctcgttaagccgttctattaaaatgtgtgggggagaaagatgactaccgtggtgccatgtggattgctatcgggtctgatcaataaaatcttgcaacacttgcac

SEQ ID NO: 2251 - DNA, 1332 bp, Saccharum officinarum
caccaacccacgtaaagcgaacccggccggcgcgtcagggacagcacacagctacagctagcgggccgcggcggcgatggcggagatcccggtgatcgacctgcgcctcgccggctcgtcgcccgaggagtccgcgcggctgcgggccgcgtgcgagcgcctgggctgcttccgggtgaccggccacggcgtgcccgcggcgctcctggccgagatgaaggccgccgtgcgcgcgctcttcgacctccccgacgacgccaagcgccgcaacgccgacgtcatcgccggcagcggctacgtcgcgcccagccccaccaacccgctctacgaggccttcgggctcctcgacgccgccgcgcccgccgacgtcgacgccttttgcacgctcctcgacgcgccgccccacgtcagggagaccgtcaagacctacgcggagaagatgcacgacgtgatcgttggcgtcgccggcgagctggcctccagcctggggctagtagaggagcactcgttccaggactggccgtgccagttccgcatcaacaggtacaactacacgcgggagacggtgggctcctccggcgtgcagacccacacggactcgggcttcctcaccgtgctccaggaggacgaacgcgtcggcggcctcgaggtgctggaccccgccaccggcgatttcgtgcccgtggaccccgtcgcgggctccttcctcgtcaacatcggcgacgtcggcacggcgtggagcaacgggaggctgcacaacgtgaagcaccgggtgcggtgcgtcgcgcccgtgccgcgcatctccatcgccatgttcctgctcgcgcccaaggacgacagcgtgagcgctccggagtcgttcgtggacgcggaccacccgcgcaggtacaaggcgttcacttacggcgactaccggaggctccggctgtccaccggcgagcacgcaggcgaggcgctcgcacggatggcggcgtgacgtcgtcacgtggttggagctgcaaattggaagccgaggcaagccgttaattaattatatacgactacacctacacgagtagagtagtgttccgtatcagttgtcgagacgttgtattaacgtgtggggagaaggatgactatcgtgctaccatgtgaactggtatcgagcttgatcaataaaattttggtgctgggaacgaatttaaatgtaaaggttagttgtggttggtggttttcttaagtctattgtcgttgcgcgatgttggtgggtggtagggattcgtctatgttggtttcagtttccgttctgcgttgttatgcggatggtgtattattttaaacgatttcatgatt

SEQ ID NO: 2252 - DNA, 1472 bp, Sorghum bicolor
gaaagaagtgtttgaattttaggccagctgacaggagctaagctacggcctacggtgtgtcggttgtttgtctcaccataatagcgacatgatggatgccatcagttcgtcgcgttccgtcaaaactcaaaagtccgcccgacaagcggcgccagcaccaacatcatttccgctcacgcctcctcgaatccgcagcgcagcggggatggcggagatcccggtgatcgacctgcgcctggccggctcggcggccgaggagtccgcgcggctgcgcgccgcgtgcgagcgcctgggctgcttccgggtgaccggccacggcgtgcccgcggggctcctggccgagatgaaggccgccgtgcgcgcgctcttcgacctccccgacgacgccaagcgccgcaacgccgacgtcatccccggcagcggctacatggcgcccagccccaccaacccgctctacgaggccttcgggctcctcgacgccgccgcgcccgccgacgtcgacgccttctgcgcgctcctcgacgcgccgccgcacgtcagggagaccatcaagacctacgcggagaagatgcacgacgtgatcgtcgccgtcgccggcgagctggcctccagcctggggctagtagcagaggagcactcgttccaggactggccgtgccagttccgcatcaacaggtacaactacacgcacgagacggtggtgggctcctccggcgtgcagatccacacggactcgggcttcctcaccgtgctccaggaggacgaacgcgtcggcggcctcgaggtcctggacccggccaccggcgagttcgtgcccgtggaccccgtcgcgggctccttcctcgtcaacatcggcgacgtcggcacggcgtggagcaacgggaggctgcacaacgtgaagcaccgggtgcggtgcgtcgcgcccgtgccgcgcatctccatcgccatgttcctgctcgcgcccaaggacgacggcgtgagcgcgccggaggcgttcgtggacgcggaccacccgcgcaggtacaaggccttcacttacggcgactaccggaagctccggctgtccaccggagagcacgcaggcgaggcgctcgcacggatggccgcgtgacgtacgtggtcacgcggttggagctgcaaattggaacgcctacacctacacgagtagagtagagagtcctacggatcgcttgtctcattgaaacgtcgcgtgtgggggagaaggatgactatatcgtgctaccatgtgaattgctaccgagcatggtcaataaaatcttgccctggaacgagtctgatcaccatcacgtggaacatgaggctattcatgtcacgaatcttatatatgcatattatgtgaaaagttgccttatagagccggtaaatatctcatatggttgagggtgtcaaagattagaatgtgccggtaaccgaaaccaaaatttgctcaacgccatcttttcacaaccaaa

SEQ ID NO: 2253 - DNA, 1195 bp, Zea mays
cgcgccatttccacccaacaaagcggcggcgccagcacgcactgcttctgcttgtgcgtgctcctccgttccgggcacgcctctaaagtctatacagcctcgaatccatcccggccgccgctcctgggggatactacagcgagccgaagcggggatggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtgacgtggctggagctgcaaattggattggaagccgagacaagccgttagttatttaccatgcccgtgcgttcaccgcacacaatcatattcaaaagccataaaataaaaaataattttaatatcagtcaacatatggtttaaa

SEQ ID NO: 2254 - DNA, 1206 bp, Panicum virgatum
aaagcctcccgtgacgtgaacgcagcggcgtgtcggccgcttgtcgatctcaccacaccggcggcgctatacatacagcagcagcaagcgaacccgggcggcgtgtccgggagactagagacgacgacggcctcggcagtgggatggcggcggaggtcccggtgatagacctgcgcctcgccggcgcggcgccggaggaagccgcgcgcctgcgggccgcgtgcgagcggctgggctgcttccgcgtgaccggccacggcgtgccgcgggggctcctggccgagatgaaggtcgccgtgcgcgcgctcttcgacctccccgacgacgccaagcgccgcaacaccgacgtcatccccggcagcgggtacgtcccgcccagcgccaccaacccgctctacgaggccttcgggctcctcgacgccgccgcgcccgccgacgtcgacgccttctgcgcgcgcctcgacgcgccgccgcacgtcagggagaccgttaaggcctacgcggagaagatgcacgacgtgatcgtcggcgtcgccggcgtgctggcctcgagcctggggctggaggagcactcgttcagggactggccgtgccagttccggatcaacaggtacaactacacgcagggcacggtgggctcctccggcgtgcagatccacacggactcgagcttcctcaccgtgctccaggaggacgagtgcgtcggcggcctcgaggtgtcggacccggccaccggcgagttcgtgccggtggaccctgtcgccggctccttcctcatcaacatcggggacatcggcacggtgtggagcaacgggaggctgcacaacgtcaagcaccgggtgcggtgcgtcgcgccggtgccgcgcatctccatcgccatgttcctgctcgggcccaaggacggccgcgtgagcgcgccggagccgttcgtggatgcggaccacccgcgccggtacaaggagttcaactacggcgactaccggggcctccggctgtccaccggcgagcacgccggcgaggcgctcgcacggttggaggcgtaacgtggccgcgtggtgcagcggctgatccggagcgttaatttggggcgaacgatgactttgaggctttgagctatgtgaattgcgatgaattgctagctattcaattccgatcaataatttttttcggtccgtctatgcctaactcaagtgatttgacgggttc

SEQ ID NO: 2255 - DNA, 1051 bp, Panicum virgatum
tagagacgacgacggccacggcagtgggatggcggcggaggtcccggtgatagacctgcgcctcgccggcgcggcgccggaggaagccgcgcgcctgcgggccgcgtgcgagcggctgggctgcttccgcgtgaccggccacggcgtgccgcgggggctcctggccgagatgaaggtcgccgtgcgcgcgctcttcgacctccccgacgacgccaagcgccgcaacaccgacgtcatccccggcagcgggtacgtcccgcccagcgccaccaacccgctctacgaggccttcgggctcctcgacgccgccgcgcccgccgacgtcgacgccttctgcgcgcgcctcgacgcgccgccccacgtcagggacaccgttaaggcctacgcggagaagatgcacgacgtgatcgtcggcgtcgccggcgtgctggcctcgagcctggggctggaggagcactcgttcagggactggccgtgccagttccggatcaacaggtacaactacacgcagggcacggtgggctcctccggcgtgcagatccacacggactcgagcttcctcaccgtgctccaggaggacgagtgcgtcggcggcctcgaggtgtcggacccggccaccggcgagttcgtgccggtggaccctgtcgccggctccttcctcatcaacatcggggacatcggcacggtgtggagcaacgggaggctgcacaacgtcaagcaccgggtgcggtgcgtcgcgccggtgccgcgcatctccatcgccatgttcctgctcgggcccaaggacggccgcgtgagcgcgccggagccgttcgtggatgcggaccacccgcgccggtacaaggagttcaactacggcgactaccggggcctccggctgtccaccggcgagcacgccggcgaggcgctcgcgcggttggaggcgtaacgtggccgcgtggtgcagcggctgatccggagcgttaatttggggcgaacgatgactatgagctatgtgaattgcgatgaattgctatctattcaattccgatcaataatttttttttgtgtc

SEQ ID NO: 2256 - DNA, 1632 bp, Setaria italica
gcacacagcagcagcccagcaagcacacccgggcggcgtgtccgggagagtagagatcatggccgaggcagcggggatggcggcagcggcggaggtccccgtgatcgacctgcgcctcgccggctcggcgtcggaggagtcggcgcgcctgcgggccgcgtgcgagcggcagggctgcttccgggtgaccgggcacggcgtgccccgggggctcctggccgagatgaaggccgccgtgcgcgcgctcttcgacctccccgacgacgccaagcgccgcaacaccgacgtcatccccggcagcggctacgtcgcgcccagcgccaccaatccgctctacgaggccttcgggctcatcgacgccgccgcgcccgccgacgtcgacgccttctgcgcgtgcctcgacgcgccgccgcacctcagggcgaccgtgaagagctacgcggagcggatgcacgacgtgatcgtcgacgtcgccggcaagctggcctcgagcctggggctggaggagcactcgttcggggactggccgtgccagttccgcatcaaccggtacaactacacggaggacacggtgggctcccccggcgtgcagacccacacggactcgggcttcctcaccgtgctccaggaggacgagtgcgtcggcggcctcgaggtgctggaccccgccaccggcgagttcgtgcccgtcgaccccgtcgccggttccttcctcatcaacatcggcgacgtcggcacggcctggagcaacgggaggctgcacaacgtgaggcaccgggtgcagtgcgtcgcgccggtgccgcgcttctccatcgccatgttcctgctcgcgcccaaggacgacagggtgagcgcgccggaggcgttcgtggacgccgaccacccgcgccgctacagggagttcaagtacgacgactacaggaggctccggctgtccaccggcgagcgcgccggcgaggcgctcgcgcggctggcggtgtgacgtggcgcacgtggtggtggggctgcaaatcgggagccgttgaggcgttaattataggcatatcggttgtctcgttgagctgttgtcttgattgaccagtggggagaaggatggctattggggtgccatgtgaattgctatcgagtctcatcaataaaaccttgtgtcatttgaaaatcgcacggacttgagccatcagccatgcgcacaaagcacactagcacagctatctccatggttcatacaggcttcagcagagacctttttctacagggaaaaaaaatcatttgtggaccaaatttgccttcgatcttcacagacaacataatgggatacaaatatagagttccagggcctcagcccccgtccataatgcattgcataaaacaggacagtctatcagaagcatgcattgttccctctctactcatacatcagagttcactgaacatcccacatcaaaagagcatggtgtaacccagctgactacctctgcctcagacggtttccctcagtttgcgatagcctgcagctcctgtgcagctcagtgctcagagcacaccgccatctcgctgtcgcagtagctgtttgcggctcccactctccggtgcttccttccccagctgcaacttctgttggctttcatcatg

SEQ ID NO: 2257 - DNA, 1130 bp, Pennisetum glaucum
cccaatcctcccccgcggcacgcacccacgcaagtcaaattcgggcggcgcgtgcgggacagtaaaggccggccaggcgtccgcagctgccagcggggagggacgatggcggtggagatcccggtggtagacctgcgcctcgccggcgcgtcgccggaggagtcggcgcgtctgcgtgcggcgtgcgagcggatcggctgcgtccgggtgaccggccacggcgtggccccggagctcctggcggagatgaaggccaccgtacgcgcgctcttcgacctccccgacgacgccaagcgccgcaacgccgacgtcatccccggcagcggctacgtcgcgcccagcgtcgccaacccgctctacgaggccttcgggctcctcgacgccgccgcgcccgccgacgtcgacgccttctgcgcgcgcctcgacgcgccgccgcacctcagggcgaccgtgaagaactacgccgagcggatgcacgacgtgatcgtcgacgtcgccggcaagctggcgtcgagcctggggctggaggagcactcgttcggggactggccgtgccagttccgcatcaaccggtacaactacacggaggacacggtgggttcccccggcgtgcagacccacacggactcgggcttcctcaccgtgctccaggaggacgaatgcgtcggcggcctcgaggtgctggaccccgccaccggcgagttcgtgcccgtcgaccccgtcgccggctccttcctcatcaacatcggcgacgtcggcacggcgtggagcaacgggaggctgcacaacgtgaggcaccgtgtgcagtgcgtcgctccgatgccgcgcttctccatcgccatgttcctcctcgcgcccaaggacgacatggtgagcgcgccggaggcgttcgtggacgccggccaccctcgccgctacagggagttcaagtacgacgactacaggaagctccggctgtccaccggcgagcgcgccggcgaggcgctcgcgcggctggcggcgtgacggcgtcgcgcaagtggtggtcgggctgcaaatcgggagccgttaattatagacataccatacgcctacacgcacgagtgtatcggctgtctctttcgttgagccgttgtattgaccagccattg

SEQ ID NO: 2258 - DNA, 1090 bp, Setaria italica
cagcccagcaagcacacccgggcggcgtgtccgggagagtagagatcatggccgaggcagcggggatggcggcagcggcggaggtccccgtgatcgacctgcgcctcgccggctcggcgtcggaggagtcggcgcgcctgcgggccgcgtgcgagcggcagggctgcttccgggtgaccgggcacggcgtgccccgggggctcctggccgagatgaaggccgccgtgcgcgcgctcttcgacctccccgacgacgccaagcgccgcaacaccgacgtcatccccggcagcggctacgtcgcgcccagcgccaccaatccgctctacgaggccttcgggctcatcgacgccgccgcgcccgccgacgtcgacgccttctgcgcgtgcctcgacgcgccgccgcacctcagggcgaccgtgaagagctacgcggagcggatgcacgacgtgatcgtcgacgtcgccggcaagctggcctcgagcctggggctggaggagcactcgttcggggactggccgtgccagttccggatcaaccggtacaactacacgaaggacacggtgggctcctccggcgtgcagatccacacggactcgagcttcctcaccgtgctccaggaggacgagtgcgtgggcggcctcgaggtgctggaccccgccgccggcgagttcgtgcccgtggaccccgtcgccggctccttcctcgtcaacatcggcgacgtcggcacggtgtggagcaacgggaggctgcacaacgtgaggcaccgggtgcggtgcgtcgcgccggtgccgcgcatctccatcgccatgttcctgctcgggcccaaggacggcagggtgagcacgccggaggcgttcgtggacgcgggccgcccgcgccggtacaaggagttcaactacgacgacttgcggaggctccggctgtccaccggcgagcacgccggcgaggcgctcgcgcggttggaggcgtgacgtggccgcctgatccggaagccctttactgaactggaggcgctaaattgcacgagcatagtcccagagcttgcaaattgggaagaaggatgagtatgactatacgagacatgcgagcg

SEQ ID NO: 2259 - DNA, 1167 bp, Leymus cinereus x Leymus triticoides
ccgttgctgtcgcgcaagccagcgagatcggcgcgtcgcgtgactccgcccaactagtaaagcagcgcagatggcggagatcccggcgatcgacctgcggctcgccggcgcgcggccggaggagtcggcgcggctgcgggacgcgtgcgagcgcctgggctgcttccgcgtgtccggccacggcgtgcccgcggcgctccaggcggagatgaaggccgccgtgcgcgcgctcttcgacctccccgacgaagccaagcgccgcaacaccgacatcatcgccggcagcggctacgtcgcgcccagccccgccaacccgctctacgaggccttcggcctcctggacgccgccgcccccgccgacgtcgacgccttctgcgcgcgcctcgacgcgccgccccgcgccagggagaccgtcaagagttacgccgaggcgatgcacgagctgatcgtggacgtcgccggcaaggtggccgcgagccttgggctggagggccacccgttccaggactggccgtgccagttccgcatgaacaggtacgactacacgcaggacaccgtggggtcctcgggcgtgcagatccacacggactccggtttcctcaccgtgctccaggaggacgactgcgtcggcggcctcgaggtgctggaccccgccaccggcgagttcgtccgcgtcgaccccgtccccggctcgttcctcgtcaacatcggcgacgtcggcacggcgtggagcaacgggaggctgcacaccgtgaagcaccgggtgcagtgcgtggcggcggtgccgcgcatctcgatcgccatgttcctgctcgcgcccaaggacgacagggtgtgcgcgccagaggcgttcgtcgacgcagagcacccgcgccggttcaaggcgttcaactacgatgactacaggaagctccggctgtccaccggcgagcgcgccggcgaggcgctcgctagaatggcggcgtgagacgcgtgacgtagctatctggcagggcctgcctgtttaggctcgagagtgtaactctgagctgttcagagagagctcagcttcagtcgattattgacggttgaaccaagtgaggctgtgaattgtcgttgttttcatcaatcaataaaatcctgtacgaattgcaaaagtgaaaactgcaaagtgcaaactttttttta

SEQ ID NO: 2260 - DNA, 1379 bp, Triticum aestivum
gtcccgacaagcggcggcgcgactcgccgccctgccccctgcgtccctctcacggccggcctctaaatactactcctacatctccacggccggccccctgcagtagaccccgcaggcaagccagcgagatcggcgcgtcgcgtgactccgcccagctagtaaagcagcgcagatggtggagatcccggtggtcgacctgcggctcgccggcgcgcagccggaggagtcggcgcggctgcgggacgcgtgcgagcgcctgggctgcttccgcgtgtccggccacggcgtgcccgcggcgctccaggcggagatgaaggccgccgtgcgcgcgctcttcgacctccccgacgaagccaagcgccgcaacgccgacatcatcgccggcagcggctacgtcgcgcccagccccgccaacccgctctacgaggccttcggcctcctggacgccgcggaccccgccgacgtcgacgccttctgcgcgcgcctcgacgcgccgccccgcgccagggagaccgtcaagagctacgccgaggcgatgcacgagctgatcgtggacgtcgccggcaaggtggccgcgagcctggggctggagggccacccgttccaggactggccgtgccagttccgcatcaacaggtacaactacacggaggacaccgtgggctcctcgggcgtgcagatccacacggactccggcttcctcaccgtgctccaggaggacgactgcgtcggcggcctcgaggtgctggaccccgccaccggcgagttcgtccgcgtcgaccccgtccccggctcgttcctcgtcaacatcggcgacgtcggcacggcgtggagcaacgggaggctgcacaccgtgaagcaccgggtgcagtgcgtggcggcggtgccgcgcatctcgatcgccatgttcctgctcgcgcccaaggacgacagggtgtgcgcgccggaggcgttcgtcgacgcgcagcacccgcgccggttcaaggcgttcaactacgatgactacaggaagctccggctgtccaccggcgagcgtgccggcgaggcgctcgctcgaatggcggcgtgacgtagctatcttggcggggccgagcctctgtttaggctcgagagtgtaactctgagcttttcagagagagctaagcttcagtcgattattgacggttgaaccaagtgaggctgtgaattgtcgttgttttcatcgatcaataaaatcttgtacgaattgcaaaagtgaaaactgcaaaaagtgcaaacacgacggcaatctttttttatttttatttttttcagccaattattattcttagagcaactagtggtcatgtgggcagcccaccatgtgttttgaaggttgcacgcaagcaaataccaagtca

SEQ ID NO: 2261 - DNA, 1484 bp, Secale cereale
cctgccccctgcgtccctctcacggccggcctctaaatactaccactcctacatctccacggccgggcccctgcagtagatccctcacgcaagccagcgagatcggcgcgtcgcctgaccccgcccagctagtaaagcagcgcagatggtggagatcccggcgatcgacctgcggctcgccggcgcgcggccggaggagttggcgcggctgagggacgcgtgcgagcgcctgggctgcttccgcgtgtccggccacggcgtgcccgcggcgctccaggcggagatgaaggccgctgtgcgcgcgctcttcgacctccccgacgaagccaagcgccgcaacgccgacatcatcgccggcagcggctacgtcgcgcccagccccgccaacccgctctacgaggccttcggcctcctggacgccgccgcccccgccgacgtcgacgccttctgcgcgcgcctcgacgcgccgccccgcgccagggagaccgtcaagagttacgccgaggcgatgcacgagctgatcgtggacgtcgccggcaaggtggccgcgagccttgggctggagggccacccgttccaggactggccgtgccagttccgcatcaacaggtacaactacacgaaggacaccgtgggctcctcgggcgtgcagatccacacagactccggcttcctcaccgtgctccaggaggacgactgcgtcggcggcctcgaggtgctggacccctccaccggcgacttcgtccgcgtcgaccccgtcccggctcattcctcgtcaacatcggcgacgtcggcacggcgtggagcaacgggaggctgcacaccgtgaagcaccgggtgcagtgcgtggcggcggtgccgcgcatctcgatcgccatgttcctgctcgcgcccaaggacgacagggtgtgcgcgccagaagcgttcgtcgacgcagagcacccgcgccgcttcaaggcgttcaactacgatgactacaggaagctccggctgtcgaccggcgagcgcgccggcgaggcgctcgctcgattggcggcgtgacgtagctatctggcggggcctgtttaggctcgagggtgtaaactctgagatgttcagagaggtaagatcaagtataataaggtgacggctgtaagactctctcatcctggtgttagaaaaaactctctcaccctagttttttttaagtcttccatgaatgaatttgaaggatgaaagagttagatgttaaaataatgtattgttgctgagttggcaaagagagaagaggagagagaagataagcggctgactaatagccggctgtagcacgtgcttctagatattttgtgagagagggaggtggaccatgtatcaaacaagtactacttatttgtatctgactattatacttgccgactataaggttggctatagatgatatggcaacatcttatagccagcgaccggctatattattaaccatgctaagcttcagtcgatta

SEQ ID NO: 2262 - DNA, 1198 bp, Brachypodium distachyon
cctttcacggccggcttcttaatacaaatcccccccgtcgaatcaccgagccggcccccacggcccccaacaacccacaagccccgcacgcaagcccccaaatcagcaaagcagcgcccggatggtggagatcccggtgatcgacctgcggctcgccggcgcggcgccggaggagtcggcgcggctgcgggacgcgtgcgagcgcctgggctgcttccgcgtgttcggccacggcgtgcccgccgcgctccaggccgacatgaaggccgccctgcgcgcgctcttcgacctccccgacgacgccaagcgccgcaacacggagatcatcgctggcagcggctatgtcccgcccagcgccgccaacccgctctacgaggccttcggtctctgggacgccgccgtccccgccgacgtcgacgccttctgcgcccgcctcgacgcgccgccccacgcaagggaggccgtgaagagctacgcggagaagatgcacgagctcatcgtggacgtggccggcaaggtggccgcgagcctcgggctggagggccacccgttccaggactggccgtgccagttccgtatgaacaggtacaactacacggaggacaccgtgggctcctcgggcgtgcagatccacacggactccggcttcctcaccgtgctccaggaggacgactgcgtcggcgggctcgaggtgctggaccctgccgccggcgagttcgtccccgtcgaccccttccccggctcgttcctcgtcaacatcggcgacgtcggcacggcatggagcaacgggaggctgcacagcgtgaagcaccgggtgcagtgcgtggcggcggtgccgcgcatctcgatcgccatgttcctgctcgcgcccaaggacgacagggtgtgcacgccggaggcgttcgtggacgcggaccaccctcgccggtacagggcgtttaactacgacgagtacaggaagctccggctgtccaccggcgagcgcgccggcgaggcgctcgcgcgtatggcggcgtgacttggccacagggtttgtttatctgggcaaggcgctcgagactataactgagatgttgagctgttgtttactgctgaatcctcccagtaaagctgccaattgtcattggtttcaatcaataaaatcttgtgctacgacttgcaaaaatgcaaattgacaaattgtggtcatgcgagattt

SEQ ID NO: 2263 - DNA, 1869 bp, Oryza sativa
agaagcaaacactgcgatcatccgaagcaatctcaatctcacctgtccatatcgcgcacgaattcgtaaagtgcaagctagaaacatgtgtcacatgtcgtgctgatcgttcgatccaccacggtgcgagcggtgagtgtcgtgacgaagcaaaggcagaggcagcagcgggaaacggcgcccccccgtgtgtcgatcggctgtctcgccgaacagggcaaatacgccaacaaaaaacggcctcgttttcccttgctcgcacgcaccgtgtcgctcccaggcgacaagccgtggcgcgactcgccgcccccctgcgccccctcgcccccgcgcgtcgctttcacgtcgcacctctaaataccaccaccccggactcggcggcgagcccccgcgccaagaacgaaaggcgagagtgagagagatggtggagatcccggcgatcgacctgcggctggccggcggcggcggcggcgcggaggagacggcgaggctgcgcgacgcgtgcgcgcggctgggctgcttccgggtgtcggggcacggcgtgccgccggggctccaggccgagatgaaggccgcggtgcgcgcgctcttcgacctccccgacgacgccaagcgccgcaacgccgacatcatcccgggcagcggctacgtcccgcccggcacagccaacccgctctacgaggccttcggcctctgcgacgccgccgcccccgccgacgtcgacgccttctgcgcccgcctcgacgcgccgccccacgtcagggagaccgtgaaggcgtacgccgagaggatgcactcgctgatcgtggacgtcgccggcaaggtcgccgcgagcctggggctgcacggcgcctcgttccaggactggccgtgccagttccgcatgaacaggtacaactacacgcaggactccgtgggctcccccggcgtgcaggtccacacggactccggcttcctcaccgtgctccaggaggacgagtgcgttggcgggctcgaggtgctcgaccccgccgccggcgagttcgtccccgtcgaccccctccccggctcgttcgtcgtcaacgtcggcgacgtcggccaggcgtggagcaacgggaggctgcacaacgtgaagcacagggtgcagtgcgtggcggcggtgccgcgcgtgtcgatcgccatgttcctgctggcgcccaaggacgacacggtgagcgcgccgggggagctggtggacggcgagcacccgcgccggtacagggagttcaagtacgacgactaccggaggctccggctgtccaccggcgagcgcgccggcgaggcgctcgcgcgtctggcggcctgacacctggccacggtccattgtcgcgaccgtttattacgcggagtgctcactgctgactagaatgtccattaggcctccctgtatggccgtgtcgattctgaacaataaaatcttcgacgtacgacagtgaaaaaaatttgtaaaggatgctgaggggatgggaattttaggggttaataagtcttttgtttggctggaggagatgatgagttgtaggaataactggaaggtggagtttgtgagtaaattcccacctttttaatatagaggactataattgggaggaaagtccctttctgagctctctaattttagttagttgaatcttacacgtccaccatcacgtaaaatctaatttccatcaccataattcttatctttgtcagtattttttttcttttgaaatacaatacgtgtacactcacccctattaacacgcacaccctatagaacaatgatagtaaatatttccaattattaattccctccggtaataaaatgtatggtattttagataagttttgggtaaaattttaaacttcgac

SEQ ID NO: 2264 - DNA, 996 bp, Panicum virgatum
tcgtacaggtcctcgctatgcatctactacggtaatgatgacagagctcatgcgagtggcgtcagcacagctcatggcgaggcatgggcaagcaacaacggtcccggtgatcgacctgcgcctggccggcgcggcgccggaggaagacgcgtgcgagcgcctgggctgcttccgtgtgaccggccacggcgtgcccggggggctcctggccgagatgaaggccgccgtgcgcgcgctcttcgacctccccgatgacgccaagcgccgcaacgccgacgtcatccccggcagtggctacgtcgtgcccagcgccaccaacccgctctacgaggccttcgggctcctcgacgccgccgcgcccgccgaccaaatccttctcgcttccgacgtcgacgccttctgcgcgcgcctcgacgcgccgccccgtgtcagggagaccgttaaggcctacgcggagaagatgcacgacgtgatcgtcgacgtcgccggcgtgctggcctcgagcctggggctggaggagcactcgttcagggactggccgtgccagttccgcatcaacaggtacaactacacgcaggacacggtgggctcctccggcgtgcagatccacacggactcgagcttcctcaccgtgctgcaggaggacgagtgcgtcggcggcctcgaggtgtcggacccggccaccggcgagttcgtgccggtggatcctgtcgccggctccttcctcatcaacatcggggacatcggcacgcaacgggaggctgcacaacgtgaagcaccgggtgcggtgcggtgcgtcgcgccggttccgcgcatctccatcgccatgttcctgctcggacccaaggacggcagcgtgagcgcgccggagccgttcgtggacgcggaccacccgcgccggtacaaggagatcagctacggcgactaccgggccctccggctgtccaccggcgagcacgccggcgaggcgctcgcgcggttggaggcgtaacgtgg

SEQ ID NO: 2265 - DNA, 1582 bp, Zea mays
cctgactccctcgtggctcgtcccattcccgcaccatctcgacaaaccacaccaactgtcatcggacggcccaaaactgtgccgcgtgttccgttcaacggctatttcagcccgcagaacgcacatcagaagggtaaagccacgaaccccccggtccgcgcctgcgccgccttccctctcctgccttctccgcttcaaatttgcgtagcgttgatttcacgcccggatctcacaacgctcaatccaaacgctagccgcaaccctaaccctagcaaccggtgagtaatggcgcgccctaggggcaagaagcgcacggcgccccgggcggccgccactgattctgtccagccggaggcggcggcgacggagacagcggcggcggagccggcaaatcgggggcggtggaagcgcgtcaaggcgccgcccaagcccaagcccgagacggattacttcgccgagaaaagaaatctggaggatctatggttatctgcttttcctgtcggtactgagtgggaaaacattgataagataaaggagttcaactggagctttgaaaatttagagaaagccttagaagaagggggcgagcttcatggtaaaacagtttatctgtttggaagcactgagccccaactattggatgttaatggcgaatcaaagatagtgcttattccaatcgtagttgctgtagactgccctttccctccatcagacaaaattggcataaactctgtccaaagggaaaatgaggaaatagtgccaatgaaggcgatgaagatggcatgggtgccttatgttccccttgaggaccggcttagcaggattgacagtttgaaaacaaaaatattcactctcggatgcacgcagcggaggtctgcactgaagcatctcaaaattgagagagtcaagaagtttgactactgcatgccttactatatgccgctgcaacctcttgaagacgagaatgacactgttatcagtttcttatatcctctagaacccccgatagtagatgagtttgactgggaaatggacgattacgaggattttgctgatcagaaagttcaagaaggtggcctgccagaggatgagaaagaaaaattcaaggagttcctgaaggagaaggttagagaaaggaagagagagcttaaacaggctaaagaagccaggaggaaagctattgatgatatggatcctaaggtgaaagaggcattcgagaacatcaaattttacaaattttatcctgtgaaaaccccagacacgcctgatgtaaacaatgtaaaggcgaggtacatcaacagatactacaggaatgcccattatctgatgtgatggctttccttatcgcacgtgcttggcgagcttgtcacttgagaggagttgatatgaaaacagttcggtgttgtactagagttggccccagtttttcaccccccctgggcatcttttgctctccggtgtatacaatcctgaggatagattattgtgtagcactaagaggggcaaagtagtttgagactaaacaaatcattaaggaacaatttgttcccttttcatcatctattttgtggttgttttaaca

SEQ ID NO: 2266 - DNA, 1729 bp, Zea mays
actggctacttccttctccccttcaaatttgcgtagcgttgaatccacgccctcccggaacccccgaatctaccgacgctccctctcagtctctcacaacgctcaatccaaacgcgagccgcgagcctaaccctagcaaccgtgagtgatggcgcgcccaagggctaagaagcgtacgacgccccaggcggccgccactgattcggtcgagccggatgccaccgtcggtgcttcgagcaagctggaggaggcggcggcggagccggcaactcgggagcgggggaagcgcgtcaaggcgccgcccaagcccaagcccgagacggaatacttcgacgagaaaggaaatttcgaggatctatggttatctgctttccccgttggtaccgagtgggaaaacatcgataagataaaggagttcaactggagctttgaaaatgtagaggaagccttagaagaaggaggagagcttcatgggaagaccctttatatgtttggaagcaccgagccccagctattgtatgttaatggtgaatcaaagatagtgcttatcccaattgtcgtcgctgtagactgtcctttcccaccttcagacaaaattggcataaattccgtccaaagggaaaatgaggaaatagtgccaatgaaggcgatgaagatggcatgggtgccttatgttccccttgaggaccggctgagcaggattgacattttcaaaacaaaaatattcacgctcggatgcacacagcgaaggtctgcactgaagcatctcaaaattgagagagtcaagaagtttgactactgcatgccttattatatgccactgcaacctcttgaagatgaagaaaacacaactatcaatttcttatatcctctggaacccccgatagtagatgagttcgactgggaaatggatgattacgaggattttgcagatcagaaagtccaagaaggtagcctgcccgagggcgagaaagaaaaattcaaggagttcctgaaggagaaggttagagaaaggaagagagagctgagacaggctaaagaagccaggaagaaagctattgatgatatggatcctgcgatgaaagaggcattcgagaatatcaaattttacaaattttatcctgtgaaaaccccagacacgcctgatgtaaacaatgtaaaggctaggtacatcaacagatactacaggaatgcccattatctgaagtaaaggctctcctgatctcacgtgcttgaggacgagcttgtcatttgagttggtgtaaaaaaattttgaaacccgggggagaaaagtttggtgacatctttggatggtcttactgttgtactgtactgtactagaattgccctcagactttcgctgtccggtgcatacagtcagaaaggttcaaggtagttttgagactaaccaaatcatgatggaacaatttgttcctttgtcatcatggttactgcacaccctgatggttatgctgtgactttttttaacatctgctatgagcaagctatgaattatgctgtaatctgtctggtgaagcgaccaggtacagtagggttcagactggttaacaatgggataacctggcttctaggcctgtttgtttttttccaattaataatcggtcttttgatctaatttaaattggtttctactccctttgccctacaatgaatgttgtttgacttttttggcataagttcgactgactcgtcttattcaaaatattta

SEQ ID NO: 2267 - DNA, 1312 bp, Sorghum bicolor
ctgcagtcgtgtttccctcgtcccgcacccgccgaacgcacatccaaaggccagagccacgagcccgcccgcgcctgcgccgcctcccctctccttccttctctctcccattcaaatttgcatagcgttgattccacgccccgagactccatatctaccgacgcatctccccatctcagaacgctcaatccaaacgcgagccgcaaccctaaccctagcaaccgaggctgatggcgcgcccgaggggtaagaagcgcacagcgacccaggctgccgccactggttcggtcgagccggaggccgccgccggtgctccgagcaagccggaggcgtcggcggcgacggagccggcaactcgggggcgggggaaacgcgtcaaggcgccgcccaggcccaagcccgagccggagtacttccccgagaaaagaaacctggaggatctatggttatctgctttccctgttggcactgagtgggaacacatcgataaggtaaaagagttcaactggagcttcgaaaatttagagaaagccttagaagaagcgggagagcttcatggaaagacagtttatatgtttggaagcaccgagccccagctattggatgtcaatggcgaatcaaagatggtgtttatcccagttgtagttgctgtagactgtcctttacctccttcagataaaattgggataaactctgtccaaagggaaaatgaggaaatagtgccaatgaaggctatgaagatggcatgggtgccttatgttccccttgaggaccggcttagcaggattgacagtttgaaaacaaaaatattcactctcacatgcacgcagcgaaggtctgcactgaagcatctcaaaattgagagagtcaagaagtttgactactgcatgccttattatatgccactgcaacctcttgaagacgaaaatgacacagttatcaatttcgtatatcctctagaacccccgatagtagatgagtttgactgggaaatggatgattacaagggttttgcagatcagaaagttgaagaaggttggctgccagagggtgagaaagaaaaattcaaggagttcctgaaggagaaggttagagaaaggaagagagaactgaaacaggctaaagaagccaggaagaaagctattgatgacatggatcctaagatgaaagaggcattcgagaatatcaaattttacaaattttatcctgtgaaaaccccagacacgcctgatgtaaacaaggaaaaggctaggtacatcaacagatactacatgcatgcccattatgtgatgtgatgactttcctgatctca

SEQ ID NO: 2268 - DNA, 1510 bp, Setaria italica
cccaaatcgacacccaccccctcccccgaacgcgcagacacaaatccattcccatccggacgcaagacctagcagccgaaggcgatggcgcggccgaggggtaagaagcgcacggcggcccaggcggcggccactgactcgagcaagccgggcgccgccgccgccggtgattcgaccaagccggaggccgcggcgaaggagccggccgctcgggggcgggggaggcgccccaaggcgccgcccaagcccaaggccgagacggagtacttcccggagaagaggaatttggaggatttatggttatccgcttttcctatcgggactgagtgggaaaatattgataagataaaggagttcaactggaacttcgaaaatttagagaaaacactagaagaagggggagaactttatggaaagacagtttacttgtttggaagcactgagccacaactcctagatgttaatggtgaatcgaagatagtacttattcctgtagtagttgctgtagactgtccgttccctccatcagataaaattggcataaattctgttcaaagggaaaatgaagaaatagtgccaatgaaggcgatgaagatggcatgggtgccttatgttcctcttgaggaccggcttagcaggatcgacagtttgaaaacaaaaatatttactctcggctgcacccagcggaggtctgcgctgaagcatctcaaaactgagagagtcaaaaagttcgattactgcatgccatattatatgccactgaatcctcctgaagatgaagatgacacggttgtcaatatcatatatcctctagaacccccgatagtttgcgattttgattgggaaatggatgattacgaggattttattgaagagaaagtcaaagatgaggtgttgccggaggatgagaaagaaaaatttaaggaatttctaaaggagaaggttagagaaagaaagagagaactgaaacaggccaaagaagccaggaagaaagctattgatgacatggatcctaagacaagagaggcatttgagaacatcaaattttacaaattttatcctgtgaaaaccccggacacccccgatgtttccaatgttaaggcaaagtacatcaacagatattaccggaacgcacattatctgatgtagtggcattcccgatctcacattttcagtgagctttgtcattgattgagctatccaacttgaagagttggtattagaaaattttggtagccggcggaaatcaggttggtgacatcttccaatgtagtctcttatgggccatgagacaacatgttgcatctgaattctgttgtaatagtcaccctcagactcttaggcatcttctctttgtgcggtgtacaacatcttgcggattagattattgtgtatgaatcagagggtcaatgtagtcgttgtaagagtaaacaagtggttcaggaacaatctgttccattttcatcatttagtaaagtttcagcacatgtttcctggatttaatatcgtt

SEQ ID NO: 2269 - DNA, 1388 bp, Panicum virgatum
ccgagcgcaagacctagcagccgaaagcgatggcgcggccgaggggtaagaagcgcacggcgccccaggcggcgcccactgactcgagcaagccgaaggatgctgctggcgattcgaccaagccggagccggccgctcgggggcgggggaagcgcgccaaggcgccgcccaagcccaaggccgagacggagtactttccagagaagagaaatttggaggatctgtggttatccgcttttcctatcgggactgagtgggaaaatattgataagataaaggagttcaactggaacttcgaaaatttagagaaaacactcgaagaagggggagaattatatgggaagacagtttacttattcggaagcactgagccacaactactggatgttaatggtgaatcgaaaataatacttattcctattgtagtcgctgtagactgtccgttccccccatcagataaaattggcataaattctgttcaaagagaaaatgaagagatagtacctatgaaagcaatgaagatggcatgggtgccttatgttcctcttgaggaccggcttagcaggattgacagtttgaaaacaaaaatattcacccttggttgcacccagcgaaggtctgcactgaagcatctgaaaaccgagagagtcaaaaagtttgactactgcatgccgtactacatgccactgaatcctcctgaagatgaagatgacacggttgtcaatataatatatcctctagaacccccgatagtttgcgattttgattgggagatggatgattacgaggactttgctgatgagaaagtcaaggatgaagtcttgccggaggatgagaaagaaaaatttaaggaatttctgaaggagaaggttagagaaaggaagagagaacttaaacaggctaaagaagctagaaagaaagctattgacgacatggatccaaagactagagaggcatttgaaaacatcaaattttacaaattttatcctgtgaaaaccccagacacacctgatgttaccaatgttaaggcgaagtacatcaacagatattaccggaacgcacattatctgatgtagtggcattcgtgatctcacatgtttggtgagcttcttaattgattgagctatccaactttaggagttggtattagaaaattttgggagccgggaggagatcagcttagtgacatcttccaatgtagtcttatgggctatcagacatgtactcctgaattctgttgtaatagtcacagccagcctcaggctcagcggataggcatcatcatctttgttgtggtgtataacatcgttgagggttagattattgtgtatgaatcagagtcaatgtaatcgctgtaacagtaaaagtaaacatctttgttgttcagg

SEQ ID NO: 2270 - DNA, 2136 bp, Panicum virgatum
ccacgcgccccccctcgccgccgcctctgcctccctttgcccttcccttcctcccccctgcttcaaatttgcgtcgcgtcgatttcacgcgccgcttcccccaaatcgacacccaccccacccccctcctcccgaacgcacaggcacgcacaaatcccagtcccatccgagcgcaagacctagcagccgaaagcgatggtgcggccgaggggtaagaagcgcaccgcggcccaggcggcggccactgactcgagcaagccgaaggctgatgctggcgattccaccaagccggaggcggcggcggcgaaggatccggccgttcgggggcgagggaatcgcgccaaggcggcgcccaagcccaaggccgagacggagtacttcccggagaagagaaatatggaggatctgtggttatccgcctttcctatcgggactgagtgggaaaacatcgataagataaaggagttcaactggaacttcgaaaatttagagaaagcactagaagaagggggagacttatacgggaagatagtttacttatttggaagcaccgagccgcaactactggatgttaatggtgaatcaaagatcgtacttattcctattgtagttgctgtagactgtccgttccccccatcagataaaattggcataaattctgttcaaagggaaaacgaagaaatagtaccgatgaaagacatgaagatggcatgggtcccttatgtccctcttgaggaccggcttagccggattgacaatttgaaaacaaaaatattcacccttggttgcacccagcggaggtctgcgctgaagcatctcaaaactgagagggtcaaaaaatttgactattgcatgccatattatatgccactgaatcctcctgaagatgaagatgacacggttgtcaatatcatatatcctcttgaacccccgattgtttgcgattttgattgggagatggatgactatgaggatttcgctgatgagaaagtcaaggatgaagtgctgccggaggatgagaaagaaaaatttaaggaattcctaaaggagaaggttagagaaaggaagagagaacttaaacaggccaaagaagccagaaagaaagctattgatgacatggatcccaagactagagaggcttttgaaaacatcaaatttcacaaattttatcctgtgaaaacccctgacacaccagatgttaccaatgttaaggcgaagtacatcaaccgatattaccggaacgcacattatctgatgtagtggcattcccgatctcacatcattgattgagctatccaactttaggagttggtgttagaaaattttggtagccgggggagatcagcttggtgacatctgccaatgtagtcttgtgggctatcagacatgtactcgtgaattctgttgtaatagtcacagtcaccctcaggctcagcggattatccccttccgtaggcatcatcttctttgttgtgtgtacatctttgagggatcgattattgtgtatgaatcagagagtcaatgtagtcgttgtaagagtaaacaagtggttcaggaacgatccgttccctttttcttcatctagtaaagattcggcgcatgattcctggattaaatattgttgcaacatgatccccgtttctttatctagtaaagtttcggcacatgattcctccatttttcattcacatgttgtattaggtttgttataagtcaaagttagtcaactttaattaaatctgtagaaaaatattatggtagctatactatccaacatatgcattatcaatatataattcagagtgaattcaataaaacaaatttggttttgtaaatattattatttttctctataaattcagttaatgttggtcaactttaatttagaataaacctaatgtgatatgtaagtaaaaatggaggaaatagtaggtactataacccaccactattttactccgtttggttcccaaaattttttcacacactatattaacttcgaatgtttgaccactaattaagagtattaaatgtggataattgacaaacccgttccataactcccgggtgaaatcacgagacgaattcaatgaacctaattatgtaatgattagataatgtcatgctacaataaac

SEQ ID NO: 2271 - DNA, 1359 bp, Setaria italica
caccaacccccctgatccgaaggcgagccggaacccaaaccctagcagccgagagcaatggcgcgcccgaggggcaagaagcgcacggcggccgaggcggcggccactgattcgagcaagccggaggcggcggcgaaggagccggccaagcgggggcgggcgaagcgcgtcaaggcgccggccgagcccacggaatactttcccgagaagaggaatctcgaggatctgtggttatctgcttttcctgttggcactgagtgggaaaacattgataagataaaggaattcaactggaactttgaaaacttagagaaaacattagaagaagggggagaactttatggcaagacagtttacttgtttggaagcactgagcctcagctattgtatgtgaatggtgaatcaaagatagtgcttattccagttataatcgcggtagactgtcctttccctccatcagataagatcggcataaattcggtccaaagagaaaatgaagaaatagtgccaatgaaggcgatgaagatggcatgggtgccttacgttccccttgaggaccggctcagcaggattgacagtttgaaaacaaaaatattcactctcggttgcacccagcgaaggtctgcgcttaagcatctcaaaactgagagagtcaagaagtttgactactgcatgccatattatatgccactgcaacctgttgaagatgaagatgacacggttatcaatttcttgtatcctcaagaaccaccaatagtagatgactttgactgggaaatggatgaatacgaggactttgctgatcagaaagttaaagatgaggtcctgccggaggatgagaaagaaaaatttaaggaatttttaaaggagaaggttagagaaaggaagagagaactgaaacaggctaaagaagccaggaagaaagctattgatgatatggatcctaaggagaaagaggcgtttgaaaatatcaaattttacaaattttatcctgtgaaaaacccggacacaccagatgttgacaatgtaaagtcaaagtacatcaacagatattaccggcacacacattatttgatgtaggcattcgtgatctcacatgtttggtgagtttcgtggattgagctatccaaattgaagagtttgttccagaaaattttgaaacccggagaagatcagcttggcaacatcttcgaatgtggtttcttatgggcccatcagacagcatgttgcatctcctgtctgctgtgcacttcagctagagttaaactcaccgagtaaccccctccttaggcatcttcctttgttgcgggcgtataacatcttgaggatatatttattgtgtaacaatcagagggtcaa

SEQ ID NO: 2272 - DNA, 1649 bp, Oryza sativa
acgcagtccccttctccaaccccgcttcaaatttggatcgcgtcgatttcacgcgccgattcccccaaatcgcacacacccccacccctcgaacgcataaatactgatccccaatcgaaacggctgctgaaaccctagccctagcaatcgagagagagggagaagatggcgcgtccgagaggcaggaagcgtgcggcggcggcggcggcggtggcggaggaggactccagcaagccggaggctgcagaggcgaagaagccggccgcgcgggggcgggggaagcgtgccaaggcgtcacccaagcccaagccggagacggagtacttccccgagaagcggaatctggaggatctttggctatcagcatttccggttgggaccgagtgggaaaacattgataagataaaggagttcaactggaactttgaaaatttggagaaagcactagaagaaggaggggagctttatgggaaaacagtttacttgtttggaagcacggagcctcaactattggaggttaatggtgaatcaaagatagtgcttattcctatagttgttgctgttgactgcccttttcctccctcagacaaaattggcataaattctgtccaaagggaaaatgaagagatagtgccaatgaaggccatgaagatggcctgggtgccttatgttccgctggaggatcggcttagtaggattgacagtttgaaaacaaaaatatttactcttggctgcacccagcggaggtctgcgctgaggcacctcaaaactgagagagtcaaattgtttgactactgcatgccatattatatgccactgaaccctcccgaagacgaagatgatacagttgtcaacatcatatatcccctagaacccccgatagtatgtgacttcgactgggagatggatgattacgaggactttgctgatgagaaagttaaagatgaggtgctaccagaggatgagaaagaaaaatttaaggaattcataaaggagagggttagagaaaggaaaagagagctaaaacaggctaaggaagcaagaaagaaagctattgatgatatggaccctaaggtcaaagaggcatttgaaaatatcaaattttacaaattttatcctgtaaaaactccagacacccctgatgtaagcaacgtaaaggcaaagtacatcaatagatattacaggcatgcacatcatctgatgtaattgcatcctatcttgaaatgagctatccaacttggagagctgacaccgaaattttgaaagccgtgggagagattcctggcgacatcttcaaattgggtctcttatagacccggggtgaaaacttgttgcaccttaactctgtactgcagttttcgtcagatcctgccattccttagagtatcgcttccttcggcattcttttttgttgtgcgtcgtgtaacattctgggaatagattatgtaaccatcaggccgtacatcttgtaagagcaaaacaattggtttaggaaaaatgctgattcctttcaccgtcctgtgaaggttgcttgggtgcaaaccccttgattttgtcttaactggtcttgcttgacatgctatattgctgtttgtagtatccgtggcctgtcgagcaccgatcttcctcagcttcgacctcgcctcccc

SEQ ID NO: 2273 - DNA, 1380 bp, Secale cereale
tcagtcgcttcaaatttgcgtcccgcgtcgatttcacgcgccgttcccccaaatcgtgtcccactcccactcctccctcccccggcgcataaatacaaatccccaatctcaaaccccaatcgagaccaaaccctaaccctagcaaatccagcgagcgagatcgagagagagagaggcatggcgccggccaagggcaagaagcgcgcggctgcggcggccggagacagccaggcggcggcggcggcgaacgggggccggccgaagcgcaccaaggcgccccccaagcccaagcccgagacggagtactttccggagcaacggaatctggaggatctttggctgtcggcttttcctattgggactgagtgggaaaatattgataagattaaggagttcaactggaactttgaaaatttagagaaagctctagaagaggggggaaactgtatgggaagacagtctatgtatttggcagcactgagcctcaactattggatgttaacggtgaatcaaagatagtacttattcctgtaatagtggctgttgattgcccttccccccatcagataaaatcggtataaattctgtacaaagggaaaatgaagaaatagtaccaatgaaggcgatgaaaatggcctgggtgccctatgttccactagaggaccggctcagcagaattgacagtttgaaaacaaaaatattcactcttggctgcactcagcgaaggtctgccctgaagcatctcaaagaagagcgagtgaagaagtttgactactgcatgccttattatatgccacttagtcctcctgaagatgaagatgatacagtcgtcaatatcatgtatcctctggaacccccgatagtatgtgactatgactgggacatggatgatatggaggattttattgatgagaaagtcaaagatgaggtcttacctgaggatgagaaagaaaaatttaaggacttcataaaggagagggttagagaaagaaagagagagctgaagcaggctaaagaagcgagaaagaaagctattgatgatatggatccaaagttgaaagaggcatttgaaaatatccggttttacaaattttatcctgtaaaaaccaaggacactcctgatgtgagccaagtacaggcgaagtacatcaatagatactaccgccacgcgcatgaactgctgtgatgcccaacctgacaatttgctgtgcgcaatgtcaagctatccatccaagcaaccgggtggaaattttgtaagactggagatgagatgtgcctgcttggttggcagactcgattcggggcttgtatggatgactttgttgcctctgagctctattgtggtacagtttcacccatgctcctctgcgtatctcctcc

SEQ ID NO: 2274 - DNA, 2608 bp, Zea mays
gctcgagccaccaaagaggccaagagcttagcttttacctaaagcagctgaggtacctcaccatcaccaccaccgacaccaactgcgccgaggccggaggcggagtagagccagaccagaatggtattggggggaggccctctaggcgccatcattggccgctacccctcctcctccgccgccgccggtgacgatgaacaaggggacccgggacccggaggaggcgtcattcgccatgaccgcaagtgccgggactggcccttcctcgtcctcttcgccgccttctgggttgccatgattgtcaactccagcttcggattcaaccagggcaacccactcaggctgacatacggactggactacaaagggaacatatgtggcagcaggcatgccgatcctgatttgtatcagttagatgttcgctattgggtgaaccccaaccaggtctaccaaagtggcctcaaaaccagtcacatcgagctacctgatgctaaaaccatctgcctgatggaatgcccacttcctgccgaagatggcttgaattttgtttgtgattatccagaaggtgacatacgcctctctgtcgacgactggattgacagggactacgattacttcgagtacctcacaccagacatgaggaatagttctcttcagctgcagggtccatgttaccctgtcatatttccaagtgtaaatgtctactggagctgccagtttattgcacgggcatccaatgcctctttaaagcattggaaggacatgggtggtgtcaccatcgacgaaaacatgctaatagacagaacaattcatgatgcaattaatagcaaatctgccgtcatgaagagatatgttgcagatattgggaagtcctggcctgtgttaatcctttgtgggggattactccctttgttcctatctatgatctggttactcatgattcgcttttttgttgctgggatgtcttggataacagtggtggtcttcaatgctcttgtggtatctgttacaatgttcttctatataaaagctggttggattggccatgatcctttgactgttgtaattggtgaaagtgatccttacgttagcataggtggacgagagataaatcaccttcatgctgcttccgtcttgatgacagtgataatgatacttgctttcctgacttcaatagctatcgctcggcgcattatgaaagcaacatcagtcctaaaggttgctgcaaaggtcgttggcgaagtgcaggcacttattatttttccagtcgtgccatacttgatcctcgctatcttttacactttctggttttcagcagcacttcatcttttcagcgccggtcaagttatacaaaatgattgcaatacagattgctgttcctacgatctgaaacttggcaaagtaaattgtgacagatgttgtggctacactatccattacaccccacatattggcatcgccattcttttccatctttttggctgttactgggcaacacagtttttcatcgggtgttcttcgactataattgccggatcggttgcttcatactactgggcacgcggtgaaatatcgcacgatatccctttccataccgtggtatcttccctgaagcgcttgttgcgctatagcctgggatctgtggctctgggctcactgatagtgtccatcgtagagtgggtgcgattcatactagaatcactacgccgcaggctgaaatttgttgactctgcccgcggaagccggttcgggaagacggtatcatcctcatcccagtgctgcttaggctgcatcgattggaccctgaaatcggtgaatcgaaatgcctatgtcatgattgccatcacagggaaaggattctgcaaggcttccgtgctagcgactgggctgatcatgaacaacgtgttgcgcgtcgggaaggtgaatgtcattggggatgtgatcctcctgttgggcaaactttgtgttagcctgttgtgtgcgctgtttgccttccttatgctggacgagcacaagtacagatctgggcataacaagatctcatcaccgctggtccccgtgctgctgtcgtgggcgctgggctatatagttgcgaagcttttcttcgcagtggtggaggtgtcgatcgacacaatggtcctgtcattctgccaggactcggaagagcatcaggggaacgcgcggtatgctcccccgctgctgatggagacattggacgaggagagcgagttgcgaaggctgacacaggggccatgatcgatcttccaaataggagacactgaactgaatggctgtgatgttggttgcatgtcttttttatatgaatcatcactggggttgatggatggagctataggtgcaagcatgtctttttatatgtatcagctaaatacgaggaatagaatagaatagggcttagtgctggaattgaaacccaccgtctgtaatgtatgttcggctttatttgatatgtcttttttgtttatatattgttagactatgtgtgtggaccgacaccactgttgggctgccgacccattagggttagggttgtgagtctatatattgcactctatcttatatcaatacatcaaccaatttaggactt

SEQ ID NO: 2275 - DNA, 2935 bp, Setaria italica
cctctgctcatcaccaccaccgacacccaccccaaaacccccaagctccgagagaaagaatcatctccaatggcattggggggagggcccctcggcgccatcatcggccgctacccctccgccgccgacgagcaggacccgggcgggggagtcattcgccacgaccgcaagtgccgggactggcccttcctcctcctcttcgccgccttctgggtcgccatgattgtcaactccagcttcggcttcaaccagggcaacccactcaggctcacattcggactggactacaaagggaacatatgtggcagcaagcatgccgttccagatttgcgtgagttggatgttcgctattggatgaaccccaaccaggtctaccaaagtgggctcaaaagcagtcgcatcaatctacctgacgttaaagccatttgcctcatggaatgcccacttccagcagaagatggtttgaattttgtttgtgattatccagaaggtgacatacgcctctctgtcgatgattggattgacagggattatgattacttcgagtacctcacaccagatatgaggaatagttctcttcagctgcagggtccttgttaccctgtcatctttccaagtgtcaatgtctactggagctgccagtttattgcgcgggcatccaatgtctccttgaagcattggcagcagatgggtggtgtcagcatcgacgaaaacatgctcatagacaaaacaattcacaacacaatcaacagcaaatctgccgtcctcaagagatatgttgcagatattggaaagtcctggcctgtgttaatcgtttgtgggggactgctccctctgttcctatctgggatctggttactgatgattcgcttttttgttgctgggatgccttggataacggtggtagtcttcaatgcccttgtaatatcagttacaatgttcttctatataaaagctggttggattggccatgatcctttaactgttgtaattggcgaaagtgatccttatgtcaacataggtggacgggagataaatcaccttcatgctgcttctgtcttgatgacagtaataatgatacttgctttcctaacttcaattgctattgcccggcgcatagcgacatctgtcctgaaggttgctgcaaaggtcatcggcgaagtccaggcacttattgtttttccagctgtgccattcttgatcctcgctatcttctacatattctggttttcagcaacgcttcatcttttcagtgccggtcaagttatacgaaacgattgcaacacagattgctgttcgtatgatctgaagcttgggaaagtaaattgtgacagctgttgtgggtatagtattcattacaccccacatattggcattgccattctttttcattttcttggctgttactgggcaacacaatttttcatcggatgttcttcgactgtaattgctggatcagttgcttcatactactgggcacgtggtgaaatatcgcacgatgtcccttttcgtactgtggtgtcttccctgaagcgcttgctgcgctatagtcttggatctgtggctcttggatcactgattgtatccatcgttgagtgggtgcggtttatactggagtcacttcgccgcaggctgaaatttgtcaattctgcccatgacagctggtttgggaagacagcgtcatcctcgtctcagtgctgcttagggtgcattgattggaccctgaaatcagtgaatcgaaatgcttacatcatgattgccattacagggaaaggattctgcaaggcttctgcgctagcaactgagttaatcatgaagaacatattgcgcattgggaaagtgaatgtgattggggatgtgattctgatgttgggcaagctgtgtgttagcctgttctgcgcgctgtttgctttcatcatgctggataagcacaagtacaggtctggccacaacaagatatcatcgccgctggtacccgtcctggtgtcgtgggcgttgggttatatagttgcaaagcttttctttgcagtggtggagatgtcgatcgacaccataatgctgtcgttctgccaggacacggaagagcacgaggggaacgcgcggtatgcgcccccgctgctgatggagacgctggatgaggagagcgagctgcgaaggctgacagaggggccatgaaggatgcattctctctttcactgttctaaagatgaggagagtagctagcgatagggctagaggagaaactggatgctgcacttgctttgaccatgcatgccgtctttatttatatactatatgaatcgctgcctcgctggagtggactagatagggtggtgatgaattgttgtgcctgtaaatgtgaattcttagtcatggatgggaaactcagctgtgaatgcctgtccacatgccattcccagtgacatgtgtctgtcttggtgcgcatgctttcagaaattcagcagacatcgatctaggagtattattggttgcatgatttacaacaaaaaacatagacaagaagcagatatgattgaaaaaaggcttgatcgatcaggtgcagatggggaggccggcggcggtgcaggcgcgggagcacttggctgcgcacttcttgtgggcggccatggtgcacttcttggcgcacacaagccgcttcaggtgacagtccttggtcgtcacgcacttgctgctgccaggcttcttctccttgttcttgtcctccttgctgctctccttcttctctcctcctcctcccactcccgccggcgagggtgacgacgacggcgaggaggacccagcaccgccgccgttggtgctgatgctggcgaggtggacgtgggcgggcaacgccgcgatggccttctcctcctccgcgtcggttctggcagccaggaggaggacgaggagcagcagcgtcgccgcctcagcgagc

SEQ ID NO: 2276 - DNA, 3196 bp, Panicum virgatum
ctgaagagtgacgtcacgctgcgcttccccctcctctcctctcattctcttctctcctcccccgacggaggccacccaagtgcaagaagaagaagcgcaccaccgacacccaccccaaaaagcccaacaatagagagatagagagagaaccagaatggcattggggggaggccccctcggcgccatcatcggccgctacccctccttcgccgctgcggacgaccaagaccccggcgggggcgtcattcgccacgaccgcaagtgccgggactggcccttcctcctcctcttcgccgccttctgggtcgccatgattgtcaactccagcttcggattcaaccagggaaacccactcaggctgacattcggactggactacaaagggaacatatgtggcagcaggcatggcgatccagatttgcgtgagttggatgttcgctattggatgaaccccaaccaggtctaccaaagtgggctcaaaagcagtcacatcgatctacctgacgctaaagccatctgccttatggaatgcccacttccagcagaagatggtttgaattttgtttgtgattatccagaaggtgacatacgcctctccatcgatgattggattgacagggactatgattacttcgagttcctcacaccagatatgaggaatagttctcttcagctgcagggtccttgttaccctgtcatctttccaagtgtaaatgtctactggagctgccagtttattgcgcgggcatccaatgtctctttgaagcattggcagcagatgggtggtgtcagcatcgatgaaaacatgctaatagacaaaacaattcacaacgcaatcaacagcaaatctgctgtcctcaagagatatgttgcggatattggaaagtcctggcctgtgttactcctttgcggaggatttctccctctagtcctatctgtgatctggttactgatgattcgctattttgttgctgggatgccatggataacagtggtagtcttcaatgcccttgtaatatctgttacaatgttcttctatataaaagctggttggattggacatgatcctttaactgttgtaattggtgaaagtgatccttatgtcaatataggcggacgggagataaatcatcttcatgctgcttctgtcttgatgacaatagtaatgatacttgctttcctgacttcaatagctattgcccggcgcatactggtagctacatctgtcctgaaggttgctgcaaaggtcattggtgaagtccatgcacttatttcttttccaactgtgccattcttgatcctggctatcttctacatattctggttttcagcaacgctccatcttttcagtgctggtcaggttatacgaaatgattgcaatacagattgctgctcgtatgatctcaagcttggcaaagtaaattgtgacagctgttgtgggtatagtattcattacaccccacatattggcattgccattctttttcattttttcggctgttactgggcaacacaatttttcattggatgttcttcgactgtaattgctggatcaattgcttcgtactactgggcacgtggtgaagtatcgcatgatatcccttttcgtactgtggtatcttccctgaagcgcatggtgtgctatagtcttggctctgtggctctcggctcactgattgtgtctatcattgagtggctgcgatttatactcgagacacttcgccgcaggctgaagtttgtcgattctgcccatgacagctggtttgggaagacagtgtcatcctcatctcaatgctgcttagggtgcattgattggaccctgaaatcagtgaatcgaaatgcttacatcatgattgccatcacagggaaaggattcttcaaggcttctgcgctagcaactgggttgatcatcaagaacgtgttgcgcattgggaaagtgaatgtgattggggatgtgattctcatgttgggcaagctgtgtgtaagcctgctgtgtgcgttgtttgctttcatcatgttggataagcacaagtacagatctggccacaacaagatatcatcgccgctggttcctgtgttggtgtcgtgggcgctaggttatatagtcgcgaagcttttctttgcggtggtggagatgtcgatcgacaccataatcctgtcattctgccaggacactgaagagcaccaggggaatgcgcagtatgcgcccccactgctgatggagactctggacgaggagagcgagctgcaaagactaacagaggggccatgaagacgaagcatccattctctcttctgaagaagagtagaatagcaaactggatgctgcatttgtaactcccttagacgaccgtgcatgcatgcatgtctttattatttatatatgtatatggatcgctgctggagtggatcggaggtggaagtagttagttaaggtggtgatgcattcgttgtgcctgcagatgtggattcatgggatcatagtcatggatggtgccattcccattgacatgtgtcttggtgcggatgctttcagaaattcaggcaccagcagtcatccatacaaacttgttgcttgcatggtttacaacaaaagcaattatattaatccagcagtgacaaaattaatcggaggaaattaaggaacagctgagctacctaattaatctgctactccagcttattcttggttaaggtatctaatatatgtataggttgatgaggaggcaagaaagaagcaggtagctagctaggtgcagatggggaggccgccggtgcaggagcgggagcacttggcggcgcatttcttgtgcgcggccatggtgcatttctgggcgcacaccagccgcttgaggtggcagtccttgctcgtaacgcacttgtccttgaccttttccttgtccttgctgccattgctgtcgtcccccttgccctccttcttctgtcctcccgctcccggagagggtgaggacggcggcgacgagggtccggtgctggggctggtggcggcaatgacgtcctcctgcttccgcgcgggcaacgccgccgcgatggccttgttactcccctcctccacctcgggcgcagatgctgctccgccggcagccaggaggatgacgagcagcagcgtgccggccttggccagccggtagcgggagcaagccatcggtctctctctttccctctcgatatagct

SEQ ID NO: 2277 - DNA, 2532 bp, Panicum virgatum
caccgacacccaccccaaaaccccaccaagagagagagagggagaaaatcagaatggcgttggggggaggccccctcggcgccatcatcggccgctacccctccttcgccgccgctgacgaccaagaccccggcgggggcgtcattcgccacgaccgcaagtgccgggactggcccttccttctcctcttcgccgccttctgggtcgccatgattgtcaactccagcttcggattcaaccaggggaacccactcaggctgacatttggactggactacaaaggaaacatatgtggcagcaggcatgccgatccagatttgcatgagttggatgttcgctattggatgaaccccaaccaggtctaccaaagcgggctcaaaagcagtcacatcaatctacctgacgctaaagccatctgccttatggaatgcccacttccagcagaagatggtttgaattttgtttgcgattatccagaaggtgacatacgcctctccgtcgatgattggattgacagggactatgattacttcgagtttctcacaccagatatgaggaatagttctcttcagctgcagggtccttgttaccctgtcatctttccaagtgtaaatgtctactggagctgccagtttattgcgcgggcatccaatgtctctttgaagcattggcagcagatgggtggtgtcagcatcgacgaaaacatgctaatagacaaaacaattcacaacgcatcaacagcaaatctgccgtcctcaagagatatgttgcagatattggaaagtcctggcctgtgttactcctttgtggaggatttctccctctggtcctatctgtgatctggttactgatgattcgctattttgttgctgggatgccgtggataacggtggtagtcttcaatgcccttgtaatatctgttacaatgttcttctatataaaagctggttggattggacatgatcctttaactgttgtaattggtgaaagtgatccttatgtcaatgtaggcggacgggagataaatcatcttcatgctgcttctgtcttgatgacaatagtaatgatacttgctttcctgacttcaatagctattgcccggcgcatactggtagctacatctgtcctgaaggttgctgcaaaggtcattggtgaagtccatgcacttatttcttttccagttgtgccattcttgatcctggctatcttctatatattctggtttttagcaacgctccatcttttcagtgccggtcaggttatacgaaatgattgcaatacagattgctgctcgtatgatctcaagcttggcaaagtaaattgtgacagctgttgtgggtatagtattcgttacaccccacatattggcattgccattctttttcattttctcggctgttattgggcaacacaatttttaatcggatgttcttcgactataattgctggatcagttgcttcgtactactgggcacgtggtgaagtatcacatgatatcccttttcgtactgtggtatcttccctgaggcgcacgatgcgctatagtcttggctctgtggctctcggctcactgattgtgtctattgttgagtgggtgcgatttatactcgagacacttcgccgcaggctgaagtttgtcaattctgcccatgacagctggtttgggaagacagtgtcatcctcatctcagtgctgcttagggtgcattgattggaccctgaaatcagtgaatcgaaatgcttacatcatgattgccatcacagggaaaggattcttcaaggcttctgcgctagcaactgggttgatcatgaagaacgtgttgcgcattgggaaagtgaatgtgattggggatgtgattctcatgttgggcaagctgtgtgtaagcctgctgtctgcgctgtttgctttcatcatgttggataagcacaagtacagatctggccacaacaagatatcatcgccgctggttcctgtgttggtgtcgtgggcgcttggttatgtagtcgcgaagcttttctttgcggtggtggagatgtcgatcgacaccataatcctgtcattctgccaggacactgaagagcaccaggggaacgcgcagtatgcgcccccattgctgatggagacgctggacgaggagagcgagctgcaaagactaacagaggggccatgaagatgaagcattattcattctctcttctgaagaagagtagaatagcaaactggatgctgcatctgtaacttgcttagaccgtgcatgcatgcatgtctttgtttatatagtatatggattgctgctggagtggatcggaggtgaaattagttagttaaggtggtgatggtgatgcattcgttgttgtgcctgtagatgcgaattcatgggatcataatcatggatcccagtgacatgtgtcttggtgcggatgctttcagaaattcaggcagcagcagtcatcccattcatacaaacttgttgcttgcatggtttacaaacaatgcaattatattaattaatccagcagtgacaaaattaat

SEQ ID NO: 2278 - DNA, 3513 bp, Panicum virgatum
gagagagagagagagagagagagagggagaaaatcagaatggcttggggggaggccccctcggcgccatcatcggccgctacccctccttcgccgccgctgacgaccaagaccccggcgggggcgtcattcgccacgaccgcaagtgccgggactggcccttccttctcctcttcgctgccttctgggtcgccatgattgtcaactccagcttcggattcaaccaggggaacccactcaggctgacatttggactggactacaaaggaaacatatgtggcagcaggcatgccgatccagatttgcatgagttggatgttcgctattggatgaaccccaaccaggtctaccaaagcgggctcaaaagcagtcacatcaatctacctgacgctaaagccatctgccttatggaatgcccacttccagcagaagatggtttgaattttgtttgcgattatccagaaggtgacatacgcctctccgtcgatgattggattgacagggactatgattacttcgagtttctcacaccagatatgaggaatagttctcttcagctgcagggtccttgttaccctgtcatctttccaagtgtaaatgtctactggagctgccagtttattgcgcgggcatccaatgtctctttgaagcattggcagcagatgggtggtgtcagcatcgacgaaaacatgctaatagacaaaacaattcacaacgcaatcaacagcaaatctgccgtcctcaagagatatgttgcagatattggaaagtcctggcctgtgttactcctttgcggaggatttctccctctggttctatctgtgatctggttactgatgattcgctattttgttgctgggatgccttggataacggtggtagtcttcaatgcccttgtaatatctgttacaatgttcttctatataaaagctggttggattggccatgatcctttaactgttgttattggtgaaagtgatccttatgtcaatataggtggacgggagataaatcatcttcatgccgcttctgtcttgatgacaataataatgatacttgctttcctgacttcaatagctattgcccggcgcatactggtagctacatctgtcctgaaggttgctgcaaaggtcattggtgaagtccatgcacttatttcttttccagttgtgccattcttgatcctggctatcttctatatattctggtttttagcaacgctccatcttttcagtgccggtcaggttatacgaaatgattgcaatacagattgctgctcgtatgatctcaagcttggcaaagtaaattgtgacagctgttgtgggtatagtattcgttacaccccacatattggcattgccattctttttcattttctcggctgttattgggcaacacaatttttaatcggatgttcttcgactataattgctggatcagttgcttcgtactactgggcacgtggtgaagtatcacatgatatcccttttcgtactgtggtatcttccctgaggcgcacgatgcgctatagtcttggctctgtggctctcggctcactgattgtgtctattgttgagtgggtgcgatttatactcgagacacttcgccgcaggctgaagtttgtcaattctgcccatgacagctggtttcggaagacagtgtcatcctcatctcagtgctgcttagggtgcattgattggaccctgaaatcagtgaatcgaaatgcttacatcatgattgccatcacagggaaaggattcttcaaggcttctgcgctagcaactgggttgatcatgaagaacgtgttgcgcattgggaaagtgaatgtgattggggatgtgattctcatgttgggcaagctgtgtgtaagcctgctgtctgcgctgtttgctttcatcatgttggataagcacaagtacagatctggccacaacaagatatcatcgccgctggttcctgtgttggtgtcgtgggcgcttggttatgtagtcgcgaagcttttctttgcggtggtggagatgtcgatcgacaccataatcctgtcattctgccaggacactgaagagcaccaggggaacgcgcagtatgcgcccccattgctgatggagacgctggacgaggagagcgagctgcaaagactaacagaggggccatgaagatgaagcattattcattctctcttctgaagaagagtagaatagcaaactggatgctgcatctgtaacttgcttagaccgtgcatgcatgcatgtctttgtttatatagtatatggattgctgctggagtggatcggaggtgaaattagttagttaaggtggtgatggtgatgcattcgttgttgtgcctgtagatgcgaattcatgggatcataatcatggatcccagtgacatgtgtcttggtgcggatgctttcagaaattcaggcagcagcagtcatcccattcatacaaacttgttgcttgcatggtttacaaacaatgcaattatatcaattaatccagcagtgacaaaattaattgaaggagattaaggagcagctgagctacataattaatgatcagctacgactccagcttattcttggtcaataaggtatctaatacatatatgtatattatatagtctgatgatgaggcaagaaggaaagaaggtaggtagctaggtgcagatggggagaccgccggtgcaggagcgggagcacttggcggcgcatttcttgtgcgcggccatggtgcatttcttggcgcacaccaggcgcttgaggtggcagtccttactcgtcacgcatttgttcttggccttttccttgtccttgctgccgctgttgttgttgtcccccttgcccccctccttctctcctcccgctcccggagtgggtgacgacggcggcgaggagggtccggtgccggtgctggtgctggtggcgacgacgacgtcctcctcctgcgtccgcgcgacggccttgatactcttcccctccacctcgggcgccgccgatgctgctccgccggcagccacgaggatgaggagcagcaaggtggcggccccagcgagccggcaacgggagcgagccatcatcatcggtggtgtatctctatagctagcacaacagatcagctgcacctagctagctagctagttgtatatatagatactcctatcctattaaagagggaggaggaggaggaggagaagagaagagccatggatggagcgtgctgcaactactcgagtcatcaatccgatccgatccggccatgccgtgttgtattgtatacatgttgtggtttggtgagcaatggcaggggcatgagtacgtagcacattttgcaaggtttaacaagtgtctactagtaacctgtcattgttttgatcataaacattaaaatgctacattctagatttttcctgatgttagattttgctcactcactcaaaacgtagagaaatgaaaagtccccccttcaacaattaaatagccagttgccaaagataccaggcagcaggcttggt

SEQ ID NO: 2279 - DNA, 2770 bp, Oryza sativa
gaccgtggttaatgatccagtcttcaccaaaccgtttcatccattctcttttctggatttaaatctaagcgaaatcttttgaaacaccatcaaatcttggacaaaaatttgtgcgaaatctgtgaagttggtaaagtttccaggtctcctgctcccactctccttttcacgcagccgcagcagcaaaaagccaaaaaaaaaaaagaaaagctagctgcacacactgacaagctcatcactccaccagccagcttgagctcgcccacttccgctcacaagaagcacaaccgcgagctaccacagcatcggatcgagggcgagcggcggcggaggcggcggaatgggagggccactcggcgccatcataggcaggcacccggcggcggcgggcggcggcgggggggatgagctgggaggtgtcggcggcggcggcggcggggatggcatcattcggcacaaccggaggtgccgggatttggccttcctcgtgctcttcgcggccttctgggtcgccatgatcgtcaactccagcttcggattcaaccagggcaacccactcaggcttacttatgaactagactacaaagggaacatttgtggcagtaggcatggtgacccggatttgcatgagcttgatgttagatattggatgaacccaaaccaggtgtaccaaagtggggtcaaggacaacaagattaaccttgctgatgccaaagccatctgcctgatggagtgccccatgccagcagcagacggattaaactttgtttgtgattatccagaaggggacattcgcctgtctgtcgatgattggatcgacagggactatgactattttgagtttctcacaccagatatgagaaatagttctcttcaactgcagggtccatgctaccctgttatatttccaagtgtgaatgtctactggagctgccaatttattgcgcgagcatcaaatgtctctttgaagcattggcaacagatgggtggtatcaacatcgacgaaaatattctcatagataaaacaatccacaaggccatcaattctaaatcttcagtcctgaagagatacgttgctgacattgggaagtcatggcctgtgttaattgtttgcggtggactgctccctcttttcttgtcagttatctggttgcttctgattcgttattttgttgttgccacgccatggataactgtagtggttttcaatgctctagtaatctctgttaccatgtttttttatattaaagctggctggttaggcaatgatcccttaacagttgtaattggcgaaagtgatccatatgtccacataactgggcgggaaataagccaccttcatgctgctacagtggtgatgacagtagtaatgattattgcatttctgacctccatagctattatccgtcgtatactgatagcaacacctgtcctgaaggttgctgcgaaggtcattggtgaagttcaggcactaattattttcccagttgtgccatactttatcctcgctatcttttatatgttctggttttctgccacactccatctcttcagctctggtcaagttctccgaaatgactgcaatacagattgttgctcatatgatctgaagttgggcaaagtaaactgtgacaactgctgtgggtacagcatccattacacccctcatattggtattgccattcttttccacttatttggctgttactgggcaacccaattctttattgcttgctcttcaaccgtgattgctggatcagttgcttcatactattgggcacgtggtgaaatatctcatgacataccatttgttacagttgtttcttcaatgaagcggttgttgcgttacagccttggttcagttgctataggttcacttgttgtatctgctgttgagtgggtgcggtttatactagaatgcctcagacgcaagttgaagctagttgattccgctcgcgaaagctgctttgggaaaatgacatcatcctcttctcaatgctgcctgggctgcatagactggaccctcaagtctgtgaatcgaaatgcctatataatgatcgccattaccgggaaagggttcttcaaagcttctgttcttgcaactggtttgatcatgaataacatactgcgcattggaaaagttaacgtcattggagatgtcatcctctttctggggaagctctgtgtgagcttgttctgtgcgctctttgcgttccttatgttagacacacacaaatacaagtccgcacataacaagatatcatctcctcttgttcctgtagtggtatcatgggcccttggtttcatagttgccaagcttttcttccaggtcgtcgagatgtcgattgacaccataatcctctcattctgccaagatgcagaagagcaccaagggaacgcgcagtacgctccccctctcctcatggagacactggatgaacagagtgaactccaaagactaactcaaggaccttgatcttttctttatttttttttcttcttgcaagtagaattaagtcgaaatgaagaaatcaagtagaagcctggttattatgtaatcatgttccatgttgctgggtagtgggtaatttcaccattttagtagtgcactctgatgctgaatgtctggtctctagcgtgaccaatacccttggcttggtctaacgtatgtactacttttacttagttaagtacaatgttagtgaagaaggttatatctcacctgaatgtctgaattttttttcgcgacagatttgcatacatacgaaag

SEQ ID NO: 2280 - DNA, 2583 bp, Oryza sativa
aaaaaaaacaaaaagctagctgctcaccctgacaagcccatcactcgaccagccccgccagcttgagctcgctcacttctgctcccaagctacagatcgctcgctgtctcgctcaagcgcgacctaccacagcatcggatcgaagcgagcggcggcggaatgggagggccgctcggcgccatcataggcaggcacccggcggcggcgggcggcggcggggaggatgagctgggaggtggcggcggcggcggagatggaggcggcatcattcggcacaaccggcggtgccgggatttggccttcctggtgctcttcgcggccttctgggtcgccatgatcgtcaactctagcttcggattcaaccagggcaatccactcaggcttacctatgaactagactacaaagggaacatttgtggcagtaggcatggtgacccggatttgcatgagcttgatgttagatattggatgaacccaaaccaggtgtaccaaagtggggtcaaggacaacaagattaaccttgctgatgccaaagccatctgcctgatggagtgccccattccagcagcagacggattaaactttgtttgtgattatccagaaggggacattcgcctctctatcgatgattggatcaacagggactatgattattttgagtttctcgcaccagatatgagaaatagttctcttcagctgcagggtccatgctaccctgtcatatttccaagtgtgaatgtctactggagctgccaatttattgcgcgagcatccaatgtctctttgaagcattggcagcagatgggtggtatcaacatcgacgaaaatattctcatagataaaacaatacacaaggccatcaattctaaatcttcagtcttgaagagatacgttgctgacattgggaagtcatggcctgtgttaattgtttgcggtggactgctccctcttttcttgtcagttatctggttgcttctgattcgttattttgttgctgccatgccatggataactgtagtgctcttcaatgctctagtaatctccgttactatgtttttttatattaaagctggctggttaggcaatgatcccttgacagttgtaattggtgaaagtgatccatatgtgcatataactggacgggaaataagccaccttcatgctgctacggtggtgatgacagttgtaatgatcattgcatttctgtcctccatagctattatccggcgtatactgatagcaacacctgtcctgaaggttgctgcgaaggtcattggtgaagttcaggcactaattattttcccagttgtgccatactttatcttcgctatcttttatatgttctggttttctgccacactccatctcttcagctctggtcaagttctccgaaatgactgcaatacagattgttgctcatatgatctgaagttgggcaaagtaaactgtgacaactgctgtgggtacagcatccattacacccctcatattggtattgccattcttttccacttatttggctgttactgggcaacccaattctttattgcgtgctcttcaaccgtgattgctggatcagttgcttcatactattgggcacgtggtgaaatatcccatgacataccatttgttacagttgtttcttcattgaagcggttgttgcgttacagccttggttcagttgctataggttcacttgttgtatctgctgttgagtgggtgcggtttatactagaatgcctcagacgcaagttgaagctatttgattccgctcgtgaaagctgctttggtaaaatgacatcatcctcttctcaatgctgcctgggctgcatagactggaccctcaagtctgtgaatcgaaatgcctatataatgatagccattactgggaaagggttcttcaaagcttctgttctcgcaactggtttgatcatgaataacatactgcgcattggaaaagttaacgtcattggagacgtcatcctctttctggggaagctctgtgtgagcttgttctgtgcgctctttgccttccttatgttagacactcacaagtacaagtctgcacataacaagatatcatctcctcttgttcctgtagtggtatcatgggcacttggttttatagtcgccaagcttttcttccaagtcgtcgagatgtcgatcgacaccataatcctctccttctgtcaagattcagaagagcaccaagggaacgcgcagtacgctccccctctcctagtggagacactggatgaacagagtgaactccatagactaactcaagggccttgacttttcttcttcttgcaagtagaattaagtcagaatggagaaattaagtagaagccttgtcattatgttctttgttgctggctagtgggtaatttcaccattttggtagtgcactctgatgctgaaagtctggtctatagcgtgactagtacccctggcctgatctaacgtatgtactcctactatactttgctaatacaatgatagtgaagaaggttatatcttgtctgaatgtctgaatattgttcgcttcaaatttgcttacataattggggctggaacttgaaa

SEQ ID NO: 2281 - DNA, 3523 bp, Brachypodium distachyon
cagcgggagaaaaagccaaatctacactcgctcgcagacacactccccctccctcgctgctccttccccacactgccctgccccgctccgcccacagatcgctcgctcctccaatcgaatcccaatctccgcccaagcaagcgagcacccagctagcgagcttcctggtcctgatcgatcggaggcagaatgggcgggccactgggcgccatcatcggccgctacccctcggcggccaccggcgggggcggagaagacgagcttggaagcggcggcggcggcggcggcggggaaggcattatacggcacgaccgcaggtgccgcgacctggcgttcctggtgctcttcgccgccttctgggtcgccatgatcgtcaactccagcttcggcttcaaccagggcaacccgctcaggctgacatacgaactggactacaaagggaacgtttgtggtgacaggcacggtgacccagatgtgcacgagcttgatgttagatattggatggacccgaaccaggtgtaccaaagtggactcaagagcagcaaggttaacctggccgatgccaaagctatctgcctgatggagtgccccactccggcaccagatagattgaactttgtttgtgattatccagagggggatataaagctatctgttgatgattggatcaatagggactatgattactttgattttctcacaccagacatgagaaacagttcccttcagcttcagggtccatgctaccctgtcatattccctagtgtaaacgtttattggagctgccaatatattgcccgggcatccaatgtttctctgaagcattggctacagatgggtggtgtaaacattgaagaaaacttgcttatagacaaaacaagccacaaggccgtcgattccagatctgcagtgctgaagagatatgttgcagacattgggaagtcctggcctgtgttaattgtgtgtggtggactccttcctctttttttgtccgtgatctggttgcttatgattcgttactttgttgctgccatgacgtggataacagtagtgctcttcaatgcccttgtgatatccgttactatgttttgttacataaaagctggctggattggaaatgaccccttaactgttgttattggtgaaagtgatccttatgtccacataactgggcgggaaataagccaccttcatgctgctacggtgctgatgacaataataatgattattgcttttctgtcctcaatagctattattcggcgtatactgatagccacacctgtgcttaaggttgctgcaaaggtcattggtgaagttcaggcactgatatttttcccagttgtgccatactttatccttgctatcttttatatgttctggttttctgctacactccatctcttcagctctggtcaagttattcggaatgactgcaatacggattgttgttcatatgatctgaagttgggcaaagtaaactgtgacaactgttgtggatacagcatccattacacccctcatattggcattgccattcttttccacttatttggctgttattgggcaactcaattctttgtggcatgttcttcaactgtgattgctggatcagttgcttcatactactgggcacgtggtgaaatatcacatgagataccattttttaccgttgtctcttcactcaagcgactgttgcgttacagccttggatctgctgctataggttcgcttgttgtatctcctgttgagtgggtgcggtttatactagaatgcttccgccgcaaattaaagctagttggttcggcccgggagagctgctttgggaaaatgacatcatcctcatctcaatgctgcctgggctgcatagactggactctcatgtctgtaaatcgaaatgcctatataatgattgccattactgggaaaggattcttcaaagcttctgtgctcgcgactggtttaataatgaacaacatactgcgcattggaaaagtcaatgtaataggagatgtgatcctcttcctggggaaactgtgtgtgagtttgttctgcgcgctttttgccttcctcatgttagacactcacaagtacaagtctgcacacaacaagatatcgtctccgctggttcctgtgctggtaacatgggcccttggatatacagttgccaagctgttctttgctgtcgtcgagatgtccatcgagaccataatcctttcgttctgccaggacgccgaggaacaccaggggaacgcgcagtacgcgccccctcttctcatggaaacactagacgagcagagtgagctgcaaagactaactcaaggaccctgaccttttcaacctctctcggaactagagccaaaatggaaatgcagtagaacactgatcagatttattcttttcatgtgttcttggcctgtcgatctcctgtagtcttcttcgagtatgagcctggcttatttctgttgacctaattggcaactgttaggcaccttatgttaagtcttatgacttatgtagtgtatgtgcttggctaatgtaatgcattgcttagtgaagtagattcaaagcttgatggaatccatggtatatatgggagctgctgactgcgctagtcctctccttgtctcggtttgcactgaaattcatgtgaaattcttgtctgaggtcacaaatttttgaaagaacgagatcatgaacattcgtcaaactactgagtactgaattaatcgaaagaattgacctgaaacacaattatctagattggaagccaattctggtcgacttttctgagccaaccagcgagtaagttctgaagacttgcacctgcaactgatcatgtatacaatatacaccatcagccagacaaacgggtatacctcaaagtcatgtcccagaacgaagtatatatgtatatgcctatactagcatcaattgcactcatcacctataaaaaaagcaggcattgcactattcttcttcatcatcatcatcattatcctagagttgtacacaaagtcaagtgtgttctaagcatggtcgtcgctcaagcaagtcggagtgccgatgctgccgccaggcccaggcatcgttgtcagggaagctatccctggcatcgacgccgacctcgtcactccacggccccggttgctcgcaggtggcgaagacggcgccgatgatgaggcctgctgctggagcagcgcgtgctgggagctgccgctgcagggcagcgtgctgatggaatggcggtgaaccggcgtggtgcccggcctcggaataccgccgccagcgctgcgcgtgggctgcagctcgatcttcaggtacggcaacggcggcctggatggcgtggcgtggtcatgatcatcgtcatcgtcttcgtcctcgtagtcgagggagcagacggtgctggtctcggtgcggatggtggagtcgtcgcccctccgcttccgccgccttttcctcgccgccttcccccacccatgcatggtttctctgatcctgttggggatcagggctgccttgtact

SEQ ID NO: 2282 - DNA, 2752 bp, Panicum virgatum
tccacacatcatccacagttcgctccctcccccctcgctcacgccaaatccaaatccaaatccaatcgagcaaccgaggagccagcagcgaggagagcgacaaggggaggcggcggaaaatgggagggcccctcggcgcgatcatcggccgctacccgtcggcggccgctggcggggacgacgagctgggaggcggcggcgccggcattatacaccacaatcgcaggtgccgcgacatcgctttcctcgtcatctttgctgccttctgggtcgccatgatcgtcaactccagcttcggattcaaccagggaaacccgctcaggctgacttatgaactggactacaaagggaacatttgtggcgacaagcatggtgacccaaatttgcacgagctggatgttagatattggatgaatccgaaccaggtctaccaaagtggactcaagaacagcaaggttaacctggccgatgccaaagcaatctgccttatggagtgcccaaatccagcagtagatggattgaactttatttgtgattatccagaaggggacattcgtctctctgttgatgattggatcaatagggactacgactattttgagtttctcacaccagacatgagaaacagctcacttcagctccaaggtccatgctacccagtcatatttccaactgtaaatgtatattggagctgccaatttattgcacgggcatccaatgtctctttgaagcactggcagcagatgggtggtgtcagcattgatgaaaatattctcattgacaaaacagtccacaaggccattgattcaaggtctgctgtattaaagagatacattgcagacattgggaaatcatggcccgtatttattgtttgtggtggaattctccctgttttcttgtcggtgatctggttgcttatgattcgttatttcgttgctgccatgacttggataactgtagttctcttcaatgtccttgttatatctgtaacaatgttttgttacattaaagctggctggataggcagtgaccctttaactgttgtcattggtgaaagcgatccatatgttcacataagtgggcgggaaataagccaccttcatactgttacaattttcatgacagcagtgatgatcattgctttcctgtcctcaatagctattgtccgccgtatactgatagcaacacctgttttaaaggttgctgcaaaggtcattggtgaagttcaggcactcatagtttttccgcttgtgccattctttatccttgctatattttatatgttctggtttgctgcgactctccacctcttcagctcaggtcaagtcgtacgcaatgattgcaatatcgattgctgttcatatgatctgaagttgggcaaagtaaattgtgataactgttgtggttatagcatccattacacccctcatattagcattgccattctattccacttatttggctgctactgggcgactcaattctttctcgcatgctcttcaactgtgattgcgggatcggttgcttcctactactgggcgcgtggtgaaatatcgcatgatataccatttctcactgtagtctcttcactgaagcggctgatgcgctacagccttggatctgtcgctctgggttcacttgttgtatcaattgttgagtgggtgcgttttatactagaatgccttcgtcgcaagttgaagtttgttggttctgctcgggaaagctgctttgggaaagcagcatcttcctcttctgaatgctgcctaggctgcatagattggaccctcaagtcagtaaatcgaaatgcctacataatgattgctattactgggaagggtttccacaaagcttctgttctcgcaactggattgataatgaagaatatcctgcgtattggaaaagtcaatgtcattggagatgtgatcctcttcctaggaaaactgtgtgtgagccttttctgtgcgctttttgcctttctgatgttggacactcacaagtacaaatctgcgcacaacaagatatcatctccactgatccctgtactggtaacatgggcccttggttacatagttgcaaagctcttctttgcagtggttgagatgtcaatcgacaccataatcctctccttctgccaggacgctgaagagcaccaagggaacgcgcattacgcgccccctcttctgatggaaactctggatgaacagagtgacttgcaaagactaactcaaggaccatgatttcctctagggttttgcccttggtactagacctgaaaaatggaaactcggtggcagcctaatgatttgttttccagttctcttggcttgtggggagaggttcatcattttgcactctgctttcttctacaagtctgagcctgacaggttgtcgtggcctaattggcaactgtaggaaccttatctaatatatgtaccattgctgatacagtgttagctgttagtgaagaaggtttgaaatctgtgataagtatgtgagttcatgtatttgtcctctctgttgcatcacaagcctcaattatttcatttcgtcctgtgggtggggtaagacagtttccaagccaagtgagcagtagagcagtgccggggtaatgctgtaggatcaaccttttctcaaattgatgaaaatactggtgaaactgtattgactgtattagtgcaaatgcgcaacaatcaccagaaaacagtgaagtcgatcaaggctgggatcaagaatgtagactgttgatttatgg

SEQ ID NO: 2283 - DNA, 2535 bp, Brachypodium distachyon
gaagcagcagcgtcactttccccctctcgcttccccaacccgaggaagaagaagaagaagaacctagtccaattcagaggagctgagcttccaggaggcgctgcatctgctgttctgagctgagctgagctcggggaaggcacaatgcgatggccactgggcgccatcattggccgccacgcctccgccgccgccgccggagcaggaggagaaaaggacgccggagccggagccggcgtcattcgccacgaccgcaagtgccgcgacctgccattccttgccctcttcgccgccttctgggtcgccatgattgtcaactccagcttcggcttcaaccagggcaacccactcaggctaacatttggacttgactataaaggaaacatatgtggcagcaaacatggtgatccaaatttgcatgagcttgatgttcgttattggatgaatcccaaccaggtctaccaaagtgggctgaaaagcaaccaaatcaatctacctgatgccaaggccatatgtctgatggaatgcccctatcctgcagaagatgggttgaactttgtctgtgattatccagatggtgacatacggctctctgttgatgattggattgacagggactatgattactttgagtatctcacaccagacatgagaaacagttctcttcagttgcagggtccatgttaccccatcatatttccaagtataaatgtctactggagctgccagtttattgcacggccgtccaatgtctctctgaagcattggcagcagatgggcggcgtcagcattgatgcaaacatgcttattgacaaaacaattcacaatgccgtcaactctaagtcctctgtcttaaagagatatgttgcagatattgggaagtcctggccagtgttaatcgtttgtggtggattactcccacttttactatcattgatatggttagcgatgatacgctattttgtttctgggatgccatgggtaacagtggtcatttttaatgtccttgtaatatcggttacaatgttcttctatataaaagctggctggattggcaatgatcccttaactgttgtaatcggtgcaagtgatccatatgtcagcataagtggacgggaaataaatcacctgcatgttgctgcggttttgatgaccgtagtaatgatcattgctttcctgacttcaatagctattgttcgacgtatactgatagcaacgtctgtcctgaaggtggctgcaaaggtcattggtgaagtccatgcattaattatttttccgatagtaccatacttcgtgcttgctatcttctatatgttgtggttttcagccacactgcatcttttcagcgctggtcaagtgttacgaaatgattgcaattcaaattgctgttcgtttgatctcaagttgggaaaagtaaactgtgacaactgctgcgggtacagtatccattacaccccacatattggccttgccattctcttccacctgtttggctgttactgggcaacacaattcttcatcgcgtgctcttcaactgtaattgctggatctgttgcttcatactactgggcgcgtgatgaaatatcgcatgacataccgtttcatacggtggtgtcttccctgaagcgcttgttgcgctatagccttggatctgtggctctaggttcactgatggtatctgtcgtagagtgggtgcagtttgtactcaaatcaattcgccgtaggctgaaagtagttgattcagcgcgtgaaagctgctttgggaagacagtgtcatcctcatctcactgctgcctcggttgcatagattggaccatcaaatcagtgaacaggaatgcttacatcatgattgccattacagggaaagggttctgcaaggcttcggagctggcgaccgggttgataatgaacaacatactgcgcatcggaaaagtgaacgtcatcggtgacgtgatcctgttcctgggaaagctgtgcgtgagcctgtcgagcgtgctcttcgcgttcctgatgctggacaaccacaagtacaggtcttctcacagcaagatatcgtcaccgctgttccccgtgctgctgtgctgggcgcttggttacgctgtggctcagctcttcttcggcgtggtggagacgtccgtggagacggtggtgctgtccttctgccaggacgcggaggagcaccaaggggatgcgcagtacgcgccccctgtgctgatggagaccctgctgggtggtgacccaacacagcttcagagactcaccgcccagccttgatcgtctgatgaatggacctcgataatttctcagctggctcttaggaatagttacattcatttttaggtaaatttgagacaagaattatgggacggagggagtaattaggagtccgtttccaattatgtaagagtctgacttgatccccaagtttgtaagggcccttatagtcctgcactcctgcctagtcaatcattcaaggaagcaatctaataccaatcctgagtctccctgtgccttgtgcgccccaattgccaattc

SEQ ID NO: 2284 - DNA, 2624 bp, Setaria italica
ctgctctgctcactgcctccctccctccgctctccacactcccagtcggccagtccccaccaggccaccaccacccacggatcgctcccgcctgctcccttcctcgctcacgccaaaggcccaaagccaccgccgctccgaatccaaatccaatcgaccaaccagcgagcaagcgaggagagtgccaagggggggaggcggccggaatgggaggtcccctcggcgcgatcatcggccgctacccgtcggcggccgcgggcggcgggggcgaagacgagctgggaggcggcggcgcctcgggcgccggcattatacgccacaaccgcaggtgccgcgacatcgccttcctcgtgctcttcgccgccttctgggtcgccatgatcgtcaactccagcttcggattcaaccagggcaacccgctcaggctgacttatgaactggactacaaagggaacatctgtggcgataagcatggtgacccaaatttgcatgagctggatgttagatattggatgaacccgaaccaagtctaccaaagtggactcaagaacagcaaggttaacttggccgatgccaaagccgtctgcctgatggagtgcccaaatccagcagtagatggattgaactttatttgtgattatccagaaggggacatacacctctctgttgatgattggatcaatagggactacgactattttgagtttctcacaccagacatgagaaatagctcacttcagctccagggcccatgctaccctgtcatatttccaactgttaatgtctattggagctgccaatttattgctcgggcatccaatgtctctttgaagcactggcagcagatgggtggtgttagcatcgatgaaaatattctcattgataaaacagtccacaaggccattgactcaaggtctgctgtattgaagagatacatagcagacattgggaagtcctggcctgtgtttatcgtttgtggtggaatcctccctgttttcttgtcagtgatctggttgcttatgattcgttatttcgttgctgccatgacttggataacagtagtcctcttcaatgcccttgttatatctgtaacaatgttttgttacattaaagctggctggatagggaatgaccctttaactgttgtcattggtgaaagcgacccatatgttcacataagtgggcgggaaataagccacctccatactgttacaattttcatgacagcagtaatgatcattgcgttcctgtcctcaattgctattgtacggcgtattctgattgccacaccagtcttaaaggtcgctgcgaaggttatcggtgaggttcaggcgctaatgttttttccacttgtgccattctttacccttgctatcttctacatgttctggttttctgctacactccacctcttcagctctggtcaagttgtccggaacgactgcaatactgattgctgttcatatgatctaaagttgggcaaagtaaattgtgacaactgttgtgggtacagcatccattacacccctcatattagcattgccattctattccacttatttggctgctactgggcgacacaattctttctcgcatgctcttcaactgtgattgcgggatcagttgcttcttactactgggcacgtggtgaaatatcacatgatataccatttctcactgtagtctcttcgctgaagcggctgatgcgctacagccttggatccgtcgctctgggttcgcttgttgtatcagttgttgagtgggtgcgttttatactagaatgccttcgtcgcaagttgaagtttgttggttctactcgcgaaagctgctttgggaaagcgacatcttcttcttctgaatgttgccttggctgcatagattggaccctcaagtcagtaaatcgaaatgcctatataatgattgccattactgggaagggtttccacaaagcttctgttcttgcaactggattgataatgaagaacatactgcgcattggaaaagtcaatgtcattggagatgtgatcctcttcctgggaaaactgtgtgtgagcctattctgtgctcttttcgcctttctgatgttggacactcacaagtacaaatctgcacacaacaagatatcatctccactgatccctgtgctggtaacatgggccctcggttacattgttgccaagcttttctttgcagtggtggagatgtcgatcgacaccataatcctctccttctgccaggatgctgaagagcaccagggcaatgcgcagtatgcgccccctcttctgatggaaactctggatgaacagagtgatctgcaaagactaactcagggaccatgatttcctctagggttttgccctcggtactagtagacccaaaaaagatggaaacctggtagcagcctaatgatttgttttccacttctcttggcttgtcgggagaggtccaccgttttgcactatgcttttcctctacaagtctgagcctgacgggttcgcctggcctatttggcaattgtaggaaccttatctaatgtatgtactattgctgatagtgttagtgaaaaaaggttgaaatctatatgataagtatgtgagtttgtctatttatcctcactgttgcat

SEQ ID NO: 2285 - DNA, 3314 bp, Sorghum bicolor
tctctcctcacatcactctccctgctgcttgctgcctcgtgcctcccctccactctccactgtccactctcccagtcggccagtccccaccagcaccgcgcaacgcacagatcgctcgctcgctcacgccaaggccaccgtgccgcgccgaatccaaatcgagtcgagcaagcaagcaaggagcgcacgcatctaggctaggcgagcagccgagcatcaaggtaggaggaggaggaggaggaggcgccgcgggcggcggtggaatgggagggcccctcggcgcgatcatcggccgctacccgtcggcggccggcggcgacgagcagctgggaggcggcgccagcggcggcattatacgccacgaccgcaggtgccgcgacatcgccttcctcgtgctcttcgccgccttctgggtcgccatgattgtcaactccagcttcggcttcaaccagggcaacccgctcaggctgacttatgaactggactacaaagggaacatctgtggcgacaagcatggcagcccaaatttgcaggagctggatgttagatactggatgaatccgaaccaagtctaccaaagtggactcaaggacagcaaggttaacctggctgatgccaaagccatctgcctgatggagtgcccaaatccagctgtagatggattgaactttatttgtgattatccagaaggggacatccacctctctgttgatgactggatcaatagggactatgactattttgagtttctcacaccagacatgaggaatagctcacttcaactccagggtccatgctaccctatcatattcccaactgttaatgtctattggagctgccaatttattgcacgagcatccaatgtctctttgaagcactggcatgagatgggtggtgtcagcattgatgaaaatatcctcattgataaaacagtgcacaaggccattgattctagatctgctgtattaaagagatatattgcagacattgggaagtcctggcctgtgttcatcgtttgtggtggaatcctccctgttttcctgtcagtgatctggttgcttatgattcgttatttcgttgctgctatgacttggataacagtagtcctcttcaatgcccttgttatatctgtaacgatgttcttttacatcaaagctggctggataggcaatgaccccttaactgttgtcattggtgaaagtgacccatatgttcacataagtgggcgggaaataagtcaccttcatactgttacaatcctaatgacagcagtaatgatcattgctttcctatcctcaatagctattgtccgccgtatactgatagcaacacctgtcttaaaggttgctgcaaaggtcattggtgaagttcaggcactgatagcttttccacttttgccgtggctgatcctttccatcttttatatgttctggttttctgctacactccatctcttcagctctggtcaagttgtccgaaatgattgcaatactgattgttgttcgtatgatctgaagctggggaaagtaaattgtgacaactgttgtgggtacaacatccattacacccctcatatcagcattgccattctattccacttgtttggttgctactgggcgactcaattcattctcgcatgctcttcaactgtggttgcgggatcagttgcttcgtactactgggcacgtggtgaaatatcacatgatataccatttcttactgtagtctcttcactgaagcgactgatgcgctacagccttggatctgttgctctgggttcacttcttgtatctgtcgttgagtgggtgcggtttatactagaatgcctccgtcgcaagttgaagctagttgattctgctcgagaaagctgctttggaaaagcgacgtcttcctcttctgaatgctgcctgggttgcatagactggactctaaagtcagtaaatcgaaatgcctacattatgattgccattactgggaaaggtttcttcaaagcttcagtgctcgcaactggattaataatgaagaacattctgcgcattggaaaagtcaatgtcattggggatgttatcctcttcctgggaaaactgtgtgtgagcctattctgtgcgctttttgcctttctgatgttagacacccacaagtacaagtctgcacacaacaagatatcatctccagttatccctgtcctggtaacatgggccctcggctatatagtcgcgaagcttttctttgcggtggttgagatgtcgatcgacaccataatcctctcgttctgccaggacgccgaagagcaccaggggaatgcacagtatgcgccccctgctttgatggaaactctggatgaacagggcgaactgcagagactaactcaagggccttgactgttgtttcctcctgggcatcccttcttggtatggtagcatggaaacttagcagcaggctaatcttttgttaccccgttcccttggcgtgtgaagaggtttgccattttgcttgctaccctaccaaagtttcttctacaagtctgaatctgacatgttttcctggcccaattggcatgtgtaggcagcttatctaatatatatatatatgtgtgtgctattgctgatacagcgttagtgaagtaggttggaatctatatgagtgagtgacttcatcatctattaatcccctctgttgaatttcattcatcaacttatacatttaacattttggtgctgtgactggagtaacacaatgtcgagtgttgaagccaattaaggagtgaaacctttaatggcgtaggatcaaaatttccaattcccaacagtataccagtgacattttctgtggacaaattcgaccatatattcgttcaaaagtgcgtagcgaatccagcccagctcgctatatccatcctactcgccagcgccacgctcaccgttggtaattaccgatgtggaattaacgtaggaacgatgaccatacctattacctaatacaatctgatatcgccgtcgacgtcgatgcccgcgtcgcagcagtctcgccgcctcctttctcccgggtccatgtgcacgaggagcggctgcgcaatgggagggagggtcggagtcagcagcggaggcggcggcgcagcgtgtaccagcacttcttgcatggagtgccgatgaccctcatcccgcgcctgcatggcgccgccaccaccttggaaaccgccctccggacctggtgccccggcttgcgcttcccggcagcagcagcagcagccggcaccacagccagagccacgggcgacggctgcggctgcgcaacgcccagcagcctcctcggcg

SEQ ID NO: 2286 - DNA, 2414 bp, Secale cereale
tcggccgcgacgcctccgccgccggcgccgggggaggaaaaggaggagacgacgacgccgcagccggcatcattcgccacgaccgcaagtgccgcgacctgccgttcctcgccctcttcgccgccttctgggtcgccatgattgtcaactccagcttcgggttcaaccagggcagcccgctcaggctgacttatggactcgactacaaagggaacatatgtggcagcaaacatggtgatccagatttgagtgagctggatgttcgttactgggtgaaccccaaccaggtgtaccaaagtgggctcaaaaatagcacaagtgatctagctgatgctaagtccatctgcctgatggaatgcccctaccctgctgaagatggcctgaactttgtttgtgattatccggaaggtgacatacggctctctgtcgatgattggatcgacagggactatgattactttgagtatctcacaccagatatgagaaacagttctcttcagttgcagggtccatgttaccccatcatatttccaagtataaatgtctactggagctgccagtttattgcacggccatccaatgtctctctgaagcattggcagcagatgggtggtgtcagcattgatgaaaacatgctaatagataagacaattcacaataccatcaactataaatcttctgtcttaaagagatatgttgcagatattgggaagtcttggcctgtgttaatcgtttgtggggggttactccctcttttcctatctttgatctggttagctatgatccgctattttgttgctgtgatgccatggataacagtgatccttttcaatgcccttgtagtatcagtcacgatgttcttctatataaaagctggctggattggcaatgatcccttaactgttgtgattggtccaagtgatccatatgtcagcataggtggacgggaaataaaccaccttcatgctgctgctgtattgatgacagtggtaatgatcattgctttcctgacttcaatagctattgttcggcgtatactgatagcgacatccacaaccgtcctaaaggtggctgcaaaggtcatcggtgaagtccatgcactcattatttttccggtcgtaccatacttcgcccttgctatcatctatatgttctggtttgcggctacgctgtatcttttcagctctggtcaagttctacaaaatgattgcaatgcagagtgctgctcatttgatctcaagctgggaaaagtaaattgcgacagctgttgcgggtacagtgtccattacacccctcatattggcattgcaattcttttccacctgtttggctgttactgggcaacacaattcttcatcgcatgctcttcgactgtaattgctggatcagttgcttcgtactactgggcgcgtggtgaaatatcgcatgacataccgtttcataccgtggtgtcctccctgaagcgtttgctgcgctacagccttggatctgtagctctaggttcgctggtggtatcgagcgtagagtgggtgcggtgtatacttaaatcgctccgccgtaggctgaagggggttgattcaaccggtgaaagccggttggggaagacagtgtcatcgtcatctcactgctgcttgggctgcatagactggaccatcaagtcagtgaaccggaatgcttatatcgtgattgcggttacagggaaagggttctgcaaagcctccgagctcgcgaccgggctgattatgaacaacatactgcgcatcggaaaggtgaacgtgatcggggacgtgatcctctacctgggaaagctgtgcgtgagcctgtccagcgcgctgtttgcgttcctcatgctggacacccacaagtacaggtctgctcacaacaagatatcgtccccgctcttccccgtgctgctgtgctgggcgcttgggtacgtggtggctcagctcttcttcggggtggtggaggcgtcggtggagacgataatcctgtccttctgccaggacgcggaggagcacgacggggaggcgcagtacgctcccccgctgctcatggagacgctgggcgacacgagccagctgcagaggctcacgcaggggccttgattcgatcaagcttctcgttctcagcattgatccaccttagtagtgtagtgttaccagaggcggatggttgggtgaatggctttgaccataataatacgcacaatactcgtactactagtattaattagctgtgttgttaggtggaatgaagttcgtttgtgatggggatggggatggggatggggatggcaattgggtaccggatggatggtggatgttgctccatgaccaacggtccaacctaggatatcagtgctaggtaggtagtgctggtactggctttcgttgttataatgacagtcaaggaac

SEQ ID NO: 2287 - DNA, 2990 bp, Hordeum vulgare
tgcgatatcactgccagtgtcactgtggcaggcagccgcagtgaagcggaagccagcaagcggcagcagcactttccccccctccccgctcctgtgacccgaggaggaagaagaaggaggcggcaagccggcgacccacctcagtttgaggagagctgagctgtggcaaggcgtaatgcgggggcccctcggccgcgacgcgtccgccggcggcgccggaggagggaaaggaggagacgacgacgacgccgcagccgacatcattcgccacgaccgcaagtgccgggacctgccgttcctcgccctcttcgccgccttctgggtcgccatgattgtcaactccagcttcgggttcaaccagggcagcccgctcaggctgacttacggactggactacaaagggaacatatgtggcagcaaacgcggtgatccagatttgagtgagctggatgttcgttactggctgaaccccaaccaggtgtaccaaagtgggctcaaaaatagcacaagtgatctagctgatgctaagtccatctgcctgatggaatgcccctatcctgcggaagatggcctgaactttgtttgcgattatccggaaggtgacatacggctctctgtcgatgattggatcgacagggactacgattacttcgagtatctcacaccagatatgagaaacagttctcttcagttgcagggtccatgttaccccatcatatttccaagtataaatgtctactggagctgccagtttattgcacggccatccaatgtctctctgaagcattggcagcagatgggtggtgtcagcattgatgaaaacatgttaatagataacacaattcacaataccatcaactataaatcttctgtcttaaagagatatgttgcagatattgggaagtcttggcctgtcttaatcgtttgtggggggttactcccccttttcttatctttgatctggttagcgatgatccgctattttgttgctgggatgccatggataacagtgatccttttcaatgcccttgtaatatcagtcacgatgttcttctatataaaggctggctggattggcaatgatcccttaactgttgtgattggtccaagtgatccatatgtcagcataggtggacgggaaataaaccaccttcaggctgctgctgtattgatgacagtggtaatgatcattgctttcctgacttcaatagctattgtccggcgtatactgatagcgacatccacaaccgtcctaaaggtggctgcaaaggtcattggtgaagtccatgcactcatcatctttccggtcgtaccatacttcgcccttgctatcatctatatgttctggtttgcggcgacactgtatcttttcagctctggtcaagttgtacaaaatgattgcaatgcagagtgctgctcatttgatctcaagctgggaaaagtaaattgcgacagctgttgtggatacagtgtccattacacccctcatatcggcattgcaattcttttccacctgttcggctgttactgggcaacacaattcttcattgcatgctcttcgactgtaattgctggatcagttgcttcatactactgggcgcgtggtgaaatatcgcatgacataccattccataccgtggtgtcttccctgaagcgtttgctgcgctacagccttggatctgtggccctaggctcactggttgtatccagcgtagagtgggtgcggtttatacttaagtggctccgccgtaggctgaagggggttgattcgaccggtgaaagccgcttggggaagacagtgtcatcgtcatctcattgctgcttgggctgcatagactggaccatcaagtcagtgaaccggaatgcctatatcgtgattgcggttacagggaaaggattctgcaaggcgtccgagctcgcgatggggctgataatgaataacatactgcgcatcggaaaggtgaacgtgatcggggacgtgatcctctaccttggcaagctgtgcgtgagcctgtccagcgcgctgttcgcgttcctcatgctggacacccacaagtacaggtctgctcacaacaagatatcgtctccgctcttccccgtgctgctgtgctgggcgcttgggtacgtggtggcgcagctcttcttcggggtggtggagacgtcggtggagacgatcatcctgtccttctgccaggacgcggaggagcacgacggggaggcgcagtacgctcccccgctgctcatggagacgctgggcgacacgagccagctgcagaggctcacgcagggcccctgatggatcaaagcttctctgctgcgtcgatccaccttagtagtgtactactgtagtagtgttaccagaggaagatggtttgggtgaatggctttgaccataataatacgcactatactaatactccgtattaacttcgttgttaggtggaaatggaatgagggcagttggtgcctggctacggtggaaaagacctctactagtagtgtcgatgaagtttctttgtttgtgatggggatggcaatcgggtaccggatggatacgtaggtagtactggtaccggtttccgttgttactccatgatgcaaagtcaacgaagcacgggttcggctcagggagtctgttcgtactactagcaatgatgcgaagggtggtcatcaattcatcatggtgatgtgagcactggcgtaaagcaatggatggtagtactacgtatttcctgcctgtgtggctgctaagtgaataatcctaagaaaacgtgctgggtgatgtcgtggtcaacagccaacacgaacaatatttgtgagaatacacgaagtagtgattgaactatttcaggctgaaggggtctgattgaactgcagtttataaaagattgtatgtaaatttacaaagcgctggatatgcttgtagttcggtaggcggccgtctaatgattcgtgtgaaagctcctgtatgtactgcaggtcaactgatc

SEQ ID NO: 2288 - DNA, 2635 bp, Triticum aestivum
ccacgcgtccggcttcttgctctccaatctggagcccggccggcagatcaccggccaccccctccccaaatccatccacccgccgcgtctccaccgcgcgctcgtcggaggaggaatgggcggcccgctgggcgccatcatcggccgctacccctcggccgccgctggcaccgggggagacgacgccgaccacccgggcgggggcgggggcacggtcagcctgggcattatccggcacgaccgcaggtgccgcgacctggccttcctcgtcctcttcgccggcttctgggtcgccatgatcgtcaactccagcttcgcattcaaccagggcaacccgctcaggctgacatacgagctggactacaaagggaacgtctgtggcgacaggcacggcgacccggacgtgcacgagctcgaggtcaggtactggttggacccgaaccaggtgtaccaaagtggagtcaagggcagcaaggctaacctggccgacgccaaggccatctgcctcatggagtgccccactccggcaccggatgggctaaactttgtctgtgattacccggaaggggatgtcaggctctcagttgatgactggatcaatagggactataactacttcgatgttctaacacctgatatgaggaacagctcccttcagcttcagggcccttgctaccctgtcatattccctagcgtaaacgtctattggagctgccaatatatcgcccgggcatccaatgtttctttgacgcactggcaacagatgggtggtgtaaacattgaacaaaatatgcttatagataaaacaatccacaaggccatcgattccagatctgcagtcctcaagagatatgttgcggacattgggaagtcttggcctgtcctaatcgtgtgtggtgcactccttcctcttttcttgtcagtgatctggttgctcatgattcgttattttgttgccgcaatgacatggataacagtagtgctcttcaatgcccttatagtatctgttactatgttttgttacatcaaagctggctggcttggaaatgaccccttaacggttgttattggtgaaagtgatccatacgtccacataagcgggcgggaaataagccatcttcatgttgccacagtgctgatgacagtaataatgatcattgcttttctgtcctcgatagctattgtccggcgtatactgatagccacacctgtcctgaaggttgctgcgaaggtcattggtgaagttcaggcactgatagttttcccagttgtgccgtattttatcctcgctatcttttatatgttctggttttctgctacactccacctcttcagctctggtcaagttgtccgaaatgactgcagtacagattgttgttcatatgatctgaagttgggcaaagtgaactgtgacaactgttgtgggtacagcatccactacacccctcatatcggcattgccattcttttccacttatttggatgctactgggctactcaattcttcatggcatgctctgcaactgtggttgctggatcagttgcttcttactactgggcgcgtggcgaaatatctcatgatataccgtttgtcagtgttgtctcttcgctcaagcggctgatgcgttacaaccttggatctgctgccataggctcgcttgttgtgtctgctgttgagtgggtgcggtttatactagaatgccttcgccgcaagttgaagctggtcggttctgctggggagagctgctttgggaaagtgtcatcgtcctcgtctcagtgctgccgaggctgcatagactggaccctcatgtccgtaaatcgaaatgcctacataatgattgccatcacggggaaagggttcttcaaagcttcggtgctcgcgaccggccttataatgaacaacatactgcgcatcgggaaggtgaacgtgatcggggacgtgatcctgttcctggggaagctgtgcgtgagcctgttctgcgcgctcttcgcgttcctcatgctggacacccacaagtacaagtcggcgcacaacaagatatcgtcgccgctggtccccgtgctggtgacgtggggcctgggctatacggtggcgaagctgttcttcgcggtggtggagatgtccatcgacaccatcatcctgtccttctgccaggacgcggaggagcaccaggggacagcgcagtacgcgccgccgctcctcatggagacgctggacgagcagggcgagctgcagagactcactcaagggccctgaatctctctccctcgtttctttaattcttcttagagctagaggtagactggtggtaatttagtactgtagaagcctgatggatcgagatctcagtccaagtgatgatcttggctgcctggctggctggctgcctcctgtacgtgttgttcagctttagctcccggtatgtacgtgtctgatgtgtcgcccctgattggcaaaagtgttgcgtacgagtacgatgatgtactttgctgatgcgatgtctggcgaaggttggaaattagttgcttgaatgtggtggtggtatgcaatgtgtcgcgggttggtactgccgccgctgtgcttgattccatatagtattatgacatgatggagcatgagatcagccagaatctt

SEQ ID NO: 2289 - DNA, 2706 bp, Zea mays
cctgctgcccctcgctgttcgctgcctcccctccactctccactgttcactcccagtccccaccagcaccaggcacagatcactcgcttccccactcgctcacgccaaaaccaccgcgccgaatccgaatcgagtcgagcacgagcgagcaagcaaggagctagcgcacgcatctaggctaggcgagagcaccaaaggaggcgccgcgggtggcggcggaatgggagggcccctcggcgcgatcatcggccgctacccgtcggcggccggcggcgacgagcagctgggaggcggcgccggaggcggcattatacgccacgaccgcaggtgccgcgacatcgccgttctcgtgctcttcgccgccttctgggtcgccatgattgtcaactccagcttcggcttcaaccagggcaacccgctcaggctgacttatgaactggactacaaagggaacgtttgtggcgataagcatggcaacccaaatttgcaggagctggatgttagatactggatgaatccgaatcaagtctaccaaagtggactcaagaacagcaaggttaacctggctgatgccaaagccatctgcctgatggagtgcccaaatccagctgtagatggattgaactatatttgtgattatccagaagggaacatagacctctctgttgatgattggatcaatagggactatgactattatgagtttctcacaccagacatgaagaatagctcacttcaactccagggtccatgctaccctataatatttccaactgtaaatgtctattggagctgccaatttattgcacgtgcatccaatgtttctttgaagcactggcatgagacgggtggtgtcagcattgatgaaaatatcctcattgataaaacagtgcacaaggccatcgattctagatctgctgtattaaagagatatattgcagacattgggaagtcctggcctgtgttcatcgtttgtggtggaattctccctgttttcctgtcagttatctggttgcttatgattcgttatttcgttgctgccatgacttggattacagtagtcctcttcaatgcccttgttatatctgtaacgatgttcttttacatcaaagctggctggataggcaatgaccccttaactgttgtcattggtgaaagtgatccatatgttcacataagtggacgggaaataagtcaccttcatactattacaatcctaatgacagcagtaatgatcattgctttcctgtcctcaatagctattgtccgccgtatactgatagcaacacctgtcttaaaggttgctgcaaaggtcattggtgaagttcaggcactgatagcttttccacttttgccgtgcctgatcctttctatcttgtatatgttctggttttctgctacactccatctcttcagctctggtcaagttgtccgaaatgattgcaatactgattgttgttcatatgatctgaagctgggaaaagtaaattgtgacaactgctgtgggtacagcatccattacacccctcatatcagcattgccattctatttcacttatttggttgctactgggcgactcaattcattctcgcatgctcttcaactgtggttgcgggatcagttgcttcatactactgggcgcgtggtgaaatatcacatgatataccatttctcactgtagtctcttcactgaagcgactgatgcgctacagccttggatctgttgctctgggttcacttgttgtatctgttgttgaatgggtgcggtttatactagaatgccttcgtcgcaagttgaagctagttgattctgcccgagagagctgctttggaaaagcgacgtcctcctcttctgaatgctgcctgggttgcatagactggaccctcaagtcagtaaatcgaaatgcctacattatgattgccatcaccgggaaaggtttcttcaaagcttcagtgctcgcaactggattaataatgaagaacattctgcgcatcggaaaagtcaacgtcattggagatgtcatcctcttcctgggaaaactctgtgtgagcctattctgtgcgcttttcgcctttctgatgttagacacccacaagtacaagtccgcacacaacaagatatcctctccagttatccctgtcctggtaacatgggccctcggctacgtagtcgcgaagcttttctttgcggtggttgagatgtcgatcgacaccataatcctctcgttctgccaggacgccgaggagcaccaggggaacgcgcagtatgcgcccccagctctgatggaaactctggacgaacagggcgaactgcagagactaactcaagggccttgactgtcttttcctcttggtagtagcatggaaacttagcggcagcctaatgttttgttaccccgttccgttctcttggcttgtgaagaggtttgccatttttgcttgctattccatgtacaagtctgaatctgacatgttctcctggcccaattggcatgtgtaggcagcttatctatatatgtgtgcagtgtgctattgctgatacggcgttggtgaaatactccctccgtttccaacttccaacatcataaatttaaccaaatttatatagtaaaacaatagcatttatgatacctaaataactattattggattcttcattagttagctatttgatgtcatagatctttgtgtgtgtgttttttttt

SEQ ID NO: 2290 - DNA, 1439 bp, Saccharum officinarum
gcgctccgacgaccgcctaagaagaaaagaacccgacgagccccccccaatccgccgaaacctcccaacatcccaacggagcccagtgcccaccctgcctgccctcctcgccgcgatccctccgcgctgctggaggtctcctgccccgaaccaatccagaacgccggtttcggcggacgacgggatcgtccaacgccgcctgcctccttcccgccgaatccgccgcttgggtcatcgagattccggcgtgaggcgacgaggttcccgactgttcgtcccttgcgcgcgtagggagggatcggaggagcgccccgccggccggccatggcgtgccggggcttcttcgagtgcgtcctcaagctgctcaacctcgtcgtcatggcggtcgggctggccatggtgggctacggcgcctacctgctcgtgatgtggctgcaggtcgcgccgctcccgccgcccgcgccgccgtcgccgtcgccggcggccgtgccgcccggcggcgacctcgtgcggctcgggaggccgctgctgctccttgttgatgcgtgcctgtcggatgcggatgggaccgtggagaggctctccagtgcctggtttatttttgctttcattggtgtcggtgctatactcttcatcacatcgatctttggttgtgctggagctagaaatggatgctgcctgtctatttactcattcctcattattttgttcatactggtcgagcttggtgcaggaggcttcattttcttcaaccatagttggaaagaggtcatcccagttgacaaaacaggaaactttgacatgatgtacagctttttgaaagagaattggagaattgcaaaatgggttgcacttggagctgttgtatttgaggcattgttgttcactgtggctatcatagtacagtcgggcaatcaagctgactatgacagtgatgatgagtacattggcgcaaggtctggaatacggcagccattggtgaatcagcaagctgctgctgctgctgatcctagggtgcccaatctcgactaccgcccaatccgaaatgacgcgtggagccaaagaatgagagaaaagtacggggtggatagctttgatccaaacaggtttcaacaagccacgatatctccaggagaacaaagaaaccgatgcacgattctctgaagcttgattgacagcagccagtagtggttccaagttttatatatatccaaccgtgcaattacatcgagttgcagagaatatgtgcctggttgtgtagcttatggagagcttcacgttcgcctgtatctgtttttttggtttagacagtccaaactcagcacaccaatgcacaggtgcaggtggcacatcctttaagtttttctaataagtagtatattgaacctagtttgtgttttagataatgttccaatgtgcataaaacttttcctgtttaa

SEQ ID NO: 2291 - DNA, 2019 bp, Zea mays
aagaacacaaagctagagataatgctagttagatgttttttgtagctttgaattagagtgtgtgatgtaattttgcttttgttatgaacattagacaataaactgaacttacgaacttttgtatagagctggttatactttttttccttctaacaaaatgatttataaacgagatagtcattacatagctgtggtaactttaattaatacaaatattaattttgattttgttcaaatttatttgtcttatcttttatttttttatttttttttttgaatttagagctctaatgtgaattttgggccaaaaactgaatttcgggccaaaaattgaatttcgggccctaatgtgaatttcgggccaaaaaatgaatttcgggcttttataatttcgggccacccaaaatgagcccggcacgtttaatcaattacgggccgggccgtgggccgagggctaggcacatgggccggcccggcacggcccgaaattcaaacgggccaggccgacccaaaattcaaacaatacggaccttttgaggcttgggccgggccgggccgggcggtccgaatgtacacctataccttgaggtttcaccgaagtgatatgttactggaactcctagttattaattaatattccggcttaggaggagaataaaaaacgcacgccacgtaagtcacccgctctcaacgcatttccgtcttctcctccgacgagttgccccaatccgcccagacctccaacatcgcaacggagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggccatggcgtgccggggcttctttgagtgcgtcctcaagctcctcaacctcgtcgtcatggcggttgggctggccatggtgggctacggcgccttcctgctcgtgacctggcttcaggtcgcgccgctcccgccgccttcgtcgtcgccggacgccgtgccacccagcggggagctcgtgcggctcgggaggccgctgctgctttttgttgatgcatccctgtcggatgggaccgcggagaggctctccagtgcctggtttatttttgcgtttattggtgtcggtgctatactctttgtcacatcgatctttggttgtgctggagctagaaatggatgctgcttatctatttactcattcctcattattttgttcatactggtcgagcttgctgcaggaggcttcattttcttcaaccatagctggaaagaggttattccagttgacaaaactggaaactttgacatgatgtacagttttttgaaagagaattggagaattgcaaagtgggttgcacttggagctgttgtatttgaggcattgttgttcactgtagctatcatagtacagtcaggcaaccaaaccgactatgacagcgacgatgagtacatcggcgcaaggtccggaatacggcagccattggtgaaccagcaagctgctgctgctgctgctgatcctagggtgcccaatctcgactaccgcccaatccggaacgacgcatggagccaacggatgagagagaagtacggggtggatagcttcgatccgaacaggtttcagccggccaccatatctcctggagaacaaagaaaccgatgcacgattctctgaggcaagttctacatatatccaaccgcgcaattaacaccgagttgcagagagtatgcgcctggattattcggtgttgcctggctgtgtggcatccggagggcttcacattctcgtctgtatttttttttttggtttacatagtccaaactcagcacaccagtgctgtttttgtaataagtattgaaccaagttcgtgttctagataacgttccaatgtgcataaaaactttccctgttaccag

SEQ ID NO: 2292 - DNA, 1586 bp, Panicum virgatum
catcttcttctccgaatccaccccaaacttccaacatcccaacggagtcccctgttctcggcgcgatccgctcctccccttgctcgaggccagctgccccgaatcgatcgagaacgccgagttccgcagccggggtcgcccaaaggcgcctgctttccgccgaatcccccgccgctgccgccatcgttgatgcgccggggccgggccgtcgagattccggcgtgaggtgcggttcctgacttgccgtgcgtgcggagaggagcgcccgccttccggctgcccgtcggccatggcgtgccggggcttcttcgagtgcgtcctcaagctgctcaacctcgtcgtcatggcggtcgggctggccatggtgggctacggcgcctacctgctcgtgatgtggctgcaggtggtgccgccggcgccggcgccggcgccggtggccgtggctgccagcggcgagctggtgcggctcgggaggccgctgctgctcctggtcgatgcgtccgccctgtcggacgggaccgcgaagaagctctccagtgcctggtttatttttgtgttcattggtgttggtgttgtacttttcatcacatcgatctttggttgtgctggagctaggaatggatgctgcttgtctatttattcattcctcattattttgttcatactggtagagcttgctgcgggaggcttcattttcttcaaccataattggaaagaggtggtcccagttgacaaaactggtaactttaacatgatgtacagctttctaaaagagaattggagaattgcaaagtgggttgcacttggagctgttatatttgaggcattgctgttcactgtggctatcatagtacagtcaggcaatcaagctgattatgacagtgatgacgagtacatcggcccgaggtctggaataaggcaaccattggtaaatcagcatcagcaagctgctactgatcctagggtgcccaatctcgactaccgcccaatccggaacgatgcatggagccaaaggatgagagaaaagtatggggtggatagcttcgatccaaacaggtttcaacaggccacgatatctcctgcagagcaaagaaaccgatgtacaattctctgaggcttggttgatatcaggcactagtgattccaagtttatatccaactgggcgattacatcgactcctggataatgcgtgcctggtttattcaaggttgccatgttgtgtagaatattgtgagttttgcctttgcctgcctgtgtccgttggtttgcagggtcagaactccatacttctactggtataggtactgaatccgtcagggttttgtgttaagtactgagcctagtttgtgtttcagagaatgtttcaatgtaatctttaaaaataataatatttcaatgtgcataaaacttctgtctgtgaagtgatcttcactatatgcaccgtgtttataaaccagacatgtttgttacgccaaaacttcacattgccagagatctctatgcacatatgaatgaagatgccggaccttctgttcttgcaataattgagcttggatgtggcgacagagcatattctattaatatg

SEQ ID NO: 2293 - DNA, 1544 bp, Panicum virgatum
caattccatcttcttctccgaatccaccccaaacttccaacatcccaacggagtcccctgttctcggcgcgatccgcccctccccttgctcgaggccagctgccccgaatcgatcgagaacgccgagttccgcagccggggtcgcccaaaggcgcctgctttccgccgaatcccccgccgctgccgccatcgttgatgcgccggggccgggccgtcgagattccggcgtgaggtgcggttcctgacttgccgtgcgtgcggagaggagcgcccgccttccggctgcccgtcggccatggcgtgccggggcttcttcgagtgcgtcctcaagctgctcaacctcgtcgtcatggcggtcgggctggccatggtgggctacggcgcctacctgctcgtgatgtggctgcaggtggtgccgccggcgccggcgccggcgccggcggccgtggctgccagcggcgagctggtgcggctcgggaggccgctgctgctcctggtcgatgcgtccgccctgtcggacgggaccgcgaagaagctctccagtgcctggtttatttttgcgttcattggtgtgggtgttgtactcttcatcacatcgatctttggttgtgccggagctaggaatggatgctgcttgtccatttattcattcctcattattttgttcatactggtagagcttgctgcgggaggcttcattttcttcaaccataattggaaagaggtggtcccagttgacaaaactggtaactttgacatgatgtacagctttctaaaagagaattggagaattgcaaaatgggttgcacttggagctgttatatttgaggcattgctgttcactgtggctatcatagtacagtcaggcaatcaagctgattatgacagtgatgacgagtacatcggcccgaggtctggaataaggcagccactggtaaatcagcatcagcaagctgctgctgatcctagggtgcccaatctcgactaccgcccaatccggaacgatgcatggagccaaaggatgagagaaaagtatggggcggatagcttcgatccaaacaggtttcaacaagccacgatatctcctgcagagcaaagaaaccgatgtacaattctctgaggcttggttgatatcaggcactagtgattccaagtttatatccaactgggcaattacatcgactcctggataatgcgtgcctggtttattcaaggttgccatgttgtgtagaatatcgagagttttgcctttgcctgcctgtgtccgttggtttgcagggtcagaactccatacttctactggtataggtactgaatccgtcagggttttgtgttaagtaccgaacctagtttgtgtttcagataatgtttcaatgtaatcttttaaaaaataaatatttcaatgtgcataaaacttctgtctgtgaagtgattttcactatatgcaccatgtttataaaccagacatgtttgttacgccaaaacttcacattgccagagatctctatgcacatacgaatgaagatgcggggccttctgttctt

SEQ ID NO: 2294 - DNA, 1796 bp, Setaria italica
cgcaattccatcttcatcttctcctccgacgagtcccaaatccacccaaacttccataataatccaagcgcaaccccctgctctcctccgccggatccctcgtcctgctcgaggtctcctccctcctgtcctaaatcaaccaagagcgccgaattccgtagccgggatcgcccaaaggcgcctcctttccgccgaatccgccgccgcccgccatcgttgatgcgcccccgggccgtggagattccggcgtgaggcgcggttcctgacttgctgtgcgcgtggggggaggagcgcccgcctgcccacccgctccgtcggccatggcgtgccggggcttcttcgagtgcctcctcaagctgctcaacctcatcgtcatggcggtcgggctggctatggtgggatacggcgcctacctgctcgtgatgtggctgcaggtggtgccgccgccggcgccgccgctgccgccgtctcccgcgccggtggtggtggctgccggcggcgagctggtgcggctcgggaggccgctgatgctccttgtcgatgcgtcctccctgtcggacgggaccgcggagaggttctccagtgcctggtttattttcacgttcattggagttggtgttgtactcttcatcacttcgatctttggttgtgctggagctaggaatggatgctgcttgtctatttattcattcctcattattttgttcatactggtagagcttgctacaggaggcttcattttcttcaaccatagttggaaagaggttattccagttgacaaaactggtaactttgacatgatgtatagctttttgaaagaaaattggagaattgcaaaatgggttgcacttggagctgttatattcgaggcactgctgttcactgtagctatcatagtgcagtcaggcaatcaagctgattatgacagtgatgacgagtacatcgtcccaaggtctggaataaggcagccattagtgaaccaacagcaaggtgctgctgatcctagggtgcccaatcttgactaccgcccaatccggaacgatgcgtggagccaaagaatgagagaaaagtatggggtggatagctttgatccgaacaggtttcaacaggccacgatatcacccgcagaacaaagaaaccgatgtacaattctctgaggcatggttgatatcagccagtagtggtttcaagtttatatccaactgtgcaattacatcgactcctggatgatgtgtgcctggtttatccgatgttgcccttctgtgtagaacatggagagtttcgctgtcacctgcctgcttccgctggattgcatggtcagaactccatacttctactggtgtaggcattgcatccttcagggttttgtaacaagtactgaacctaattttgtgttttagataatgttccaatgtgcataaaaccttttgtccgtgaagtgattttcaccgtatgcaccatgtttgaacgagacatgtttgttacgccaaaacttcaagagaaggtttgggtttaggggttggtgtttgttcaggttaggcgtcgtgctcgggctgtctgttcctcaaccgctgctactgtacctgtcctgttgactcgactgaacaccacttatgagcctgtgacactgcttttatcagtgtgtgttgtcttctgaacttttgcattattttctctgaattgtgacgaggcaggcatcaatgccaataataagtggatcagttatcagagactgatagtccttttcagcatgaatgattcaccgacctctgccgtagctgcagagctgaatggag

SEQ ID NO: 2295 - DNA, 1588 bp, Panicum virgatum
cacgtggtcacccacccccaacgcaattccaacttcatctccgaatccaccccaaacttccaacatcccaacggagtcccctgttctcggcgcgatccgcccctccctccccttgctcgaggccagctgccctgaatcgatcgagaacgccgagttccgcagccgggatcgcccaaaggcacctgctttccgccgaatcccccgccgctgccgccatcgttgatgcgccggggccgggccgtcgagattccggcgtgaggtgcggttcctgacttcccgtgcgtgcggagaggagcgcccgccttccggctgcccgtcggccatggcgtgccggggattcttcgagtgcgtcctcaagctgctcaacctcgtcgtcatggcggtcgggctggccatggtgggctacggcgcctacctgctcgtgatgtggctgcaggtggtaccgccgccggcgccgccgctgccgccgtctccgtcgccggtggccgtggctgccagcggcgagctggtgcggctcgggaggccgctgctgctcctggtcgatgcgtccgccctgtcggacgggaccgcgaagaagctctccagtgcctggtttatttttgtgttcattggtgttgggtgttgtacttttcatcacatcgatctttggttgtgctggagctaggaatggatgctgcttgtctatttattcattcctcattattttgttcatactggtagagcttgctgcgggaggcttcatttttcttcaaccataattggaaaaaggtggtcccagtgacaaaactggtaacttaacatgatgtacagctttctaaaagagaattggagaattgcaaagtgggttgcacttggagctgttatatttgaggcattgctgttcactgtggctatcatagtacagtcaggcaatcaagctgattatgacagtgatgacgagtacatcggcccgaggtctggaataaggcaaccattggtaaatcagcatcagcaagctgctactgatcctagggtgcccaatctcgactaccgcccaatccggaacgatgcatggagccaaaggatgagagaaaagtatggggtggatagcttcgatccaaacaggtttcaacaggccacgatatctcctgcagagcaaagaaaccgatgtacaattctctgaggcttggttgatatcaggcactagtgattccaagtttatatccaactgggcgattacatcgactcctggataatgcgtgcctggtttattcaaggttgccatgttgtgtagaatattgtgagttttgcctttgcctgcctgtgtccgttggtttgcagggtcagaactccatacttctactggtataggtactgaatccgtcagggttttgtgttaagtactgaacctagtttgtgtttcagagaatgtttcaatgtaatctttaaaaataataatatttcaatgtgcataaaacttctgtctgtgaagtgattttcactatatgcaccgtgtttataaaccagacatgtttgttacgccaaaacttcacattgccagagatttttatgcacatatgaatgaagatgccggaccttttgtttttgc

SEQ ID NO: 2296 - DNA, 5252 bp, Brachypodium distachyon
agctgactttttgtaataaaccagcggtaacagttcagttcagttcgacttccacacgagagaaccagagagaaagaaaacgcacggacggcagcccacttcttcttccccggaattcattaccgaatcgcaggtgcacgagcacgggccaacattccaatcccccaatccgccgcatatcccgatccccttctgcccgcctcgattcgcttccatccagagtcctcccgctccccgaatccatcgaggagcgcctccttctcctcttcctcgatcggtcaaaggcgccccctttccgcgccgcccctgtcctgcccggaaccgacgcccggcgccgtcgcaatctctgcgtgaggcccggcgacggtctctctctctctgccccgggtgtcacatcaatcaatcaaggaatccggccatggcgtgcaggggcttcttcgagtgcgtcctcaagctgctcaacttcgtggtcatggtggtcgggctggccatggccggctacggcgcgtacctgctcgtgctctggctccaggtgctctcgccgccgctgcctccgtctccggcgccgcctgcggccgtggcccctagcggcggcgacctggtgcggctggggcggccgatgctgctccttctcgatgcgtccctgtctgataatgggaccgtggagaggctctccagcgcatggtttatttttgcgtttattggcattggcgtcatactctttattacctccattttcggttgtgctggtgcttcaacgaggagcggatgctgcttatccacttattcattcctcatcattttgttcatactagtagagcttgctgcaggatgcttcattttcttcgaccatgactggaaaaatgtaattccagttgataagactggcaactttgacatgatctacagtttcctgaaagaaaattggagaattgcaaaatgggttgcacttggttctgttgtgtttgaggcattgttgttcactgtagcgctcatagtgcagtcaggcattcaagatgattatgacagtgatgacgagtatattggcgcgaggtctggagtccgtcagccattggtgaataagcaagctgctgctgatcctagggtgcccaaccttgactaccgtccaatccggaacgatgcatggagccaaagaatgagagacaagtacggggtggatacctttgatccgaaccggttccaacaggccacgatatctcccgcagaacaaagaagccgatgcacaatcctctgaggcctggctgtggtcgatacaagtcagcactggttttgaattcacatccagctgtgcaataacgtccgctcccatgtaacgggtggctggttgatctggcgttttcaagtttgtgtaggatgtggcgatcccttgcatccgcccaccccggtttcttcatttacgtagatagatgtctttatcaacaggagtacatgctgcgtccttcagccttgcaataactgtattatagttctgctttgtaacgtatattttgttgtttacatgcttcgcataaaagcttatatggaactatcatcttgatcaggtttgcatctcacggaacacggatagtcctatcaggtttacatatcttgaagagttccttatttatggaacctctaaatttggtagatcgggttctcttatttggaattaggaaggtccagctttccccgttaggcaatcttgttattgcaggatatgatccgcattgcccataagatttcctcttctgactaccagtagttgatagggaagtatagtacaaagcagagtttcctgttatacaatctggaacaatgtcttcatatagctctgcattgcattgcatatatcatataccctgcgaccatggtggatctggagaatcctgagggcgccaccagtcctcagggcgagcatgccggtcatcgcggttgtcgctgccttgctcgcggcgatcaggtcgtctggcaggagtgcttcaccttggtctgcgttgtcccggtgacctgcctcgccgccgctgtatgcctgctcatctactcccaggctggagacaagagcatcaaggccaactggctcctagtatgggggggcatgttcctcctggccgcctctgtggtcacggccagcccctccgtccagtgcgccatctggtgcatccggcatcgccatcgatctcggccgatatagggctgagatcacgtcgttgccgagccggaaaaaatgaatcgttgtcaagggcgaagagtatatagtactatcaaaatattaattaatgataagtgctttgtatgattggtgtcgaattgcaattgcagggtttttgctaggtgcacttaacgtagctcaaaacactttcagatttaggcaccaatccgacaggatctgcagtgctgttaagtccgtttctgaactggcaccagcactcctgcaccacactgacccgactcagcaccagcaaaaggcatcaatgggtcctcttctcttcatcattgtgtttatctggaacattttttgctggctttctctgccaataatttggacctgtgatcaatggagccatcacaggtttgacaatccttgtcagcctgattgaagggctcacccagatgcagcagcacatgacttcaaggggccaggtcatgacgatggcgcccagcactcacccaatcctgtgtcctagcaagcaacaccaccactgctccatgcccatcattcacctcccatctgatctgatttgctgctgcatcttggattattatgtttttccatgttccagcaaatcttgctgtcaatgtatgattcggtgtagttccctttcggtaaggggagcgcaaaacgtggagcgaatggagttactacagagaaaaatcaaaacaagggaaagaagctactacatttgaacataagcatggtagggtttatgtatgtttctgacgatgatgatcgatccagttatacagatgattcgacgaattttcgagcacactaggtattaccaaaaactcttgttttattccgcaggcccgccagttccaatgaaggaagggaagaaatggagattgcttcagggaagaactctatacatgtgcactcaaagcatccttcattatagtcttgcatgtgtttcagttgctggacttctggtctgcaccaggtgttgcctgaaaaaggacaagcaataataactctcttcaggtctggctggcattaaatgaaattcaggtttgcggtacaacagcaacaacaatgacagttggatgatgtaaatccaaataaaattttcatggcaaaaataggaaatgatactaaacaaaaagtgatgaatacttaccccaactgatgtcacaaaactgcagaccgcacatttaacagaccttgcgccgtactggtacatgagcagcattcggcagttcccgcagtttacatgcgcaacctgattcgctgcggtgacgagacacatctttcattcagagtgtttgagattagatgaacactcatccttctgagttttatgagtaagtcagtagtaaatgattgatggtgagtatctttgtgtccgtgaacggtttccgtaattctctgacatgttatcatcttatggtaactctaggagatattcgtcaaactttggtagatccaggatatccttgtcaggcttttgtttttctaaatcaaaacaaacacatacatcctacagtccaattttgatgagtgcgacttcgggataagccaattcgatgatgctaacggttattgactgattgctagagcttttctaacctcagaaaatattctcttcagaagtaggattttacatgcaggaataaaaaccaaacatcgtttcaagaagggaaacagaacacaccgaatataccgtttgcaaccaagaaagaggagaaatgaaagaaaataataagctttggttggtgtaccttccatggccaggttcacagtgtggcaacaagaacattgcacacttgtcgcgccacgtatgtacattaggagagtgtggcatcctccgcaaactaactgcgccatctccgtccctgcaccaacaaatccagatgaaaactgaacttcaggacaattgccagctagcggaaagccctttgaattggttcaagggagaagtatttaaaccctttgatctgtctacgctactgtgtaatctgcaactgcatttctgtacttagaaaggaagcaagccgcagaaaagaacatttttctgtctgctatactagtcttgcatatagatggaactcgatgttcggctgccacattacttacaaatcctcgaggggcaaaatgagtttgattcatatgcataccgggagccggcacagcggtcacggtactgcaaactgcgcagcataccgacgtcgcgccggcagggtacatgagcagattccggcacccggagcagacaagctggctttgagcccctgaaattgcacaaccacgccacttgagctcagtgtctggatctcacatactgattactagcagcttcgtttcagagatgcattgcaacagcagacaaacgtctgtaactcaactgagcatatcttgagcctaatctgttctatcagatcttcagagagaaaataaaataaacagaagaaaccatctgagctttatttctagtaaaaaaatcatgaagaagcctgaactttatgccatattcatcttgttaaagattgagtgtctgatacttttggcaaatactaaagcattttctggttgcccaagacaagaaacatgaaatgacttctaaaaaaaagcatcaagggaagagttgcaaagctggctttcttggcagtgcccagggagaccatacctgcattgggagtgggtggtgtgaacggtgcaggtggagttggataaggggcaaggggaaccggcattgccgtcccggaggctgccttaacagacgtcgtcgttgctgctctcgtgagactccggtggcaattgatttcaagagactccggtggcaatcgacgaagagcagctttccttcccctacatgaaaaccctgcagaaagcctagcaacaatgattaggactcaatcctatgatgaacttctggatgcataagaacagtttcattagttagtgcatatcttgctttctccctctcccccctctctctttctatctctatcctttctccctcacacagtgtgggagcagaggttgacaaatatataggggagcagggaaaaaggagagattatgatagatggccaaa

SEQ ID NO: 2297 - DNA, 1337 bp, Triticum aestivum
tttctttatccatcgcgggtgcacgaaccaaacattccagtcgtctgccggcaatttcgattccccctctctcacgagttctcctatcccggatccatccagaaaaccaggttggtccgcagccgggtcggtcaaaggcgctccgtccctgcccggagttgatgcgcgccgccgtctgaatctctgcgtgaggcaggccgatcaaccgatccatccggccatggcgtgcaggggcttcttcgagtgcgtcctcaagctcttcaacctcgtgctcatggctgtcgggctggccatggcgggctacggcgcctacctgctcgtgctctggctccagctgctgcctccgtcgccgccggcgccgcctccaagcggcgacctagtgcggcttgggcggccgatgcttcttcttattgacgtgtctatctcagatgggacctcggagaagctcatcagcgcatggtttatttttgcatttataggtgtcggtgttatactcttcattacttccatcttcggttgtgctggagcatcaacaaggagtggatgctgcttatccacttattcattcctcatcattttgttcatactagtagagcttgctgcaggatgcttcattttcttcgaccatagctggaaagatgtaattccagttgataaaactggtaactttgacatgatctacagtttcctgaaagaaaattggagaaccgcaaaatgggtcgcacttggagctgttgtgtttgaggcactgttgttcactgtagccctcatagtgcagtcaggcaatcaagatgattatgacagtgatgatgagtacattggcccgaggtccggagtccgtcagccattggtgaataagcaaactgctaccgatcccagggtgcccaatcttgactaccgtccaatcaggaacgatgcatggagccaaagaatgagagacaagtatggggtggattcctttgatccaaacaggtttcaacaggccacgatatctcccgcagaacaaagaaacagatgcacaatcctctgatgcttggtcgatgcaattcagtactggtctccgaatttacagccagctgtgcaataacatcgacttgcatgtagcatgtggttgggtgatctgttgtttccaagtcgtgttggatgtggcgagcccttgcattcgccagtcctagttccttcatttacatagtcagaaatctccgcatccttcagtctttgcaataattgaacttaattttggccatacaggacattctattgtgtacatgttcccatggaaccttgtatagaacttcaatctgtgaaccgatttgcattgtgcactgaagcgtgtt

SEQ ID NO: 2298 - DNA, 1404 bp, Triticum aestivum
acattccagtcgtctgccggcaatttcgatcccccctccctcacgacttctcctatcccggatccatcgacaaaagcaggttggtccgcagccgggtcggtcaaaggcgctccgtccctgcccggagttgatgcgcgccgccgtctgaatctctgcgcgaggcaggccggtcgaccgatccatccggccatggcgtgcaggggcttcttcgagtgcgtcctcaagctgctcaacctcgtcctcatggctgtcgggctggccatggcgggctacggcgcctacctgctcgtgctctggctccagctgctgcctccgtcgccgccggcgccgcctccaagcggcgacctagtgcaccttggccggccgatgcttcttcttattgacgtgtctatctctgatgggacctcggagaagctcatcagcgcatggtttatttttgcatttataggcgtcggtgttatacttttcattacctccatcttcggttgtgctggagcgtcagctaggagtggatgctgcttatccacttattcattcctcatcattttgttcatactagtagagcttgctgcaggatgcttcattttcttcgaccatagctggaaagatgtaattccagttgataaaactggtaactttgacatgatctacagtttcctgaaagaaaattggagaaccgcaaaatgggtcgcacttggagctgttgtgtttgaggcactgttgttcactgtagccctcatagtgcagtcaggcaatcaagatgattatgacagtgatgatgagtacattggcctgaggtccggagtccgtcagccattggtgaataagcaaactgctaccgatcccagggtgcccaatcttgactaccgtccaatcaggaacgatgcatggagccaaagaatgagagacaagtatggggtggattcctttgatccaaacaggtttcaacaggcgacgatatctcccgcagaacaaagaaacagatgcacaatcctctgatgcttggtcgatgcagttcagtaccggtctccgaatttacagccagctgtgcaataacatcgactcgcatgtagcatgtggctgggtgatctgatgtttccaagttgtgttggatgtggcgagcccttgcaatcgcccgtcgtagttctttcatttacatagtcagaaatctctgcatctttcagtctttgcaataattgaacttaattttggccatatcatttacatagtcagaaatctctgcatctttcagtctttgcaataattgaacttaattttggccatacaggacattctgttgtgtacacgttcccgtggaaccttatatggaagttcaatctgtagtaaagaaaaagtaaaacgaacgtagcgtggcggctcgtcgtcgtacgtacgtacgtaccg

SEQ ID NO: 2299 - DNA, 1573 bp, Oryza sativa
gcggtgttgagttgcattaaatcagaaggaaactgctaaatatttttcttcaacggctgcctcatgctttgcgttttacatttagctttacaggtgaaaagaacacgttagagaggccaaggccataccatagtttggagctcccagtttacgagaggaggagaagaagaaccgcacgacaccccaccccacctcccgatcgccaagaaccacaatccccaatccacccaataactctaattcctcccccgattcgccctcgaccaagaaccactcggatcgatcaaagccgccacctttccaccaaatccccaatcttttttttttcttcttcttttcttgcaattgatgcgcttcgccatcgggatttgaggggaggaagaagaaggggatggcgtgcagggggttcttcgagtgggtcctgaagctgctcaacttggtggtgatggtggtcgggctggccatgatggggtacggcgcctacctcctcgtggcgtggctccagctgctgccttcgccgccgccgctgccgcctgcgccggcggtggctcccggcggcggcggaggcggcgagatggtgcggctcgggaggccgctgctgctcctcctcgacgtgtcgtccttgcccgatgggacggcggagaggctctccgctgcatggtttatttacgcgtttattggtgttggtgtaatactcttcattacatccatctttggttgtgctggagcatcgaggggcgggtgctgcttatccttttattcgttcctcattattctgttcatactggtagagcttgctgcaggaggtttcattttcttcaaccatagctggaaagatgtaattccagttgataaaactggtaactttgacatgatgtacagctttttgaaggagaattggagaatcgcaaagtgggttgcacttggagctgtactatttgaggcagtgctgttcactgtagctctcatagtgcagtcaggcaatcaagcagactatgacagtgatgacgagtacattgccccaaggtcttcaacccggcagccgttggtgaacaagcaacctgttgctgaccctagggtgcccaaccttgactaccgtccaatccgaaacgatgcgtggagccaaagaatgagagaaaagtatggggtggacacctttgatccaaacaggttccaacaggcgacaatatctcccgcagaacaaagaaaccgatgcgcaatcctctgaaactcggttggtatcagtcggtagcggctctaatttacacccaactgtacaatagcatcgatcggttcccgcataatgtatacctgcttgatgtctttgaaccaatgttgttcagttgtttaggatgtggagagcctgtccagttaaaaaaaaaaaacttgcacagttagagttctgttgaacattttgtagtttatgcgcccttccatcttgcaataattaaatttcagtttttgttaacagagacatctcctgttgtgcataaaacctgctatgtactcccatcggttcctcttttctttttataacaaggtatattataaagtcaataagttaaaaatttag

SEQ ID NO: 2300 - DNA, 1297 bp, Avena sativa
cggtcaaaggcgattcctgtccgccgtacctttcccgagctgatgcgcgctgcctgaggccggtgacgtctcttgccccctcggaggaggaggaggcgcccgctcaatcagtcgatcgctgcatccggccatggcgtgcaggggcttcttcgaatgcatcctcaagctgctcaacctcgtggtcatggtggtcggcctggccatgacgggctacggcggctacctgctcgtcatgtggctccaggtgctgactccgtcgccggcaccgccgccgtcggtggctcctagcggtgacctcgtgcggcttgggcggccgatgcttcttcttcttgatgcgtctttgtcagatgggaccgtggagcggctctccagcgcctggtttatttttgcgtttatcggcatcggtgttatactcttcattacctccatctttggctgtgctggagcgtcaactaggagcggatgctgcttatccacttattcattcctcatcattttgttcataatagtagagcttgctgcaggatgcttcattttcttcgaccatagctggaaagatgtgattccagttgataaaactggcaactttgacatgatctacagtttcctgaaagaaaattggaaaaatgcaaaatgggttgcacttggagccgttgtgtttgaggcactgttgttcactgtaaccctcatagtgcagtcaggcaatcaagatgattacgacagtgatgatgagtacattggcccaaggtccggagtccgtcagccattagtgaacaataagcaaactgttaccgatcctagggttcctaatcttgactaccgtccaatcaggaatgatgcatggagccaaagaatgagagacaagtacggggtggatacctttgatgcaagcaggtttcaacaggcgacgatatctccggcagaacaaagaagccgatgcacaatcctctaatgccttgttgatacaagtgccggtctctgaatttacatgggctcctgtgtaacatgtgcctgggtaatctgatgtttcacagtttgtgttggatgtggtgagcccttcagttgcttcatttacagagacagaaacctatatcatcaggtgtacatgctgcatccttcatcagttttgcaataatcgaatttagattttggtcacatagaacataatctattgtgtatatgtttccgtagaaccttatatggaacttttgtttgtgaactggtttgcattgcacaatttcgggtgtttggtccttatcaaccgatttgtgttgagcaagatactgtgcttgagcta

SEQ ID NO: 2301 - DNA, 1704 bp, Hordeum vulgare
gagaggccgagaggggggcccggagagagagaaaaagaaacgcacggcgcccacttcctcctgtaattctttctttatcaatcgcgggtgcacgaaccaaacattcgcgtcctctgccggtaatttcgactccccctccctcacgagttctcctatcccggatccatcgagaaaagcaggttggtccgcagccgggtcggtcaaaggcgctccgctactgtccggagttgatgcccggcgccgtctgaatctctgcgcgaggccgctcaaccgatccatctggccatggcgtgcaggggcttcttcgaatgcgtcctcaagctgctcaacctcgtcctcatggctgtcgggctggccatggcgggctacggcgcctacctgctcgtgttctggctccagctgctgcctccgtcgccgccggcgccgcctccaagcggtgacctggtgcggcttgggcggccgatgcttcttcttattgacgtgtctatctcggttgggacctcgcagaagctcatcagcgcatggtttatttttgcatttataggcgttggtgttatactcttcattacctccatcttcggttgtgctggagcgtcaaccgggagtggatgctgcttatccacttattcattcctcatcattttgttcatactagtagagcttgctgcaggatgcttcattttcttcgaccatggctggaaagatgtaattccagttgataaaactggtaactttgacacgatctacagtttcctgaaagaaaattggagaactgcaaaatgggtcgcacttggagctgttgtgtttgaggcactgctgttcactgtagccctcatagtgcagtcaggcaatcaagatgattatgacagtgatgatgagtacattggcccgaggtccggagtccgtcagccgttggtgaataagcaaactgttaccgaccccagggtgcccaatcttgactaccgtccaatcaggaacgatgcatggagccaaagaatgagggacaagtatggggtggattcctttgatccaaacaggtttcaacaggccacgatatctcccgcagaacaaagaaacagatgcacaatcctctgatgcttgcaatcctctgaagcttggtcgatgcaattcagtactggtctctgaattcacagccagctgtgcaacatggactcgcatgtagcatgtggctgggtgatctgatatttccatgttgtgttggatgtggcgagcccttgcattcgcccgtcgtagttctttcatttacatagtctgaaatctctgcatcgtagagtctttgcaataattgaacttaattttggccatacacgacattctattgtgtacacgttcccatggaaccttgtatggaacttcgatctgtgaaccgatttgcattgtgcaatgaagcgcgtttgagccccgtgggtttatttcgcctacacaaggtagagtattgtgttttagctaggatgtgtttgtttggccgtttgcgccatccaaaactgttacgtctgtatggtttgagtcgggctggaatcccaaaccatgtaatcggtcagagtgctatacaaagggtcagttcttttggcagcttaaaaaataaaccgctttctcattagcttttttatatgaaatttgtaattttgaaacgttcggattatataatcccgatctattttgaatcttaagagaatttagccg

SEQ ID NO: 2302 - DNA, 1353 bp, Secale cereale
gtcgtctgccggcaatttggattccccctccctcacgagttctcctatcccggatccatccagaaaaggttggtccgcagccgggtcggtcaaaggcgctccgtccctgcccggagttgatgcgcgccgccgtctgaatctctgcgcgaggcaggccggtcaaccgatccatctggccatggcgtgcaggggcttcttcgagtgcgtcctcaagctgctcaacctcgtcctcatggctgtcgggctggccatggcgggctacggcgcctacctgctcgtgctctggctccagctgctgccttcgtcgccgccggcgccgcctccaagcggcaacctagtgcaccttgggcggccgatgcttcttcttattgacgtgtctatctcagatgggacctcggagaagctcatcagcgcatggtttatttttgcatttataggcgtcggtgttatactcttcattacctccatcttcggttgtactggagcctcaactaggagtggatgctgcttatccacttattcattcctcgtcattttgttcgtactagtagagcttgctgcaggatgcttcattttcttcgaccatggctggaaagatgtaattccagttgataaaactggtaacttcgacatgatctatggtttcctgaatgagaattggagaaccgcaaaatgggtcgcacttggagctgttgtgtttgaggcactgttattcactgtagccctcatagtgcagtcaggcaatcaagatgattatggcagtgatgatgagtacattggcccgaggtccggagtccgtcagccattggtgaataagcaaactgctaccgatcctagggtgcccaatcttgactaccgtccaatcaggaacgatgcatggagccaaagaatgagagacaagtatggggtggattcctttgatccaaacagatttcaacaggccacgatatctcccgcagaacaaagaaacagatgcacaatcctctgatgcttggtcgaggcaattcagtaccggtctccagccagctgtgcaataacatcgactcgcatgttgcatgtggctgggtgatctgatgtttccaagctgtgttggatgtggcgagcccttaaattcgcccgtcgtagttctttcagttacatagtcagaaatctctgcatctttcagtctttgcaataattgaacttaattttggccatacatgacattctactgtgtacacgttcccatggaaccttatatgaaacttcaattctgtagaaaaaaccaaaaaaaaaaaaaaaacaaaaaaaaaaagaaaaaaaaataaaaacaaagacacgacacgacgacacgaaggaggtaagagacccccc

SEQ ID NO: 2303 - DNA, 3124 bp, Panicum virgatum
cttgcagctgatcaatcaagtagggctgagagtagaagcagctagcaaaccacaattgttaagctccaacacctacagacaccagagctgtgattgtgtgaagtgataacactgagggaggagagagagagacaaggatcaaaaagatacatcgactgatcaccatgccgcctcagctggagcacgatgagcagcagacagcgggaagtggcggccaccgagcagcgccgccgcctcctcctcctccgaacatgctgctcacctttagcagcagcagcagtagcagcggcgctccctcttctacttgtgtcgcgaccaccaccacgaccactgccaccaccaactcctccggcgccgtcgtccatcccaccacctccagcccaccgtcgtcggccgctgctagcctccgccccgccgccaactccttccctctcgtcctcaagttcgaggaggtggtgtacaaggtgaagctcggccagccgacggccggatggtgcgacaagctgtcggccgcggcgagcatggctgtcggtggcagcggggacgccgggaggcagaagaaggcggtgtcggcggcggggtcgtcgccggcgcgggagaagacgatcatcagcgggatgtccggcgtggtgcggccgggggagatgctggcgatgctgggcccgtccgggagcggcaagacgacgctgctgacggcgctgggtgagcggcacgggcacggcggccgggcgctgctgtcgggcaagatcacctacaacgggcagcccttctccggcgccgtcaagcggcgcaccgggttcgtgacgcagcacgacgtgctgtacccgcacctcacggtggccgagacgctgtggtacacggcactgctccggctgccgcgcgcgctgggcgccggcgagaagcgcgcgcaggcggaggccgtggcgcgggagctgggcctcgccaaggtcgcgcacagcatggtcggcggcgtgcgcggcgtgcgcgggctgtccggcggcgagcgcaagcgcgtcagcatcgggctcgagatgctcgtcgaccccagcctgctgctcctcgacgagcccacctccgggctcgactccaccaccgccgcccggatcgtcggcacgctccgccgcatggcggccgacggcggccgcaccgtcgtggtcaccatccaccagccgtcctcgcggctgtaccacatgttcgacaaggtgctgctgctgtccgccgacggctgccccatctactacggccgcgccgccgacgcgctctcctacttcgcctccgtcggcttcgcctcgccgctctccctcaaccccgccgacctcatgctcgacctcgccaacggtatcgcgccgcagacggcgagcggcgacggcgacggcgtggcggcggtgaccggcggcagcgagagcgagcacaaggaggtgcgggccaagctggcggccgcgtacgagcgccacattgcgccggcggtgaagctggacatctgcgcgcgggagacggcggcgccgcaggcgtcggcggcgcggcgcgggccggcgccgtcggagtggacgacggggtggtggacgcagttcgtggtgctgctccagcgcgggctcaaggagcggcggcacgagtcgttcaacaagctgcgcgtcctccaggtgctgagcgtggcgagcctggcgggcctgctgtggtggcgcacgccggcggcgcacctgcaggaccggacggcgctcgtcttcttcttctccgtcttctggggcttcttccctctctacaacgccgtgttcacgttcccgctggagcggccgatgttgctcaaggagcgctcgtcggggatgtaccggctctcctcttacctggcgtcgcgcgccgccgccgacctgcccatggagctcggcctgcccacggcgttcgtggtcatcctctactggatgagcgggctggacccgcggccgggccccttcctcctctcgctcgccgtcgtgctctacagcgtgctggtggcgcagagcctggggctcgccatcggcgccgtgctcatggacgtgaagcagggcaccacgctggcctccgtcataaccatggtcttcctcatcgccggcgggtactacgtgcagcacatcccgccgttcgtggcctggctccggtggctcaactacagcttctactgctaccgcctcctgctcgggatccagttccccaacggcggcggctactacgactgcggccacggcgccctgtgcccggtggccgagttcccggcgatcaaggccgtcgggctcaacaaccactgggtcgacgtctgcgtcatggcgctgctcctcgtcggctaccgcgtcgtcgcctacgtcgcgctggaccgcctcaagccgaggtgaaattattacgccatggctgtgaccaagctgcccgtgcacgaatcgatccatggagcagtagaatctgcttgatgaatcagctcaaagtcaaggccaggagagatctggagtaattaactggacgagttagttaattagcttcttgtttaactcttcgccgtttctcggagggatgcacggtgtgaggtgattagtgcttaatcgggcgatcaagaggtagaagaaagggttaatagcggtgatcactgattagcgaaataattattagattgatctgtggcgagaagagaaggaagcactcggtgctctgtataatacaaggggaaatagtacaatacaaacctgcagccatcagctgcagctcctctctgagactctgaaagtctgaatgagttccagtgccatttataagatcaccagaacgattttgtttcatgagtccccaacttcccaggaccattgtcgaatctaattggcagcacaagtgagtgaccaaaacatcttgtgcaattcatattcggcctcctgaaaagaactgttcatgatgaactgaacagaacaggcctggacagaacagcggcctgatgaactgtatgagagagacgcaagaacacgaagattttccaacagtgttaggagacgagcagacatgccgacccgggctgcattctccactacgaggtcttgcttcacgacccatgggcccaatatttccttgccgcaacgccggtctgcttccatcggctgcctgttccacacct

SEQ ID NO: 2304 - DNA, 2814 bp, Setaria italica
cttgcagctgatcaaccaagtaggagtagtactactgactactgagagtagcaaaccaaaattgttaagctcctacacctacacctgcaggtgtgcttgtgtgaagtgatcatagaacagggagacagatcgaaaggatacatcgatcgccatgccgcctccgctggagcaggatgagcagcagacagcaggaggtggtagccaccgagcagcgccgccgccccctcctcctccgaacatgatcgcctttagcagctgcagtagtagtagtagtagcagcagcggcactccctcttgtacttctgttgcgaccaccaccacaaccactgccaccaccaactcctcctctggcgccgtcgtgcatcccaccacctccagcccgccgtcgccggccgatgctcgcctccgccccgccgccaactccttccctctcgtcctcaagttcgaggaagtggtttacaaggtgaagctcgggcagccgacggccggatggtgcgacaagctgtcggccgcggcgagcatggctgtcggcggcggggacgggaggaagaagaaggccgccgcaccggggtcgtcggcgcgggagaagacgatcatcagcgggatgtccggcgtggtgcggccgggggagatgctggcgatgctgggcccgtccgggagcggcaagacgacgcttctgacggcgctgggcgggcggcacggcggccgggcgctgctctccggcaagatcacctacaacgggctgcccttctccggcgccgtcaagcggcgcaccgggttcgtgacgcagcacgacgtgctgtaccctcacctgacggtggcggagacgctgtggtacacggcgctgctccggctgccccgcgcgctgagcgccggcgagaagcgctcgcaggcggaggccgtggcgcgtgagctggggcttgccaaggtcgcgcacagcatggtcggcggcgtccgcggcgtgcgcgggctgtccggcggcgagcgcaagcgcgtcagcatcgggctcgagatgctcatcgaccccagcctgcttctcctcgacgagccaacctcggggctcgactccaccaccgccgcccggatcgtcggcacgctccggcggatggcggccggcggcggccgcaccgtcgtggtcaccatccaccagccgtcgtcgcggctgtaccacatgttcgacaaggtgctgctgctctcagccgacgggtgccccatctactacggccgcgccgccgacgcgctctcctacttcgcctccgtcggcttcgcgtcgccgctctccctcaaccccgccgacctcatgctcgacctcgccaacggaatcgcgccgcagacggcgagcggcgacggcgacgtcggcgaggcgcggccggcggcggtgaccggcggcagcgagagcgagcacaaggaggtgcgggccaagctggcggccgcgtacgagcgccacattgcgccggcggtgaagctggacatctgcgcccgggagacatccgccgcggcgtcgccgggcggcgggcaggcgccgtcgtcgcgccgccgcggctcggcctcttcggagtggaccaccgggtggtgcacgcagttcctggtgctcctccagcgcggcctcaaggagcgccgccacgagtcgttcaacaagctccgcatcttccaggtgctgagcgtggcgagcctcgccggcctgctgtggtggcgcacgccggcgtcgcacctccaggaccggacggcgctcgtcttcttcttctccgtcttctggggcttcttcccgctctacaacgccgtgttcaccttcccgctggagcggccgatgctgctcaaggagcgctcgtcggggatgtaccggctctcctcctacttcgcgtcgcgcgccgccgccgacctgcccatggagctcggcctgcccacggcgttcgtgctcatcctctactggatgggcgggctcgacccgcaccccgggcccttcctcctctccctcgccgtcgtgctctacagcgtgctcgtagcgcagagcctggggctcgccatcggcgccgtgctgatggacgtgaagcagggcaccacgctggcctccgtcatcaccatggtcttcctcatcgccggcgggtactacgtgcagcacatcccgccgttcgtcgcgtggctccggtggctcaactacagcttctactgctaccgcctcctgctcgggatccagttccccaacggcggcgggtactacgactgcggcggcggcgccatgtgccccgtggccgagttcccggcgatcaaggccgtcgggctcaacaaccactgggtcgacgtctgcgtcatggcgctgcttctcgtcggctaccgcgtcgtcgcctacatcgcgctcgaccgcctcaagcccgaggtgaacgaaagccatggatgagtagaatctggtgaatcagctcaaggcccaagagacagtgattaactggacgagttagttaattagcatcttgtttagctcttgccgtttcttggagggatgcacggtgtcggtgagaagtgattagtggttaattgggcgatcaagagggggacgagaggattagtggcggtgatcatcagttgatcactgattagtttacgtcgatgacctggagtgaaataattattagattgatctgtggcgagaagagaatgaagcacctggtgctctgtataatacaacaagggataatacattacaaacctgcagctgcaacttctcagactctgagactctgcagtctgaacaaaaggttttcagaattcagacgccttctactaattcagaaatctgctgtgccattcacagttctgcat

SEQ ID NO: 2305 - DNA, 3647 bp, Panicum virgatum
agaaccacacttgcagctgatcaatcaagtagggctagctagctgagagtggaagcagctagcaaaccaaaattgttaagctccaacactacctacacgcatactgtgatcgtgtgaagtgataacacagggaggagagagagagagacaggatcgaaaagccacatcgatcatcgatcgccatgccgcctcagctggagcacgatgagcagcagacagcggcaagtggcggccaccgagcagcagcgccgcctcctcctcctcctcctcacatgctgctcacctttagcagcagcggcggcggcggcggcggcggcggcgctccctcttctacttctgtcgccaccaccaactcctctggcgccgtcgtccatcccaccacctccagcccgccgtcgtcggccgctgcggctcgcctccgccccgccgccaactccttccctctcgtcctcaagttcgaggaggtggtgtacaaggtgaagctcgggcagccgacggccggatggtgcgacaagctgtgcgccgcggcgaggagcatggctgtcggcggcggcggcggcggggacgggaggaggaagaagaacgcggcggcggggtcatcgtcgtcgctggcgcgggagaagacgatcatcagcgggatgtccggcgtggttcggccgggggagatgctggcgatgctgggcccgtcggggagcggcaagacgacgctgctgacggcgctgggcgggcggcacggcggcggggcggcgctctccggcaagatcacctacagcgggcagcccttctccggcgccgtcaagcggcgcaccgggttcgtgacgcagcacgacgtgctgtacccgcacctcacggtggcggagacgctgtggtacacggcgctgctccggctgccccgcgcgctgggcgccgccgagaagcgcgcgcaggcggaggcggtggcgcgggagctggggctcgccaaggtcgcgcacagcatggtcggcggcgtgcgcggcgtgcgcgggctgtccggcggcgagcgcaagcgcgtcagcatcgggctggagatgctcgtcgacccgagcctgctgctgctcgacgagcccacctccgggctcgactccaccaccgccgcccggatcgtcggcacgctccgccggatggcggccgacggcggccccaccgtcgtggtcaccatccaccagccgtcgtcgcggctgtaccacatgttcgacaaggtgctgctgctgtccgccgacggccgccccatctactacggccgcgccgccgacgcgctctcctacttcgccgccgtcggcttcgcctcaccgctgtccctcaaccccgccgacctcatgctcgacctcgccaacggtatcgcgccgcagacgacgagcggcgacgccgacggcggcggcgaggcgcggatggcggctgcggtggccggcggcagcgagagcgagcacaaggaggtgcgcgccaagctggcggccgcgtacgagcgccacatcgcgccggcggtgaagctggacatctgcgcgcgggagccggccgcggcggcgtccccgccgcaggcgccgtcgtcggcgcggcggcgcgggccgtcggagtggacgacggggtggtggacgcagttcctggtgctgctccagcgcgggctcaaggagcggcggcacgagtcgttcaacaagctgcgcgtgttccaggtggtgagcgtggcgagcctggcgggcctgctgtggtggcgcacgccggcgtcgcacctgcaggaccggacggcgctcatcttcttcttctccgtcttctggggcttcttcccgctctacaacgccgtgttcacgttcccgctggagcggccgatgctgctcaaggagcgctcgtcggggatgtaccggctctcctcctacctggcggcgcgcgccgccgccgacctgcccatggagctcggcctgccgacggcgttcgtggtcatcctgtactggatgggcgggctggcgccgcggccgggcgccttcctcctctcgctcgccgtcgtgctctacagcgtgctggtggcgcagagcctggggctggccatcggcgccgtgctcatggacgtgaagcagggcaccacgctggcctccgtcatcaccatggtcttcctcatcgccggcgggtactacgtgcagcacatcccgccgttcgtggcgtggctccggtggctcaactacagcttctactgctaccgcctcctgctcgggatccagttccccaacggcggcggctactacgactgcggcggcggcgccatgtgccctgtggccgaattcccggcgatcaaggccgtcgggctcaacaaccactgggtcgacgtctgcgtcatggcgctgctcctcgtcggctaccgcgtcgtcgcctacgtcgcgctggaccgcctcaagcctaggtgaaaatgaaattgcctccagccatggctgtggccaagctgcatgaatcgatcttggtccatggagcagtagaatctgattgcttgatgaatcagctcaaggccagccaagagaaagtaattaactggacgagctagttaattagcttcttgtttaactcttgtgccgtcgtttcatggagggatgcacggtgggaggtgatcagtgcttaatagggcgatcaagaggtagaagaaagggttaatggcggtgatcactgattagcgaaataatcattagattgatctgcggcgagaagagaaggaagcactcggtggtgctctgtataatacgaaggggaaatagtacaatacaaacctgcagccaccagctgcagcctgcagctcctctccgagactcttctgaaagtctgaatgagttccaccaggtggctactaactcagtaatctggtgtgtgtgccaggtgcgatttagaagatcaccggaacggttttgtttcatgagtctccaacttcccaggggccaggaccactgtcgaatctaatcggcagcactagtgcagtgactgaccaaaacatctcgcgcaattcatattcagtcatcaggcgccgaaagtgagacgtattctgaagccggcccggacctttggtgaatcagtcgatgatgagtcggtttgtactccttcagcgtctcaccttcaatcgactgcttggttgcttcatacaggcagcatttgcggctttgcaccactcctttgagcttcccttgttcagttcggcttacactgctatgcaacgcgatcatcagaactcatctgacgaactggcgttcccatttatcccccaaactcatgtgattttactattttagcagcagcagcagcatcataggagcaaaatggccatgttcgagaaggagactagtccagcttccagattccgacccaaccaacgaaacggtcttccatctcacggcccaactccacccaactgggcccacttccagcgccacctgggttggaccttggaccgttcccacccactccctgctctgctcgcccgctataagtagcgcgccgcggcggcgaccctaggtttggccgcaccaccgccgaaacgccaccacccccccacccgctaccaaatcaaaccggctgccacttgccgccactgaccaagcaagctctcctcccgcgcgcccagcgtctggaaccccgatggcgagagcggccgcgccgtcccg

SEQ ID NO: 2306 - DNA, 2890 bp, Zea mays
ctacaactacgcctgctggacacaagcctaaaccgagcagtgcgtgcttatcgttcaagtagagcacggagctagagagtgtagctagcacgcacagaagcaaaccaaaactgccatgctctcatacctacaccaggtgttgtagtaagcctgtgaagtgaggtgacacaggccgggagaagagcgagcgagagagaggagaaaagatacacagatagctagatcgacatgccgcctgagctggagcaccatgagcagcagacagccggaggtggtggccaccgagcgcctcctcctcccccgaacagcatgcccacctttagtagcagcactccctcttctacttgtgtttctgccaccaccaacccctctggcggcgccggcgctgtccatcccaccacctccagcccggcgtcgtcggcttccgcccgccctgccgtcaactcattccctctcgtcctaaagttcgaggaggtggcgtacaaggtgaagctcgggaagccgacgacgacgacggccggatggtgcgacaagctgtcggcggccgcggcgagcatggcggtcggcggcggaaggaagaagaaggccaccgcggcggcggctgggtcttcgccgtcgtctccggcagcgttgcgggagaagacgaggaccatcatcagcggcatgtccggggtggtgcggccgggcgagatgctggcgatgctgggcccgtcggggagcggcaagacgacgctgctgacggcgctgggcgggcggcacggcggcggcgggcgcgcgctgctgtccggcaagatcacgtacaacgggcagcccttctcgggcggggtgcggcggcgcacggggttcgtgacgcagcacgacgttctgtacccgcacctgacggtggcggagacgctgtggtacgcggcggcgctgcggctgccgcgggcgctgggcgcgggcgagaagcgcgcgcgggcggaggcggtggcgcgggacctgggcctgggcaaggtggccggcagcatggtgggcggggtgcgcggcgtgcgggggctgtcgggcggcgagcgcaagcgcgtcagcatcgggctggaggtgctggtggacccgagcctgctgctgctggacgagcccacgtcggggctggactccaccacggccgcccgcatcgtggccacgctccgccggatggcggccgagggcgggcgcaccgtcgtggtcaccatccaccagccgtcgtcgcggctctaccacatgttcgacaaggtgctgctgctgtccgccgacggccgccccatctactacggccgcgccgccgacgcgctctcctacttcgcctctgtcggcttcgcgtcgccgctctccctcaaccccgccgacctcatgctcgacctcgccaacggtatcgcgccgcagacgacgagcggcgacgggatggcggcgctgctggccggcggcggcgagggcgagcacaaggaggtgcgcggcaggctgtccgcggcgtacgagcggcacattgcgccggcggtgaagctggacgtctgcgcccgggaggcgacgcccggcgggcagcaggcggcgtcgcggcgcgcgtcgaaggcggcgtcggagtggacgacggggtggtggacgcagttcgcggtgctggtgcagcgcgggctcaaggagcggcgtcacgagtcgttcaacaagctgcgcgtgttccaggtgctgagcgtggcggcgctggcggggctgctgtggtggcgcacgccggcgtcgcacctgcaggaccggacggcgctcgtcttcttcttctccgtcttctggggcttcttcccgctctacaacgccgtgttcacgttcccgctggagcggcccatgctgctcaaggagcgggcctcggggatgtaccgcctgtcctcctacgtggcgtcgcgcgccgccaccgacctgcccatggagctgggcctgcccacggcgttcgtgctcatcctctactggatgggcgggctggacccgcgcccggggcccttcctgctctcgctcgccgtcgtgctctacagcgtgctggtggcgcagagcctcgggctcgccatcggcgccgtgctcatggacgtcaagcagggaaccacgctggcctccgtcatcaccatggtcttcctcatcgccggcgggtactacgtgcagcacatcccgcccttcgtcgcctggctcaggtggctcaactacagcttctactgctaccgcctcctgctcggcatccagttccccgacggcggagggtactacgactgcggccacggcgcgctctgccccgtcgccgagttcccggccatcaaggccgtcgggctcaacaaccactgggtcgacgcctgcgtcatggcgctcatgctcgtcggctaccgcgtcgtcgcgtacattgcgcttgaccgcctcaagcccaggtgaaacaagataagagaagagaagagaagggatcaattagtttagtgctctatgcataatacaaccagaggggatgaaatgaatacgatacaaacctgcagcagctgagctctctgttttactccattcacaagggtttccagaactcgtaagctttccttcggctcctacccagcttcccacagccatcgccgaatctcattctccggaacaaaagctccgcgtcgaatagaaccgaatccggtcgagctccgcgtgaccgagactctagactctggtctctggtgccctacccaccatggccatgccttgcagctctcaaacagtgttacgacagggcacgaagagacaatgtaacagaaatagattttctttccgtacaggagaatgtctatatgctattcttctgtaaccgaaacatatgctgctagctgctctgctcttctcaactcccagtgataccacggcatctccttgacat

SEQ ID NO: 2307 - DNA, 1465 bp, Zea mays
agtcgtagccctcgcagcggcaaaaggaccacacggtttccgcagctctctcagcctcccaacgaagggaactcccaggaactttcgccaacccgtgcggcggcaaaatcagctgccagcctgccacctctacgcgcgggcgcggcgcccgctcccgctcccgctgggacgccacgccaaggcacaccaccaccaccctacaaatacgccccgctccgcacactggaacgaccacatagaccaccacgacacccttccccacaccagcagtcgagctgagcacgacacaaagccggctggggccgcctcgccatggcgatccggatgagcaacaacgtgatcggcgcgctgaacctggtgacactcctgctctcggtccccatcctcgtctcgggaatctggctgcggtcgcgcgccgacggcaccgagtgcgaccacctcctgtccaccccggccatcgcgctgggcgcggtgctcatggccgtcgctgtcgcgggcctcgccggcgcctgcttccgcgccacctggctgctatggctctacctcctcgccatgctcgtgttcatcgtcgcgctgctctgcttcaccgtcttcgccttcgccgtcaccaacaggggcgccggggaggccgtgtcgggggtaggctacagggagtaccgcctcggggactactccacctggctgcggcgccacgtcgaaagccgcaaggactgggcccggatccggagctgcctcgccgacgcgcacgtctgcaggcgcctggaggagagggagagggagagcaaggacgcggcggggtctggttcggctcggcctgtccccggtcgagtccgggtgctgcaagccgcccacgagctgcaacttcacgtacaccggcggcacggagtggaccaggacagcggcgggctccgcgcccgccggccgggactgcagcgcgtggggcaacgacgaggacgacctctgctacgggtgccagtcgtgcaaggccggcgtggtggacgcgctcaagcgggactggaagcgggccgccatcgtcaacgtcgtcatcctctccttcatcgtcgtcgtttactccgtcggctgctgcgccttcaagaacagccgccgggacaactacgcctaccacagcggccgcggatggaaacgaggcggtgacgcttaaatgcttaatcaaacttttccttatcatctgcgttagtgcaatttaccattatcttgtatattagcctgagttcgtgatctgctttagttcagtttaccattagcttgtatattattagcctcagtttgtatcacttagttgtttggcagcatattagcagaatttcgggcagtatatgagcagaatttcgctgcctggtccaatttcccatagacaagtatgcaggcaaaattcattgtcatttgttagcggtatctgttcagaaatagtaatttttagttttaatttaatccaaaaaacaac

SEQ ID NO: 2308 - DNA, 2597 bp, Zea mays
gcgtcttgttcccaccgccgccgctctccctcatctccttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgaggttgatggcatcgacaacctcagcgagaacgatgtcagcgactaggagatcgatgctgacgagctcgcccgacgaatgtggaaggacaaggtcaagctaaagaggatcagggagaggcagcagaagcttgccctgcagcggctggagctggagaagaccaagacaaagaagatttcagaccaagccctccggaagaagatgacgagggcccaggacgggatcctcaagtacatgctcaagctgatggaggtgtgcaatgcccgagggttcgtgtacgggatcattcctgagaaaggtaagcctgtcagtggtgcgtccgataacatcagggcctggtggaaggacaaggtgaagtttgacaagaatgggccagcagcgatcgtgaaatacgagcttgagaactcgatgctgagcaaccctaagggcggcggagccatggaccagcatagcttgatggacctccaagacggcactctgggctcattgctttcagcgctgatgcaacactgcagcccgcagcagcgaagctatccattggataagggtgtcccgcccccttggtggccaacagggaacgagtcgtggtggcctgcgttgggcctcccaaagggagaagcgcctccgtacaggaaaccgcatgacctgaagaaggtttggaaagttggtgtcctgacgggcgtgatcaagcacatggccccaaacttcgataagatcaggaaccgtgtaaggaagtcgaagtgtctgcaggacaaaatgactgcaaaggagagcctcatctggcttggtgttctacaacgcgaggagaagtctgttcacggctttggcagtgctttactacagaatgctcggcatagtagcacttcagaggacagaaacgagggcatatatagcagcagtgacgagtatgatgtcgaccgcctcgagcagcctcctcgttccacatcatccaaagaggacgagggagacgctcagcctgtcttgcagattagaggggagcagacctcaactagaggaactaataagagaaggcgccatgacacatcctccaaccaactagctattagcaaggaagagatgagtaaatctaaatctcaacagcggaaaggcccctcaacccgccctcctgttgccgaggttgaggttgaagtgacacaaagaaacgacaagacgccagaagtagtgtgcagtgcagctggtggtgatatgaactttatcgacccaattgatgcggtgggcattactaacctgccaatgagccctaaacatgtcccccctacaattggagctttgcagcagcacggagattgtcgagggaattttctatctcctgctgctgccatcaactacaacagcagcaacagcaaccaggcagcaagtgctgctcaatcaaacacttatctgggaggccatcctctggcttgtgaaggcagtgatattgccaactcatggtccggacactcatttcagcaggatgttggtcttgggcctcctattggttttgatccttcaccagttgctcaccagggttcggcagtgcagcagccactgccactgccacttccacttcctatggatcaccaagcgcctatcacgggatcaggagctctcgccacgaacggctcttacagtctcccgacagcaggcggtgtgagttctgggacaatcgtcagcgagacccaccagcagctcatggacaaccctttcttcggcgacgccggagacagctcttttggcggtcttcctttcagcctccttcctttcagtagtccgatgcttaacttcgatgaattggatgagttggtggacgacgacgacttgatgcagtacctcggcacataacacagtgtgtccaatgaatgtgctcggtgcagcctgttaggctttttcggggagagtttggtaacatgctgatggagcggcgggatgttgatgtagctgcagctcgtgacccattcatttgtggcaccgtcctgagaaggccattgcttttgtaatataacaacaacgaataatgtagtttagggtgctctcttgactgtactggatgttaaatggcattgccgtcgtaagcagggaacttgtagcctgtagagcaagttagcaattcgtggcctcgtgggcatcatgatgttggcggagaattaccgcagccgtttaaaggattttattttttttatttattgccgtatacacggatttttagatataggtgatttaacgagtatggtatgagaattctgatggttttaa

SEQ ID NO: 2309 - DNA, 1165 bp, Saccharum officinarum
cccgcgcccttccagagatttccaccgcactctccactccactccactccacctccacggctccactacaccgcaccggcaccggcgtacggcagcccgcagcaagcacgagcagaggcagagcagcgtccgccgcagcgagcgtgcacgcaacagacgacgctccagcgccaaacggcagcaggtccggacgtccggtcaccttccgcgctctgcgctcgtccccacccatggcgtccgcgccttccgccccagcatccgccgccgtcaaggccgcggtcctccccatcccaccggtccagccgccgcccgccgttgcagtagtggcgcggcgcgcgccggtgccggccgccctgcgcgccctcggcgggcgtggcgcggcgctggtggcgtccgccgcgctggatgacctgcgcccggccatcgacgagtaccccgagggcatcctgtctggggagtggcccggcaacttctccctcctcagctacgccgacctccgcgcctacctcgagtcccagatcgtcacctccgaccagatgagcccggcggcgaagctcggggacgtgatgtcgcgccccgtgcaggtggccacgccgggacagcggctcgcggaggtcgatgccatcttcgccgcgcagcagtactcgggcctgcccgtggtcgacgaggacggcaggtgcgtcggggtgatctccaagaaggacaaggccaaggcgcccaatgggatggagtcaactgtaggtgaagtcatgtcatctcctgcgataaccctgacaccccaggagacggtcttggaggatgcagcactaatgcttaaggagaaggttcacaggataccggttgtgaatgaacagcagcaagtgatcggaattgtgactcgctcggacgtattccaggcacttgaggccaacaacaacaaagcatgagaagtgaggtcccctattaggcttgttctcgccagatgttgcccgttgtaaatatcagtcgaactagtcggtaccccccgcggacgcaagcaataataacggtgggcactcacagtataccattccatgcctgcctgtgtatcatagtttccgtgacactgagtgtgtgcccgttgtgagtgattctgcattgtattgtgtaattcgaaaaaaaataaaaaaaatcataaaaacctgaa

SEQ ID NO: 2310 - DNA, 1136 bp, Pennisetum glaucum
gagaagttgtcgggccactccccggacaagacgccctcggggtactcgtctacttgagctgcacacaagcagagtcaccgcagcgcacgcgccgacaactccgcaaacggcaggtcaccttcctcgccgcgtccatggcgtcggcagcttccgctcccgcgtccaccgtaaaggccgccgccgtcctccccgtcccgccgccaacgccgccgtccgcggccaccgtggcagtggctcggcgtgcgcggccagtgccaaccgtcctgcgcgccgcggacggccacgcgcggcgcggcgcagcggtggttgcggctgcagcgctggacgacctgcgcccggccatcgacgagtaccccgagggcgtcttgtccggggagtggcccgaaaacttctccctgctcagctacgccgacctccgcgcctacctcgagtctcagatcaccaccaccggcgagatgagcccggcggcgaagctcggggacgttatgtcccaccccgtgcaggtggccacgccggggcagcggcttgcggagatcgacgccttctttgccacgcagcagttctccggcctgcccgtggtcgacaagggaggcgtatgcgttggggtcgtctccaagaaggacaaggccaaggcgcccaatgggatggagtcaactgttggtgaagtgatgtcgtctcctgctatcactctgacacctgagaagactgtcctagaggctgctgcactaatgctcaaggagaaggttcacaggataccagttgtgaatgagcaacagcaagtgatcggaatcgttactcgtacagacgtgttccaggctttggaggccaacaactgagcttcatcagatgccttgttggcttgttcacatcactactggatcgtgggatgttgctccctgtccatatgatgaatcagattgcatgttgatccatcttgtaaatcactaaatcctagccgtgtaacacaatctgggtttgttgaattggagcatatgtgcgtgtgaactccgtgccatgtaaatcactaaataaggaggattgtctgtctgcacattattagaatgtaaaaccagtatatatgtgactatattgccaacagatcaatggcccaaaccttccaagcatttccaatggca

SEQ ID NO: 2311 - DNA, 1525 bp, Saccharum officinarum
gagcagaggaaagactctggtggagcggtatgagatggggagattgctggggaaaggcacgtggggcaaggtgcactatggaaggaaccttgagtccaaccagagcgttgctatcaagatgatggacaaggacaaagtgctcaaggtcgggctttcggagcagataaagcgtgagatcacaacaatgcggttggtggcgcataagaacattgtccatcttcatgaggtcatggcgacacgaaacaagatctatattgtcatggagtatgtgaaaggtggagagctctttgacaagattgacaagagtggcaagctcacagaggctgctgcacacaaatacttccagcagctcattagtgcagtggaccactgccacagccgaggtgtgtatcaccgggacttgaagcctgagaacctgctgctggatgagaatgagaacctcaaggtgtcggattttggactgagcgcactttcagagtcaaagaggcaagatggcctgctccacactacctgtggaacaccggcatatgtagctccagaggtgatcagcaagataggctatgatggtgcaaaatcagacatctggtcttgtggtgttgccctgtttgttcttgctgctggctatctccctttccagggcccaaacttgatggagatatatcggaagatacagcatggtgaattcaggtgcccaagttggttttcacacaagctcaagaagctgttgtacaagatactggaccccaacccgagcacaagaatttcaattcagaagataaaagagtctacttggttccgaaagagtcctggggagatccgtgcagtaaaggagaaaattcttagtgagaatgccaccacaaatgctgccccagtgcttgctacaaggcacaagaagattgctcacgaagatatgaaggctgccacaaacctaaatgcctttgaaattatctcattctcaacagggttggacctgtctggtctatttatcaaaaaggagtgcagaaaggagacaaggttcacttcagataagcctgccttgaccatcatctcaaagcttgaagaggttgcaaaagcactgaatctaaggataaggaagaaggataatggcattgtcaagattcaagggaggaaggaggggaggaatggtatccttcagtttgacacggagatctttgagattacaccatcctaccatctcattgagatgaaacaaacaagtggtgattcagttgagtaccagaaactgttggaagaggacatccggccagggctgaaagacatagtctgggcctggcatggaaatgatctgcagcaaaagtaggatagcttccgatgtctcacatagaatttgttctgaaaattcgttggattttcagcttcgaaggatcctgttctacaacagcttacaattttatggttttggaagagccatggtggtgatgtgaaccctttaggctatattttggttgaccgcctgagttggtgggttacatttcttgaaaatgggtacaagtttggaatggct

SEQ ID NO: 2312 - DNA, 2225 bp, Sorghum bicolor
caggaaacgccgcggagagacagctctgccagctgcagccatccagggtcattaccgtcaaatcagccacgcggttaggccggctggctaaccctgttctgttcgttcacctctgctccgcctccgcctccgcctccgcctggtataagaagagcctcctctcctcattctccccgcatcacatccctcacctctgctcccctccctgcccagaggaactcaggcagtagcgtagtctaccaaaaagttgcaaagctctgatcttgtcgcctcccacgcaatcttctctccatctccgttcgtccgtccgttcttcgtgtcgtcgcaagataacagaactcacaagaagttaaagcctcagggaatgctgaaagatgtgctttcgtagaagagattcctgttgcgacatcaaggaccttgctgctccgcaagggctgctgatctgctcaactcttgatgacctgaccttcatcaattctacgcccttcagactgcgacacgaccaggccataagaattctgttcaccatcatggatcatgacatgggggaggagggctaactctttgtgcagtccacctgattggcagccaaaagtgtagccctgtgaattgtgatttactcttgaagaaagatatggaatcgagaggaaagattttgatgaagcggtatgagctggggaggttgctggggaaaggcacatttggcaaggtgcactatgcaaggaaccttgagtccaaccagagtgttgctattaagatgatggacaaggacaaagtgctcaacgttggactttcagagcagataaggcgggagatcacaaccatgcggttggtggctcataagaacattgttgagcttcatgaggttatggcaacacgaaacaagatctactttgtcatggagtatgtgaaaggtggcgagctctttgacaagattgagaagagtggcaagctcacagaggctgttgcacacaagtacttccagcagctcattagtgctgtggattactgccacagccaaggtgtgtatcaccgggacttgaagcctgagaacctgctgttggatgagaatgagaacctgaaggtctcagattttggactgagcgcactttcagagtctaagaggcaggatggcttgctccacaccacctgtggaactccagcatatgtagctccagaggtgatcagcaagacaggctatgatggtgcaaagtcagacatctggtcttgtggggttgttctatttgtacttgttgctggttatctcccttttcaaggcccaaacttgatggagatgtatcgtaagatacagaatggtaatttcaggtgccccagttggttttcacacaaactcaagaagctattgtacaagatcctggaccccaacccaaacacaagaatttcagtccagaagataaaagagtctacctggttccgaaaaggtcctggggagacccgtacagtaaaggagaaaattccaagtgagaatgccaccacaaatgctgctccagtacttgctatgaggcgcaagaagaatgttcatgaagatgtgaagcccttggctgtcacaaacttaaatgcctttgaaatcatatctttctccacaggatttgacctctctggtctatttatcaaaaaggagtgcaaaaaggagacaagattcacttctgataagcctgctgctgccattatctcgaagcttgaagatgttgcaaaaatactgaatctcaggataaggaagatggataatggtgttgtcaagattcaagggaggaaggagggaaggaatggtgtccttcagtttgacgcagaaatatttgagatcacggcatcctaccatctcattgagatgaaacaaacaggcggtgattcacttgagtaccagaaactgttggaagagaacatccggccagcactgaaggacatagtctgggcctggcatggagatgatcaacagcaaaagtagtagtacctttggatgtctcagttttgttcctaaaatttgttagattttttagctcggagtgattctgttcgacatgtgtatgttcttttttagtaattgcattctttctctttctgtgaaccattctgttgcgcgataattgttgagaggctgagttgtccagtcgttccattctgaaaactgtttctgtcctgtaatgtgtaatggttgtccctatcaataatgaaataattgcatttgatcctttaaaaaaggttga

SEQ ID NO: 2313 - DNA, 2045 bp, Setaria italica
ccgcctcattgtcgccgcatcccatcccctctccctgcccagcggagctcaacttcaggcaacaactagatacccaaaccagaacgcgtagccccgcacaagttttggttttgtcgcctcctcgaccccctcttcctcatccttcgtggcatcgcaagataacaaaatccacgacaagaagcaaaacttcagggaatgctgaaagatgtgctttcatagaagagatttctgctgcatcaccaaggagctcgctgctccacaagggctgctgagctgctcaactcttgatgtgagcgacaattccacactgttcagattgcgacacgaccaagccataagaatactgttcaccgccatggatcatgacatgggggaagagggctgaatctttgcagtcaaactaattggtggcctgaagatagccctgtgtccacacttttggagatatggaaactagagggaagattttaatggagcggtatgagctggggagattgttggggaaaggcacatttggcaaggtgcactatgcaaggaaccttgactcaaatcagagcgttgctatcaagatgatggacaaggacaaagtgctcaagattgggctttcagagcagataaggcgtgagatcacaacaatgaggttggtggcacataagaacattgttgagcttcatgaggtcatggcaacacggaacaagatctactttgtcatggagtatgtgaaaggtggcgagctctttgacaagattgagaagagtggcaagctcacagagactgctgcacacaagtacttccagcagcttattagtgcagtggattactgccacagccgaggcgtgtaccaccgggacctgaagcctgagaacctgctgttggatgaggatgagaacctgaaggtctctgattttggactgagcgcactttcggagtcgaaaaggcaagatggattgctccataccacctgtggaacaccagcatatgtagctccagaggtgatcagcaagataggctatgatggtgcaaaatcagacatctggtcttgcggtgttgttctatttgttcttgttgctggttatctccctttccaaggcccaaacttgatggagatgtatcgaaaggtacagcatggtgatttcaggtgccccagttggttttcacacaaactcaagaagctgttgtacaagatcctggaccccaacccagccacaagaatttcaatccagaaaataaaagagtctacctggttccgaaaaggtcccgaggggacccgcacagttaaggagaaaattccctgtgagaatgcaacaataaatgctgctccaacactttctgtgaggcgcaaaaagaatcctcatgaagatgcgaagccgctgactgtgatgaacttaaatgcctttgaaattatctctttctccttggggtttgatctatctggcctatttattgaaaaggagtgcagaaaggaggcaagatttacttcagacaagccagcctcggccatcatctcgaagattgaagacgtcgcaaagatgctgaatctcagggtaaggaagaaggataatggtgttgtcaagattcaagggaggaaggagggaaggaatggtgtccttcagtttgacacagagatctttgagatcacaccatttcatcatcttgttgagatgaaacaaacaagcggtgattcacttgagtatcagaaactattcgaagagcacatccggccagcgctgaaggacattgtctgggcctggcatggagatgatcagcagcaaaagcaggagtagctttggatgcctcagtttgtggtctgaaattccgtttgatttttcagctcagattttattttcatgtgttcattgttagcaactacattcgtttttgtattggaagaacacctgttgagttgtgttgatgtgaaccattaggctgtatttcgtcgaataataattgttgagaggctgagttcttgagttttattctgaaactctttctgttctgtaattgctgtccccgtcgataatgatatacaacacctctggtgcttg

SEQ ID NO: 2314 - DNA, 2109 bp, Setaria italica
attccccctctgcttccaccccccaccccggccccctccctgtataagagcagcttcccctccgcctcattgtcgccgcatcccagcccctctccctgcccagcggagctcaacttcaggcaacaactagatacccaaaccagaacgcgtaaccccgcacaaattttggttttgtcgcctcctcgaccccctcttcctcatccttcgtggcgtcgcaagataccaaaatccacaagtcaaaacctcagggaatgctgaaagatgtgctttcataaaagagatttctgttgcgacatcaaggagctcgctgctccacaagggctgctagcctgctcaactcttgatgtgagcgaccacctcagctgcatcaatcctacacccttcagactccgacacgaccaagccataagagtactgttcaccatcatggaccatgacatgggggaggagggctaaatcattgcagtccacctaatcggccggccagaggatagccgtgtgttttatacttttggagacatggagggcagaggaaagattttaatggagaggtatgagctggggagaatgttggggaaaggaacatttggcaaggtgcactatgcaaagaaccttgagtcaaatcagagcgttgctattaagatgatggataaggacaaagtgctcaaggttgggctttcagagcagataaggcgtgagatcacaacaatgagattggtggcacataagaacattgttgagcttcatgaggtcatggcaacacggaacaagatctactttgtcatggagtatgtgaaaggtggcgagctctttgaaaagattgagaagagtggcaagctcacggagcctgctgcacacaagtacttccagcagcttattagtgcagtggattactgccacagccgaggcgtgtaccaccgggacctgaagcctgagaacctgctgctggatgaggatgagaacctgaaggtatctgattttggactgagcgcactttcggagtcgaaaaggcaagatggattgctccataccacctgtggaacaccagcatatgtagctccagaggtgatcagcaagataggctatgatggtgcaaaatcagacatctggtcttgcggtgttgttctatttgttcttgttgctggttatcttcctttccaaggcccaaacttgatggagatgtatcgaaaggtacagcatggtgatttcaggtgccccagttggttttcacacaaactcaagaagctgttgtacaagatcctggaccctaacccagccacaagaatttcaatccagaaaataaaagagtctacctggttcagaaaaggtcccgaggggacccgcacagttaaggagaaaattccctgtgagaatgccaccacaaatgctgctccaacactttctgtgaggcgcaaaaagaatccttatgaagatgcaaaaccgctgcctgtgacaaacttaaatgcctttgaaattatctctttctcctcagggtttgatctatctggcctctttcttgaaaaggagtgcagaaaggaggcaagatttacttcagacaagtcagcctcggccatcatcttgaagattgaagacgtcgcaaagatgttgaatctcagggtaaggaagaaggataatggtgttgtcaagattcaagggaggaaggagggaaggaatggtgtccttcagtttgacacagagatctttgagatcacaccatttcatcatcttgttgagatgaaacaaacaagcggtgattttcttgagtatcagaaattatttgaagaggacatccggccagcactgaaggacatagtttgggcctggcatggagatgatcagcagcaaaagcagtagcttggatgcctcagttagtttttgttccaaaattcgttggattcttcagctaagggtgattctgttctacatgtgtgttcttttttagaagctgcatccattttgtgatgtgtaccataggctacattccattcgaacaataattgttgagaagctgagttcttgagtttcattctgaaaattgtttctgttctgtaatggttgtacctgtcgataatgaaatacaatgcctttgatccttgaaaaaaggttgag

SEQ ID NO: 2315 - DNA, 2000 bp, Panicum virgatum
gcccaccggaactcgtgcaacaataacatactcaatcaaaggcctcctttagccctgcttccgcacaagttttgatttttgtcgcttcctcaaccccctcttcctcttcgtggaatcgcaagataacaaaatccacaacaagtcaaaacatcagggaatgctgaaagatgtgctttcatagaagagatttctgctgcgacatcaaggagctcgctgctccacaaaggctgctagcctgctcaactcttgatgtgagcgaccatcttagctgcatcaactctacaccattcagactccgacacgaccaaggcataagagttctgttcaccgtcatggaccatgacatgggggaggagggctaaatcattgcagtccatctgttcggcggtcaaaatatagccctgtgatttatacttttgaagacatggagggtagaggaaagatattgatggagcggtatgagttggggagattgctgggcaaaggtacatttggcagggtgcactatgcaagaaaccttgagtccaacaggagtgttgctattaagatgatggacaaggacaaagtgctcaaggtcgggctttcagagcagataaggcgtgagatcacaacaatgaggttggtggcacataagaacattgttgagctccatgaggtcatggcaacacgaaacaagatctactttgtcatggagtatgtgaaaggtggcgagctctttgacaagattgagaagagtggcaagctcacggagtctgctgcacacaagtacttcaagcagcttattagtgcggtggattactgccacagccgaggtgtctaccaccgggacctgaagcctgagaacctgctgctggatgaggatgagaacctgaaggtctctgattttggactcagtgcactttcggagtcaaaaaggcaagatggattgctccatacctcctgtggaacaccagcttatgtagctccagaggtgatcagcaagacaggctatgatggtgcaaaatcagacatctggtcttgtggtgttgttctatttgtccttgttgctggttatctccctttccaaggcccaaacttgatggagatgtatcggaagatacaacacggtgatttcaggtgccccagttggttttcgcacaaactcaagaagctgttgtacaagatcctggaccccaacccaaacacaagaatttcaatccaaaaaataaaagagtctacctggttccgaaaaggccctgagcggacccgcacagttaaggagaaaattccctgtgagaatgccaccacaaatgctgctccaacactttctgtgaggcgcggaaagaatgcttatgaagatgtgaagccgctgcctgtgacaaacttaaatgccttcgaaattatctctttctcctcagggtttgatctatctggcttatttattgaaaaggaacacagaaaggacgcacgatttacttcagataagccagcctcagcaatcatctcgaagattgaagatgttgcaaagatgctgaatctcagggtaaggaagaaggataatggtgttgtcaagattcaagggaggaaggagggaaggaatggtgtccttcagtttgacacagagatctttgagatcacaccgttccatcatctcgttgagatgaaacaaacaagcggtgattcacttgagtatcagaaattatttgaacaggacatccggccagcgctgaaggatatagtctgggcgtggcatggagatgatcagcagcaaatgcaggagtagctttggatgcctcattttttgttctgaaaatttgttttcttcaggtcagagtcatgtgtgttcttttttagaagctacattcttttttttttatcgtaagagaacctagtgaggggtggtgacgtgaaccatttggttgtattccatagaacaataattgtggaaaagctgagttcttgagtttcattctgaaaattgtttctcttctgtaatggtggtccctattgatagtgaaata

SEQ ID NO: 2316 - DNA, 2231 bp, Panicum virgatum
gtgatgcggtgcgcaggaaacgcagcggtatgattaggccaagtaatctgagtcccttccttctctgaaaccctcctcccctgcctgcctgcaggctgcagctgctccccctgtataagaagacccgcctcctctcctcattgtcgccgcatcccacccctcccctccccgcccagcggaactcaggcagcagcaacatactcaatcaaagtcttgatttttgtcgcttcctctaccccccccccctcttcctcttcgtggaatcgcaagataacaaaatccacaacaagtcaaaacatcagggaatgctgaaagatgtgctttcatagaagagatttctgctgcgacatcaaggagctcgctgctccacaaaggctgctagcctgctcaactcttgatgtgagcgaccatcttagctgcatcaactctacaccattcagactccgacacgaccaaggcataagagttctgttcaccgtcatggaccatgacatgggggaggagggctaaatcattgcagtccatctgttcggcggtcaaaatatagccctgtgatttatactgttgaagacatggagggtagaggaaagatattgatggagcggtatgagttggggagattgctgggcaaaggtacatttggcagggtgcactatgcaagaaaccttgagtccaacaggagtgttgctattaagatgatggacaaggacaaagtgctcaaggtcgggctttcagagcagataaggcgtgagatcacaacaatgaggttggtggcacataagaacattgttgagctccatgaggtcatggcaacacgaaacaagatctactttgtcatggagtatgtgaaaggtggcgagctctttgacaagattgagaagagtggcaagctcacggagtctgctgcacacaagtacttcaagcagcttattagtgcggtggattactgccacagccgaggtgtctaccaccgggacctgaagcctgagaacctgctgctggatgaggatgagaacctgaaggtctctgattttggactcagtgcactttcggagtcaaaaaggcaagatggattgctccatacctcctgtggaacaccagcttatgtagctccagaggtgatcagcaagacaggctatgatggtgcaaaatcagacatctggtcttgtggtgttgttctatttgtccttgttgctggtcatctccctttccaaggcccaaacttgatggagatgtatcggaagatacaacacggtgatttcaggtgccccagttggttttcgcacaaacttaagaagctgttgtacaagatcctggaccccaacccaaacacaagaatttcaatccaaaaaataaaagagtctacctggttccgaaaaggccctgaggggacccgcacagttaaggagaaaattgcctgtgagaatgccaccacaaatgctgctccaacactttctgtgaggcgtggaaagcatgcttatgaagatgtgaagctgatgcctgtgacaaacttaaatgccttcgaaattatctctttctcctcggggtttgatctttctggcttatttattcaaaaggaacatagaaaggaggcacgatttacttcagataagccagcctcagcaatcatctcgaagattgaagatgttgcaaagatgctgaatctcagggtaaggaagaaggataatggtgttatcaagattcaagggaggaaggagggaaggaatggtgtccttcagtttgacacagagatctttgagatcacaccgttccatcatcttgttgagatgaaacaaacaagcggtgattcacttgagtatcagaaattattcgaacaggacatccggccagcgctgaaggatatagtctgggcctggcatggagatgatcatcagcaattgcaggagtagctttggatgtctcagtttttgttccgaaaatttgttttcttcagctcagagtgattccgttttatatgtgtgtgtgttcttttttagaagctacattccttttttttatcagaagagaacctaatgagtggtggtgacctgaaccattaggttgtattccattgaacaataactgtggaaaagctgagttcttgagtttcattctgaaaattgttcctgttctgtaatgttggcccctattgatagtgaaacattgttgataaggtaaatcttcaggtaatatttaaactccactagtcagtccacttgcactgaaaagaa

SEQ ID NO: 2317 - DNA, 2811 bp, Panicum virgatum
cggtagtgtacacaacgtcatggaattattattgaaagcagacacaccttaaaatacatggtgattattagaacactacaacagaaaaatagatttgctatagttgtactctagttagtactcacgtatgtttacttggccggagtttttattacgcttaattagaaacaaacatggatactgaatcatgatcactacgcaagatccagcagcacaccgcacacgtaggtcaagttaaggtggaggtgtttagtttgtacatggaatggaacattctcaagcatgggagtggcctggtccaagtccaagcaggtacgtggacacaggcaggctgccctgactcagcaaaggatgagatcggatccaccattgttttgtgtgctactaattctataactgaagtcacatctttctttggaaaaaaaacagcttttttaacaacagccttgaatgtaatcatgtactcctagatgaacgaaaaaaaatgaaattggagacggcgaccggtgagctgtaatcagatggcgacattacgggcttagctgttgcctcctgatgtgtcgcggacgcaagaatatccatccggacctggaggtgtgatgcggtgcgcaggaaacgcagcggaggcggcatcaacgggggtcattatcgtcatgtcgtatggttaggccgactaatctgagcccttcttctctcctgctcgcctccagctgctccccctgtataagaagagcctcctctcctcccccttgtcgccgcatcccctcctcccctctccctgcccagcggaactcaggcaacaataacatactcaatcaaaggcagcgtttagccctgcttccgcacaagttttgatttttgtcgcttcctcaaccccctcttcctcttcgtggaatcgcaagataacaaaatccacaagtcaaaacctcagggaatgctgaaagatgtgctttcatagaagagatttctgctgcgacatcaaggagctcgctgctccgcaagcgctgctagcctgctcaactcttgatgtgagcgaccaccttagctgcatcaattctacaccattcagactccgacacgaccagggcataagagttctgttcaccgtcatggaccatgacatgggggaggagggctaaatcattgcagtccatctgtttggcggtcagaagatagccctgtggtttatacttttgaagacatggatggtacaggaatgatactgatggagcggtatgagttggggagattgctggggaaaggtacatttggcaaggtgcactatgcaagaaaccttgagtccaacaggagtgttgctattaagatgatagaaaaggacaaagttctcaaggttgggctttcagagcagataaggcgtgagatcgcaacaatgaggttagcggcacataagaacattgttgagctccatgaggtcatggcaacacgaagcaagatctactttgtcatggagtatatgaaaggtggcgagctctttgacaagattgagaagagtggcaagctcacggagtctgctgcacacaagtacttccagcagctcattagtgcggtggattactgccacagccgaggtgtctaccaccgggacctgaagcctgagaacctgctgctggatgaggatgagaacctgaaggtttctgattttggactgagtgcactttcggagtcaaaaaggcaagatggattgctccataccacctgtggaacaccagcttatgtagctccagaggtgatcagcaagacaggctatgatggtgcaaaatcagacatctggtcttgtggtgttgttctatttgtccttgttgctggttatctccctttccaaggcccaaacttgatggagatgtatcggaagatacagcatggtgatttcaggtgccccagttggttttcacacaaactcaagaagctgttgtacaagatcttggaccctaacccaagcacaagaatttcaatccagaaaataaaagagtctacctggttccgaaaaggccctgagcggacccgcacagttaaggagaaaattccctgtgagaatgccaccacaaatgctgctccaacactttctgtgaggcgcggaaagaatgcttatgaagatgtgaagccgctgcctgtgacaaacttaaatgccttcgaaattatctctttctcctcagggtttgatctatctggcttatttattgaaaaggaacacagaaaggacgcacgatttacttcagataagccagcctcagcaatcatctcgaagattgaagatgttgcaaagatgctgaatctcagggtaaggaagaaggataatggtgttgtcaagattcaagggaggaaggagggaaggaatggtgtccttcagtttgacacagagatctttgagatcacaccgttccatcatctcgttgagatgaaacaaacaagcggtgattcacttgagtatcagaaattatttgaacaggacatccggccagcgctgaaggatatagtctgggcgtggcatggagatgatcagcagcaaatgcaggagtagctttggatgcctcattttttgttctgaaaatttgttttcttcaggtcagagtcatgtgtgttcttttttagaagctacattctttttttttatcgtaagagaacctagtgaggggtggtgacgtgaaccatttggttgtattccatagaacaataattgtggaaaagctgagttcttgagtttcattctgaaaattgtttctcttctgtaatggtggtccctattgatagtgaaatacgatgcctttgatccgtgaaaaaattttgagcttt

SEQ ID NO: 2318 - DNA, 1967 bp, Zea mays
ccccgcatcgccgcatctttccaccttccctcccctccactcccgcaatctcgtctccgccgtccgccgccgcgccgtagcaaggtaacagagatcacaacaagttaaagcctcaaggaatgctgaaagatgtgctttcctagaagatatttctgttgcgacatcaaggaccttgctgctccccgagggctgctgatctgctcaactcttgatgacctgatctgcatcgattctacaacgttcagactgcgccacgaccaagccataagagtactgttcaccgtcatggatcatgacatgggggaggaaggctaactctttgcccagtcccacctgattggcgccagcagtgtgatttatactttttgcagagagagaagatatggagtcgacaggaaagattttgatggagcggtatgaggtggggaggctactggggaaaggcacatttggcaaggtgcactacgcaaagaatcttgagtccaacgagagtgttgccattaagatgatggacaaggacaaagtgctcaaggccgggctttcggagcagataaggcgggagatcacaacgatgcggttggtggctcataataacattgttgagcttcatgaggtcatggcgacgcggaacaacatctactttgtcatggagtatgtgaaaggcggagagctctttgacaagattggcaagagtggcaagctcacagaggccgctgcacacaagtacttccagcagctcattggtgcggtggattactgccacagccgaggtgtgtatcaccgggacttgaagcctgagaaccttctgttggatgagaatgagaacctcaaggtctcagattttggactgagtgcactttcagaatccaaggggcaagatggcttactccacaccacctgtgggactccagcatatgtagctccagaggtgatcagcaagacaggctatgatggggcaaagtcagacatctggtcctgtggtgttgttctatttgtactagttgctggttatcttcctttccgggccccaaacatgatggagatgtatcgcaagatacagaatggtgatttcaggtgccctagttggttttcacacaaactcaagaagctcttgtacaagatcctcgaccccagcccagacacaagaatttcagtccagaagataaaagagtctacctggtttcgaaaaggccctgtggagacccgtacagtaaaggagaaaattctgagtgagaatgacaccacaaatgctgctccagccgttgctatgaggcgcaagaagaatgttcatgaagacgtgaagcccccgactgtcacaagcttaaacgcctttgaaattatatctttctccacaggattggacctctctggcctatttatcagaaaggagtgtaagaaggagacgcggttcacttctgataagggtgccgtgtccatcatctcgaagcttgaagatgttgcaaaagcactgaatctcagggtaaggaagaaggacaatggtgttgtcaagattcaggggaggaaggtgggaaggaagggtgtcctggagttcgacacggaaatatttgagatcgcggcatcctaccacctcatcgagatgaaacaaacgggcggcgattcacttgagtacaagaaactgttggaagaggacatccggccagcactgaaggacatagtctgggcctggcatggagatgacccgcagcaaaagtagtagctttggatctctcggttttgttccataaaattgttagatctttcacttcagattgattttgttcgacatgtgcgtgttcttcttactagttgcattctttctgtttctgtggaccattggactgtattctgtcgtgcaataattgttgggaggcctgagttgttagtcgttctattctgaaaactggtatctgttctgtaatggttgtccctatcaataatgaaataattgcgtttgatccttgaaaaaa

SEQ ID NO: 2319 - DNA, 1968 bp, Pennisetum glaucum
aatcctcctggctgtatataaagaggaggagcagcctcattgtcgccgcatcccagcagcagcctcctctcctccctgcccaccggaactcaactcatcaggcaacaacccaaggacttgtacaaacaaagttttggttttgtcgattcgcaagataacgaaatccacaacaagtcaaaaacatcagggaatgctgaaagatgtgctttcatagaagagatttctgctgccacatcaaggagctctctgctccccaagtgctgctagcctgctcaactcttcatgtgagcgaccacctcagctgcatcaatcctacacccttcagactccgacacgaccaagccataagagtcctgttcaccgtcatggaccatgacatgggggaggagggctgaatcatcgcagtcacacttaaatcggcaggccacaggatagcactgtgtttttaaacttttggagacatggagggtagaggaaggattttaatggagcggtatgagctggggaggatgttggggcaaggcacatttggcaaggtgcactatgcaaggaaccgcgactcaaatcagagcgttgccattaagatgatggacaaggacaaagtgctcaaggttgggctttcagagcagattaggcgtgagatcacaacaatgagattggtggcacataagaacattgttgagcttcatgaagtcatggcaacacggaacaagatctactttgtcatggagtatgcgaaaggaggcgagctctttgcaaagattgagaagagtggcaagctcacggaggctgttgcacacaagtacttccagcagcttattagtgcagtggattactgccacagccgaggcgtgtaccaccgggacctgaagcctgagaacctgctgctggatgaggatgggaacctgaaggtctctgattttggactgagtgcactttcggagtcgagaaggcaagatggattgctccacaccacctgtggaacaccggcttatgtggctccagaagtgatcagcaagataggctatgatggggcaaaatcagacatatggtcttgcggtgttgttctatttgttcttgttgctggctatctccctttccaaggcccaaacttgatggagatgtatcggaaggtacaacatggtgatttcaggtgccccagttggtttccacacaaactcaagaagctgttgtacaagatcctggatcccaacccagccacaagaatttcaatccggaaaataaaagagtctacctggttccgaaaaggtcctgaggggacccgcatggttaaggagaaaattccctgtgagaatgcaacaacaaatcctcctccagcacttcctgtgaggcgcaaaaagaatccttatgaagatgccaaggcactgaatgtgacaaacctaaatgcatttgaaattatctctttctcgtcagggtttgatctatctggcctatttattgaaaaggagtgcaaaaaggaggcaagatttacttcagacaagtcagcctcggctatcatctcaaagatcgaagatgttgcaaagatactgaatctccgggtaaggaagaaagataatggtgttgtcaagattcaagggaggaaggagggaaggaatggtgtccttcagtttgatatggagatatttgagatcacaccattgcatcatcttgttgagatgaaacaaacaagcggtgattcacttgagtatcagaaactattcgaagagcacatccggccagcgctgaaggacatagtctgggcctggcatggagatgatcagcagcaaaagcaggagtagctttggatgcctccgttttttgtccgaaagtcgtttgattttcagttcagattttgttttcatgtgttcattgttagcaactacatttgttttgtactggaagagcacctgttgagttgtattgatgtgaaccattaggctttattccatcaaataataattgttgaga

SEQ ID NO: 2320 - DNA, 2131 bp, Pennisetum glaucum
cagacagatgatactgcccagcgattatttacaggcaaaccactacagtgaggacaaggtacactgtcatgaccaaggagctcctggatgagcatccagagctgaaggcggaggcatcccaacactgacgccgcgccttgacatctgcaactctgcggtgatcgaccttggtgctactgcagctcgtgctgccattgacgactggggccgccctgcagccgacatcaccccctcctctcccgcgccgttcgtcgtcgactcgcaagataacggaatccacaacaagtcaaaacaccagggaatgctgaaagatgtgctttcgtagaagagatttctgctgcgacatcgaggagctctctgctccccaacggctgctagcctgctcaactcttgatgtgagcgaccaccgcagctgcatcaatcctacacccttcaggctccgacacgaccaagccataagagtcctgttcaccgtcatggaccatgacatgggggaggagggctgaatcatctgcagtccgcttaatcggcaggccacgggacagcactgtgtctggaacttttggagacatggagggtagaggaaaggttttgatggagcggtatgagctggggaggatgttggggcagggcacatttggcaaggtgcactatgcaaggaaccgcgactcgaatcagagcgttgctattaaggtgctggacaaggacaaagtgctcaaggttggcctttcagagcagataaggcgcgagatcacaacaatgaggttggtggcacataagaacattgttgagctccatgaagtcatggcaacacggaacaagatctactttgtcatggagtatgcgaaaggaggcgagctctttaaaaagattgagaggagtggcaagctcacggaggctgttgcacacaagtacttccagcagcttattagtgcggtggattactgccacagccgaggcgtgtaccaccgggacctgaagcctgagaacctgctgctggatgaggatgggaacctcaaggtctctgattttggactgagcgcactctcggagtcgagaaggcaagatggattgctccacaccacctgtggaacaccggcttatgtggctccagaagtgatcagcaagacgggctatgatggtgcaaaatcagacatctggtcttgcggtgttgttctgtttgttcttgttgctggatatctccctttccaaggcccaaacttgatggagatgtatcggaaggtacaacatggtgatttcaggtgccccagttggtttccacacaaactcaagaagctgctgtacaagatcctggaccccaacccagccacaagaatttcaatcaagaaaataaaagagtctacctggttccgaaaaggtcccgaggggacacacacggttaaggagaaaattccctgtgcgaatgcaacaacaaatcctgctccagcactttctgtgaggcgcaaaaagaatccttatggagacgccaaggcgctgactgtgacaaacctaaatgcatttgaaattatctctttctcgtcagggttcgatctgtctggcctatttattgaaaagaagtgcaagaaggaggcaagatttacttcagacaagccagcctcggccatcatctcaaaggtttcagatgttgcaaagatactgaatctccgggtaaggaagaaagataatggtgttgtcaagattcaagggaggaaggagggaaggaatggtgtccttcagtttgacacggagatatttgagatcacaccatcccatcatcttgttgagataaaacaaacaagcggtgattcacttgagtaccagaaactattcgaagagcacgtccggccagcgctgaaggacatagtctgggcctggcatggagatgatcagcagcaaaagcaggagtagctttggttgcctctgtttttttggtccgaacgttgtttgattttcagttcagattttgttttcatgagttcattgttagcaactacattcgttttgtattggaattgcacctgctgagttgtatttacgtggaccattaggcttcattcggtcgaataataattgttgagaggcttgagttattgaagaaaaaaaaaaaaaaaaaaaaaaacgtactactagt

SEQ ID NO: 2321 - DNA, 2181 bp, Oryza sativa
ctgaagaaagcttgaaaggctcaaagccaatttttatattgcagctcaatttctcataaaattactctcgacagactccatctaaattgtgcataaattgcctaaacatcaactctccaaatacaattgcatacattgtctcaacatgaactctccagatacaaaaacatagatgctaaaaagaacacaggcaagacaaataaattcatttgagctaaaacctaatgaatttgaggagcggaaactaaatgcttgagacatcaaaatctactcttgcgactgctgctattcatctccatgctaggccaagacaatgtccttcagagctggccggatgccctcctccagtagctgtcggtactccaatgaatcgccacttgtttgtttcatctcgatgatatgataggaagtggtaacctcaaatatctctatgtcaaactgaagaacaccattccttccctccttcctcccttgcatcttcactacaccattgtctttcttccttaccctgagatttagcgcctttgctacatcttctagctttgagattatggttgaggcagatttatctgaagtgaaccttgcctcatttctccattcctttacaatgaacatgccagagagatcaaatcccttggagaaagagataatttcaaaagcatttaagtttgtcactgacatgggcttcacatcttcatgagcatttttcttgcgtctcacaccaagcaccggagcaacatttttggtggtgttttcattcaaagttctttccttcaaaatacggttctcctcaggacctttccggaaccaggtagactcctttatcttctggattgaaatccttgtgcttgggttggggtccatgatcttgtacaacaacttctggagtttgcgtgaaaaccaaccggggcacctgaattcaccgtgttgtatcttccgatacatttccatcaagtttgggccctggaaaggaaggtaaccagcaacaagaacaaacaggataacaccacaagaccaaatatctgactttgcaccatcatagcctatcttgctaatcacctctggagctacatatgcaggtgttccacaggtggtatggagtaagccatcttgcctcttcgactctgaaagcgcactcaatccaaagtctgagactttcaggttctcattctcatccaacagtaggttctcaggcttcaagtcccggtgatacacacctcgactgtggcagtaatccactgcactaatgagttgctggaaatacttatgtgcaacaacctctgtaagctttccacgctttgcaactttttcaaatagctcaccacctttcacatactccatcacaaagtagatcttgttccgtgttgccatgacctcatgaagctgaacaatgttcttatgagccaccaaccgcatggttgtgatctcacgtctgatctgctccgaaagcccgaccttcaatatctgctgtttgtccatcatctttatggccacactctggtttgactccagattccttgcatagtgcaccttgccaaatgttcctttccccaacaatctccccaactcatacctctccattagaatcttccctctactctccatgcccacaaagatataaatctcagcactatgttttgaccaccaatcagatggactgcaattctttagccatcctccccaaggtcatgatcgtggatggagaacaacattcttatatcatcgtcgtttcggagtctaaatggtgtagaattagtgcaggaaagttgatcactcacatcaagacttgagtagatcagtagcactggtgaaccagcaatctgttttatctcacacggaaaatttcttctatgcaagcacatctttcagcattccttgaggctttcactgcttgtttttttattgattccccttcgaagaagaggagattcaggtaacaaaaggtgaactttttggatctgtcccccacttctttctcaacacctgtttgggtagagagagagagtttttgagtggtagtatcaggagtggatgcgaggagagcgagaagacggggttctcttttatacagggggaaccgatcaagaagaggagaggaggcagccgccagttggagaagaaacagtggtgccttgcattattagcagagattgatttgacgtttataaaggtgatttggct

SEQ ID NO: 2322 - DNA, 2549 bp, Oryza sativa
caggaaacgcggcccaaccaaatcagggtcattaacgtcaaatcattctctgctaataatgcaaggcaccattgtttcttctccaactctctccctggcggctgcctcctctcctcttcttgctcggttccccctgtataaaagagaaccccgtcttctcgctctcctcgcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggcatggagagtagagggaagatactaatggagaggtatgagttgggcagattgttggggaaaggaacatttggcaaggtgcactatgcaaggaatctggagtcaaaccagagtgtggccataaagatgatggacaaacagcaggtgttgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtacttccagcaactcattagtgcagtggattactgccacagtcgaggtgtgtatcaccgggacttgaagcctgaaaacctgctgttggatgagaatgagaacctgaaagtctcagactttggactgagtgcgctttcagagtcgaagaggcaagatggcttactccataccacctgtggaacacctgcatatgtagctccagaggtgatcagcaagataggatatgatggtgcaaagtcagatatttggtcttgtggtgttatcctgtttgttcttgttgctggttaccttcctttccagggcccaaacttgatggaaatgtatcggaagatacaacatggtgaattcaggtgccccggttggttttcacgcaaacttcagaagttgttgtacaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaagaaaaatgctcatgaagatgtgaagcccatgtcagtgacaaacttaaatgcctttgaaattatctctttctccaaggggtttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatagcagcagtcgcaagagtagattttgatgtctcaagcatttagtttccgctcctcaaattcattaggttttagctcaaatgaatttatttgtcttgcctatgttctttttagcatctatgtttttgtatctggagagttcatgttgaggcaatctatgcacaatttagatggagtctgtcgagagtaattttatgagaagttgagctgcaatataaaagttggctttgagcctttcaagctttcttcatatattcgtccttgtcctgtcataaagctatgcttgggtgcaatgttgtgacaccattagcaaggttactgcagcatgaagtatgcaattcttggtattcaccagtcgctcaagaatttctagagtttttaactttttattaccaacttgttgacgaaaattctcatatcaatagtgctacagaggtataccttatcagctattgaacataagtctttatcaaacaaataaaagaaaaaccgaagcgacttctcattctgcggacgaacaagataacacgagtgcgcaatcctacaagatagtagcaggtaggcaacgaaataccaaaaagctgcagtttcattggaaggc

SEQ ID NO: 2323 - DNA, 2005 bp, Triticum aestivum
caagcacacacaccaaaaccaaaactccagcacctcacacagaggcacagacacagagagagaactgcctcgaggtcccagcttggatccggagcctcccctcttggcggcgccggaagagaactccaatacagaataagcactcaaagcctcggggaatgctgaaagatgtgcttgcttagaagaaatttcacctgcgcgataaaggagattgcctcttctccacaggagctgagttggtcaactctttatgcgagcaaccatcttgtttgcatcagctctacaccatctagactccgtcgagacaaagacatgagagtgttgttcattgtagtggatcaagactaccttggagaggatggttgaagtgccgcagtccatttgaattatagccacaatataggctgtggttttacgcagcttgaagtcatggcaaacagagggaagattctaatggagcggtacgagctgggaagattgttggggaaaggaacattcggcaaggtgcactatgcaaggagcctagagtcgaaccaaagcgtcgccataaagatgctggacaaggagaaggtgctcaaggttgggctctcggagcaaatcaggcgtgaggtcacaaccatgcggctggtggcacacaagaacattgttcagcttcatgaggtcatggcgacacgaaacaaaatatactttgtcatggagtatgtgaaaggcggtgagctctttgacaaggttgcaaagagtggcaagctcacagagggtgctgcacataagtatttccagcagctcatcagtgcagtggattactgccacagccaaggcgtgtatcaccgggatctcaagctggagaacctgctcctggatgagaatgagaaccttaaggtctcagattttggactgagcgcactttcagagtcaaagaggcaagatggcttgctccacaccacctgcggaacacctgcatatgtagctccggaggtcatcagcaagacaggttacgatggtgcgaaatcagatatctggtcttgtggtgttatcctttttgttcttgttgctggttatctccctttccatggttccaacttgatggacatgtaccggaagattgaacaaggagatttcaggtgccccagctggttctcacacaaactccagaagctcttgtgcaagatcctggaccccaatccaagcaccagggcatctatccagaagataaaagagtctacctggtttcggaaaggtccaaggggcacccttgcagtgaaggagagaactcccagtgagaatgtcaccacaaatgctcctcctacagctggtgtgaggccaaggaagaacactcatgaagatgtgcagcccctgacggtgacaaacttaaatgcctttgagatcatctccttctccacggggtttgacctgtccggcctattcatccaagaggactgcagaaaggagacaaggttcacttcagacaagcctgcttcagccatcatctcgaagctggaatacgttgcaaaggcgctgaatctcagggtaaggaagaaggacaatggtgtggtgaagatgcaagcaaggaaggagggaaggaatggtgctgttcagttagacatggagatcttcgagatcacaccttcccaccacctcattgagatgaaacaaacaagtggtgatccgctggagtaccgggagctattggaggacatccggccagcgctgaaggacatagtctgggcctggcacggagatgaccaccagcagcagctagagtaggttttggaatcttgagtatttagttttggttctgcgaattcgtccggttttcagctggaacgatcctattttaaatgcttgtgttctttgtacaaaatatattttttcctacatgaggtgaggcattctgttgaggcattgttgagaagttgagatgcataataaaggttgttcctgtttagttgctgtcaacttgtcattgtcctgtcataatgctctgccaagcattcacagtagaaag

SEQ ID NO: 2324 - DNA, 2007 bp, Triticum aestivum
acacacaccaaacaaaactccagcagctcacacagaggcacagacacagagagagaactgcctcgaggtcccggcttggatccggagcctcccctcttggcggcgccggaagagaactccaacacagaacaagcactcaaagcctcggggaatgctgaaagatgtgcttgcttagaagaaatttcacctgcgcaataaaggagattgcctcttctccacaggagctgagttggtcgactctttatgtgagcaaccatcttgtttgcatcagctctgcaccatctagactccgtcgagagaaagacatgagagtgttgttcatcgtagtggatcaagactaccttggagaggatggttgaagtgctgcagtccatttgaattatagccgcaatataggctgtggttttatgcaacttgaagtcatggcaaacagagggaagattctaatggagcggtacgagctgggaagattgttggggaaaggaacatttggcaaggtacactatgcaaggagcctagagtcgaaccgaagcgtcgccataaagatgctggacaaggagaaggtgctcaaggttgggctctcggagcaaatcaggcgtgaggtcacaaccatgcggttggtggcacacaagaacattgttcagcttcatgaggtcatggcgacacgaaacaaaatatactttgtcatggagtatgtgaaaggcggtgagctctttgacaaggttgcaaagagtggcaagctcacagagggtgctgcacataagtatttccagcagctcatcagtgcagtggattactgccacagccaaggcgtgtatcaccgggatctcaagctggagaacctgctcctggatgagaatgagaaccttaaggtctcggattttggattgagcgcactttcagagtcaaagaggcaagatggcttgctgcacaccacctgcggaacacccgcatatgtagctccggaggtcatcagcaagacaggttatgatggtgcgaaatcagatatctggtcttgtggtgttatcctttttgttcttgttgctggttatctccctttccatggttccaacttgatggacatgtaccggaagattgagcaaggagatttcaggtgccccagctggttctcacacaaactccagaagctcttgttcaagattctggaccccaatccaagcaccagggcatctatccagaagataaaagagtctacctggttccggaaaggtccaaggggaacccttgcagtgaaggagagaactcccagtgagaacgtcaccacaaatgctcctcctacagctggtgtgaggccaaggaagaacactcatgaagatgtgaagcccctgatggtgacaaacttaaatgcctttgagatcatctccttctccacggggtttgacctgtctggcctattcatccgagaggagtgcagaaaggagacaaggttcacttcagacaagcctgcttcagccatcatctcgaagctggaatatgttgcgaaagcgctgaatctcagggtaaggaagaaggacaatggcgtggtgaagatgcaagcgaggaaggaaggaaggaatggtgctgttcagttagacatggagatcttcgagatcacaccttcccaccacctcattgagatgaaacaaacaagtggtgatccactggagtaccgggagctattggaggacatccggccagcgctgaaggacatagtctgggcctggcacggagatgaccaccaccagcagctagagtaggttttggaatcttgagtatttagttttggttctgcgaattcgtccagttttcagctggaacgatcctattttacatgcgtgtgttctttgtacaaaatatattttttcctacatgaggtgaggcattctgttcgaggcattgttgagaagttgaaatgcataataaaggttgttcctgtttagttgctgtcaacttgtcactgtcctgtcataatgctcattttgggtgaaattaaatgctatgccaagc

SEQ ID NO: 2325 - DNA, 1980 bp, Triticum aestivum
caccccaaacaaaactccagcaactcacacagaggcacagacacagagagaactgcctcgaggtcccggcttggatccggagcctcccctcttggcgccgccggaagagaactccaatacagaacaagcactcaaagcctcggggaatgctgaaagatgtgcttgcttagaagaaacttcacctgcgtgataaaggagattgccgcttctccacaggagctgagttggtcgactctttatgcgagcaaccatcttgtttgcatcatctctgcaccatctagactccgtcgagacaaagacatgagagtgttgttcactgtggtggatcaagactaccttggagaggatggttgaagtgctgcagtccatttgaattatagccgcaatataggctgtggttttatgcagcttgaagccatggcaaacagagggaagattctaatggagcggtacgagctgggaagattgttggggaaaggaacattcggcaaggtgcactatgcaaggagcctagagtcgaaccgaagcgtcgccataaagatgctggacaaggagaaggtgctcaaggttgggctctcggagcaaatcaggcgtgaggtcacaaccatgcggttggtggcacacaagaacattgttcagcttcatgaggtcatggcgacacgaaacaaaatatactttgtcatggagtatgtgaaaggcggtgagctctttgacaaggttgcaaagagtggcaagctcacagagggtgctgcacataagtatttccagcagctcatcagtgcagtggattactgccacagccaaggcgtgtatcaccgggatctcaagctggagaacctgctcctggatgagaatgagaaccttaaggtctcggattttggattgagcgcactttcagagtcaaagaggcaagatggcttgctgcacaccacctgcggaacacccgcatatgtagctccggaggtcatcagcaagacaggttatgatggtgcgaaatcagatatctggtcttgtggtgttatcctttttgttcttgttgctggttatctccctttccatggttccaacttgatggacatgtaccggaagattgagcaaggagatttcaggtgccccagctggttctcacacaaactccagaagctcttgttcaagattctggaccccaatccaagcaccagggcatctatccagaagataaaagagtctacctggttccggaaaggtccaaggggaacccttgcagtgaaggagagaactcccagtgagaacgtcaccacaaatgctcctcctacagctggtgtgaggccaaggaagaacactcatgaagatgtgaagcccctgatggtgacaaacttaaatgcctttgagatcatctccttctccacggggtttgacctgtctggcctattcatccgagaggagtgcagaaaggagacaaggttcacttcagacaagcctgcttcagccatcatctcgaagctggaatatgttgcgaaagcgctgaatctcagggtaaggaagaaggacaatggcgtggtgaagatgcaagcgaggaaggaaggaaggaatggtgctgttcagttagacatggagatcttcgagatcacaccttcccaccacctcattgagatgaaacaaacaagtggtgatccactggagtaccgggagctattggaggacatccggccagcgctgaaggacatagtctgggcctggcacggagatgaccaccaccagcagctagagtaggttttggaatcttgagtatttagttttggttctgcgaattcgtccagttttcagctggaacgatcctattttacatgcgtgtgttctttgtacaaaatatattttttcctacatgaggtgaggcattctgttcgaggcattgttgagaagttgaaatgcataataaaggttgttcctgtttagttgctgtcaacttgtcactgtcctgtcataatgctcattttgggt

SEQ ID NO: 2326 - DNA, 2207 bp, Oryza sativa
caggaaacgcggcgcagccaaatcagggtcattaacgtcaaatcaatctctgctaataatgcaaggcaccactgtttcttctccaactggcggctgcctcctctcctcttcttgatcggttccccctgtataaaagagaaccccgtcttctcgctgtcctcgcatccactcctgatactaccactcaaaaactctctctctctacccaaacaggtgttgagaaagaagtgagggacagatccaaaaagttcaccttttgttacctgaatctcctcttcttcctgtcaccggaaggggaatcaataaaaaaaacaagcagtgaaagcctcaaggaatgctgaaagatgtgcttgcatagaagaaattttccgtgtgagataaaacagattgctggttcaccagtgctactgatctactcaagtcttgatgtgagtgatcaactttcctgcactaattctacaccatttagactccgaaacgacgatgatataagaatgttgttctccatccacgatcatgaccttggggaggatggctaaagaattgcagtccatctgattggtggtcaaaacatagtgctgagatttatatctttgtgggcatggagagtagagggaagattctaatggagaggtatgagttggggagattgttggggaaaggaacatttggcaaggtgcactatgcaaggaatctggagtcaaaccagagtgtggccataaagatgatggacaaacagcagatattgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtatttccagcaactcattagtgcagtggattactgccacagtcgaggtgtgtatcaccgggacttgaagcctgagaacctactgttggatgagaatgagaacctgaaagtctcagactttggattgagtgcgctttcagagtcgaagaggcaagatggcttactccataccacctgtggaacacctgcatatgtagctccagaggtgattagcaagataggctatgatggtgcaaagtcagatatttggtcttgtggtgttatcctgtttgttcttgttgctggttaccttcctttccagggcccaaacttgatggaaatgtatcggaagatacaacacggtgaattcaggtgccccggttggttttcacgcaaactccagaagttgttgtacaagatcatggaccccaacccaagcacaaggatttcaatccagaagataaaggagtctacctggttccggaaaggtcctgaggagaaccgtattttgaaggaaagaactttgaatgaaaacaccaccaaaaatgttgctccggtgcttggtgtgagacgcaagaaaaatgctcatgaagatgtgaagcccatgtcagtgacaaacttaaatgcttttgaaattatctctttctccaagggatttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctagcatggagatgaatagcagcagtcgcaagagtagattttgatgtctcaagcatttagtttccgctcctcaaattcattaggttttagctcaaatgaatttatttgtcttgcctgtgttctttttagcatctatgtttttgtatctggagagttcatgttgagacaatgtatgcaattgtatttggagagttgatgtttaggcaatttatgcacaatttagatggagtctgtcgagagtaattttatgagaaattgagctgcaatataaaaattggctttgagcctttcaagctttcttcaga

SEQ ID NO: 2327 - DNA, 1896 bp, Hordeum vulgare
aactccaatataaaacaagcacttaaagcctcggggaatgctgaaagatgtgcttgcttagaagacatttcacctgcgcgataaaggagattgcctctgctccacaagagctgagttgttcgactctttatgcaagcaaccatcttgtctgcatcatctctacaccatctagacttcgtcgagacaaagacatgagagtgttgttcactgtggtggatcaggactaccttggagaggatggttgaagtgctccagtcgatttgaattatatagccgcaatataggcttgtggtgttatacagctagaagtcatggcgaacagagggaagattctaatggagcgctacgagctgggaagattgttggggaagggaacatttggcaaggtgcactttgcgaggagccttgagtccaaccaaagcgtcgccataaagatgttggacaaggagaaggtgctcaaggttgggctctcggagcaaatcaggcgtgaggtcacaaccatgcggttggtggcacacaagaacattgttcagcttcatgaggtcatggcgacacgaaacaaaatattctttgtgatggagtatgtgaaaggtggcgagctctttgacaaggttgcaaagagtggcaagctcacagagggtgctgcacacaagtatttccagcagctcatcagtgcagtggattactgccacagccaaggtgtgtatcaccgggatctcaagctggaaaacctgctcctggatgagaatgagaaccttaaggtctcagattttggattgagcgcactttcagagtcaaagaggcaagatggcctgctccacaccacctgcggaacacccgcatatgtagctccggaggtcatcagcaagacaggttatgatggtgcgaaatccgatatctggtcttgtggtgttatcctttttgttctcattgctggttatctccctttccatggttccaacttgatggagatgtaccggaagattgagcaaggagatttcaggtgccccagctggttctcacacaaactccagaagcttttgtgcaagatcctcgaccccaatccaagcaccagggcatctatccagaagataaaagagtctacctggttccggaaaggtccaaggggcacccttgcagtgaaggagagaactcccagtgagaatgttaccacaaatgctcctcctacagctggtgtgagggcaaggaagaacactcatgaagatgtgaagcccctgatgctgacaaacttaaatgcctttgagatcatctctttctccacagggtttgacctatctggcctattcatccaagaggagtgcagaaaggagacaaggttcacttcagacaagcctgcttcagccatcatctcgaagctggaatacgtcgcgaaggcgatgaatctcagggtaaggaagaaggacaatggcgtggtaaagatgcaaacgaggaaggaaggaaggaacggtgctgttcagttagacatggagatcttcgagatcacaccttcccaccacctcattgagatgaaacaaacaggtggtgatccgctggagtaccgagagctgttggaggacatccggccagcgctgaaggacatagtctgggcctggtatggagatgaccaccagcagcggctagagtagtttttggaatcttgagtatttagttttggttctgcgaattcgtccagttttcagctggaacgatcctattttacatgcttgtgtgtctttgtagaaaatatattttttcctacatgaggtgaggcattctgttgaggcattgttgagaagttgagatgcataataaaagttgttcctgtttagttgttgtcaacttgtcattgtcctgtcataatgctcatttcgggtgaaattaaatgatataccaagc

SEQ ID NO: 2328 - DNA, 1885 bp, Secale cereale
aaacacacaccccagaacaaaactccagcaactcacacagggacagagagggaactactgcctcgaggtcccagcttggatccggagcctcccctcttggcaccgccggaagagaactccaatacagaacaagcactcaaagcctcggggaatgctgaaagatgtgcttgcttagaagaaatttcacccgcgcgataaaggagattgcctcttctccacaggagctgagttggtcgactctttatgcgagcaaccatcttgtttgcatcatctctgcaccatctagactccgtcgaaacaaagacatgagagtgttgttcactgtggtggatcaagactaccttggagaggatggctgaagtgctgcagtccatttgaattatagccgcaatacaggctgtggttttatacagctggaagtcatggcgaacagagggaagattctaatggagcggtatgagctgggaagattgttgggtaaaggaacattcggcaaggtgcactatgcgaggagccttgagtcgaaccaaagcgtcgccataaagatgctggacaaggagaaggtgctcaaggttggactctcggagcaaatcaggcgtgaggtcacaaccatgcggttggtggcacacaagaacattgttcagcttcatgaggtcatggcgacacgaaacaaaatatactttgtcatggagtatgtgaaaggcggtgagctctttgataaggttgcaaagagtggcaagctcacagagggtgttgcacataaatatttccagcagctcattagtgcagtcgattactgccacagccaaggcgtgtatcaccgggatctcaagctggagaacctgctcctggatgaaaatgagaaccttaaggtctcggattttggattgagcgcgctttcagagtcaaagaggcaagatggcttgctccacaccacctgtgggacacccgcatatgtagctccggaggttatcagcaagacaggttatgatggtgcgaaatcagatatctggtcttgtggtgtcatcctttttgttcttgttgctggttatctccctttccaaggctccaacttgatggacatgtaccggaagattgagcaaggagatttcaggtgccccagctggttctcacacaaactccagaagcttttgtgcaagatcctggaccccaatccaagcacaagggcatctatccagaagataaaagagtccacctggttccggaaaggtccaaggggcacccttgcagtgaaggagagaactcccagtgagaatgtcagtacaaatactcctcctacagctggtgtgaggccaaggaagaacactcatgaacatgtgaagcccctgatggtgacaaacttaaatgcctttgagatcatctccttctccacggggtttgacctatctggcctattcatccaagaggagtgcagaaaggtgacaaggttcacttcggacaagcctgcttcagccatcatctcgaagctggaatacgtcgcgaaggcgatgaatctcagggtaaggaagaaggacaatggcgtggtgaagatgcaagcgaggaaggagggaaggaatggtgctgttcagttagacattgagatctttgagatcacaccttcccaccacctcattgagatgaaacaaacaagtggtgatccgctggagtaccgggagctattggaggacatccggccaaggctgaaggacatagtctgggcctggcacggagatgaccaccaacagcagctagagtaggttttggaatcttgagtatttaattttacatgtgtgtgttctttgtacaaaattttttttttcctacatgaggtgaggcattctgctgaggcattgttgagaagttgaaatgcataataaaggctgtt

SEQ ID NO: 2329 - DNA, 1962 bp, Zea mays
gtatctcaactccgccaagccaagctcagcgaaaactcaggcgatcggacgacgccccaaggaacaagtgcagcggaacgaagcttcggcgtcctcgtcgtcccgtcgcaagtgcagatcacaagtccataacaagaaagacaacaaaactatgctgaaagatgtgcttgcatagaagagacttctgcagcaacaccaccaagggcctggtggttcttgcgcaaggtccgcaggcctgctcgtctcttgacttgagcggcggtcaccttgcctgcatctactccacgcccttcagactccgacgccaccgacccataaggcgcagtccacctgattgacaacagaaagctagccctgtgcgtgatcacatagtttttatggagataaaagatatgaagaccagagggaagactttgacggagcggtacgagatggggaagctgctggggaaaggcgcgttcgggaaggtgcactatgcaagggacctcgagtccaaccagggtgttgctatcaagatcatggacaaggacagggtgctcaaggccgggctctcggagcaggtaaagcgtgagatcacgactatgcggctggtggaacacaaaaacatcgttcgtctccatgaggtcatggcgacacggaacaagatctacatcatcatggagtatgccaaagggggtgagctcttagacaaggttaagaggagcggcaggctgacggaggctgacacacacagatacttccaacagctcattggcgcactggatcactgccacagccgaggcgtgtaccaccgggacttgaagcgtgagaatctgttgttggatgagaatggggaccttaaggtgtctgactttggactgagcgcgttttcagagtcgaggaggacagatgggctgctccatactgtctgtgggacaccagtgtatatagctccggaggtgatcaagaagacgggatacgatggtgcaaaatcagacatctggtcttgtggtgtcgtcctgtttgttctcgctgctggctacctccctttccagggcccaaacatgatggagatttatcgaaagatacatgatagtgatttcaggtgccccagttggttttcacacaaactcaagaggctgctatacaagattctgaaccccaaccctagcatgagaccttcaattcaggagataaaagagtctacctggtttcgaaaaggtcctagggagatcagtgcagtgaaggagaaagttcttagcgagaatgccaccgccacaaatgctgccccagtgcttgctgctaggcgcaaggagattgctcacgaagataagaccctggttgccacaaaactcaatgcctttgaaatcatcgcgttctcagcagggttggacctttctggtctgtttatcaaggagtgcaggaaggagacacggttcacttcagataagcctgcattggccatcatctcaaagcttgaagatgtcgcgaaagcactgaatctcaggataaggaagaaggacaacaacactgtcatcattcaagggaggaagcatgggggcaatggtgtccttcagtttgacacgcagatctttgagatcacaccatcctgccatctcgttcagatgaaacaaactagtggcgatctacttgagtaccagaaactgttggaagagggcatccgaccagggctgaaggacgttgtctgggcttggcatggagatgatctgcagcagaagtaggagtagcttcagctgtctcccgtagattatgttctacattccattccttattttttagcaacaacattcccttttttgtattggtggtgatatgaaccattaggctatgttttgtttgagcaataattgttgtggagttgagttgttgtgttacattctgaagattgttacagttttgtaatggctgtcaatatcagtaatgaaaataaatgttgttgatccttaaaaagggtcgagcttt

SEQ ID NO: 2330 - DNA, 1969 bp, Zea mays
tctcaactccgccaagccaagctcgatcagcgaaactcaggcgatcggacgacgccccaccgaacaagtgcagcgcccggcggccctcccccccggaacgaagcttcggcgttctcgtcgtgccgtcgcaagtgcagatcataagtctataacaagaaagacaacaaaactatgctgaaagatgtgcttgcatagaagagacttctgctgcaacaccaccaagggcctggtggttcttgcgaaaggtctgcaggcctgctcgtctcttgacttcagcggcgatcaccttgcctgcatctactccacgcccttcagactccgacgccaccgatccataaggcgcagtccacctgattgacaacagaaagctagccctgtgtgcatcatcacacaattttcatagagataaaagatatgaagaccagagggaagactttgacggagcgatacgagatggggaagctgctggggaaaggcgcgttcgggaaggtgcactatgcaagggacctcgagtccaaccagggtgttgctatcaagatcatggacaaggaaagggtgctcaaggccgggctctcggagcaggtaaagcgcgagatcacgacgatgcggctggtggaacacaaaaacatcgttcgtctccatgaggtcatggcgacgcggaacaagatctacatcatcatggagtatgcgaaagggggtgagctcttggacaaggttaagaggagcggcaggctgacggaggctgacacacacagatacttccaacagctcattggcgcactggatcactgccacagccgaggtgtataccaccgagacttgaagcctgagaacctgctgttgaatgagaatggggacctcaaggtgactgactttggactgagcgcgttttcagagtcgaggaggacagatgggctgctccatactgtctgtgggacaccggtgtatatagctccggaggtgatcaagaagacgggctacgatggtgcaaaatcagacatctggtcttgtggtgtcgtcctgtttgttctcgctgctggctacctccctttccagggcccaaacttgatggagatttatcgaaagataaatgatagtgatttcaggtgccctggttggttttcacacaaactcaagaggctgctgtacaagattctgaaccccaaccccagcatgagaccttcaattcaggagataaaagagtctacctggtttcgaaaaggtccaagggagatcagtgcagtgaaggagaaagttcttagcgagaatgccaccgccacaaatgctgccccagtgcttgctgctaggcgcaaggagattgctcatgaagatatgaagcccctggttgccacaaaactcaatgcctttgaaatcatcgcgttctcagcagggttggacctttctggtctgtttatcaaggagtgtaggaaggagacaaggttcacttcagataagccagcattggccatcatctcaaagcttgaagatgtcgcgaaagcactgaatctcaggataaggaagaaggacaacaacactgtcatcattcaagggaggaagcatgggggcaatggtgtccttcagtttgacacgcagatctttgagatcacaccatcctgccatctcgttcagatgaaacaaaccagtggcgatcttattgagtaccagaaactgttggaagagggcatccggccagggctgaaggacgttgtctgggcctggcatggagatgatctgcagcagaagtaggagtagcttcagatgtctcctgtagattatgttatacattccattccttattttttagcaacaacattctcttttttgtattggtggtgatatgaaccattaggctatgttttgttgagcaataattgttgaggagctgagttgttgtgttacattctgaagattgttacagttttgtaatggctgtcaatatcagtaatgaaaataaatgttgttgatcctt

SEQ ID NO: 2331 - DNA, 1971 bp, Triticum aestivum
aaagcctcggggaatgctgaaagatgtgcttgcttagaagaaacttcacctgcgtgataaaggagattgccgcttctccacaggagctgagttggtcgactctttatgcgagcaaccatcttgtttgcatcatctctgcaccatctagactccgtcgagacaaagacatgagagtgttgttcactgtggtggatcaagactaccttggagaggatggttgaagtgctgcagtccatttgaattatagccgcaatataggctgtggttttatgcagcttgaagccatggcaaacagagggaagattctaatggagcggtacgagctgggaagattgttggggaaaggaacattcggcaaggtgcactatgcaaggagcctagagtcgaaccgaagcgtcgccataaagatgctggacaaggagaaggtgctcaaggttgggctctcggagcaaatcaggcgtgaggtcacaaccatgcggttggtggcacacaagaacattgttcagcttcatgaggtcatggcgacacgaaacaaaatatactttgtcatggagtatgtgaaaggcggtgagctctttgacaaggttgcaaagagtggcaagctcacagagggtgctgcacataagtatttccagcagctcatcagtgcagtggattactgccacagccaaggcgtgtatcaccgggatctcaagctggagaacctgctcctggatgagaatgagaaccttaaggtctcggattttggattgagcgccctttcagagtcaaagaggcaagatggcttgctccacaccacctgcggaacacccgcatatgtagctccggaggtcatcagcaagacaggttacgatggtgcaaaatcagatatctggtcttgtggtgttatcctttttgttcttgttgctggttatctccctttccatggttccaacttgatggacatgtaccggaagattgagcaaggagatttcaggtgccccggctggttctcacacaaactccagaagctcttgctcaagatcctggaccccaatccaagcaccagggcatctatccagaagataaaagagtctacctggttccggaaaggtccaaggggcacccttgcagtgaaggagagaactcccagtgagaatgtcatcacaaatgctcctcctacagctggtgtgaggccaaggaagaacactcatgaagatgtgaagcccctaatggtgacaaacttaaatgcctttgagatcatctccttctccacggggtttgacctgtccggcctattcatccaagaggactgcagaaaggagacaaggttcacttcagacaagcctgcttcaaccatcatctcgaagctggaatatgttgcgaaggcgctgaatctcagggtaaggaagaaggacaatggcgtggtgaagatgcaagcgaggaaggagggaaggaatggtgctgtacagttagacatggagatcttcgagatcacaccttcccaccacctcattgagatgaaacaaacaagtggtgatccgctggagtaccgggagctattggaggacatccggccagcgctgaaggacatagtctgggcctggcacggagatgaccaccagcagcagctagagtaggttttggaatcttgagtatttagttttggttctgcgaattcgtccggttttcagctggaacgatcctattttacatgcgcgtgttctttgtacaaaatatattttttcctacatgaggtgaggcattctgttggggcattgttgagaagttgagatgcataataaaggttgttcctgtttagttgctgtcaacttgtcattgtcctgtcataatgctctgccaagcattcacagtagaaagctcccactacacctccataaacatatttctcaaaacatacaacttattagctatgccagcacttgaactttttgtgatttgccatctctggaagaaagctacaactgttca

SEQ ID NO: 2332 - DNA, 1989 bp, Zea mays
caactacgccaagccaagcttagcgaaactcaggcgatcggaccacgccccaccgaacaagtgcagcgcccgaccctccccacggaacgaagcttcggcgttctcgtcgccccgtcgcaagtgcagatcacaagtccataacaagaaagacaacaaaactatgctgaaagatgtgcttgcatagaagatacttctgctgcaacaccaccaagggcctagtggctcttgcgcaagatctgcaggcctgctcgtctcttgacttgagcggcggtcaccttgtccgcatctactccacgcccttcagactccgacgccagcaacctataaggcgcagtccacctgattgacaacagaaagctagccttgtgcgtgatcacacagttttcatggatataaaagatatgaagaccagagggaagactttgacggagcggtatgagctggggaagctgctggggaaaggcgcgttcgggaaggtacactatggaagggaccttgagtccaaccaggatgttgctatcaagatcatggataaggacagggtgctcaaggccgggctctcagagcaggtaaaatgtgagatcacgacgatgcggctggtgacacacaaaaacatcgttcgtctccatgaggtcatggcgacgcgaaataagatctacatcatcatggagtatgcgaaagggggtgagctctttgaaaagattaagaggagcgacaggctcacggaggctgacacacacaaatacttccaacagctcatcgatgcactagatcactgccatagccgaggcgtgtaccatcgggacttgaagcctgagaacctgctgctggatgagaatggggacctcaaggtgtctgactttggactgagcgcgttttcagagtcgaggaggacagatgggttgctccatactgtctgtgggaccccggtgtatatagctccagaggtgatcaagaagacaggctacgatggtgcaaaatcagacatctggtcttgtggtgttgtcctctttgttctcgctgctggctacctccctttccagggcccaaacttgatggagatttatcggaagatacatgatagagattttaggtgccccagttggttttcacacaaactcaagaggttgctatacaagatcctgaaccccaaccccagcatgagaccttcaattcaggagataaaagagtctacctggttccgaaaaggtcctagggagatcagtgcagtgaacgagaaagttcttagcgagaatgccaccaccacaaatgctgccccagtgcttccttctaggcgcaaggagattgctcacgaagatatgaagtccttggttgccacaaacctcaatgcctttgaaatcatcgcgttatcagcaggattggacctgtctggtctgtttatcaaggagtgcaggaaggagacaaggttcacttcagataagcctgcattgtccatcatcgcaaagcttgaagacgtcgcaaaagcactgaatctcaggataaggaagaaggacaacaacactatcagcattcaagggaggaaggaggggggcaatggtgtccttaagtttgacacgcagatctttgagatcacaccatcctgccatctcgttcagattaaacaaaccagtggcaatctacttgagtacgagaaactgttggaagagggcatccgaccagggttaaaggacgttgtctcggcatggcatggagatgatctgcaacagaagcagaagtagcttcggatgtctcctgtagattctattctagtacatttcattccttatttttttagcagctacattccttttttgtattggtggtgatatgaaccattaggttgtgttttgttcagcaataattgttaaggagctgagttattgtgttacaacctaatgattgttacaattttataatgaaaaaatgttgtcgatccttaaaaagggtcgagctttccaggagatccattagtagtttgatgtgtaccag

SEQ ID NO: 2333 - DNA, 4205 bp, Setaria italica
acagcacgcgaccgacctctgctcccccctccccgcatcagcaacttcccttcgccccgcatccgccctcgacccccccacccccctcctcctcctctccccgccgccgtccgccgccgcctggcggccgcctctcgcgagtccactgcagtcgccggcgacgacgaccccatgactatgatgacgccgccccctctcgagcagcagcaggaggacgaagagatgctcgtgccgcaccaggagctccccgtcgccggccccgaacccgccccgcagccgatggaagtcgtcgcgcagacggagcccgccaacacggctgagagtcagccggcggaggacccgcagacgtcgcgcttcacctggacgatcgagagcttcagccgcctcaacactaagaagcactactccgacgtgtttgtcgtcggagggtataaatggcgtgtgctgatcttccccaaggggaacaatgtggatcacttctcgatgtatttggatgtcgcggattcggggaacctcccgtacgggtggagccgttatgctcagttcagcttggccgttgtgaaccaaatccatcccaagtatacgatacggaaagatacccagcaccaatttaatgcacgtgagagcgactggggtttcacatcatttatgcctttgagtgacctatatgacccaagcaggggctatcttgtgaatgacactgttgtagtagaagctgaggtggctgtgcgaagaatggttgattattggacttacgattcgaaaaaagaaacaggttatgtaggtctcaagaatcaaggtgctacctgttatatgaactctctcctacaaacgttgtaccatataccatacttcagaaaggctgtatatcatatgccaacaactgagaatgacatgccatctgggagtattcctctggcccttcagagccttttttacaagctccagtatagtgacaacagtgtggctacgaaagagttgaccaaatcctttggatgggatacttatgattctttcatgcagcatgatgtgcaagagctcaacagagttctttgtgagaagcttgaagataagatgaagggaactgttgtggaaggaacaattgaacaattatttgaaggccaccacattaattatatcgagtgcatcaatgtggactataaatctagcagaaaagaatcattttatgatctgcaacttgatgtgaaaggttgtcgtgacgtttatgcatcatttgataaatatgtggaagtggagcgtttagagggtgataacaaatatcatgcggagcaatatggcttacaggatgcaaagaaaggtgtgctcttccttgatttccctcctgttttgcaacttcaactgaagcgttttgaatatgattacatgcgagatacaatggttaagattaatgaccgttatgagttcccgctacaacttgatcttgatagagatgaaggaaaatatctttctccagatgcagatcgtagtattagaaacctttatacgcttcacagtgttcttgttcatagtggaggagtacatggtggtcactattatgctttcattcggccgacactctcagatcagtggtacaaatttgatgatgagcgggttacgaaagaagatacgaaaaaggcacttgaagagcagtatgggggtgaggaagagttgcctcaaataaaccctggtttcaataacacgccgttcaagttcacaaagtattccaatgcctacatgcttgtctacattcgtgagagtgacaaggagaaaataatgtgtaatgttgatgagaaggatattgcggagcatttgcggataaggttgaagaaagaacaagaagagaaagaacacaagaaaaaggaaaaggctgaagcacacctctacactatcataaagattgctcgagatgaagatttaaaggatcagattggtaagaacatatattttgacctggtggaccacgaaaaagttcgcagcttccgcattcagaagcagttgccttttacttcattcaaggaggaagttgcaaaggaatatggcatacctgtacagtttcagcgcttctggttgtgggctaagaggcagaaccatacataccggccaaatcgtccgttgaccgcccatgaagaagcacaatcggtcgggcagcttagggaagtctcaaataaggcacacaatgctgagttgaagctgttcctggaagttgaacttggaccggagttacgtccaattcgtccaccagagaagagcaaagaagacatactacttttcttcaagctttatgatgctgagaaggaagagctcaggtttgttggtagacttttcgtgaaggctttgggaaagccatctgaaatattgacgaagctaaatgaaatggcagggttttctccaaatgaagaaatagagctatacgaggaaattaagtttgagccaaatgtgatgtgtgaacatattgacaagaaactaactttccgttctagtcagcttgaagatggagacatcatctgtttccaaaaggctcctgttcctgatggtgatacacaagtgcgctatccagatgttccttcattcttggagtatgttcacaataggcaggttgtgcactttcggtctctggacaaacctaaggatgatgatttttctttggaattgtcaaagcttcatacttatgatgatgttgttgagaaagttgcgcatcaacttggtttggatgatccatcaaagattcggcttacatctcacaattgttattctcagcaacctaaaccgcagcctatcagatatcggggagtagaacatctactggacatgcttgtccattataatcagacttctgatatcttgtattatgaggttctggacattccattgccagaattgcagtgtttgaaaacacttaaagttgcattccatcatgcaacaaaagatgaggttgtagttcatagcataagacttccaaagaatagcaccatcagcgacgtgattactgacttgaaaaccaaggttgaactgtctaatcctgatgctgagctccgcttgcttgaagtattttaccacaagatttataagatctttccacctcatgagaagatagagaacataaatgatcagtactggacactacgggctgaggagatcccagaggaagagaagaatcttggcccacatgatcgattgattcatgtttaccatttcatgaaagaccctaatcagaatcagcagattcagaattttggagatccttttttgatggttatccgtgaaggtgagactgctgctgaggtaatggagcgcatccaaagaaaacttagagtccccgatgaggaattctccaagtggaagcttgcattcatatccatgaaccggccagagtacctccaggatactgatgttgtatctgcacgttttcagaggagagacgtatacggtgcttgggaacaataccttggcttggagcacactgatacaacatcgaaaaggtcttacacagccaatcagaatcgtcacacctatgagaagcctgtgaaaatttataattgagaaaccatcatatggacttaactccaacaaaggcctcgttcgagtcggtctgccaaagacgataagggacgtcactaagaaaaaatggcagatgaatataatgccgcttgtgtgccaaggcctgcatgactcagcaatggcgtgaaccatcggcattactcctgttgtcgattggccaaagggtattcttttcgaggcattcccatcttgcttccgagcaaccaagcatgtgtgttggttttttcattgtgtcgagtatgatggcccctgctaggataggtgtttgcttaatttgtagagcaaaaggctagtacataaggaagaagattttggtagggggcatgtatacaggattatagccgagacttattgctgaattggcgcctctcttgtagcttggggaacaatgggagagattgtataatgggtttggtattggttccaattttccgtggtgatgagaaatgtaaggataactgcgcagatagtacagttttgagttccagcgtaggctgtcttgtttgcaaacttgcattagcacctcacagataaaacctgttgggaaaattttgcttcaacatgccgtacgagggtccagtaattcttccttcccaattgcaaactgaacacttgaaaattcatcgtagcagatcttgtactggagg

SEQ ID NO: 2334 - DNA, 4174 bp, Zea mays
aagaataagagacaaagctgggtagtcgagggtaaaaaaaaccccctccctgctcctgtctgagcttcgccgtggcgtgcccgtttcgaccctggaaaatcacgaaatcgccccgacagcacacgaccgacctgtccccccttcaccgcatcagcaacatcccctctcctccctcgctccttcttcctcctcttcccgccgccgtcgtccgccgccgccgctggcttggcggccgcctctcgtacacccatcgcagttgcgggcgacgacgaccacatgactatgatgacgccgccccctctcgagcagcagcaggaggacgacgagatgctggtgccgcatcaggagctccctgtcgctggcccagaagcagccccacagccgatggaagttgttgcgcagacagagcctgccaccacagcggagagccagccgcctgaggacccgcagacgacgcgcttcacctggacgatcgagagcttcagccgtcttaacactaagaagcactactctgatgtatttgtcgttggaggatacaaatggcgtgtcctaattttccccaaggggaacaatgtggatcacttctcgatgtatttggatgttgcagattctgggaacctcccatacgggtggagccggtatgctcagttcagcttggctgttgtgaatcagatccatcctaagtatacgattcggaaagatactcagcaccaatttaatgcacgtgagagcgactggggtttcacatcatttatgcctttgagtgacctatatgacccaagcaggggctatcttgtgaatgacaccattattgtggaagctgaggttgctgtccgcagaatggttgattattggacttatgactcgaaaaaagaaacaggttttgtaggtcttaagaatcaaggtgctacctgttatatgaattctctccttcaaacgttataccatacaccatattttagaaaggctgtatatcatatgccaacaactgagaatgacatgccatctgggagtatccctttagccctgcagagcctgttttacaagctacagtatagtgacaacagtgtagcaacgaaagagttgactaaatcctttggatgggatacctatgattctttcatgcagcatgatgtgcaagaactcaacagagttctttgtgagaaactggaagataagatgaagggaactgttgtggaaggaacaattgaacaattattcgaaggccaccacattaattacattgagtgcattaacgtggactataaatctaacagaaaagaatcattttatgatctacaacttgatgtgaaaggttgtcgtgatgtttatgcatcatttgataagtatgtggaagtggagagtctagagggtgataacaagtaccatgcggagcgttatggcttacaggatgcaaggaaaggtgtgcttttccttgatttccctcctgttttgcagcttcaactgaagcgttttgaatatgattacatgcgagatacaatggttaagattaatgaccgctatgagttccctcttcaacttgatcttgatagagacaatggaaaatatctatctccagatgcagatcgaagtattagaaacctctatactcttcacagtgttcttgttcatagtggaggagtacatggtggtcactactatgctttcattcggccgacactctcggatcagtggtacaaattcgatgatgagcgggttacaaaagaagacactaaaaaggcacttgaagagcagtatgggggtgaggaagagttgcctcaaataaaccctggtttcaataacacaccattcaaattcacaaagtattcaaatgcctacatgcttgtctatatacgtgagaatgacaaggataaaataatgtgtaatgtcgatgagaaggatattgctgagcatttgcggataaggttgaagaaagaacaagaagagaaagagcacaagaagaaggagaagtctgaagctcatctctacactatcataaagattgctcgagacaaggatttaaaggagcaaattggtaaaaatatatattttgacctggtggaccatgaaaaagtttgcagcttccgcattcagaagcagttgccttttactgcattccaggaggaagttgcaaaggaatttggcatcccagtacagtttcagcgcttctggttgtgggctaagaggcagaaccatacataccgcccgaatcgtccattgaccccccatgaggaagcacaatcagtcgggcagcttagggaagtctcaaataaggcacacaatgctgagctgaagctgtttttggaagttgaacttggaccggagctatgtccaattcgtccacctgagaagagcaaagaagacatacttcttttcttcaagctctataatgccgagaaggaagaactttgttttgtcggtaggctttttgtgaaggctctgggaaaaccgtctgaaatattgacaaaactgaatgaaatggctggattttctccaaatgaagaaattgagctatatgaggaaattaagtttgagccaaatgtgatgtgcgaacatattgacaagaaacttactttccgttctagtcagcttgaagatggagacatcatctgtttccaaaaggctcctgttccagatggtgatccacaagtgcgctatccagatgtcccttcattcttggagtatgttcacaataggcaggttgtgcactttcggtctctggacaaaccaaaggatgatgatttttctttggaattgtcaaagcttcatacttatgatgatgttgttgagagagttgcacataaacttgggttggatgatccatcaaagattcggcttacatctcacaattgttattctcagcaacctaaaccacaacctattagatataggggagtagaacatctactggatatgcttgtgcattataaccagacttctgatatcttgtattatgaggttctggacattccactgccagaattgcagtgtttgaaaacgcttaaagttgcattccaccatgcaacaaaagatgaggtggttgttcatagcataagacttccaagaaacagcaccatcagtgacgtgatcactgatttgaaaaccaaggttgaactatcaaatcctgatactgagctccgcttgcttgaagtattttaccacaagatttataagatttttccgcctcatgagaagatagagaacataaatgatcagtactggacattacgagctgaggagattccagaggaagagaagaatcttggcccacatgaccgtttgattcatgtttatcattttatgaaagaccctaatcagaatcagcagattcagaatttcggagatccttttttgatggttatccgtgaagttgagactgctgcagaggtactggagcgcatccaaagaaaacttagagttccggatgaggacttctccaagtggaagcttgcattcatatccatgaaccggccagagtacctccaggacactgatgttgtatcagcacgttttcagaggagagatgtatatggtgcttgggaacaataccttggcttggagcacaccgatacaacatcgaaaaggtcttacacagccaatcagaatcggcacacctatgagaagcccgtgaaaatttataattgagaaaacttaaagtttcaatcgattgacggaggcctcgacaacagtatgcccaagatgatgaggcttagaacagaaaaattggcagaggaatatagttgctgcctgtgctgaggcctatacaagcccatgaatgccacgtcaaccttcagtgttgttactgctgttgtctattggttcttctcgaggctttgcttccaagcaaccaagcatgtgtgttggttttttcatcgtgtctagtatgatggcccctgctaggatagtttgcttaatttgtagagcaaagcgagtacataaaaaaagatttttggtagggggcatgtatacaggattatagccgatactgattgctgccgcttgctgctgtgggaacaatggcagagattgtataatgggtttgttattggttcctaattttcgtgatgttgagaaatgtaagaggagaaccgcgtggatagtacagttttgagttccagcctaggctgtttgttgcaacttggcatatttggtataatattctgctttccacaat

SEQ ID NO: 2335 - DNA, 4272 bp, Oryza sativa
cttccttgctgcagccggaaatccccgaatcacccccctcgtcaccaccacgaccaatttccccctcccccttcccttccctctccgcatcagcaacccacccccacccctcgccgccgccgccgccgccgcagtcgcggctcccgctccccaaccgaggaatccgctgccaccgccgccgctgcgggcgcccgcgcgcgcgacgtcccgctgcctacgacgtcgcccacggctccatgactatgatgactcctccccccatcgagcagcagcagcaggaggacgaggagatgctcgtgccgcaccaggagctccccgccgccgccgctgtcgtcgccgacgccgtgcagccgatggaagttgtggcgcagacagagcctgccaacgcggcagagagccagccgccggaggacccgcagacgtcgcggttcacgtggacgatcgagaacttcaccaggatcaacgggaagaagcactactcggagccgtttgttgttggaggattcaaatggcgtgtgctgattttccctaaggggaacaatgtggaccatttctctatgtatttggatgtcgcggactcggtgaatctcccttatggatggaaccggtatgctcagttcagcttggctgttgtgaaccagatccatccgaagtataccattcggaaagatactcaacatcaatttaatgcacgtgagagtgactggggtttcacatcttttatgcctttgagtgatctgtatgacccaagtaggggctaccttgttaatgacaccgttgttgtggaagctgaggttgctgttcgcagaatggttgattactggacttatgactcgaaaaaggaaacaggatatgttggtctaaagaatcaaggagctacctgttatatgaactctcttctacaaacactgtaccatataccatatttcaggaaggctgtatatcatatgccaactactgagaatgacatgccatctgggagtattcctttagccctgcagagccttttttacaagctccaatacagcgacaatagcgtagctacaaaggagttgaccaaatcttttggatgggacacttatgattctttcatgcagcatgatgttcaagagcttaacagagttctttgtgagaaacttgaagacaaaatgaaggaaactgttgtggaaggaacaattgaacaattatttgaaggccaccacataaactatatcgagtgcattaatgttgattataaatctaacagaaaagaatccttttatgatctacagcttgatgtcaaaggttgtagtgatgtttatgcatcatttgataaatatgtcgaagtggagcgtctagagggtgataacaaatatcatgcagagcagtatggcttacaggatgcaaagaagggagtactcttccttgatttccctcctgttttgcaacttcaactgaagcgttttgaatatgattacatgcgagatacaatggtcaagattaatgaccggtatgagttcccacttcaacttgatcttgacagagatgatgggaaatatcttgctcctgatgcagatagaagcattagaaacctttacactcttcacagtgttcttgttcatagcggaggagtacatggcggtcactactatgctttcatacggcctacgctatcagaccagtggtataaatttgatgatgaacgagtaacaaaagaagataccaaaaaagcccttgaagagcagtatgggggtgaagaagagttgcctcaaataaaccctggtttcaataacaccccatttaaattcacaaagtattcgaatgcctacatgcttgtctatattcgtgagagcgacaaggataaaataatgtgtaatgttgatgaaaaggacatcgctgagcatttgcggataaggttgaagaaagaacaagaagagaaggaacacaagaagaaggaaaaagctgaagctcatctctacaccatcataaaggttgcccgagatgaggatttgaaggaacagattggtaagaatatatattttgatctggtggaccatgaaaaggttcgcagcttccgcatacagaagcaactaccttttacttcatttaaggaggaagtcgcaaaggaatgtgggatccctgtgcagtttcagcgcttctggctgtgggctaagaggcaaaatcatacataccgaccgaatcgtccactgggccctcatgaagaatcacaatcagtggggcaacttagggaggtatctaacaaggcgcacaatgctgagttgaagttgtttctggaagtagagactggagtggatctgcggcccattcgtccacctgagaagagcaaggaggatatactacttttctttaaactttataaccctgaaaaggaagaactttgttttgttggtaggctttttgtgaaggctacgggaaaaccatctgaaatcctgacaaaattgaatgaaatggctggatttgctccaaatgaagaaattgagctatatgaggaaattaagtttgagccaaatgtgatgtgcgaacacattgacaagaaactaactttccgttccagtcagcttgaagatggggacataatatgtttccaaaagtcacctgtgtcagatggggagactcaagtgcggtatccagacgttccttcatttttggagtatgtgcataatagacaggtggtgcacttccggtctttggagaaaccaaaggaggatgatttttgtttggaattgtcgaagcttcatacttatgatgatgttgttgagagagttgcacgccaacttggcttggatgatccatcaaaaattcgccttacatctcacaactgttattcccagcaacctaaaccacagcctatcagatatcgtggtgtagagcacctattggatatgcttgttcattacaatcagacttctgacatcttgtattacgaggttctggacattccactgccagaattgcagtgtttgaaaactcttaaagttgcattccaccatgcaactaaagatgaggttgtaatccatagcataagactaccgaaaaacagcaccatcagtgatgtgattactgacctaaaaaccaaggttgaactgtccaatcctgatgctgaactccgcttgcttgaagtattctatcacaagatttataagatatttccacctcacgagaaaatagagaacataaatgatcagtactggacactacgtgctgaggagataccagaggaagagaagaaccttggcccacatgatcggttgattcatgtttaccatttcatgaaagatcctaatcaaaatcagcagattcagaattttggagatccatttttgctggttatccgtgaaggtgaaactgcagcagagatattagaacgaattcagaaaaaacttcgagttcctgatgaggaattctccaagtggaagcttgcattcatatctatgaatcggcctgaatacctccaggatgtcgacgttgtatctgcacgttttcagaggagagatgtttatggagcttgggaacaataccttggcttggaacatactgacacaacaccaaaaaggtcttatacagccaatcagaatcgtcacacttttgagaagcctgtgaaaatttataattgagaagatttatagctgggcttgaagccctgaacaaaggcctcgtctggatagcatgccatgccaaagagagatcacaaagtaagacaacctcaacagaagaaacatggcaacaaaacatatggccattacgctgaggcctatattgcttcccgctggttgacgccgttggtgcagcttactcgtgatgtagtgggcgtcagggattttttttcaaggctttccatcttgtttccgggcaaaacaattgtgtcgagtgtgatggccccgctaggataaggtagatgttgctttatttgtgtagagcaaagctggtacataagaaaaagattttggtaggggcatgtatacagaattatagccgtgactgattgctttatttgcttctcccgtttctgttagccttggagcagtgggagaatcgtataatggggtttggtgttggttccaattttccatgtctattgataaaatgtaagagaataatttgccagatagtgcagctttcagttcctgttagcataaccttgtgtcggtgctgttctattcgttgtgatttgacaacccatgaagatcagtttacagtctgtcatttgcttgtaaaattacgtggaacccttgttttaatccaatatctttgcttgtcatcgcttgtgcaaac

SEQ ID NO: 2336 - DNA, 4381 bp, Brachypodium distachyon
ggcccctgctggaccccggaaatccccgaaccacccctcgacaccacgcgaccatttccgtttccattccacccacgcagcagcacccgccccccctcgcaatccctcgtcgtcctccgcctcacgccgcccgccgttcgccgccgccgccgccggctcgcgcgcggcagccacctgctcccgggccgccacctcacccgcggccaccgccgcccaagcgacgacggctccatgactatgatgacccctccccctctcgagcagcagcaggaagacgaagagatgctcgtgccgcaccaggagctccccgccgccgacgccgcgcagccaatggaagtggtggcgcagaccgaacctgtgtctatggcggagaaccagccaccggaggacccacagacgtcccggttcacctggacgatcgacaacttcaccagactcagcggaaagaagcactactcggatgtgtttgtcgttggtggatttaaatggcgtgtgctgatcttccccaagggaaataatgtggagcatctctcgatgtacttggatgttgcggactcggggaacctcccgtatggttggagccggtatgctcagttcagcttggccattgtaaaccaggtccaccagaagtatacgacacgtaaagatactcaacatcaatttaatgcacgcgagagtgattggggtttcacatcttttatgcctttgagtgagctttatgacccaagtaggggctatcttctgaatgacaccgttgttatcgaagctgaggttgccgttcgcaaaatggttgactattggacttatgactcaaaaaaggagacaggttatgttggtctcaagaatcagggagctacctgttatatgaattctcttctgcagacattgtaccatataccatacttcaggaaggcggtatatcacatgccaactactgagaatgacatgccatctggaagcattcctttagctctgcagagccttttttacaagctccagtatagtgacaacagtgtagctaccaaagagttgaccaaatcttttggatgggacacttatgattctttcatgcagcatgatgtgcaagagctcaatagagttctttgcgaaaaacttgaagacaagatgaaggggactgttgtggaaggaaccattgaacaactatttgagggtcaccacattaattacattgagtgcattaatgttgactataaatctaacagaaaagagtccttttacgatttacaacttgatgtcaaaggctgtcgtgatgtttatgcatcatttgataaatatgttgaggtggagagtctagatggtgataacaaatatcaggcggagcaacatggcttacaggatgcaaaaaagggtgttctcttccttgattttcctcctgtcttgcaacttcaactgaagcgttttgaatatgattatatgcgagatacaatggttaagattaatgaccgttatgagttcccgctacaacttgaccttgatagggatgatgggaagtatcttactccagatgcagatagaagtattagaaacctttacactctgcacagtgttcttgttcatagtggaggagtacatggtggtcactactatgctttcatacgaccaacactctcggatcagtggtataaatttgatgatgagagagtaacgaaagaagacactaaaaaagcgcttgaagagcagtacggcggcgaggaagagttgcctcaagtaaaccctggtttcaataacaccccatttaagttcactaagtattcaaatgcctacatgcttgtatatattcgtgagagcgacaaggagaaaataatgtgtaacgttgatgagaaggacattgctgagcatttgaggataaggttgaagaaagaacaagaagagaaagaacataagaagaaggaaaaagctgaagctcacctctacactatcataaaggttgctcgagatgaagatttgaaggagcaaattgggaaaaatatatattttgatctggtggaccatgaaaaagtccgtagcttccgtatacagaaacaattgccattcacttcattcaaggaggaagttgcaaaggaatatggaattcctgtacagtctcaacgcttctggttgtgggcaaagaggcaaaaccatacataccggcccaatcgtccgctggcacctcatgaagaaacacaatcagtggggcaacttagggaggtctcaaacaaggcacacaacgctgagttgaagctatttctagaagtagagctagggctggatttgcgtccaattcgtcctcccgagaagagcaaggaagatattctacttttcttcaagctttacaaccctgaaaaggaagagcttcgttttgttggtaggctttttgtgaaggcattaggaaagccatctgatatcctgacaaaattaaatgaaatggctggattttccccaaacgaagaaattgagctatatgaggaaattaagtttgagccacatgtgatgtgtgaacatattgacaagaaacttactttccgttctagtcagcttgaagatggggacataatatgtttccaaaagccatctgtaccagatgctgatactcaattgcgatatgcagaagttccttctttcctggagtatgttcataataggcaggttgtgcactttcggtgtctggagaagccgaaggaagatgatttttgtttagaattgtcaaagcttcatacttatgatgatgttgttgagagagttgcaagtcaactcagcttggatgatccatcgaaaattcggcttacatctcacaattgctattctcagcaacctaaaccgcaacccatcagatatcgtggagtagagcatctattggatatgcttgtccattataatcagacttctgacatattgtattatgaggttctggacattccactgccagaattgcagtgtttgaaaacacttaaagttgcatttcaccatgcaacgaaagaagaggttgtaattcatagcataaggcttccaaaaaacagcaccatcagcgatgtgataactgacttgaaaacaaaggttgaactatcgaatactgatgctgagctccgattgcttgaagttttctaccacaagatttataagatatttccacttcaggagaagatagagaacataaatgatcagtattggacactacgtgctgaggagattcctgaggaggagaagaatctcgctccacatgatcggttaattcatgtctatcatttcatgaaagatcctaatcagaaccagcagattcagaatttcggagatccctttttactggttattcgtgaaggcgagactgcatcagaggtaatggagcgtgtgcgaagaaaactccgagttctggatgaggaattctcaaagtggaagcttgcgttcatatccatgaatcgtccggaatacatccaggatactgatgttgtatctgcacggtttcagaggagagatgtttacggagcttgggaacaataccttggcttggagcacactgatacaacaccaaaaaggtcttacacagccaatcagaaccgacacacatacgagaagcctgtgaagatttataattgagaaaccttccacctggggtgcaagcccttgacaaagacctcatcggagatagcatctcaaagaggttctcaaagtgacctcctggaagaaaattggcggttggaaaatatggccatttatgtgctgtggctaatattacttgctcctggttaacgccgtcgctgtgattgacagcaggataattttcaaggctttccctcttgcttgctcccacgcaaagaagcaagcgtaatgattaattagttgtgccgagtgtgatggcccccgctaggatagatgttgctttatttgtgtagagtaaagctggtacataaaaagaagattttggtaggggcatgtatacatggttatagccaagactggttgctttatgtgccactgacgtttatcgtggcatcggaagaatggggtagattgtacaacaggtttggtgctggtttcagtttttggtctctgttgagaaatattagataataactgccgcagatagtacagcttcatcagttccagcacagcctatgttgttggcatcattttgattcaacttagcagcttctgatgctgctgctacattctatttttctctccccttgtagaatggaaaagaagtcttctgatccaataactgtactcaactaatgagcaagttgcttagttgcgacttaaaatataaccgctcatcataaggccatactaataaagctacatgtactccgtatgtttttttttatcttctggagatagttgaatctgagaaagcaagcagaaaataaaatcttgttgagaaatg

SEQ ID NO: 2337 - DNA, 4057 bp, Secale cereale
gactccaaacgttcggcttcgaagctcttcacctcgctgacagcccaagagagcatgacgtgaaaatttagaatttgtcatctcctcttgctgtgacctgctggacccgggaaatcccctcgaccatttcccccaagctcctcgccgtccgccgcctcacgccgcacgccgcccgccgccgctgcctggtcgcgcgcggcagccgcctcccagatcgctaccccatcaccggccaccgccgccagcgacgacggctccatgactatgatgaccccttcccctctcgagcagcaggaggaggacgaagagatgctggtgccacaccaggagctttccgccgcagacgccgcgcagccaatggaagtggcggcgcagacggatcctacgaatacggcggagagccaagcacctgaggacccgcagacttcccggttcacctggacgatagagaacttcaccagggtcagcgggaagaagcactactcggatgtgtttgtcgttggtggatttaaatggcgtgtgctaattttccccaagggaaataatgtggaccatctctcgatgtacttggatgttgcagactcggggctcctcccttacggatggagccggtatgctcagttcagcctagccattgtaaaccagatccatcagaagtatacagcacgcaaagatactcaacatcagtttaatgcacgtgagagtgactggggtttcacatcttttatgcctctgagtgaactgtatgacccaagtaggggctatctcgtgaatgatactgttgttgttgaagctgaggttgctgttcgcaaaatggttgactattggacttatgactcgaaaaaggaaacaggttatgttggtctcaagaatcagggtgctacctgttatatgaactctcttctgcaaaccctgtatcatataccttactttcggaaggctgtatatcacatgccaactactgagaatgacatgccatctgggagtattcctttagccctgcagagccttttttacaagctccagtatagcgacaatagtgtagctacaaaagagttgactaaatctttcgggtgggacacttatgattctttcatgcagcacgatgtgcaagagctcaacagagttctatgcgagaaacttgaagacaaaatgaagggaactgttgtggaaggaacaattgaacaactatttgaaggccaccacattaattacatcgagtgcattaatgttgactataaatctaacagaaaagagtccttttatgatctacaacttgatgtcaaaggttgtcgtgatgtttatgcatcatttgataaatatgtcgaagtggagcgtctagagggtgataataaataccaggctgaacaacatggcttacaggatgcaagaaagggtgtactctttcttgatttccctcctgttttgcaacttcaactgaagcgtttcgaatatgattacatgcgagacacaatggttaagattaatgaccgttatgagttcccgctacaactcgatcttgataaggatgatgggaaatatcttactccagatgcagatagaagtatcaggaacctttatactcttcacagtgttcttgttcacagtggaggagtacatggtggtcactactatgctttcatacgacctacgctctcagaccagtggtataaatttgatgacgagcgagtaacaaaagaagatactaaaaaagcgcttgaagagcagtacgggggcgaggaagagttgcctcaagttaaccctggtttcaataataccccatttaagttcacaaagtattcaaatgcctacatgcttgtatatattcgtgagagtgacaaggagaaaataatgtgtaatgttgatgagaaggacattgccgagcatttgaggataaggttgaagaaagaacaagatgagaaagaacacaagaaaaaggaaaaagctgaagctcacctctacaccatcataaaggttgctcgagatgaagatttgaaggagcagattgggaagaatatatattttgatctggtggaccatgaaaaagtccgtaattttcgtatacagaaacagttaccctttaattcattcaaggaggaagttgcaaaggaatacggcattccggtacagtctcagcgtttctggttgtgggctaagaggcaaaatcatacataccggcccaatcgtccactggcccctcatgaagaagcacaatcagtggggcaacttagggaggtatcaaacaaggcacacaatgctgagctgaagctatttcttgaagtagagataggattggatttgcgcccaattcatcctcccgagaagagcaaggaagatattttactattcttcaagctttatgatcctgaaaaggaagagcttcgttttgttggtaggctttttgttaaggctttgggaaagccatctgatatcctgacaaaacttaatgaaatggctggattttccccaaatgaagaaatcgaactttatgaggaaattaagtttgagccgaatgtgatgtgtgaacatattgacaagaaacttagtttccgatctagtcagcttgaagatggggacataatcagtttccaaaagccatctataccaggtggcgatactcaagtgcgctataaagatgttccttctttcttggagtatgttcataataggcaggttgtgcacttccggtgtctggagaaaccaaaggaggaggaattttgtttggaattgtcgaagcttcatacttatgatgatgttgttgagagagttgcgcgccaacttggattggatgatccatcaaaaattcggcttacgtctcacaattgctattctcagcaacctaaaccacagcccatcagataccgtggagtagagcatctattggatatgcttgtccattataatcagacttctgacatactgtattatgaagtcttggacattccactgccagaattgcagtgtttaaaaacacttaaagttgcatttcaccatgcaacgaaagacgaggttgtaattcacagcatcaggctttcgaaaaatagcaccatcagtgatgtgatcactgacttgaagaccaaggttgaactatccaatcctgatgctgagctccgcttgcttgaagttttctaccacaagatttataagatatttccacctcatgagaagatagagaacataaatgatcagtactggacactacgtgctgaggagattccagaggaggagaagaatctcactgcacaggatcggttgattcacgtctatcatttcatgaaagatcctaatcagaaccagcagattcagaattttggagatccctttttgctggtcatccgtgaaggtgagactgccgcagaggtcatggaccgtgtgcagaaaaaactccgagttcccaatgaagaattcgccaagtggaaggttgcattcatatccatgaatcgtccagaatacctccaggatattgatgccgtgtctgcacgttttcagaggagagatgtttatggagcttgggaacaataccttggcttggagcatactgacacaacacccaaaagatcctacacagctaatcagaatcgacacacatatgagaagcctgtgaagatttacaattgagaaaccttccatctgggctgcaagcctcgacaaaggcctcatccgaaaaagtatgctagaggccaagatagctcaacagaagggaaatgctgtcaaatatatggtcatttgtgggccaaggcctatattacttgctacttgttgacagtcggtgctgtgacactcaggctttccctcttgcctgctccctgacagtgaagcaagcatgctgatttcgttgtcctgagtgtggccccactaggatagatgttgcttcgtttgtgtagagcagagctggtacataaggaaatgattttggtagggcatgtatacatggttatagccaagactgattgctttatttgccgctcctgttattggggcattggaacaatgggatagattgtataatgggtttgtggctggttccagtttttggtatccattttgaatgtaggaa

SEQ ID NO: 2338 - DNA, 4258 bp, Oryza sativa
ctcgatctctctctctctctctctctctctctctttctcgctcacctgcgctgcgagcctgcggcacacgaaatccccaaaccacccccaaccttccaaaactcccaaactcctccattcctcgtcgcactcccccctcccttctcctccgcccccgactcgctgcttccacctccacccgctgctctcctctccgccgccgccgccgccgccgccgccgcggaggccgtacgccaccgctctcaccgacgccgacgacctgcaggcgcccctctccatgactatgatgacgcctcccccgctcgagccggaggaggacgagatgctcgtgcctcaccaggagctcgtcgctgctgacgccgcccagcccatggaagtggttgcgcaaacggaggcagctagcacggcggagagccagccagctgaggacccgcagacgtcgcggttcacgtggacgatcgagaacttcacccggatcaatgcgaagaagcactactcggatgcgtttgtcgttggcgggtacaaatggcgtgtgctcattttccctaaggggaacaacgtggaccatttctccatgtacttggatgttgccgactctgctaacctcccatatggttggagccgatatgctcagtttagcttggccgttgtcaaccagatccaacagaagtatacgatacgcaaagatactcagcatcaatttaatgcacgtgagagtgattggggtttcacatcttttatgcctttgagtgagctctatgatccaagtagaggataccttgtcgatgatactgttgttgtggaggctgaggttgctgtccgcaaaatggttgattattggacatatgattcaaaaaaagaaacaggttacgttggcctgaagaaccaaggagctacctgttacatgaactctctactacagacactataccatataccatacttcaggaaggctgtgtatcatatgccaaccaccgaaaatgatatgccatctgggagtattccgttggcattgcagagccttttctacaagctccagtatagtgacaatagtgtagccaccaaagagctgaccaaatcttttggatgggacacatatgattccttcatgcaacatgatgtacaagagctcaacagagttctctgtgagaaacttgaagataagatgaagagaactgtcgtagagggaacgattgaaaagttattcgaaggtcaccacatcaattatatagagtgtataaatgttgactataaatccaacaggaaggagtccttttatgaccttcaacttgatgttaaaggttgtcgtgatgtgtatgcatcgtttgataaatatgttgaagttgagcgcctcgaaggtgataataagtatcatgcagagaatcatggtttacaggatgcgaaaaagggtgttctgttccttgatttccccccagttttgcaacttcaactgaagcgttttgagtacgactatatgagagataccatggttaagattaatgaccgctatgaattccctttgcaacttgatttggatagagatgatggaaaatatcttgctccagatgcagatagaagtataagaaacctttatgctcttcacagtgttcttgttcatagtggaggagtacatggcggtcactactatgccttcattcgaccaacgctatcagatcaatggtataaatttgatgatgagcgtgtaactaaagaagatactaagaaggcccttgaagagcaatacgggggtgaggaagagttgcctcaaataaatcctggtttcaacaacgctccatttaaattcacaaagtattcaaatgcctacatgcttgtctacatccgtgagagtgataaggacaaaataatgtgtaatgttgatgagaaggacattgctgagcatttaagggtaaggttgaagaaagaacaagaagagaaagaacacaaaaagaaagagaaggctgaagctcatctttataccatcataaaggtggctcgagatgagaatttgaaggagcaaattggcaaggatatatattttgacctggtggaccatgaaaaagttcgtagcttccgaattcagaagcagttactgtttaccactttcaaggaggaagttgcaaaggagtatggcatccctgtacaatttcagcgcttctggttgtgggctaagaggcagaaccacacatacaggcctaatcgtccattgagtcctcatgaagaaacacaatctgtgggacaactgagggaggtatcgaataaggcacacaatgctgagctgaagttgtttttggaagtagaacttggcccggatttgcggcctctccctccacctgagaagagcaaggaagatattcttctgttcttcaaactctataatcccgaaaaggaagaactctgttttgtggggaggctcttcgtaaaggccttgggaaaaccctcagaaatcttgaccaaactaaatgaaatggctggatttgtgccaaatgaagaaattgagctctacgaggaaattaaatttgagccaaatgtgatgtgtgaacatattgacaaaaaagccactttccgtgctagtcagcttgaagatggggacatcatctgtttccaaaaatcacctatacctgatagtgacactcaaatgcgttatccagatgtcccttcgtatctggagtatgttcataataggcaggttgtgcactttcggttattggagaaaccaaaggatgatgacttttctttggaattgtcaaaacttcatacctatgatgatgttgttgagagagttgcccgtcagcttggtgtggatgatccagcgaaaattcgtctaacatcccataactgctattcgcagcagcctaaaccgcaacctatcagatatcggggagtggagcatcttttggacatgctcattcattataatcagacatcagacatattgtattatgaggtgttggatattccactgccagaattgcagggcctgaaaaccctgaaagttgcattccaccatgctacaaaggatgaggttgtgattcacagtatcaggcttccaaagaatagcaccattgcagacgtgattaatgatttgaaaacaaaggttgaactatccagtcccagtgctgaattgcgcttgttagaggtcttttaccacaagatatataagatttttccactccatgagaagatagagaatattaatgatcagtactggacactacgtgctgaggagattccagaggaggagaaaaatctcggtccaaatgatcggttaattcatgtttatcacttcatgaaagaccctcttcagaatcagcagattcagaactttggagatcctttttatcttgctatccgtgaaggtgagactttagcagaagtaaaggagcgcatacagaaaaaactccaagtccctgatgaggaattctgcaagtggaaattcgctttcatatccatgaaccggccagattacctccaagattcagatgttgtatctgcccgtttccagaggagagatgtctatggagcctgggagcagtatcttggtttggagcatgctgatactgcaccaaaaagggcctacacagccaatcagaaccgtcacacctatgagaagccagtgagaatttacaattgaaatcacttctgactgtgctggccccttggtggtgtcaaatctgaaagcagcaacagagagatgtagtatggagaagttaaactcgaacagggaaaagcagcaacaagttttggccatttgggtgccgtggcctctattcctttctaccggtgctgtttggatgcagaagtgcacttgatttcattgttcatgatgacaaatttttcatgattttccaccatgctttggggcaatggtgcgtgctattgaatttccttaagttgggtgtgaatgcccccttagggtagatgttgcttcatttttagagcaaagtttcggtacataagattttggtaggggggcatatgtatacagggtatagttctgactcatatcgacttcttgtctttgtgtggatgtaacaatggaaaacatcataccaatcttgctgtatggctcaattttatcttcctttcgcagaaaaaattaaccagaattactgccgcagttagtgcggcgctgggttccgtgatagtaatagctgatgtaagcgtggatatgatgtaattcaccagaaatatgaaatatcccgatttccttcgagaaacaaatatgaaatatcattgaaatgtggtacttcttttttcc

SEQ ID NO: 2339 - DNA, 3934 bp, Triticum aestivum
cccacagcccaactcccatctgctccgcctcgccgcatcctctccagcccttgcccccgccggctccggctccgcccgcctctctgcggccgcgtccaaagacgaccacggttattacgacgccgatatgactatcatgactcccgcccctctcgagcaggagaacgacgagatgcttgttccccaccaggagctagccaccgccgatgcagacactgcccagcccatggaagtggtggcacagacggaagcggcaagcacagccgagagccagccttctgaggacccacagacatcgcggttcacttggacaatcgcaagttttacccggctcaacgggaagaagcactactctgatgtgtttgccgtcggtgggtacaaatggcgtgttcttattttccccaaggggaataatgtggagcacctgtcaatgtacttggacgtcgctgactcggccaatctcccatatggttggagccgttctgcccagtttagcttatctgttgtaaaccagattgatcagaagtatacgacacgaaaagatactcaacatcaatttagtgcacgtgagagtgattggggtttcacttcttttatgcctttgagtgagctatatgatccaagtagaggttaccttgtgaatgatactattgttgtggaggcagaggttgctgtccgcaaaatggttgactattggacatatgactcaaaaaaggaaacaggttatgttggtttgaaaaaccaaggagcgacctgctatatgaactctcttctacaaacattgtaccacataccatacttcagaaaggctgtgtatcatatgccaaccaccgaaaacgacatgccatctggaagtattcccttggcgctgcaaagccttttttataagctccagtacagtgacaacagtgtagctacaaaagagttgacgaaatcttttggatgggacacatatgattccttcatgcagcatgatgtacaagagctcaacagagttctctgtgagaaacttgaagataagatgaagggaactgttgtagaaggaacaatcgagcaattatttgaaggtcaccacattaattatattgagtgtataaacgtggactataaatctaacaggaaggagtccttttatgaccttcaacttgatgtcaaaggttgtcgtgacgtgtatgcatcgttcgataaatatgttgaggttgagcgtctcgagggcgataacaagtatcatgcagagaatcatggtttacaggatgcaaaaaagggtgttctcttcctcgatttcccccctgttttgcaacttcagctgaagcgttttgagtacgattatatgagagataccatggttaagattaatgaccgctacgagtttcctttgcaacttgatctggatagagatgatggcaagtatcttgctccagatgcagatagaagtataagaaacctttatactctccacagcgttcttgttcatagcggaggagtacatggtggtcattactatgcattcatacggccaacgctagcagatcaatggtataaatttgatgacgagcgtgtaacaaaagaagatactaaaaaggcctttgaagagcagtatgggggtgaggaagagttacctcaaataaaccctggattcaacaacactccattcaaattcacgaagtattcaaatgcctacatgcttgtatacatccgtgagagtgacaaagagaaaataatgtgtaatgttgatgagaaggacattgctgaacatttaaggataaggttgaagaaagaacaagaagagaaagaacataagaagaaagaaaaagctgaagcccatctctataccatcataaagattgcccgggatgaggatttaaaggagcaaactggtaaggacatatattttgatctggtggaccatgaaaaggtccgtagcttccgaatacagaagcaattgccatttagtactttcaaggaggaagttgcaaaggaatatggcatcccagtacagtttcagcgcttctggctgtgggctaagaggcaaaaccatacatacagaccaaatcgcccattgaatcctcatgaagaaatgcaatctgtggggcaactgagggagatatcaaataaggcacagaatgctgaactgaagctgtttctggaagtggaatttggactggatttgcagcctcttcctcctcctgagaagagcaaggaagatattcttcttttcttcaaactgtacaatcccgaaaaagaagtgctttgttttgtggggaggctctttgtaaaggccttggggaaaccttcagatattctgagaaaactaactgaaatggctgggtttaccccggatgaggagatcgagctatatgaggaaattaagtttgagccaaatgtaatgtgcgaacatattgacaagaagcttactttccgtgctagtcagcttgaagatggggacatagtctgtttccaaaagtcacctaaagcagacagtggtactcaagtgcgctatcctgacgtcccttgattttggagtatgttcataataggcaggttgtgcactttcggtcgttggagaaaccaaaggatgatgaattttgtttggaattgtcaaagcttcacacatacgatgatgttgttgagagagttgcccaccagcttgggttggatgatccagcgaaaattcgccttacatcccataactgctattcacagcagcctaaaccgcaacccatcagatatcagggtgtggagcatttattggacatgctcgtccactataatcagacgtctgacatcttgtattacgaagtattggatattcctttgccggaattgcagttccttaaaacccttaaagttgcattccaccatgctacaaaggaggaggttgtcattcacagcatcaggcttcctaagaacagcaccattgctgatgtgataattgacttgaaaactaaggttgatctatccagtcccactgccgagctacgcgtgctagaggtcttttaccacaagatctataagatctttccacttcacgagaagatagagaatataaatgatcagtactggacgctacgtgctgaagaggttccagaggaggagaaaaatcccagtcagaatgatcgcttaatccatgtttatcacttcgcgaaagattctcttcagaatcaacagattcagaattttggagatccttttttcttgccatccgtgaaggtgagactttagcggaagtaaagagccgcatacagagaaaactccaggtccctgatgaagaattctccaagtggaaatttgcattcatatctatgaatcggccagactacctacaagattctgatgttgtatctgctcgtttccagaggagagatgtctatggagcttgggaacaatatcttgggctggagcatactgacactgcaccaaaaagggcctatacagccaatcagaaccgtcacacgcatgagaagccggtgaggatatacaattagtacgccttaaaactgtgttggtcccctgatgaaggcgttgatctgggagtggaaaaggagtaggctgcaacaggtgaaagcagcagcatgtttggccatttgggtgctacagtttttgctcttgatgcatggccatgacgatttttcaaggttcatcatcgcaagggtgcacgatatcaagtttctgtaaattgggtgtaaaggccaccctcctaagggtagatgttggatgttggttcatttttagagcaaagtcgagtacatatgatattggtagtgggcttgtatacaagggtatagttttgcgacttgatattggcatttgttgtaatctggcgataatgggagactaatggactttttcttggtttaagtagctgcagtagtaaaaatgttttttgcgggtgtgcagtagtaaaattgttagtcacatttgactaacatactac

SEQ ID NO: 2340 - DNA, 4387 bp, Brachypodium distachyon
ccactccctccgtaaagaaaaagagaggatcgaaatcagccttcccttccaaaaactcaagtcctccataccgcaacccgtacctccccaaaaccggcggccactctcctcccccctcctcccccacaccccgcctccaatctgcttccgcctcgccgcatcctctccgtgcccgccccagccgtcgccgaccccgtccgccgcttccccggccgctgttttcaccgacgcggggcgccggcatgactacgacgactcccgcccctctcgagcaggaggacgaggagatgctcgtgccccaccaggaggtcgccgccgtcgccgctgacgctgcccagcccatggaagtggtggcgcagacagaggcggtaagcacagctgatagccagccaccggaggacccgcagacgtcccgtttcacttggacaatccagaattttaccaggctcatcgggaagaagcactactcagatgtgtttgtcgtcggcgggtacaaatggcgcgttcttattttccccaaggggaataacgtggagcacttgtcaatgtacttggacgttgccgactcggctaacctcccgtatggttggagccgctccgctcaatttagcttggcaattgtgaaccagatcgatcagaagtatacgacacgaaaagatactcaacatcaatttagtgctcgcgagagcgattggggtttcacatcttttatgcctttgagtgagctatatgagccaagtagaggataccttgtgaatgatactattgttgtggaggcagaggttgctgtccgtaaaatggttgactattggacatatgactcaaaaaaggaaacaggttatgttggtctgaaaaatcaaggagctacatgttatatgaattctcttctgcaaacattgtaccacataccatacttcaggaaggctgtctatcatatgccaaccaccgaaaatgacatgccatctggaagtattcccttggcgctgcagagcctcttctacaagctccagtacagtgacaacagtgtggctacaaaagagttgaccaaatcttttggatgggacacatatgattccttcatgcagcatgatgtacaagagctcaacagagttctctgtgagaaacttgaagataagatgaagggaactgttgtagaaggaacaatcgaacaattatttgaaggtcaccacattaattacatcgagtgtataaacgtggactataaatccaacaggaaggagtctttttatgaccttcaacttgatgttaaaggttgtcgtgatgtgtatgcatcgtttgacaaatatgttgaagttgagcgtcttgagggtgataacaagtaccatgcagagaaccatggtttacaggatgcaaaaaagggtgttctcttcctcgatttcccccctgttttacagcttcagttgaagcgttttgagtacgactatatgagagataccatggttaagattaatgaccgctatgagttccctttgcaacttgatctggatagagatgatggcaagtatcttgctccagatgcagatagaagtataagaaacctttatactcttcacagtgttcttgttcatagtggaggagtacatggtggtcactattacgcattcatacgaccaactctagcagatcaatggtataaatttgatgatgagcgcgtaacaaaagaagatactaagaaggcattcgaagagcaatatggcggtgaggaagagttacctcaaataaaccctggattcaacaacacaccatttaaattcacgaagtattcaaatgcctacatgcttgtatacatccgtgagagtgacaaagagaaaataatgtgtaatgttgacgagaaagacattgctgagcatttaaggataagattgaagaaagagcaagaagagaaagaacataagaagaaagaaaaagctgaagctcatctctataccatcataaagatagctcgagatgaggatttgaaggagcaaactggtaaagatatatattttgatctggtggaccatgaaaaagtccgtagcttccgaatacagaagcaattgccatttaatactttcaaggaggaaatagcgaaggagtatggtatcccagtacagtttcagcgcttctggttgtgggctaaaaggcaaaaccatacataccggccgaatcgtccgttgactcctcatgaagaaacacaatctgtggggcaactgagggagatatcaaataaggcacagaatgctgagctcaagcttttcttggaagtggaatttggactggatctgcagcccctccctcctcctgagaagagcaaggaagatattcttctctttttcaaactctacaaccccgaaaaggaaacgctttgttttgtggggaggctcttcgtaaaggccttggggaaaccttcagatatcctgagaaaactaaatgaaatggctgggttcacgccagatgaagagatcgagctgtacgaggaaattaagtttgagccaaatgtgatgtgcgaacatattgacaagaaacttactttccgttcttgccagcttgaagatggggacatagtctgtttccagaaatcacctaaagcagatagtgatactcaagtgcgctatccggatgttccttcatttttggagtatgtgcataataggcaggttgtgcactttcggtctttggagaaacctaaggatgacgatttttgtttggaattgtcaaagcttcacacatatgatgatgttgttgagagagttgcccgccagcttgggctagatgatccagcaaaaattcgtcttacatcccataactgctactcacagcagcctaaaccgcaacccatcagatatcgaggcgtggagcatctactggacatgctcatccactataatcagacgtccgacatcttgtattatgaagtgttggatattccattgccggagttgcagttcctgaaaacccttaaagttgcattccatagcgctacaaaagatgaggttgtcattcacagcatcaggcttcctaagaatagcaccattgctgacgtgattaatgacttgaagaccaaggttgatctatccagtcccagtgctgaactgcgcttgctagaggtcttttaccacaagatctataagatctttccacttcatgagaaaattgagaatataaatgatcagtactggacgctgcgtgctgaggagattccggaggaggagaaaaatcccagtccacacgatcgcttaattcatgtttatcatttcactaaagatcctcttcagaatcagattcagaactttggagatcctttttttcttgctatccatgaaggtgagacattagcacaagtaaaggagcgcataaagagaaaactccaagtcgctgatgaggaattctccaagtggaaatttgcattcgtgtctatgaatcggccagactacctcgaagattcagatgttgtatctgcccgctttcagaggagagatgtctatggagcttgggaacaatatcttgggttggagcacactgatactgcaccaaaaagggcctacacagccaatcagaaccgtcacacacatgagaagccagtgaaaatttacaattgaggtgtctgtacgattgtgaagctggtcccatgatgatggcgttgatatgaaagtggaaaaggagaagctgtttatggggaatacggactgtaacaggggaaatcaacaaaatgtttggcctttgggtgtcatggcatatctatcgcgtttgctactggttgctctggacatgtgctcatgaagctgatttttttcaagatttttcatcttgcattctgtgcaagggtgtatgcatatctagtttccttaagttgagtgtaaaggccaaccccctagggtagatgttgcttcatttctagagcaaaattgggtacataagattttggtagggggcgtgtatacaggggtatagttctgacttgatattgacatttgttgtaatctagtggcactgtaatactgtataatgggtttgttcgtttcaaatttagtgccatagaaatatgggtgataattattgctgcagtggatctaatctggagttccatgatagcgagtgtaagcatcgaaaccattttcatgtgtttttttccccttcagttctcgacacacaattattttctgtaggccccatttggcagtgtaatacattaggttgatcctgctgggtttggtttcttttacatactctgtttcataattcctgtctcaaatttgcctagaaattgatgtatctatttctaaagtgtctagatacatgtaatattttgataaaattatggaatggagggaaagaattatagaatggagggataaaattatggaatggagggaaagaattatagaat

SEQ ID NO: 2341 - DNA, 4392 bp, Sorghum bicolor
gtcttccaaactgcgtgagcttttctcgcacccgtacttccccctccactccggctaggaggctgctccctccgccgcgccgcctccaccgcgctttccgtcgtctccggctccgtccccggatatctcttcaccaccgctgcctgcgccgcggcgccgacaccaccgaaggagacccagtcgccttcatgactatggtgactcctcccactgtcgagcatgaggacgaggagatgctcgtgcccgcccaggaggtggccgccgccgacaccgacgcagcacagcccatggaagtggtggcacagactgaggtggtgagcacggcggagagccagcctgtggaagatccgcagacatcgcggttcacatggacaattgagaacttcaccaggttcaatgggaagaagcactattcagaggtttttgtcgttggcggattcaaatggcgtgtgctgattttccccaaggggaacaatgtggaccatttctcaatgtacttggatgttgctgactcagccaacctcccgtatggttggagccgctatgctcagtttagtcttgctgttgtaaaccagatccagccgaagtatacgatacgcaaagatacccaacatcaatttaatgctcgtgagagtgattggggtttcacatcttttatgcctttgagtgacctctatgatgcaagtagaggttaccttgtgaatgatactgttgttgtggaggccgaggttgctgtccgcagaatggttgactattggacatatgactcaaaaaaggaaactggttatgtgggtctgaaaaaccaaggagctacctgttatatgaactcccttctacaaacactataccatataccgtacttcaggaaggctgtgtatcatatgccaaccactgaaaatgacatgccatcaggaagtattcctttggcactgcagagccttttctacaagctccagtacagtgacagtagtgtagctacaaaagagctgaccaaatcttttggatgggacacatatgattctttcatgcagcatgatgtacaagagctcaacagagttctctctgagaaacttgaggacaaaatgaagggaactgtcgtagaaggaacgattgagcaattatttgaaggtcaccacatcaattacattgagtgtataaatgttgagtataaatctaaccgcaaggagtccttttatgatcttcaacttgacgtcaaaggttgtcgtgacatttactcgtcatttgataaatatgttgaagttgaacgcctagagggtgataacaagtatcacgcagagaatcatggtttacaggatgcgaagaagggcgttcttttccttgattttccccctgttttgcaactccagctgaagcgctttgagtatgattatatgagagacaccatggttaagattaatgatcgctatgagttccctctgcaacttgatctggatagagatgatggcaaataccttgctccagatgcagatcgaagtacaagaaacctttacactcttcacagtgttcttgttcatagcggtggggtacatggtggtcactactatgcattcatacggccaactctatccgagcaatggtataaatttgatgatgagcgtgtaacaaaagaagatgctaagaaggctcttgaagagcaatatgggggtgaggaagagttgccccaaataaaccctggtttcaacaatgctccatttaaattcacgaagtattcaaacgcgtatatgcttgtttatattcgtgaaagtgacaaggagaaaattatgtgtactgttgatgaaaaagacattgctgagcatttaagggtaaggttgaaaaaagaacaagaagagaaagaacacaaaaagaaagaaaaagctgaagctcatctttataccataattaaggtagctcgagatgaggatttgaaggaacaaattggaaaggatatgtattttgatttggtggaccatgaaaaagtccgtaatttccgtatacagaaacaaatgccttttagttctttcaaggaggaagttgccaaggaatatggcatccctgtgcagtttcagcgcttctggttgtgggccaagaggcaaaaccatacataccgccctaatcgtccattgacccttcatgaggaaacacaatctgtggggcaactgagggaggtatcaaataaggcacacaatgctgagttaaagctgtttttggaagtagaagttgggctggatttgcggcctctccctcctcctgagaagggcaaggaagatattcttcttttcttcaaactctacaacccggaaaaggaagaacttcgttttatgggtaggcttttcgtgaaggccttgggcaaaccttcagaaatactggcaaaactaaacgaaatggctggattttcccctgaccaagaaattgagctttatgaggaaattaagtttgagccaaacgtgatgtgcgaaattattgacaagaagctcacttttcgttctagtcagcttgaagatggggacattgtctgtttccaaaaatcaccaggagcagaatatgatgcacaagtgcgatatccagatgttccttcatttttggagtatgtccataataggcaggttgtgcatttccggtctttggagaaaccaaaggatgatgatttttctttggaattgtcaaagcttcatacctatgatgatgttgttgagagagttgctcgccaacttgaattggatgatccagcgaaaattcggcttacatcccacaattgctactctcagcaacctaaaccacaacctgtcaaatatcgagtggagcatctgttggacatgctcatccattataatcagacgtctgacatcttgtattatgaagtgttggatataccactgccagaattgcagttcctaaaaaccctgaaagtcgcatttcaccatcctacgaaggatgaggttgttattcatagcatcaggcttccaaaaaatagcaccattgctgatgtaataaatgacttgaaaactaaggttgaactgtccagtcctaatgctgaactacgtgtgctagaagtcttttaccacaagatctataagatctttccactacaagagaagatagagaatataaatgatcaatattggacactacgtgccgaggagattccagaagaggagaaaaatataggtccaaatgatcggctaattcatgtttatcacttcatgaaagatattaatcagactcagcaaattcagaacttcggagaccctttctttctgcttattcatgaaggtgagactttagcagaagtcaagaagcgcatacagagtaaactgcaagtctctgctgatgaattttccaagtggaaatttgcgtttatatcgatgaatcggccagactacctccaggattcagatgttatatctactcgctttcagaggagagaggtctatggagcttgggagcaatatcttgggatggagcacactgatactgcaccaaaaagggcttatacagtgaatcagaaccgtcactcatacgagaagccagtcaaaatttacaattgaaatttctaactggtctggcctcatggtgaggtaccccatatgagaggagcaaccaaaaaggcaggataaggaatttgtactgtcagggggaaacctcatagttgtcaaccattcgggccatgaccatctattccagtgctacaggccagccgctgtcatctcatctgtagcagccagatcccacagcaatgatttttttttcaagattttccttctttgcccccgggcgatggtgctagagcattgatgtccgtttcggttgggtacaagggccagatattgcttcattcttagagcaaagttgggtacataagattttggtaggaggcgtgtatacaggcaggcggtatatgttgtcatgtactgctgttaatgtagtgacagtggttgacttgtaaattggttccagtttccagcgcatgtctgaaaaaggagagtaattttgggtcctttcagaaacatgcaatatttgacttcttgttgcaagaaactacaacttgctcaaggccctactgcttcgattatcactaaagcaagagaaaaattgtaccttttatttttgcaacgtgaccgtgatgtgccaaaatagtttgtatgcttcttaaattgacccaaaagttgtaagtagtttcctgctgctgaagtcaacgtagttgtaggttttttcaaatcttgaaaaagttctcagaatttataatgcggcggaggccataactcattgctagcatcgtttttgtttggaaataagcatcttttgatggtcgcatgcgaattcgatggtttgaccatgacgactcaccatgttatggtggccgattggttaagtgcatccagagacagttttttt

SEQ ID NO: 2342 - DNA, 3855 bp, Elaeis guineensis
caggaggacgacgagatgctggtccctcaccctgagttcgctgacggtccccagccaatggaagtagctcaaaccgaaactgctactactgctgagaaccagcaagtggaggatcctccatcgtccaggttcacatggacaatcgataatttctcgaggctgaacaccaagaagcactactccgacatctttgttgtaggaggctacaaatggcgggtgctgattttcccaaaggggaacaacgtagaccacttgtctatgtacctggatgttgcggattcagcaaccctgccatatggctggagcagatatgcgcagttcagcctggctgtgattaatcaaattcacaacaaatatacaatccgaaaagacacccaacaccaatttaatgcacgggaaagtgattggggattcacatcattcatgcctctaagtgaagtttatgacccaactagaggatatcttgtaaatgatactcttgttgttgaagccgaggttgccgttcgcagggtggttgattactggacctatgactccaaaaaggaaacaggttatgttggcctcaaaaatcaaggagctacttgttacatgaattctcttctccaaactttgtaccatattccatactttaggaaggctgtgtaccatatgcctacaactgaaaatgacatgccgtcgggaagcattcccttggctctgcagagtctgttttataagcttcagtacagtgacagcagtgttgctacaaaagagctaaccaagtcttttggatgggatacatatgattcttttatgcagcatgatgtgcaagaactcaatagggttctttgtgagaaattggaagataagatgaagggaactgttgtggagggcacaatacaacagttatttgagggccatcatatgaattatatcgagtgcattaatgttgactacaaatctagcaggaaggaatctttttatgatcttcagcttgatgtcaaaggttgtcgggatgtttatgcttcttttgataaatatgttgaagtcgagcgtcttgaaggagacaataagtatcatgcagaacagtatggtctacaggatgctaagaaaggtgttcttttcattgactttccccctgttttgcaacttcagttgaaacgctttgaatatgatttcatgcgggacaccatggtcaagataaatgaccgatacgagttcccactgcaactagaccttgatagggataatgggaaatatctttctccagaagcggacagaagtgtccgcaacctttatactctgcacagtgttcttgttcatagcggtggggtgcatggtggacattactatgcttttattcgaccaactctctctgatcagtggtttaaatttgatgatgagcgggtaacaaaagaagatatcaagagggcactagaggagcagtatggtggtgaggaagagttgccacagacaaatcctggcttcaataacaccccatttaaatttacaaagtattcaaatgcatacatgcttgtttatattcgggagagcgacaaggagaaaataatatgtaatgtggatgagaaagacattgcggaacacctcagaataagattgaagaaagaacaagaggagaaggagcacaagaagaaggaaaaggctgaggctcacctttataccatcataaaggttgctcgagatgaagatttagctgaacagataggcagggatatatattttgacctggtggaccatgataaagttcgcagctttcgtattcagaaacaattgcctttcaatgttttcaaggaggaggtggcgaaagaatttggtatcccggttcaatttcagcgtttttggttgtgggccaagaggcaaaatcatacataccgtcccaacaggccattgagccctcaagaagaagcacaatctgttggacaattaagggaggtatccaacaaggcacataatgctgaacttaagctgtttttggaagttgagcttggactggatttgcgtcctcttcctccacctgataagaccaaagaggatattatacatttttttcaagctttatgaccctgagaaggaggaacttcgatatgtggggaggctttttgtgaaggcgttaggaaagccatcagacatactgacgaaattgaatgaactggctggtttttcacctaatgaagaaattgaactttacgaggaaataaagtttgagccaactgttatgtgcgagcacatagacaaaagacttacattccgctcgagccagcttgaagatggtgacatcatctgctacctgaaatctcctgtaatagatagtgatgaccaattccgttatcctgatgttccttcttttctagaatatgttcacaatcgacaggttgtgcattttcggtctttagagaagccaaaggaggacgatttttgtttggaactgtcaaagcttcatacttatgatgatgttgtagaaagagttgctcaccagcttggtctggatgatccatcaaaaattcggcttacatctcataactgttactctcagcagcctaaacctcaacctatcaagtaccggggtgtagagcatctctcagacatgctggtccactacaaccagacttctgacatattgtattatgaagtgttggacatccctctgccagaattgcaaggtttaaaaactcttaaagttgcattccatcatgccacgaaggatgaggttgtaattcatagtattagactgccaaaaaacagcacagtggctgatgtgattaatgacctgaaaacaaaggtcgaactctcccatcctaatgctgaactccggttgctagaggtcttctatcacaagatctacaagatctttccacctaatgaaaagatagaaaacataaatgatcagtactggacattgcgtgcagaggagattccggaggaagagaagaaccttggtccccatgatcgcttaattcatgtttatcacttcatgaaagatccaaatcagaatcagatgcaggttcagaactttggggagcctttctttttggttattcatgaaggtgaaactttagctgaggtgaaagcacggatccagaaaaaacttcaggttcctgatgatgagttctctaagtggaagtttgcatttttgtcactgggtcgccccgagtaccttcaggactcagatattgtgtccagtcgttttcagcgaagagatgtctatggagcttgggagcagtaccttggattggagcactcggacactgctccaaaaagggcttacacagcaaatcagaatcgccacacatttgagaagccagtgaaaatctacaactagtggtccatcaacccccccttatgggatatttatcctgaacatatgccattgggtctgcgtgtaccaattgaaaacaggagaggatgaaatatggatcgttaattacaaagcagcagctaagaggtggggttgcaatattcctggtttgttgaatttgttgctgttgttgttcattcagttgctgattgatggggaagtctgttggactgcatgataacgatactgcccattttgggttttcctctgtttttatcatgtccccccactatgatagaggttgcctttatttccagtgtaatttagtacataaaaaagattttgaattagggcatgtatacagggtatagttggttccgactcttccgttgtttattcttgcattgccgtctatctttattctgtttcttttagttagggaaaatggggattgtataatgtggtgattgttatttaatgccttctgagtctctcagttgttgtgtaaaagaaacaactgccttctcttcttgaattcaaatgttggcctgtacgggccg

SEQ ID NO: 2343 - DNA, 3618 bp, Elaeis guineensis
cctatccatgactatgatgactccccccccttcgatcaggaggacgacgagatgctggtccctcacccggagtttgctggcggtccccagccaatggaagtagctccaaccgaaactgctactactgccgaaaaccagcaagtggaggaccctccatcgtccaggttcacttggacgatcgagaatttctctagactgaacaccaagaagcactactcagacgtctttatcgtggggagctacaaatggcgggtgctgattttcccgaagggaaacaatgtagaccatttgtctatgtacctggatgttgcggattcagcaaccctgccgtatggctggagcagatatgcacagttcagcctggctgtgaccaatcaaattcacaacaagtatacaataagaaaagacacccaacaccaatttaatgcccgggaaagtgattggggcttcacatctttcatgccgctaagtgaactttatgacccaactagaggatatcttgtgaatgatactcttgttgttgaagccgaggttgctgttcgcagggtggttgattactggacttatgactccaaaaaagaaacaggttatgtcggtctcaagaatcaaggagctacttgttacatgaactctcttctccaaactttgtaccatattccatactttagaaaggctgtgtaccatatgcctacaactgaaaatgatatgccgtcaggaagcattcctttggccctgcagagtcttttttataagcttcagtacagtgacagcagcgttgctacaaaagagctgaccaagtcttttggatgggatacatatgattctttcatgcagcatgatgtgcaagaactcaatcgggttctttgtgagaaattagaggataaaatgaagggaactgttgtggaggggacaatacaacagttatttgaaggccaccatatgaattatattgagtgcattaatgttgactacaaatctagcaggaaggagtctttttatgatcttcagcttgatgtcaaaggttgtcgggatgtttatgcttcttttgataaatatgttgaagttgagcgtcttgaaggagataataagtatcatgcagaacaatatggcttacaggatgctaagaaaggtgttcttttcattgattttccccctgttttgcaacttcagctgaaacgctttgaatatgatttcatgcgagacaccatggtcaagataaatgaccgatatgagtttccactgcaactagacctggatagggataatggcaaatatctttctccagaagcggacagaagtgtccgcaatctttatactctacacagcgttctcgttcatagtggtggggtgcatggtggacattattatgcttttattcggccaactctctctgatcattggtttaagtttgatgatgagcgggtaacaaaagaagatatgaagagggcactagaggagcagtatggtggtgaggaagagttgccacagacaaatcctggcttcaataacactccatttaaatttacaaagtattcaaatgcatacatgctggtttacattcgtgagagtgacaaggagaaaataatatgtaatgtagatgagaaagacattgctgaacatcttagaataagattgaagaaagaacaagaagagaaagaacacaagaagaaggaaaaggctgaggctcacctttataccatcataaaggttgctcgagatgaagatttagctgaacagataggaagggatatatattttgacttggtggaccatgataaagttcgcagctttcgtattcagaaacaattgcctttccatgctttcaaggaggtggtggctaaagaatttgttatcccagttcaatttcagcgtttttggttgtgggctaagcggcagaaccatacataccgtcccaacaggccattgagtcctcaagaagaagcacaatctgttggacagttgagggaggtatccaacaaggcacataatgcagaacttaagctgtttttggaagtggagcttggactggatttacatcctctccctccacctgataagagcaaagaagacatactactttttttcaagctttatgaccctgagaaagagcagcttcgatatgtggggagactctttgtgaaggctttaggaaagccatcagaaatactgacaaaattgaatgaactggctggttattcacctgatgaagaaattgaactttatgaggaaataaagtttgagccaagtgttatgtgtgaacatatcgacacaaaactcactttccgttctagccagcttgaagatggtgacatcatctcttaccagaaatctcctgcagtagaaagtgatgaccaattccgctatcctgatgttccttcttttctggaatatgttcgtaatcggcaggttgtgcattttcggtcattagagaagccaaaggaggatgatttttgtttggaactgtcgaagcttcatacttatgatgatgttgtagaaagagttgctcaccatcttggtctgaatgatccatcaaaaattcggcttacatctcataactgttactctcagcagcccaaacctcagcccatcaagtatcggggtgtagagcatctctcagacatgttggtccattataaccagacttctgacatattgtattatgaagtgctggacatccctctgccagaattgcagggtttaaaaactctgaaagttgcattccatcatgccacaaaggatgaggttgtaattcatagtattagactaccaaaaaacagcaccgtggctgatgtgattaatgacctgaaaacaaaggtcgaactgtctcatcctaatgctgaactccggttgctagaggtcttttatcacaagatctacaagatttttccacccaatgaaaagatagaaaacataaatgatcagtactggacattgcgtgcagaggagatcccagaggaagagaagaaccttggtccacatgatcgcttaattcatgtttaccacttcacgaaagatacgagtcagaatcagatgcaggttcagaactttggagagcctttctttttggttattcatgaaggtgaaactttagctgaggttaaagtgcggatccagaaaaaacttcaggttccagatgaggagttctctaagtggaagtttgcgtttttgtcaatgggccgccctgaataccttcaggattcagatattgtgtctagtcgttttcagagaagagatgtctatggagcctgggagcagtaccttgggttggagcactcagacactgctcccaaaagggcttatgcagcaaatcagaatcgtcatacatttgagaagccagtgaaaatctacaattagaagttagccaaccccctcccacggaaagttttacctttaaccaatatgccactcgccatctgtttgttaccaacttagtcaaaccaaggagggaagtagtaaagtaagttcggtatactattaaatttaacagaagcacgacggccgtgaggaaggtgggggttggtcaagttaggtttggtatggggggtaggggcctttttacggttaacgtaggtccgaaagaaagtaaagtaaagtggttggttttttaatttactgtcg

SEQ ID NO: 2344 - DNA, 3794 bp, Musa acuminata
atgactatgatgactccgccccctctcgagcaggaggacgaagagatgctggtcccgcaccaggaattcaccgagggaccccagccgatggaagttataccaaccgagacagcgtccgcaccagagaatcagcaggtggaggatcctccttcgttcaaatttagatggacgatagagaacttctccaggttgaacgtcaagaagctctactccgacattttctatgtcggagcgtacaagtggcgtgtgctaatttttcccaagggaaataatgttgaccatttgtctatatacctggatgttgctgattcaacaaccttgccatatggttggagtagatatgcacagttctcacttgctgttgttaaccaaatccacggaaagtacactgtaagaaaagagactcaacaccaatttaattcacgagaaagtgattgggggttcacttcatttatgtctctgagtgaactctatgatccaagtagaggatatcttgtcaacgatacatgtgtaattgaagctgaagttaccgtccgtaagatggtagactactggagttatgactcgaaaaaggaaacgggttatgttggtcttaaaaatcaaggggctacttgttacatgaattctcttcttcagactctctatcatattccatattttagaaaggctgtttatcacatgccgacgacagagaatgatatgccatctggaagcatccctctggctttgcagagcctgttttataaacttcagtacagtgataacagtgttgccacaaaagagttgacaaaatcttttggttgggatacatatgattctttcatgcaacatgatgtccaggagctcaacagggttctttgtgaaaaattggaagacaagatgaagggtactgttgttgagggcacaatccagcatctgtttgaaggacatcacatgaattatattgaatgcataaatgtagactacaaatccaccagaaaggaatcgttctatgatctgcagcttgatgtaaagggctgccgggatgtttatgcttcatttgataagtatgttgaagtcgagcggctggagggtgataataaatatcatgcagaaaattatggcttacaggatgctaagaaaggtgttctattcattgacttcccccctgttctgcaacttcagctaaagcgctttgaatatgatttcatgcgtgatacaatggtgaagataaatgaccgttacgagttcccacttcagttggaccttgatagagataatggtaaatatctttctccagaagcagacaggagggttcgtaacctctatacccttcacagtgttcttgttcacagtggtggagttcacgggggacattattatgctttcatccgaccaactctatcagatcaatggtttaagtttgatgatgagcgagtaacaaaggaagatgcaaaaagggcattggaggagcagtatggtggtgaagaagagttacctcagacaaatcctggcttcaataatcctccatttaaatttacaaaatattcaaatgcttacatgcttgtatatattcgcgagagtgacaaggagaaaataatgtgtaacgtggatgagaaagacatcgcagagcaccttagagtaagattgaagaaagaacaagaagagaaggagcacaaaaagaaggagaaagctgaggctcacctttataccatcataaaggtagctcggaatgaggatttggcagaacagattggaagggaaatattttttgatcttgtagaccatgacaaagttcggagctttcgtatccagaaacaactgccattcagccattttaaggaggaggtggccaaagaatttgggatcccagtgcagtttcagcgcttttggctgtgggctaagaggcaaaaccatacataccgtcccaatcgacctttaacacctcaggaggaagtacaatccgttggacagcttagggaggtatcaaataaggcacataatgctgaactgaagctatttttggaaatagagcttggaccggatcttcgtcctcttcctccaccacaaaaaaccaaggaggatatactactatttttcaagctctatgaccctgaaaaagaagatctgagatttgtaggaaggctatttgtgaaggctttaggaaaaccaactgaaatacttctaaaattgaatgaaatggctggattttctccaaatgaagaaattgaactttatgaggaaataaagtttgaaccaaatgtaatgtgcgaacacatcgacaaacggatctctttccgatctagccagcttgaagatggagatatcatttgctatcaaagagcttccgcattacaaaatggtgaccaatatcgatatcctgatgttccttctttcttggagtacgttcgtaatcgccaggttgttcactttcgatcattggagaagccaaaggaggatgatttttctttagaattgtcaaaactttctacctatgatgatgttgttgaaagagttgctcgtcaacttggtctggatgatccatcaaaaattcgtcttacatctcacaattgttattcgcagcagcctaaacctcaacccattaagttccgaggtctagagcatctctcagaaatgcttgtccactataaccagacttctgatatattgtactatgaggtattggatattcctctgcctgaattgcaaggtctgaaaactcttaaagttgcattccaccatgccacaaaggatgaggtggcagtccatagcatcaggcttccgaaaaatagtactgttgctgatgtaatcaatgatttaaagacaaaggttgagctctctcatcctgatgcagaactcaggttgcttgaggtcttctatcacaagatctataagatctttccacctggtgaaaagatagaaaatattaatgatcagtattggactttgcgtgcagaggagattccagaagaggagaaaaaccttggtcctcatgatcgcttgattcatgtttaccacttcacacgagatcctaatcagaaccaaatgcaagttcagaattttggtgaacctttcttcttggttattcgagaaggtgagactttagctgatgtcaaaatacgcattcaaaagaaactgcaagttccagatgaggaattctcaaagtggaaacttgctttcatatcacttggacgccctgaatacctccaggattcagatatagtatctaacagatttcagagaagagatatttatggagcctgggagcagtaccttgggttagagcactctgacactgctccaaaaagggcttacactgctaatcagaaccgtcacacgtttgagaagcccgtgaaaatctacaattgaaaagtggccggatctcctcccatggcatcatccaatgctgtcacctcaggtccacatggataggagagaaccaaagtgtagaattttgaacaataagattgcagcattagtgaggtggggacttttgggggattcgccaccaaaatttgttgtggtgtaatgtgtgtcaagtgttagctggggaggactcgggagaatgcttgatcatgagttctttttaacgtctcggcctcgttataaaattttccttgtggctttttttctttttcttttttctggtcaagcccatgtcagttagggtttcctgcccttggatccagtgtaattttagtacataaagattttggatcggagggggaggcacatatagggtatagctggtgtctttgacttcccttgggggtcttcgtccccatccttgttatatttccatagttttcttattc

SEQ ID NO: 2345 - DNA, 3844 bp, Setaria italica
ctcccattgccctcctctttcgcagcaggaggacgaggagatgctcgtgccccaccaggaggttgccgctgccgatgcagacgcagcccagcccatggaagtggtggcacagacagaggtggcgagcacagcagagagccagccagcggaagatccgcagacatcgcggttcacgtggacaatcgataacttcacccgctttaatgggaagaagcagtactcagaggtttttgttgttggcgggttcaaatggcgtgtgctgattttccccaaggggaacaatgtggaccacttctcaatgtacttggatgttgctgactcagccaacctcccgtatggttggagccgctatgctcagtttagcctggctattgtaaaccagatccagccaaagtatacgatacgcaaagatacccaacatcaatttaatgctcgtgagagtgattggggtttcacatcctttatgcctttaagtgagctctatgatccaagtagaggttacctcgtgaatgatactattgttgtggaggctgaggttgctgtccgcagaatggttgactattggacgtatgactcaaaaaaggaaacgggctatgtgggtctgaaaaaccaaggggctacctgttatatgaactctcttttacaaacactttaccacataccgtacttcaggaaggctgtgtatcatatgccaaccactgaaaatgacatgccatcaggaagtattcccttggcgctgcagagccttttctacaagctccagtacagtgacagtagtgtagctacaaaagagctgaccaaatcttttggatgggacacatatgattctttcatgcaacatgatgtacaagagctcaacagagtcctctgtgagaaacttgagggcaaaatgaaggaaactgttgtagaaggaacaattgagcaattatttgaaggtcatcacatcaattacattgagtgtataaatgttgactataaatctaaccgcaaggagtccttttatgatcttcaacttgatgtcaaaggttgtcgtgacgtgtatgcgtcgtttgataaatatgttgaagttgagcgtttagagggtgataacaagtatcatgcagagaatcatggtctacaggatgcaaagaagggtgttctcttccttgattttcctcctgttttgcaactccagctgaaacgctttgagtatgattatatgagagataccaatgttaagattaatgatcgctatgagttccctctgcaacttgatctggatagagatgatggcaaataccttgctccagatgcagatcgaagtacaagaaacctctatgctcttcacagtgttcttgttcatagtggtggggtacatggcggtcactactatgcattcatacggccaactctatctgagcaatggtacaaatttgatgatgagcgtgtaacaaaagaagatgctaagaaggcccttgaagaacaatatggcggcgaggaagagttgccacaagtaaaccctggcttcaacaacgccccgtttaaattcacgaagtattcaaacgcgtatatgcttgtttatattcgtgagagtgacaaggagaaaatcatgtgtactgttgatgaaaaggacatcgctgagcatttaagagtaaggttgaagaaagaacaagaagataaagaacacaaaaagaaagaaaaagctgaagctcatctttataccattattaaggtggctcgagatgaggatttgaagcaacaaattgggaaggatatatattttgacctggtggaccatgaaaaggtccgcaatttccgaatacagaagcaattgccgtttagttcgttcaaggaggaagttgccaaggagtatggcatccctgtgcagtttcagcgcttctggttgtgggctaagaggcaaaaccatacataccgccctaatcgtccattgacccctcatgaggaaacacaatctgtggggcaactgagggaggtatcaaataaggcacacaatgctgagttgaagctgtttttggaagtagaacttgggctggatttgcagcctctccctcctcctgagaagggcagggaagactttcttcttttcttcaaactgtacaaaccagaaacggaagaactttgttttatggggaggctcttcgtgaaggccttgggcaaaccttcagacatcctggcaaaactaaatgaaatggctggattttctccagatcaggaaattgagctttatgaggaaattaagtttgagccaaatgtgatgtgtgaaattattgaccagaaacttacttttcgttctagtcagcttgaagatggggacatcctttgtttccaaaaagcaccaagagctgaccatgatacacaagtgcgatatccagacgttccttcatttttggagtatgtccataataggcaggttgtgcatttccggtctttggagaaaccaaaggatgacgatttttctttggaattgtcaaagcttcatacctatgacgacgttgttgagagagttgctcgtcaacttgagttggatgatccagcgaaaattcggcttacatcccataattgctactctcagcaacctaaaccgcaacccgtcaaatatcgaggtgtggagcatctgttggacatgctcatccattacaatcagacatctgacatcttgtattatgaagtgctggatattccacttccagaattgcagttcctgaaaaccctgaaagttgcattccatcatcctacaaaggatgaggttgttattcatagcatcaggcttccaaaaaatagcacaattgctgacgtgataaatgacttgaaaacaaaggttgaactgtccagtcctaatgctgaactacgtgtgctagaagttttttaccacaagatctataagatctttccgctacttgagaagatagagaatataaatgatcaatattggacgctacgtgctgaagagattccagaagaggaaaaaaatataggcccaaacgatcggctaattcatgtttatcacttcacaaaagatattaatcaaactcagcaaatccagaacttcggagaccctttttttctacttgttcgtgaaggtgagactttagcagaagtcaagaagcgcataaagagtaaacttcaagtctccgccgaggaattttccaagtggaaatttgcttttatatcgatgaatcggccagattacctccaggattcagatgttatagctccccgttttcagaggagggaggtctatggagcttgggagcaatatcttgggatggaacacactgatactgcaccaaaaagggcctatacagtgaatcagcagaaccgccatgcgtatgagaagccagtcagaatttacaattgaaaatgctgacaaccgagctggtctcgtggtgaaagccaagttgcctcaatgcgagcgagagtagcaactaaaaagggagggtagggaatatagactgccaggtggagacttcaagttgttggcgatttcgggggtgctgtccgccacggccctctattctgtgcttgaagccaccttcatcagtagcaattcacctgttagtggcgcagtgcatattgatttacatttccgtttccgttgggtacaagggtttcccgtggatagtagatattgcttcattcatagagcaaagttgggtacataagattttggtagggggcgtgcgtgtatacaggcgggtatagttgtggcttgacccggcgtttcttttcttgtactaatgtggcggcggtggttgactgtaaatgggctccaattttcagcttccatctcatgaatgcgtggaagaattgcattgcagcgcgtcgacgccatttcgagatgagt

SEQ ID NO: 2346 - DNA, 4283 bp, Aristolochia fimbriata
ttttcccggtggggtgtcttattgcaacgacagaagggaagccctcttctgcctgtgcgcctctccaatttgctgccacttctcgctccgattttgtcgatcgcaagggcgcgctctctcgctctacatccatgactatgatgactccccctcccttagatcaggaggacgaggagatgctggtgccgcattcggattttactgacggcccgcagccgatggaagcagtgtcgcaaccagaacctgccagtacggtggagaatcagccagtcgacgatcctccttcctcgagattcacttggacgattgaaaatttttctaggttaaacaccaaaaagcactactcagacatcttctttgtcggtggttataaatggcgagttctgatttttcccaagggaaacaacgtggaccacctatctatgtacttggatgttgcggactcgacacagttgccttacggctggagtagatatgcacagttcagtttggcggtgatcaatcaaggtcaccctaagtataccatacggaaagacacacagcatcaattcaatgctcgggaaagtgattggggtttcacatcattcatgcctcttagtgaactttatgacccgacgagaggataccttgtgaatgatacttgtatagttgaagctgaggttgcggtgcgtagggttgtggattactggacgtatgattcgaaaaaggaaacaggttatgttggtttgaagaaccaaggtgcaacctgttacataaactctcttcttcaaactttgtaccatatcccatattttcgtaaggctgtgtaccatatgcccactacagagaatgatatgccatctggaagcattccattagctctccagagcttgttttataagcttcagtatagtgataacagtgttgcgacaaaagagctgacaaaatcattcggatgggacacttacgattctttcatgcaacatgatgttcaggagctcaatcgggttctttgcgaaaagcttgaagataaaatgaagggtactgttgtggagggaacaatacagcagttgtttgaaggtcatcatatgaactacattgagtgcatcaatgtggactataaatctaccagaaaggaatccttttatgatcttcaactggatgtgaaaggttgtcgtgatgtctatgcatcctttgacaagtatgttgaagttgagcgtctcgaaggtgataacaagtatcatgcagaacaacatggtttgcaggaggctaagaaaggtgtcctgtttatcgacttcccccctgttctgcaacttcagcttaaacgctttgagtatgatttcatgagggacacaatggtgaagataaatgatcgatatgagttcccattacaacttgatcttgacagagacaatcggaaatatttgtctccagaagcagacacaagagttcgcaatctttatacacttcacagtgttcttgttcacagtggtggagtgcatggaggacattactatgcttttatcaggccaactctctcggatcagtggttcaagtttgatgatgaaagggtaactaaggaagatatgaaaagagcattggaggaacagtatggtggtgaagaagagttgccacagaccaaccctggattcaataacacccctttcaagtttacaaaatattcaaatgcatacatgcttgtgtacatacgtgagagtgataaggagaagataatttgtaatgtggatgagaaggatattgcagaacatcttaggataaggctgaggaaagaacaggaagaaaaggaacacaagaagaaggagaaggcagaagcacatctttatactattataaaggttgctcgagatgaggatctttctgatcagattggaaaagatatttattttgatcttgttgaccatgacaaagttcgcagtttccggattcagaagcagatgccatttaatctcttcaaggatgaggtggctaaggaatttggaatacctgtgcaatatcaacgtttttggctatgggccaagcgtcaaaaccatacgtataggccgaacaggccattgactcatcaggaagaagctcagtcggttggtcagctgagggaagtatcaaacaaatctcataatgcagagctgaagttgtttctggaagtggagctaggaccggattcacaccctcttcctccaccagacaagaataaagaagatatattgttattttttaagctttatgatcctgagaaggaagagctcagatatgttggaaggctatttgtcaagggtggagggaagccatcggagatcctaactaagttaaacgagttggctggttttcctcccaatgaagagattgaactttatgaggaaataaagtttgaacctagtgtcatgtgtgagcacatagacaagaagctcacattcagatcaagtcaactcgaagatggtgatattatttgtttccaaaagttacctgcaactgaaaatgataagcaatatcggtatcctgatgtgcctcagtttttggaatatgttcataaccgacaggttgtccatttccgatctcttgagaaacccaaggaagatgatttttgtcttgagctgtcaaagctttttatttacgatgatgtagtcgagagagttgcccgtcaacttggtgtggatgatccaactaagattagactcacatctcataattgctactcccagcaacctaagcctcaacctatcaagtaccgtggtgtggaacatctgtccgacatgctggtccactacaaccagacttcggatatcttatattacgaagtattagacattccattgccggaacttcaggggttgaaaactctgaaagttgctttccaccacgccacaaaggatgaagtcgtaattcacagcataagattgcccaagcagagcactgttggggatgtgattaatgacttgaaaaccaaggttgagttgtctcatcctaatgcggaacttcgattgcttgaagtcttctatcataaaatctacaagatattccctccgaatgagaagattgaaaacatcaatgatcagtattggacacttcgtgcagaggagattcctgaagaagagaaaaatcttggtcctcatgatcgtcttattcatgtgtaccactttaccaaagatgcatctcaaaatcaaatgcaggttcagaattttggggaacctttcttcttgatcatccatgagggtgaaacccttgctgaagttaaggtgcgaattcaaaagaaattgcaagttccagatgaggagtttgcaaagtggaaatttgcttttctatcacttggtcgccctgaataccttcaagactctgatatagtctctagtcgtttccagagacgggatgtttatggggcttgggagcagtatcttggtttggaacattctgacagtgctccaaaacgatcttatccgcccaatcagaatcgtcacacatttgagaagcctgtgaaaatctacaattagcaactggcaaagaacctatgcaacagcatattggctgaaccctttgatgtggcctttgatttgcccacctgttcaccagtggtgtgatatgttaagaatggagaagtaacggaaggcaaatacaaagcatgcaactgccgaggaagaggatttgtcgggtttggttattgtttttgttgcaattgtcttgttttcttgtgtttgggtggggagaggacatttatccaagtgagtgtgcttgtgtcgtttttttatcaacccccatctcgagctttattttctgttcttttcaacaagagctgccccttttggtgagaagtgtctcacttagcttctacttcaattccaatgtaatttagtacataagaagattttgaactaggggatgtatacagggtatagatagtcggttgttctttgccatttttctttttcttttttggtttttcagttacccttttgtttattctagcttctgctcaggggaaaaggggttgtataatggttggccatcattagctgttaaagttgtttaggaaattaattatgtaatactttttttttttcgcaccgcagctttaagattgccatcacaatgtctttattatatgtcattacaaacttccttcctgctattttaagttttttgaatccagctctggaaaagtgttctttcctcttaatagaggaactcagacagttgaacatcctcgagaggtctcaataactattttacctccacagcgtgtacgggaaaccattttttggccgtggcttagcacagaccaattgtttttcata

SEQ ID NO: 2347 - DNA, 4025 bp, Amborella trichopoda
acgagatgctggttcctcattcagagttcaacgataatgctcaaccaatggaagtagtggcgcagggggaaactgttagcacggccgagaaccagcctgttgaggatcccccaacttctcgattcacttggacgatcgagaatttctcaaggctcaacagcaaaaagcactactccgacatatttgtagtcgggggttacaaatggcgggtgctgatattccccaaagggaataatgtggaccacttgtcgatgtacttggatgtggcggattctgctactcttccttatgggtggagtcgatatgcacagttctgcttgtcggtcgtaaaccagcttaatagcaagtacacaataagaaaagacacacaacaccaatttaatgcccgagaaagtgattggggcttcacatcatttatgcctctcagtgacctctatgacccgaacaaagggtatcttgttaatgatacagtagtagtggaagcagaagttgctgtccgtagagtcgttgattattggacgtatgactctaagaaagaaactggttatgttgggctcaaaaaccagggagcaacttgttacatgaattctcttcttcagactctctaccatattccatacttcagaaaggcggtttaccatatgcccaccactgaaaatgatatgccatctgggagcatcccactagcgctacagagcttgttctacaaactacagtatagtgacaatagtgttgccacaaaagagctgactaaatctttcgggtgggacacatatgattctttcatgcagcatgatgtgcaggagcttaatagggttctttgtgaaaaactggaggacaagatgaagggtacagtggtcgagggtacgatacagcaattatttgaagggcaccacatgaactacattgagtgcattaatgtagattacaaatcgacaagaaaggagtcattttatgacctccagcttgatgtcaaaggctgtcgtgatgtatatgcttcttttgacaagtatgtggaagtcgaacgtcttgaaggtgacaacaagtaccatgccgagcaacatggtttgcaggatgctcggaagggtgtgcttttcattgatttccctcctgtattgcaacttcagctaaagcgctttgagtacgatttcatgagggatacaatggttaagataaatgacaggtacgagttcccattacaattggaccttgatcgagagaatgggaaatatctttctccagatgcagacaggagtgtccggaacctttatacgctgcacagtgttctagttcacagtggtggtgtacacggtggacattattatgctttcatcaggccaaccctctctgaccaatggttcaagtttgacgatgagcgtgtgacaaaagaagatatgaagagggcattagaggagcagtatggtggtgaggaggagttgccacaaaatcctgggtttaataatacaccattcaaatttacaaaatattcaaatgcgtacatgcttgtgtacatccgagaaagtgacaaggagaaagtcatttgtaatgtggatgagaaggacattgctgaacatcttaggataagattgaagaaagaacaagaagagaaagagcacaagaagaaggagaaagcagaggcacacctttataccatcataaaggttgcaaaaaatgaggatctagcagaacaaataggaaaggatatatattttgatcttgtggaccacgacaaagttcgaagtttccgtattcagaagcaaatgcctttcagtgttttcaaggaagaggtcgcaaaggagtttggcgtaccagtgcaatttcaacggttttggctgtgggctaagcgtcaaaaccatacctatcgccccaacaggccattgacccatcaagaagaaacacaatcggttgggcagttgagggaggtatcaaacaaggctcataatgcagaattgaggctcttcctggaagtggaatttggacctgatctacgtcccatccttccccctgagaagactaaagaagatatactactatttttcaaactttatgacccagaaaaagaagagctacgctatgttggaagactttttgtgaagtcctcgggaaagccaattgagattttgacaaaactgaatgaaatggctggtttccctccgaatgaagaaatcgaactttatgaggaaataaagtttgaaccgaatgtcatgtgtgagcatattgacaagaagcttgcatttcgagcgagccagcttgaagatggggatattatatgcttccagaaagccttgtctgcagaaaatgatgaacgtttccgttatccagatgtaccttctttcttggattatgtacataatcggcaggttgtccattttcgttcattggagagaccaaaggaggatgacttctgtctagaactatcgaagctgtacacatatgatgatgttgtggaaagggttgctcgtcaacttggtttggatgatccaacaaaaatacggctcacatctcacaactgttattcccagcaacctaaaccccaaccaataaagtatcggggcgtggagcgtctatcggatatgctggttcactataaccagacttctgatatattgtattatgaagtgctggatattccactgccagagttgcagggtttgaaaaccctaaaagttgcatttcatcattcaaccaaagatgaagttgttagccatagtatccggctacccaagcagagcactgttggggatgtcatcaatgatttgaaaactaaggttgagctgtctaactctagtgctgagcttcgattgcttgaggttttctatcacaagatttacaagatatttcctcttggtgagaagattgagaacataaatgatcagtactggacgttacgtgctgaggagatcccggaagaagagaaaaacctcagccctcatgatcggttaatccatgtttaccactttaccaaggataccacgcaaaatcagatgcaggttcagaattttggggaacccttctttttagtcattcgtgaaggggagactttagctgaggttaaggtacggatccagaagaagctacaggttccagacgaggagttctctaagtggaagttcgcatttttgtcattgggtcgccctgaataccttcaggattctgatgttgtatcaacccgttttcagagaagagatgtttatggagcttgggagcagtacctcgggttggagcattcagatagtgccccaaaaaggtcctacacggccaatcagaaccgtcacacttttgagaagccagttaaaatctacaactagatagaagataagggcacaaattctggggtctctattaatgaatcttgcatgtgcatctccccttccaactttatcaaggaggctccaagtgggcttatagaatgggagaggagtggttattggatttgggttgttgattggtcgtgtaggctttccgagaagaaaggtttattcttttccagtgtggctgggctgagagacttgctgctatatgcttgtgtttctttcttttgctctgttcctttttcagattagcccccttttttaggtatggctgagaggtctatccttcattttaccagtgtaatttagttggtacataaagagattttggcttagggcatgtatacatgagttgggtggtgtatgcctcttttttgtggttctttcctctcttttttttctttttttttgttttggtgggtgggtctgggggaaaggtgtataatgggcttggttggttcctctggttttggcttctagttctatgtaaaagaaggtatactgctttgaggatctctctctcatcatcatgtttgcctctttggccgacctgccttctttttattgttcaagtggttctctcattcatgcagatagccaagggtggagagtttcaagctatataatatcatcaagtttctaggggttgtttggagttttagttcatttactcttttggattgattaactctctctctctctctctctctctct

SEQ ID NO: 2348 - DNA, 3864 bp, Musa acuminata
atgactatgatgaccccgccacctctcgaccaggaggaagaggagatgctggttccgcatcaggagctcactgagggaccccagccgatggaagttacacaaactgagacggcaactacgccagagaatcaacaggtggaggatcctcctccattcaaatttagatggaccattgagaatttctccaggttgaacatcaagaagctctactctgacattttctatgttggagggtacaagtggcgggtgctgatttttcccaagggaaataatgtggaccacttgtccatatacctggatgttgctgattctactaccttgccatatgggtggagtagatatgcacagttcacacttgcaattgttaatcaaattcatagcaagtatacgataagaaaagagacacaacaccaatttaattcacgagaaagtgattggggttttacttcatttatgtctctaagtgaactctatgatccaagtagaggatatcttgtcaatgatacatgtgtaattgaagctgaagttgctgtccgtaggttgatagactactggagttatgattcaaaaaaggaaacgggttatgttggtcttaagaaccaaggagctacttgttacatgaactcgcttcttcagactctgtatcatattccatatttcagaaaggctgtttatcatatgccaacgacggagaatgatatgccatctggaagcattcccttggctcttcagagcctattctataaacttcagtacagtgacaacagtgtcgccacgaaagagctgacaaaatcttttggatgggatacatatgattctttcatgcaacatgatgttcaggaacttaacagggttctttgtgaaaaattggaagacaaaatgaagggaactgttgttgagggcacaatccagtatttgtttgagggacatcacatgaactatattgaatgtattaatgtagactacaaatccatgagaaaagagtcgttctatgacctacagctagatgtaaaaggttgtcgggatatttatgcttcatttgataagtatgttgaagttgagcggcttgaaggagataataaatatcatgcggaaaatcacggcttacaggacgctaagaaaggtgttctattcattgacttcccccctgttttgcaactccagttaaagcgctttgaatatgatttcatgcgggatacaatggtgaagataaatgaccgttatgagttcccactccagttggaccttgataaagataatggcaaatatctttctccagaagcggacaggagagttcgcaatctttatactcttcacagtgttcttgttcacagtggtggagtgcatgggggacattactatgctttcattcgaccaacactatcagatcagtggtttaagtttgatgatgagcgagtgacgaaggaagacgtgaaaagggcattagaagaacaatatggtggtgaagaagagttatctcagacaaatcctggcttcaataatacaccatttaaattcacaaaatattcaaatgcttacatgcttgtgtacattcgtgagagtgacaaggagaaaattatgtgtaatgtggatgagaaagacatagccgagcatctgagagtaagattaaagagagaacaagaagagaaggagcataaaaagaaagagaaagctgaggctcacctttatactatcatcaaggttgctcggaacgaggatttggcagaacagatcggaagggaaatattttttgatcttgtagaccatgacaaagtccggacttttcgaattcagaaacaacttccattcagccatttcaaggaggaggtggccaaagaatttaatattccggtgcagtttcagcgtttttggctttgggctaagcggcaaaaccatacttaccgtcccaatcgccctttaacacctcaggaggaagcacaatctgttgggcagcttagggaggtatcaaataaggctcataatgctgaactgaagctattcttggaagtagagcttgggctggatcttcaccctcttcctccaccacaaaagaccaaggaggatatacttctttttttcaagctttatgatcctgaaaaagaagggttaagatttgtaggaagactatttgttaaggctttagggaagccaattgaaatactctcaaaactgaatgaaatggctggatttcctccaaatgaagatattgaactttatgaggaaataaagtttgaacctagtgtaatgtgcgaacacatcgacaagcagatcccctttcggtcaagccagcttgaagatggagacatcatttgctatcaaaaggcttcaacattagggaatatagatcagtatcgatatcctgacattccttctttcttggagtatgttcataatcgccaggttgttcatttccgatcattggaaaagccaaaggaggatgatttttctctggaattgtcaaaactttttacctatgatgatgttgttgaaagagttgctcgccaacttggtgtggatgatccatcaaaaattcgtcttacatctcacaactgctattctcagcagcctaaaccccaacctattaaataccgtggtgtagagcatctttcagatatgctggttcattataaccagacttctgatatattgtattatgaggtattggatattcctctgcctgaactgcaaggtttgaaaactttaaaagttgcattccaccatgccacaaaggatgaggtagcagtccacagcatcagacttccaaaaaatagcactgtagctgatgtaatcaatgacctaaagacaaaggttgagctctctcatcctgatgctgagctcaggttgcttgaggtcttctaccacaagatctataagatttttccacttggtgaaaagattgaaaatattaatgatcaatattggactttacgtgcggaggagattcctgaagaggagaaaaatctcagtcctcatgatcgcttgattcatgtctatcactttacaagagatcctaatcagaatcaaatgcaagtacaaaattttggggagccttttttcttggttattcgggaaggagagactttagctgatgtcaaaatgcacattcagaagaaactgcaagttccagatgacgaatactcgaagtggaaatttgcttttgtatcacttggacgtcctgaatacctccaagatttggatgtggtgtctaacagatttcagaggagagatatttatggagcatgggagcagtaccttggattagagcaccctgacactgctccaaaaagggcttacacagttaatcagaaccgccacacgtttgagaagcctgtgaaaatctacaattgagagctggatggatctcctcccatggcattcaattctgtggcctcactagaacatgggtatgagagagtgttgtagatctttacaacaaatgcagaatagcgaggtggggtggcggggattcacgaccaaaattcttgttgcggtgtgacatgcaacactgcttgctcagaacactcgggatgatgcttgatcatgagttctttagacagctcagcctcttttataagttttccttgtgctgttttctgatcaagccctctgacaggtttccttctcttttatccagtgtaatttagtacatgagattttggattggagtggtatataacgggtatagttggtgtctcgaacattttttttccactaattatccctgcctttattatattttcatatttttcctctctaccttggtcttgaaaagaaaatctggggttgtaaaatggggattatttggtgtaacttcttttccaagtccctgtaaaagaaagacaatagttggaaatatcttttcat

SEQ ID NO: 2349 - DNA, 4201 bp, Glycine max
accgaaattgcccaaagccccaaataaaaaccgaagacatttctccctctcgtctcgagcaatagcaagacagcaatagcttctggtgatctcgttttcttacagtgctctcttccccctttctctctcctctttatctctctcttccattgctcctccacaagcaacgccgcgcgaggtcaattttcgcaatcgccatgactgtgatgactcctgctcccattgaccagcagcaggaggacgaggagatgcttgtcccgcacacggatttggctgagaataatcaccaacctatggaagttgtggctcaacctgatgctgccaacactgtggagagtcagcctgtcgaggatccttcgacatcaaggttcacatggaaaattgaaaacttttctaggatgaatacaaagaagctctattcagaaatatttgttgttggtggttataaatggcgagtactcattttcccaaaagggaacaacgtggactatttgtccatgtatttggatgttgcagattcagctagtttgccctatggctggagtagatatgcacagtttagcttggcagtcgttaatcaaatccataataaatactctgtgagaaaagacacacagcaccaattcaatgcgcgggaaagtgattggggtttcacgtctttcatgccacttggtgaattgtatgatcctagtagagggtatcttgtgaatgatactcttgtagttgaagctgaggttcttgttcgtagaattgttgattactggacctatgattcaaaaaaggagactggctatgttggacttaagaaccagggagctacatgttatatgaattctctacttcaaactttgtaccatattccttattttcgaaaggctgtataccatatgccaacaacagagaatgacatgccgtcgggaagcatccctttggctttgcaaagtttattctacaagctccagtatagtgacaccagtgttgcaacaaaggagctcactaaatctttcggatgggatacatatgattctttcatgcagcatgatgttcaagaactgaacagagtcctctgtgaaaaacttgaagataagatgaagggaactgttgttgagggaactatacagaagttatttgaagggcatcatatgaactatatcgaatgcatcaatgtggactataaatcaactagaaaggagtcattttatgaccttcagcttgatgtgaaaggctgtcctgatgtttatgcttcctttgacaagtatgttgaagttgaacgtcttgaaggggataacaaatatcatgcggaacaatatggtttgcaggatgctaagaagggtgtcctgttcattgatttccctcctgttcttcagcttcaactgaaaagatttgaatatgactttatgcgggatactatggtcaagattaatgaccgttatgagtttcccttgcaacttgaccttgatcgtgagaatggaaaatatttatcacctgacgctgataggaatgtccgcaatctttacacacttcatagcgttttggttcacagtggtggtgtgcatggtggacattattatgcttttatcaggccaactctatctgagcagtggtataaatttgatgatgagagggtgactaaagaagacactaaacgggcattagaggagcaatatggtggcgaggaagagttaccgcagacaaatcctggatttaacaacactccttttaaattcaccaaatattcaaatgcttatatgctggtgtatatacgtgaagctgacaaggacaaagtaatatgcaatgtggatgaaaaagacattgctgaacatttaagggagaggttgaagaaagaacaagaagaaaaagagcacaaaaagaaagaaaaagcagaggctcacctttacactattataaaggtggcacgagatgaagaccttgcagagcagattggaaaggatatatattttgatcttgtagaccatgacaaagtgaggagtttccgtgtccaaaaacagacatcttttaacctttttaaggacgaggtggctaaagagtttggaataccagttcaattccagcgcttttggctatgggcaaagcggcaaaaccatacgtatcgtccaaatcgaccattgacacacatggaagaagcacaatctgttggacaattgagagaggtatccaacaaagttcacaatgcagaattaaaattgtttttggaagtggagcttgggctggatttacgtcccattgcaccgcctgacaagacaaaggatgatatattacttttcttcaagttatatgatactgaaaaagaggagctacgttatgttggaaggctctttgtgaaggctactggtaagccatcagaaattttaaccaggttaaataaaatggctggttatgatcctgatgaagagattggactatacgaggaaattaagtttgagccaaatgttatgtgtgaacctattgataagaaagtaacatttcgagcaagccagttagaagatggagatattatatgctttcagaaagctcctgctatagacaatgaacacgtccgctatccagatgtgccttcataccttgaatatgtgcacaatcgccaggttgttcactttcgatctctagaaaaaccaaaggaagatgacttctgcctggagatgtcaaggctctatacatatgatgatgtggtggagaaagtggctcaacaacttggtttggatgatccatccataattaggcttacccctcacaattgctactctcaacaaccaaaaccccaacctattaagtatcgtggtgtggaacatttgtctgatatgctggttcactacaatcagacttcggatatattgtactatgaagtacttgacatccctctgccagaactacaaggattgaaaactctgaaagttgcatttcaccatgctaccaaggatgaagtggttattcataccatcagactcccaaagcagagcactgtgggggatgtccttaatgatctgaaaacaaaggtggaattgtctgatcctgaagccgagcttaggttgcttgaagttttctatcacaagatatacaaggtcttccctcccaatgaaaagattgaaagtataaatgatcaatactggacattacgtgcagaggagattccagaagaagagaaaaatctgggtcctcatgatcgtctaatccatgtgtatcatttcactaaagacacagctcagaaccaaatgcaaattcagaactttggggaaccctttttcttggtcatacatgaaggggagactttggctgaaattaaagtaagaatacagaagaaacttcaagtccctgatgatgagtttgtcaagtggaaatttgcctttttttcattagggcgtcctgaataccttcaggattctgacattgtgtccagtcgttttcagaggagagatgtttatggtgcttgggagcaatatcttggtttggagcatactgataatgctcctaaaagatcatatgctgttaaccagaatcgccatactttcgagaagccagtaaagatttataattaaggaaactggtattgatgagttatcgtcttgcgtgggatgaatttgccatattctgctacatctatgggcttttgtaaaaacagggaaaatagcgaaaggctactccgtataggccacaattagtgagatcagcaatccaggtggtttctgcaggttttatattagaattgtggtatgtaattctttctgtcaacggatctcaacactgtctgccgaccacagcccgttgagctttactacttccaactttgtgtggaagttgttcaagttggggtcattgatcatcatcactgtactgtaccagtacataagatttttggattagtgagtgtatacagggtatagttggttgacttttttttttttttgttcatcttgattgcttccagattttgttcactcagtagtgttaatttaagtgatgggctgcaaaatggtgtagcagagttaatgtaatgttgtaaaagagactcgctagcctcggtataaccctttagcataaaaatatagtttcctgccgcaccatttgctccatttcatttggctttttttttttttttttgagttttttctgtttcttcgcctcaccttgttggctgttaccaacgccgtctcacttaattttagaggaaaataaaattaaggca

SEQ ID NO: 2350 - DNA, 4157 bp, Cajanus cajan
tcgagcaacagcaatagcaatagcttctggtgattgatctcgttttcttacactgctcttccccctttctctctcttccattgctccaccacgagtgacgccacgcgaggtcaattgcgcaatcgccatgactgtcatgactcctgctcccattgaccagcaggaggacgaggagatgcttgtcccgtcgcacacggattcggctgagaataatcaccaacccatggaagttgtggctcaacctgatgctgtcaacactgtggagaatcagcctgttgaggatcctacatcgtcaagattcacatggagaattgacggcttctctaggatgaatacaaagaagctctattcggatgtatttgttgttggtggttttaaatggcgtgtacttattttcccaaaaggaaacaatgtggactatttgtccatgtatttggatgttgcagattcagctagtttgccctatggttggagtagatatgcacagtttagcttggcagttgttaatcagatccataataaatactctgtgagaaaagacacacagcaccaattcaatgcacgagaaagtgattggggtttcacatccttcatgcctcttggtgaattgtatgatcctagtagagggtatcttgtgaatgatactcttgtagttgaagccgaggttcttgttcgtagaattgttgattactggacatatgattcaaaaaaggagactggctatgttgggcttaagaaccagggagctacttgttatatgaattctcttctccaaactttataccatattccttattttcgaaaggctgtgtaccatatgccaacaacagagaatgacatgccctctggaagcattcctctggctttgcaaagtttattctacaagctccaatatagtgacaccagtgttgcaacaaaggagcttacaaaatcttttggatgggatacatatgattctttcatgcagcatgatgttcaagaactgaacagagtcctttgtgaaaaacttgaagacaaaatgaagggaactgttgttgagggaactatacagaagttatttgaagggcatcatatgaactacattgaatgcatcaatgtggactataaatcaactagaaaggagtcattttatgaccttcagcttgatgtgaaaggctgtcctgatgtttatgcttcctttgacaagtatgttgaagttgagcgtcttgaaggggacaacaaatatcatgctgaacaatatggtttgcaggatgccaagaagggtgttctattcatcgatttccctcctgttcttcagcttcagcttaaaagatttgaatatgactttatgcgggatactatggtaaagattaatgatcgttatgagtttcccttgcaacttgaccttgatcgtgagaatggaaaatatttgtcacccgatgctgataggaatgtccgtaatctttacacccttcatagtgttttggttcacagtggtggtgtgcatggtggacattattatgcttttatcaggccaacgctctctgagcagtggtataaatttgatgatgagagggtgactaaagaagacactaaacgggcattagaggagcaatatggtggtgaggaagagttaccacagacaaatcctggatttaacaacactccttttaaattcaccaaatattcaaatgcttatatgctggtgtatatacgtgaagctgacaaggagaaagtaatatgcaatgtggatgaaaaagacattgctgaacatttaagggagaggttgaagaaggaacaagaagaaaaagagcacaaaaagaaagaaaaggcagaggctcacctttacactattataaaggtggcacgagatgaagaccttacacagcagattggaaaggatatatattttgatctagtagaccatgacaaagtgaggagtttccgtgtgcaaaagcagacatcttttaacctttttaaggaagaggttgccaaagagtttggcataccagttcaattccagcgcttttggctatgggcaaagcggcaaaaccatacctatcgtcctaatcgaccattgacacacatggaggaagcacaatctgttggacaattgagagaggtatcaaacaaggttcacaatgcagaattaaagttgtttttggaagtggagcttgggccggatttacgtcccattgcaccacctgacaagacaaaggatgatatactacttttcttcaagttatatgatcctgaaaaagaggagcttagttatgttggaaggatgtttgtgaagagtactggtaagccatcagaaattttaacgaagttgaataaaatggctggttatgatcctgatgaagagattggactatacgaggaaatcaagtttgaacccaacgtaatgtgtgaacctattgataagaaagtaacttttcgagcaagtcagttagaagatggagatattatatgctttcagaaagctcctgctatagacagtgaggaacatgtccgttatccagatgtgccttcatacctagaatatgtgcacaaccgccaggttgttcactttcgatctctagataaacccaaggaagatgacttctgcctggagatgtcaaggctctttacgtatgatgatgtggtggagagagtggctcaacaacttggtttggatgatccatccataattaggcttacccctcacaattgctactctcaacaaccaaaaccgcagcctattaagtatcgtggtgtagaacatttgtctgatatgctggttcactacaatcaaacttcggatatattgtactatgaagtacttgacatccctctgccagaattacaaggtttgaaaactctaaaagttgcatttcaccatgctaccaaggaggaagtggttattcataccatcaggctcccaaagcagagcactgtgggggatgtccttgatgatctgaaaacaaaggtggaattgtctgatcctgaagctgaacttaggttgcttgaagttttctatcacaagatatacaaggtcttccctcccaatgaaaagattgaaaacattaatgatcagtactggacattacgtgcagaggagattccagaagaggagaaaaatctgggtcctcatgatcgtctaatccatgtgtatcatttcactaaagacacagctcagaaccaaatgcaaattcagaactttggggaaccctttttcttggtcatacgtgaaggggagactttgtctgaaattaaagtacgaatacagaagaaacttcaagttcccgatgatgagtttgtcaagtggaaatttgcttttttctcattagggcgtcctgagtaccttcaggattctgacattgtatccagtcgttttcagaggagagatgtttatggtgcttgggagcagtatcttggattggagcatactgacaatgctcctaaaagatcttatgctgttaaccagaatcgccacacttttgagaagccagtaaagatttataattaggaaactggtattgatgagttctcgtctcgcgtgggatgaatttggcattcttctacatctatgggcgtgtaaaaacagggaaaatagcggaaggctactctgtataggccaactagtgaactgagatcagcaatcctggtggtttctgcaggttttatattttaattgtggtatgtaattctttctgtcaacggagtgacattgctctcaacactatctgccgaccacagcccgttgagctttactacttcctactttgtgtggaagttcaagttgaggtcattgatcatcatcactgcactgtatcagtacataagatttttggattagcgagtgtatacagggtatagttggttgactttttttcttcatcatgattgcttccagattttgttcagttagtagtgttaatctaagtgagggctgcaaaatggtgtagcagagttattgtaatgttgtaaaagagactcgtcagccacggtataacccgttagcataaatatagtttcctgccgcaccattttgtccattttctgtgctgttttacttcactttctttcctgtcatatctagaagaacttgagtatgcgttgccaaccaacagcgtctcagttaaatttagagaaaagggcattggtatttgggtttgccagttctgcccatatcttcg

SEQ ID NO: 2351 - DNA, 4184 bp, Glycine max
gagcaatagcaacacagcaatagcttctggtgatctcgttttctcacattgctctcttccccctttctctctcctctttctctctcttccattgcttctccataagcaacgccacgcgaggtcaattgcgccatcgccatgactgtgatgactcctgctcccattgaccagcagcaggaggacgaggagatgcttgtcccgcacacggatttggctgagaataatcaccaacccatggaagttgtggctcaacctgatgctgccaacactgtggagagtcagcctgtcgaggatccttcaacgtcaaggttcacatggaaaattgacaacttttctaggatgaatacaaagaagctctattcagaaatatttgttgttggtggttataaatggcgtgtacttattttcccaaaagggaacaatgtggactatttgtccatgtatttggatgttgcagattcagctagtttaccctatggctggagtagatatgcacagtttagcttggcagttgttaatcaaatccataataaatactctgtgagaaaagacacacagcaccaattcaatgcgcgggaaagtgattggggtttcacatctttcatgccgcttggtgaattgtatgatcctagtagagggtatcttgtgaatgatactcttgtagttgaagccgaggttcttgttcgtagaattgttgattactggacttatgattcaaaaaaggagactggctatgttggacttaagaaccagggagctacatgttatatgaattctctactccaaactttgtaccatattccttattttcgaaaggctgtataccacatgccaacaacagagaatgacatgccctctggaagcatccctttggctttgcaaagtttattctacaagctccagtatagtgacaccagtgttgcaacaaaggagctcactaaatcttttggatgggatacatatgattctttcatgcagcatgatgttcaagaactgaacagagtcctctgtgaaaaacttgaagacaagatgaagggaactgttgttgagggaactatacagaagctatttgaagggcatcatatgaattatatcgaatgcatcaatgttgactataaatcaactagaaaggagtcattttatgaccttcagcttgatgtgaagggctgtcctgatgtttatgcttcctttgacaagtatgttgaagttgaacgtcttgaaggggataacaaatatcatgcggaacaatatggtttgcaggatgctaagaagggtgtcctgttcattgatttccctcctgttcttcagcttcaactgaaaagatttgaatatgactttatgcgggatactatggtcaagattaatgaccgctatgagtttcccttgcaacttgaccttgatcgtgagaatggaaaatatttatcacctgatgctgataggaatgtccgcaatctttacacacttcatagcgttttggttcacagtggtggtgtgcatggtggacattattatgcttttatcaggccgactctatctgagcagtggtataaatttgatgatgagagggtgactaaagaagacactaaacgggcattagaggagcaatatggtggtgaggaagagttaccacagacaaatcctggatttaacaacactccttttaaattcaccaaatattcaaatgcttatatgctggtgtatatacgtgaagctgacaaggacaaagtaatatgcaatgtggatgagaaagacattgctgaacatttaagggagaggttgaagaaagagcaagaagaaaaagagcacaaaaaaaaagaaaaagcagaggctcacctttacactattataaaggtggcacgagatgaagaccttgcagagcagattggaaaggatatatattttgatcttgtagaccatgacaaagtgaggagtttccgtgttcaaaaacagacgtcttttaacctttttaaggaagaggttgctaaagagtttggcataccagttcaattccagcgcttttggctatgggcaaagcggcaaaaccatacgtatcgtccaaatcgaccattgacacacatggaagaagcacaatctgttggacaattgagagaggtatcaaacaaggttcacaatgcagaattgaaattgtttttggaagtggagcttgggctggatgtatgtcccattgcaccgcctgacaagacaaaggatgatatattacttttcttcaagttatatgatcctgaaaaagaggagctacgttatgctggaaggctctttgtgaagagtactggtaagccatcagaaatcttaaccaggttaaataaaatggctggttatgatcctgatgaagagattggactatatgaggaaattaagtttgagccaaatgttatgtgtgaacccattgataagaaactaacatttcgagcaagccagttagaagatggagatattgtatgctttcagaaagctcctgctatagacagtgaacatgtccgctatccagatgtgccttcatacctagaatatgtgcacaatcgccaggttgttcactttcgatctctagaaaaacccaaggaagatgacttctgcctggagatgtcaaggctctatacatatgatgatgtggtggagaaagtggctcaacaacttggtttggaagatccatccataattaggcttacccctcataattgctactctcaacaacctaaaccccaacctattaagtatcgtggtgtggaccatttgtctgatatgctggttcactacaatcagacttcggatatattgtactatgaagtacttgacatccctctgccagaattacaaggattgaaaactctgaaagttgcatttcaccatgcaaccaaggatgaagtggttattcataccatcagactcccaaagcagagcactgtgggagatgtccttgatgatctgaaaacaaaggtggaattgtctgatcctgaagccgagcttaggttgcttgaagttttctatcacaagatatacaaggtcttccctcccaatgaaaagatcgaaagcattaatgatcaatactggacattacgtgcagaggagataccagaagaagagaaaaatctgggtcctcatgatcgtctaatccatgtgtatcattttactaaagacacagcacagaatcaaatgcaaattcagaactttggggaaccctttttcttggtcatacatgaaggggagactttggctgaaattaaagtaagaatacagaagaaacttcaagttcctgatgatgagtttgtcaagtggaaatttgcctttttttcattagggcgtcctgaatatcttcaggattctgacattgtatccagtcgttttcagaggagagatgtttatggtgcttgggagcagtatcttggcttggagcatactgacaatgctcctaaaagatcatatgctgttaaccagaatcgccacactttcgagaagccagtaaagatttataattaggaaactggtattgatgagttctcgtcttgcgagggatgaatttggcatattctgctacatctatgggcatttgtaaaaacagggaaaaatagcgaaaggctactctgtataggccataattagtgagatcagcaattccaggtggtttctgcaagttagaatttatattagaattgtggtatgtaattctttctgtcaacggatctcaacactgtctgccgaccactgcccgttgagctttactacttccaactgtgtggaagttgttcaagttgaggtcattgatcatcatcactccactgtatcagtacataagatttttggattagtgagtgtatacagggtatagttggttgactctttttttgttcatcttgattgcttccagattttgttcagtcagtagtgctactttaagtgagggctgcaaaatggtgtgtggcagagttaatgtaatgttgtaaaagagactcgccagcctaaaaatatagtttcctgccgcaccatttgctccaactcatgtgccttttttattttactttttcctgtttcttcgcctcaccattaagccacttttattgattagagtttggctgttaaagttaagctaaaaataagccaggctaaacatatagctcactcacattttgaactttaggtcagaagttaccacgattcctatatgataa

SEQ ID NO: 2352 - DNA, 4107 bp, Fragaria vesca
cgaaagtagccagtccacgtagaaagagagagagaggcaaagactataacctctttctctctcctctctctcgaccctgcttcttcttctgggtgatcgccattttgtgtgttcactttgccttttacttctaatcccacactctgagagctccggcctcattcccgaccttccgttccgtcatgaccgtcatgactcccgcccctattgatcaacctgaggacgaggagatgcttgttccaccttcggatttgcccgaaaacaatcaccagcccatggaagttgttgcacaaccggaaaatgctaataatgtggagacccagccagtagaagatcctccttcgtccagatttacatggagaattgacaacttttctaggatgaatacaaagaagctttactctgacatatttgttgttggtggctataaatggcgtgtgcttatttttcccaagggaaacaatgtggatcatttgtctatgtatttggatgttgcggactctacaaatttgccatatggctggagtagatatgcacaatttagcttgggagttatcaatcaagttcataataagtattctgtacgcaaagacacacaacatcagttcaatgcacgcgaaagtgattggggtttcacatcctttatgcctctcggtgaactatacgatcccagcagaggttatctagtgaatgatgcagttataattgaagcagaggttctcgttcgcagggttgtagattattggacatacgactcaaagaaggaaacggggtttgttgggcttaagaaccaaggagctacatgctacatgaactctctcctgcagaccctgtatcatattccttattttagaaaggccgtttaccatatgcccacaactgagaatgatttgccatcacaaagcataccattggctctccagagtctattttacaaactccagtacagtgacaatagtgttgcaacaaaagagctgacaaagtcttttggatgggatacatatgattcatttatgcagcatgatgtgcaagaactgaatagggttttgtgtgaaaaacttgaagacaaaatgaagggaactgttgtagagggaaccattcagcagttatttgaaggtcaccatatgaactacatcgaatgcattaatgtggactacaaatctacgagaaaggagtcattttatgaccttcagcttgatgtcaaagggtgtcgcgatgtatatgcttcttttgataagtatgtagaagttgaacgtcttgagggtgataacaagtatcatgctgaacagaatggattacaggatgctaagaaaggtgtcctgttcattgactttccccctgtgcttcaacttcaactgaaacggtttgagtatgactttatgcgtgacaccatggtgaagattaatgaccgttatgagttccctttgcaacttgaccttgatcgagagaatggaaaatatttatcacctgaagctgataggagtgttcgcaacctttacacacttcacagtgtattggtacacagtggtggggtgcatggtggacattactatgcctttatcaggccgacgctgtctgatcagtggtacaaatttgatgatgagagagtaacgaaagaagatataaagagggcattggaggagcagtatggtggtgaggaagagctaccacagacaaaccctggatttaacaacactcctttcaaatttacaaaatactcaaacgcgtacatgctggtgtacatacgtgaaactgacaaggataaaataatctgcaatgttgatgagaaggacattgctgaacatctacgggagaggttgaagaaagaacaagaagaaaaggagcacaagaagaaagagaaggcagaggcacatctatatactatcattaaggttgcccgggacgagaacctgctggagcaaattgggaaggatatatattttgatcttgtggatcatgacaaagtcaaaagttttcgtattcagaaacagatgcctttcaaccttttcaaggaggaggttgctaaggagtttggcataccagtgcaatttcagcggttttggctgtgggcaaagcgtcaaaatcatacatatcgtccaaaccgtccattgacacctgtggaggaaacacaatctgttggacagttgagggaggtatcaaacaaggttcataatgcagaactgaagttgttcttggaaatagagcttggactggatttacaccctattgctccacctgacaagacaaaggatgacatcctgcttttctttaagctttatgagcctgaaaaagaagaactacgttatgttggaaggcttttcgtgaagagtactggtaagccagctgaaatcttgtcgaaattaaatgaattggctggctatgcccctgatgaggagatcgacctctatgaggaaatcaagtatgagcccactgtcatgtgtgaacccatcgacaagaaattcacatttcgagccagccagcttgaggatggagacattgtttgctttcaaaaaccaaatccagatgaaaatcagttccgctatccagacgtcccgtcttttctggattttgtgcacaatcgtcttgttgttcatttccgatcattcgagaaacccaaagaggatgatttcagcttagaattgtcaaaacttcatacctatgatgatgttgtggagcgagtagctcaacaacttgggttggacgacccatccaaaattaggctcacctcacataactgttactcccagcaacccaaacctcagccaattaagtaccgtggggtagagcgtttgactgatatgctggttcactacaatcagacttcagatatattgtattatgaagtattggatatccctctgcctgaattacaaggtttgaaaaccctgaaagttgcatttcatcatgctaccaaggatgaagtggttattcacaccataaggctgccaaaacagagcactgtgggggatgtaatcaatgatcttaaaactaaggttgaattgtctcatccggatgcagaacttaggttgcttgaagttttctatcacaagatatacaaggtctttccccaaagtgaaaagatcgaaaacataaatgaccaatactggacgctacgtgctgaagaggtcccagaggaagagaaaaatcttggtcctaatgaccgtgtaattcatgtctaccacttcactaaagacactgctcagaatcaaatgcaaattcaaaacttcggagaaccttttttcctggttatacgtgaaggtgagaccttggatgaaattagagttcgaatacagaagaaattacaggttgcggatgaggaatttgcgaagtggaagtttgcatttctttcgctaggtcgcccggagtaccttcaggacactgatattgtttctagtcggttccagagaagagatgtttatggtgcttgggagcagtatcttgggttggagcactctgacagtacacctaaaagatcttatgcagctaatcagaatcgccatacatatgagaagccagtaaaaatctacaactaagatgcagtgtgctgactggactttcttcatttcagagatgaattgggtgatcctctacatcatttggctgtagaagttgggaagtggtgaaacgcaactgtatagctcggaagctgtcagcaaggtttggtgagttgattttgttgtctatgtaattctttatcccagtttgtggttggggaggacttatccgtagatcagtgtttatctccaaccattggtcaaagcctctattgtgtttttacaacttttctggaggttcttcctttggttgacaaggcaatggccttcatcaagcagttcagtgtaactttaacagtaaataaacaggatttttgaactagttaatgtatacagggtatagtttggtctttctccatgtttggttgttctgttcagtttaggtagggagatggggttgtccatcaattagttcctaaacatatgttttgtaaaagtgacttctgaggtactgccattgatggctattcttaattttcactgtgtagtacatagatacactttttctgcagaaaggtttgtatttcagctcgtcacctaccaacatgtcgat

SEQ ID NO: 2353 - DNA, 3945 bp, Lotus japonicus
ctggtgatctcgttttcacacactcctctctctctctctctctccttcttcttcttcttctctgcgaataagcaacgctttgcgaggtcaattgccgcaatcgccatgaccgtgatgactcctgctcccattgatcagcaggaggatgaagagatgcttgttccgcatacggatttgcctgagaataatcaccaacccatggaagttgttgctcaacctgaagctgcccccactgtggagagtcagcctgtcgaggagcctccacaatcaaggttcacgtggagaattgacaacttctccaggatgaatgtgaaaaagctctattcagaagtatttgttgttggtggttataaatggcgtgtacttattttcccaaaagggaacaatgtggactatctgtccatgtatttggatgtcgcagattcaactaatttgccctatggttggagtagatatgcacagtttagcttggcagtagttaatcaaatacagaataaatacaccgtgagaaaagacacacagcatcaattcaatgcacgagaaagtgattggggtttcacgtccttcatgccgcttggtgaattgtatgatcccagtagagggtatcttctgaatgatactcttgtagttgaagccgaggttcttgttcgtaggattgttgattactggacttatgattcaaaaaaggagactggctatgttgggctgaagaaccagggagctacatgttatatgaattctctactccaaactctgtaccatataccttattttcgaaaggctgtataccatatgccaacaacggagaatgatatgcccgctggaagcattcctctggctctgcaaagtttattctacaagctccaatatagtgacaccagtgttgcaacaaaggagctgacaaaatcttttggatgggatacatatgattctttcatgcaacatgatgttcaagaactgaatagagttctatgtgaaaaacttgaagacaaaatgaagggaactgttgttgagggaactatacagaaattatttgaagggcaccatatgaactatattgagtgcatcaatgtggactataaatcaactagaaaggagtccttttatgaccttcaacttgatgtgaaaggctgtcatgatgtttatgcttcctttgacaagtatgttgaagttgaacctcttgagggggacaacaagtatcatgctgaacaatatggtttgcaggatgctaagaagggtgtcctatttattgattttcctcctgttctgcagcttcagctgaaaagatttgagtatgattttatgcgggacactatggtaaagattaacgatcgttacgagtttcccttggaacttgaccttgatcgtgatgatggaaaatatttatcacctgatgctgataggaatgtccgcaatctttacacacttcatagtgttttggttcacagtggtggtgtgcatggtgggcattattatgcttttatccggccgactctctctgatcagtggtacaaatttgatgatgagagggtgacaaaagaagatactaaacgggcactagaggagcaatatggtggggaggaagagttaccccagacaaatcctggattcaataacacaccttttaaattcaccaaatattcaaatgcatatatgctggtatatatacgtgaagctgacaaggacaaagtaatatgcaatgtggatgagaaagatattgctgaacatttaagggagaggttgaagaaagaacaggaagaaaaagagcacaaaaagaaagaaaaggcagaggctcacctctacactattataaaggtggcacgaaatgaagaccttaaagagcagattggaaaggatatatattttgatctcgtagaccatgacaaagtgaggagtttccgtgtccaaaagcagatgtcatttaaccttttcaaggaagaggttgctaaagagtttggcataccagttcaattccagcgcttttggctatgggcaaagcgtcaaaaccatacatatcgccccaatcgaccattgacaccagctgaggaagcacaatctgttggacaagtgagagaggtttcaaacaaggttcacaatgcagaattgaagttgtttttggaagtggagcttggaccggacttacgtcccattgcaccatctgacaagacaaaggacgatatacttctttttttcaagttatatgatcctgaaaaagaggagctacgttatgttggaaggctctttgtgaagagtaccggtaagccatcagaaatcttaacaaggttaaatgaaatggctggttatgatcctgacgaagagattggactttatgaggaaattaagttcgaaccaaatgtcatgtgtgagcctattgacaagaaattaacatttcgagcaagccagctagaagatggagatatcatatgctttcagaaagctcctgcaatggatagtgaggaacatgttcgctatccagatgtgccttcttacttagaatatgtgcacaatcgccaggttgtccactttcgttcgttagataaacctaaagaagatgacttctgcctggagatgtcaaggctgtatacatatgatgatgtggtggagaaagtagcccaacaacttaacctggacgatccatccaaaattaggcttaccccacacaactgctactctcaacaacctaaaccccagcctataaagtacagaggggtggatcatttatctgatatgctggttcattacaatcagacttcggatatattatactatgaaatacttgacatacctctgccagagttacaaggtctgaaaactctgaaagttgcattttatcatgctaccaaggatgaagtggttagtcataccatcaggctcccaaaacagagcactgtgggggatgtccttgacgatcttaaaacaaaggttgagttgtctcatcctaatgctgagcttaggctgcttgaagtcttctatcacaagatatacaaggttttccctcccaatgaaaagattgaaaccataaatgatcaatactggacattgcgtgcagaggaggttccagaagaagagaaaaatcttggtcctcatgatcgtctaatccatgtgtatcatttcactaaagacacatcccagaaccaaatgcaaattcagaactttggggaaccctttttcttggtcatacgtgaaggcgagactttaactgaaattaaagtgagaatacagaagaaacttcaagttcctgatgatgagtttgaaaagtggaagtttgctttttttgcattaggccgtcctgaatacctccaggactctgacatcgtatccaatcgttttcagagaagagatgtttatggtgcttgggagcagtatcttggtttggagcatactgacaatgctcctaagaggtcatatgctgttaatcagaatcgccacacatttgagaagccagtaaagatttacaattaggaagtcggtgttgatgagtcctcgtctcgcgggggatgaacttagcattcttctacatctatgggtttgtaaaaacagggaaaatagcaaagggctaactgcgcgtaggccaacttgtaagttcagcaattgaggtggtgtctggagggttttttatattagaattgtggtatgtaattctttctgtctgacggattgtcattgctgtcaccccttgagcttcttactacttccatatttatatggaagttgttcttcaagttgaggtccttgattgatcatcatcactgcactgtataatccgtacatatgatttttggattagcgagtgtatacagggtatagttggttgactctttttgtttgtcaactccttgattgcttccagattttgttcagttagcaaagagacatggttagacaggaatattctgctgcaccatttcttgtgattattctcttgttctttacttcagtttagcc

SEQ ID NO: 2354 - DNA, 4124 bp, Medicago truncatula
cgagcaacaccttcttctggtgtgatctcgtttttttttttttttttttcacagtgcactttctctctcctccattgttttccttcaacaaccgcaccgcgaggtcaatttccataaccgtcatgaccatcatgactcctgctcccattgaccaacaacagcaggaagatgaagagatgcttgtgccgcacgcggttccgcatgcggatttggctgagaacaataatcatcaaccaatggatgtggttgctcaacctgaaactgccaacactgtggagcctgtcgaggatccttcaccatcaagattcacatggagaattgacaacttttctagggtgaatttgaaaaagctctattcagatgtatttgttgttgggagttacaaatggcgtgtacttatttttccaaaagggaacaacgtggactatttgtccatgtatttggatgttgcagattcaactagtctgccctacggttggagtagatatgcacagtttagcttggctgttgttaatcagatccataataagtacaccgtgagaaaagatacgcagcatcagttcaatgcacgggaaagtgactggggtttcacatccttcatgcctcttggtgaattgtatgatcctagtagagggtatcttatgaatgatactcttataattgaagctgaggtccttgtccgtaggattgttgattactggacatatgattcaaaaaaggagactggatatgttgggcttaagaaccagggagctacatgttatatgaattctctgcttcaaactctgtatcatattccttatttccgaaaggctgtataccacatgcctacaacagagaatgatatgccctctggaagcatccccctggctctgcaaagtttgttctacaagctccagtatagtgacaccagtgttgcaacaaaagagctgacaaaatcttttggatgggatacatatgattctttcttgcagcatgatgttcaagaactaaatagagtcctttgtgaaaaacttgaagacaaaatgaaggcaactgttgttgagggaactatacagaaattgtttgaagggcaccatatgaactacatcgagtgcatcaatgtggactataaatcaacacgaaaggagtcattttatgatcttcaacttgatgtcaaaggttgtcctgatgtttatgcttcctttgacaagtatgttgaagttgaacgtcttgagggggacaacaaataccatgctgaacaatatggtttgcaggatgctaagaaaggtgtcctgttcatcgattttcctccagtcttgcagcttcagctgaaaagatttgaatatgactttatgcgggatactatggtaaagattaatgatcgttatgagtttccattgcaacttgatcttgatcgtgacaatggaaaatatctatcacctgatgctgataggaatgtccgcaatctttacacacttcatagcgttctggttcacagtggtggtgtgcatggtggacattactatgcttttatcaggccaactctctctgatcagtggtacaaatttgatgatgagagggtgacaaaagaagaccctaaacgggcaatggaggagcaatatggtggagaggaagagttaccgcagacaaatcccggattcaataacactccttttaaattcaccaaatattcaaatgcttatatgctggtgtatatacgtgaagctgacaaggaaaaagtaatatgcaatgtggacgagaaagatattgctgagcatttaagggagaggttaaagaaagaacaggaagaaaaagagcacaaaaagaaggaaaaggcagaggctcacctctacactattataaaggtggcacgggatgaagatcttggagaacagattggaaaggatatatattttgatcttgtagaacatgacaaagtgcggagtttccgtgtacaaaagcagacaccatttaacgttttcaaggaagaggttgctaaagagttcggcatacctgttcaattccagcgcttttggctatgggcaaagcgtcaaaaccatacatatcgtcctaatcgtccattgacacaaattgaggaagcacaatctgttggacaattgagagagatatcgaacaaggttcacaatgcagaattaaaattgtttttggaagtggagcgtggaccggatttatgtcccattgcaccacctgagaagacaaaggatgatatattactttttttcaagttatatgatcctgagaaagaggagctacgttttgttggcagactctttgtgaataacactggtaaaccatcagaaatcttagcaaggttaaataaaatggctggttatgatcctgaagaagagattggactttatgaggaaattaagtttgaaccaaatgtgatgtgtgagcctattgacaagaaattaacatttcgagcaagccagcttgaagatggagatattatatgctttcagaaggctcctgctacggataatgaggaacatatccgctatcctgatgtgccttcttacttggaatacgtgcacaatcgccaggttgttcactttcggtccctagataaaccaaaggaagatgacttctgcctggagatgtcaaggcttttcacatatgatgatgttgtggagagagtagctgaacaacttggtttggacgacccatccaaaatcaggctcaccccacacaactgctattctcaacaaccaaaaccccagcctatcaagtaccgaggggtggaacatttatctgatatgctggttcactacaatcagacatccgacatattgtactatgaagtacttgacatccctctgccagaattacaaggtttgaaaactctgaaagttgcgtttcatcatgctaccaaggatgaagtggttatccacaccatcagactcccaaagcaaagcactgtaggagatgtccttgaggatcttaaaaagaaggttgaattgtctcgtcctgatgctgaacttaggttgcttgaagtcttttatcacaagatatacaaggttttccctcccaatgaaaagattgaaaacataaatgaccaatactggacactacgagccgaggagataccagaagaagagaaaaatcttggtccccatgatcgtctaatccacgtgtatcattttactaaagacactactcagaaccaaatgcaaattcagaactttggggaaccttttttcttggtcatacacgaatgtgagactttggctgaaattagattgcgaatacagaagaagcttcaagttccagacgatgagtttggcaagtggaagtttgcttttttctcattagggcgtcctgagtaccttgaggactctgaagttgtatcaaatcgttttcagagaagagacgtatatggtgcttgggagcagtatcttggcttggagcatactgataatgctccaaaaagatcatatgctgctaatcagaatcgtcacacatttgagaagccagtaaagatttataattaggaaatcagcatggatgagctatcattttgcatgggatgaattcagtgttcttctatgtctatgggattgtaaaaacagggaaagcagcgaaagactaattatgcataggccaacttttgagatcagtgaccaaggtggtgtgtgcaggttttatattagaattatgacatgtaattcctttttttgatggactgatattgctctcttaccttgtgtatctgctgccgaccacttgagctttttgctacttccgttggtctatggaagttgttcttcatgtccaggtccttgatcatcgtcactgcgctgtatcagtacataagattttttgttggattagcaagtatatacagagtatagttggttggctctttttgtcctcttggtcgctttcagattttgttcagttagcacttagcagtgttaattctagtgagggctgcaaaatggtgtaacaaagttcatgtagtgttttgtaaaggagactttgcagccaccatatactcgttagcataaaatattctgcagcaccatttggttcacctcttgtggctgttttactatttcctttttattgtcttggaaggaatatcagtcaacgagactgtttcttaaatctgaaaaagaaag

SEQ ID NO: 2355 - DNA, 3948 bp, Papaver somniferum
ctctctaaaaaagaacacgaaaaatctctgcttcgatttttctcagaaatcgtttaatttatcttcaaatttccagacatgactctgatgactcctccgccgttagatcaggaggatgatgagatgttggttccacattcagagtttgttgaaggtcctcaacctatggaagtcgcaacagcagaagcagttagtacagttgaaaatcagccggttgaggatcctgcatcttcgagatttacctggacgattgagaatttttctaggttaaacactaagaaacattactctgatgtcttcactgttggtgcttataaatggcgggtgctgatttttcccaagggaaataatgtagatcacttatctatgtaccttgatgttgcggactcagctaatttgccgtatgggtggagtaggtatgcacagttcagtttggcaatcgtcaatcaaatccataacaagtacacagtgagaaaagatacacaacaccaatttactgcacgagaaagtgatttgggtttttacatcgttcatgcctcttagtgaactttacgaccccggaagagggtatctcgtaaatgatacatgtatagtgaagcggaggttgctgtccgtaaaaatcacggattactggacatatgactccagaaaggagacaggttatgttggtcttaagaatcagggagcaacatgttatatgaactctcttctccagactctgtatcatattccttattttagaaaggcggtgtaccatatgccaacaactgagaatgatttgccatcaggaagcatccctttggctctacagagtttgttttataagcttcagtacagtgacaatagcgtcgcaacaaaggagctgactaaatcttttggatgggatacatatgattctttcatgcaacatgatgtgcaggaacttaatagggttctttgtgaaaagcttgaagataagatgaagggaactgttgtggagggtacgatacaacagttgttcgaaggtcaccatatgaactacattgaatgcatcaacgtggactacaaatctactagaaaggagtcattttatgaccttcaacttgatgtaaaaggctgtcgggatgtttatgcttctttcgacaagtacgtggaagtggagcgtcttgaaggtgataacaagtatcatgctgaacaacatggtttacaggatgcaaagaagggtgttcttttcattgacttcccacctgttctccaactccagctaaaacggtttgaatatgattttatgcgggatactatggtgaagataaatgatcggtatgagttccccctgcaacttgatcttgacagggaggacggcaaatacttatcaccagatgctgatagaagagttcgcaatctttacacacttcatggtgttttggttcacagtggtggggtgcatggtggacactactatgcttttataaggccgacactgtcagaacaatggttcaaattcgatgatgagcgggtaacaaaagaagatatcaagcgggcattagaagagcagtatggtggggaggaggagttgcctcagacaaatccagggttcaataatacaccattcaaatttacaaaatattcaaatgcatatatgcttgtgtatatacgtgaaagcgataaagataaaattatttgtaacgtggatgagaaggacatcgctgaacacctgaggattaggttgaagaaagaacaagaagagaaggagacataaaaagaaagaaaaagcagaggctcatttgtataccattataaaggttgctcgaaatgaggacctttttgaacagattgggagagatatctattttgatcttgttgatcatgacaaagttcgcagtttccgtatccagaaacagatgtccttttaacctcttcaaggaggaggttgctaaagagtttggtgtacctgtgcaatttcagcggttttggtatgggcaaagcgtcaaaatcatacttatcgtccaaaccgaccgttaacgcctcaagaggagacacaatctgttggacagttgagagaagtttcaaataaggctcacaatgcggaactaaagttattcttggaaatagagctcgggccggaatcacatcccattcctcctcctgatagaacaaaagaagatattcttctttttttcaagctctatgatgctgaaaaagaagaacttcggtatgtggggagactctttgtgaagggtagtggtaagcccttggaaaattcttaaaaagcttaatgagatggctgggttctctccagatgaagaaatagaactttatgaggaaataaagtttgagcccacagttatgtgcgagcacatagacaagaagctcacattccgtgctagccagcttgaagatggagacattatttgcttccagaaacccacttcagctgatagtatgacactatgccgctatcctgatgttccttcttttctggaatatgttcataaccgtcaggttgtgcatttccgatctttggagaagccgaaggaagatgatttttgtttagagctgtcaaaggtcttaacatatgatgatgtcacggaaagagttgctcgccatcttggcttggatgacccaaccaagatcagacttacccctcataattgttactctcagcaacctaaaccccaagctattaagtaccaaggcgttgaccacttgtctgagatgttggtgcactacaatcagacatctgatattttgtattacgaagtcttggacatccctctaccagagctgcaaggtttgaaaactctaaaggttgcattccatcatgcaacaaaagaagatacggttgttcatagtattagacttccaaaacaaagtacagtaggtgacgtgattaacgatctgaagacaaaggttgagctgtctcatcccgatgcggaacttagattgttggaagttttctaccacaagatttataagatctttccgcttagtgagaagattgagaacattaatgatcagtactggactcttcgtgcagaggagattccagaggaggagaagaacttgggtcctcaggatcgcttgattcatgtttatcacttcacaaaggatgcatctcaaacccaaatgcaggttcagaattttggggaaccatttttcttaattatccatgaaggagagactttaggtgcagtcaaattgcgcatacagaaaaaattgcagattcctgacgaggaattcgctaagtggaagttcgcatttttgtcactgggccgtcctgagtaccttcaggactcagatgtagtgtccagccgttttcagagacgagatgtttatggagcttgggaacagtaccttggcctggagcattctgatagctcccccaaaagagcatatgcagccaatcagaatcgccatacatttgaaaagccagtaaaaatctacaactagggttaagctgataaagcctccgtgactacctactggaccctctaatccttcagcgacgtgtgcataaacgtgataagacaacaagatgggaattaatctttcatccgcttggagaatgaagctagcaatgaaatgagtttttcctttccgctggttttccaactgtagctccttgaacgtctcttgttcttgggtaaagaaaaacaaacaaaaggacgaatatgaaggcccttgttgtagtagggtgtgaggtttgcagttgtcctctaaatctttttttccagtgtaatagtaggtatataagaagattttggactctttgtatatggtgtgtagctgttctgaggtgtcttgacattgcttttctgttttttattcggtattaaagaattgggtttagttcagttcagacgcgttggtggatttgtacaagggttcatggtcttcttttcgtatatgtaaggtttgtgtaaaagaactttggcaatgctgttttcagccaagtcatacaaggattta

SEQ ID NO: 2356 - DNA, 3898 bp, Ricinus communis
gttcttttccacctctttacttttcatccagtccttctactcttaacatatcctgaaatgcccaaattgcccccttccttgtaacgaaaccccttccctttttctacactcagcttacgttgcagaactctctctttctctctccgtctctctctcaaatttctacttcgcagtttctccgattcctcgatcggacgttcaccataactacccatgactctgatgactcctccaccattagatcagcaagaggacgatgaaatgttagtccctcacactgagttcactgaaggtcctcagcctatggaagtagcacctgcagaaacagcaagtgcagttgatgcgcagtcagctgatgatccaccatcagcaaggttcacatggacaattgataatttctcgaggctcaataccaagaagctctactctgatgttttcattgttggaggctataaatggcggattctaatttttccaaaggggaacaacgtggatcatttgtcaatgtatttagatgtcgcagactctgcaactttgccatatgggtggagcagatatgctcaatttagtttatgcgttgtcaatcaaattcatcaaaaatactctattcggaaagacacacagcaccaattcaatgcacgtgagagtgattggggcttcacttcattcatgccccttggagaattgtatgaccctggtagaggttatcttgtcaatgatacatgtgtagttgaagctgatgttgctgtccgtagggtcattgattactggtctcatgattccaaaaaggagactggttatgttggacttaagaaccaaggagctacctgctatatgaactctctccttcaaacactgtatcatattccttatttcagaaaggctgtgtatcatatgccaacaaccgagaatgatatgccatcggggagcattcctctggctttgcagagtttattctataagcttcaatatagtgacaccagtgtagcaacaaaagagttaacaaaatcttttggctgggacacatatgattctttcatgcagcatgatgtgcaagaacttaatagggttctttgtgaaaagcttgaagataaaatgaagggaacagttgtggagggcacaatacaacagttatttgaagggcaccatatgaattatattgagtgcatcaatgtagactataagtcaacgagaaaggaatctttttatgatcttcagcttgatgtcaaaggctgtcgggatgtttatgcttcttttgacaaatatgtggaggtggagcgtcttgagggtgataataaatatcacgctgagcaacatggcttgcaggatgctaggaagggtgtcctatttattgactttccccctgttcttcaacttcaattaaaacggttcgaatatgatttcatgcgggatactatggtaaagataaatgatcgctatgagttccctttgcaacttgatcttgatagagaagatggtaaatatttgtctcctgaggcagacagaagtgtccgaaacctgtatactcttcacagtgttttagttcatagtggtggtgtgcatggtgggcactactatgcttacatccggccaaccctctcagatcaatggtttaaattcgatgatgagcgggtaactaaagaggatataaaaagggcgctagaggagcagtatggtggggaagaagagttaccacaggcaaatcctggcttcaacaactctcccttcaagtttacaaaatattcaaatgcttatatgcttgtgtatatacgcgaaagtgacaaagaaaagataatttgtaatgtggatgagaaggacattgccgaacacctgagggtgagatgttgaagaaagaacaggaagaaaaggaacaaaagagaaaggaaaaagctgaggcccacttgtatactatcataaaggttgctcgtagtgaggatctgcttgaacagattgggaaggatatatattttgatcttgtagatcatgacaaagttcgtagtttccgcattcagaaacaaatgccctttaatcttttcaaggaagaagttgtcaaagagtttggtataccagttcaatttcaacgtttttggttatgggcgaagcggcaaaaccatacatatcgtccaaatcgaccattgactcctcaggaagaagcacaatctgttggacaattaagagaggtttccaataaagcaaataatgccgagctgaagttgtttctggaagtagaatttggacaagatttgcggcctattcctcctcctgagaagactaaagaggatattctcctcttttttaaactttatgatccgtcgaaagaggagctccgatatgtcgggaggctatttgtaaagggggctggaaagccattagagatattgacaaagctaaatgaaatggctggctttgcttctgatcaagagattgaactatatgaggaaataaaattcgaacctaatgtcatgtgtgaacacattgacaagaagctcacgtttcgtgctagtcagcttgaagatggggatattgtttgctttcaaaagtccgctcaagatggaggtggtgaacaatgccgttacccagatgtaccttcatttcttgaatatgtacataaccgtcaggttgttcgctttcgatctttggagaaaccaaaggaggatgaattttgtcttgagctatcaaagcttcacaattatgatgatgttgttgaaagagtagctacgcatcttggcttggatgacccttccaaaattaggcttacatctcataactgttattctcaacaacctaagccacaacctatcaagtaccgaggggtggatcatttgtctgacatgctggctcactacaaccagacatctgacatcctttactatgaagtgctggatatccctctgccagaactgcaaggcttgaaaaccttgaaagttgcttttcatcatgccacaaaggatgaggtggtgattcatacaattagattgcctaaacagagcactgtaggtgatgttattaatgaccttaagataaaggttgagttgtcccatctcagtgcagaacttagattgcttgaggttttctaccacaagatttacaagatctttccccacaatgaaaagattgagaatattaatgatcagtactggacgttacgtgctgaggagattccagaagaggagaaaaaccttggtcctaatgatcgcttgattcatgtttatcattttatgaaggacccaactcaaaatcagcaggttcagaattttggcgaaccatttttcctggtcattcatgagggtgagacattgtcggaagtaaaagtgcgagtacaaaaaaaattgcaggttcctgatgaggagtttgctaagtggaagtttgcttttctgtcacttggtcgacctgaatatctccaagactcggacattgtatcgagtaggtttcagagaagggatgtctatggtgcttgggagcagtatctcggactggagcactctgacaatgctcctaaaaggtcatattcagctaatcagaatcggcacacgtttgagaagccagtaaaaatctacaattaggagaatgattagttgaaactaatatgttggattcatctggtatcccaaaggcatttgcgctgttgcaaaaggagaagaatgcagtcaagagtgagttcttagttgtgttagatgtgtaattctttcatgtagggcagggaggactgtcttaagacctcgatagttttgactctctcttttgcctgcgtctcaggcgaaatagatgacattcaatccttatattcctactgtaatttagtacataagattttgttgtggggaatgtatagagagtatagggtgtgtacttgattttttttttttacatttttcctattaatttcgctcttttcaat

SEQ ID NO: 2357 - DNA, 4197 bp, Gossypium hirsutum
aagtacagaaaatgaatgaaattccaaaattacccatttcccaataaagaccatcgaaagaccttgctttctcctcgcttctcttcactgtaataaaatcaccaaataaaatcaacccaaaaaatagagaaaaaatctttctcctagtttcccctttctcgttcctcttgttttcgtaagcttgtttacctctcaatttcatagctatgactgttatggcccctgcccccatcgatcaacaagaagatgaggaaatgctcgtcccacagtctgatttgaccgacaatcaccagcccatggaagttgtagcgcaacccgaagctgcaaatactgtggaaaatcaaccagttgaggatcctccttcatcaagattcacttggaggattgaaaacttctctaggttaaacgctaagaagcattattctgaagtcttcgttgtcggtggttataaatggcgaatactgctatttccaaagggaaacaatgtggatcatttgtctatgtatttggatgttgctgactcagcaagcttaccctatgggtggagtagatatgcccagttcagtttggcagtagttaatcaaattcataataaatattctatcagaaaagacacacagcaccagttcaatgcacgagaaagtgattggggttttacatcctttatgcccctcggcgagttatatgatccttgcagagggtatcttgtgaatgacactttgattgttgaagcagaggtggttgtccgcaggattgttgattactggacatatgactcaaagaaggaaactggttatgttggacttaaaaatcaaggagcaacatgttacatgaattctctgcttcaaactctgtatcacattccttacttcaggaaggcagtgtatcatatgcctacaactgagaatgatatgccatcaggaagcatccctcttgctctgcagagtttattttacaaactccagtacagtgacagcagtgttgcaacaaaagagctgaccaaatcttttggatgggacacacatgattctttcatgcagcacgatgttcaagaacttaatagagttctgtgtgaaaaacttgaagataaaatgaagggaactgttgtggaaggcaccatacagcagttgtttgaggggcaccatatgaattacattgagtgcattaatgtggattataaatctacaaggaaggagtcattttatgatcttcagcttgatgttaaaggctgtcatgatgtatatgcttcttttgacaagtatgtagaagttgaacgccttgaaggtgataataaatatcatgccgaacaatatggcttgcaggatgctaagaagggtgtcttgtttattgacttccctccggtccttcagcttcagcttaagcgatttgaatatgattttatgcgggacactatggtcaagattaatgatcgctatgagttccctttgcaacttgaccttgaccgagatggtggaaaatacttatcaccagatgctgataggagagtccgcaatctttacacgcttcacagtgtcctcgttcacagtggtggggtgcatggtggacattattatgcatttatcaggccgactctttctgatcaatggtataaatttgatgatgaaagagtaaccaaagaagatatgaaaagggcattggaggagcagtatggtggtgaagaagagttaccacagacaaatccaggattcaataatactccttttaaatttaccaaatactcaaatgcatacatgctggtgtatatacgtgaaagtgacaaagacaagataatatgtaatgtggatgagaaggatattgccgaacatcttagggagaggttgaagaaagaacaagaagagaaggagcataagaaaaaagagaaggcagaggcacacctttacactattataaaggttgcacgagatgatgatcttgcagagcaaattgggaaggatatatattttgatcttgtggatcatgataaagtcaggagttttcgaattcagaagcagataactttcaatgtgtttaaggaagagattgctaaagagtttggcataccagtgcaatttcagcgtttctggttgtgggccaagcgtcaaaatcatacataccgtccaaaccgaccattgacacctttggaggaaacacaatctgttggaacactgcgggaggtatcaaataaagttcacaatgcagaattgaggttgttcttggaagttgagcttggactggatttacgcccaattgctcctccggataagacgaaggaggatattttacttttctttaagcactataatcctgagaaagaagagcttcgctttgttggaaggctgtttgtgaaaagcactggcaagccgattgaaattttatcaaaattaaacaaaatggcaggatatgctcctgatgaagagatcaacctttacgaggaaattaagtttgagcccagtgttatgtgtgaacccattgacaagaaaatcacattccgagctagccagcttgaggatggtgacatagtttgctttcaaaagtctcttcctgttgaaagcattgaacaattccgctatccagatgttccttcatttttggaatatgtgcataatcgccaaattgtacactttcggtctttggagaaacccaaggaagatgatttttgtcttgagatgtcaaggctttatacctatgatgatgttgttgaaagagtagctcagcaacttggtttgaatgatccgtcaaaaatcaggcttacatctcacaattgttactctcagcaacccaaacctcagcctattaagtatcgtggggtggatcatttgtctgacatgctggtccactacaatcagacttctgatattttatactatgaagttttagacatccctctaccagaattacaaggtttgaaaaccttgaaggtagcatttcatcatgctactaaggatgaagttgttatccatacaattaggcttccaaaacagagcactgtgggcgatgtgattaatgatcttaagacaaaggtagagttgtctcatcctgatgcagaactgcggttgcttgaagttttctatcacaagatctacaagattttcccacctagtgagaagattgagaatataaatgaccagtactggacattacgggcagaagagattccagaagaagagaaaaatcttggtccaaatgatcgcctaattcatgtttaccacttcactaaagaaactgcacagaaccagatgcaaattctgaattttggagagccctttttcttggtgattcatgaaggtgagacactggctgaaataaaagtccgaatacaaaagaagctgcaagttcctgatgaggactttgctaagtggaagtttgcattcctctcacttggccggccagagtaccttcaagattctgatattgtatctagtcgttttcagagacgagatgtttatggtgcttgggagcagtatcttgggctggagcactctgacaatgctccgaaaagagcttatgctgctaatcagaaccggcacacctttgagaagcctgttaaaatatacaattagggactattttagattttacctccctttggtgacattgcacaaaagagtggcactctacatgaactaaaagcaaatgacaatgtgaggcaacaagttagcactgaaatggcatctgtgacctttgcttgttgatttgttggataaatgtaattctttcggtagtgtcgatttgaaggactacttccttttacgtaatcaaagtgtgcatctgcaaatgacaattacgatccgctgagatttttgctactactttccgtctttaaatcgaggttggttggttggttcaatcttcaatcaaaacgtaaatgggggcaagttgcctgtgtaatttgtcagtacataaacaagattttgattattagtgaatttatgtatacacagtatagttgggagaaggttgtgatttttgccattccctttggttggttgccctgattttgtccatgtagatcatctgatgcatttagcattagctgctgccctttgtaatggttgattgccattctttttcaagcctattattatggcttattattatatctaaagattctcttcatatttgcgctactttcgcctaactctgaaatgccaatctcaatcattactgatttctttttatagtgaacttgtttttata

SEQ ID NO: 2358 - DNA, 4133 bp, Gossypium raimondii
caagaacaaaaaggaagtacagaaaatgaatgaaattccgaaattacccatttcccaaataaagaccatcgaaagaccttgctttctcctcgcttctcttcactgtaataaaatcaccaaataaaatcaacccaaaaaatagagaaaaaatctttctccgagtttcccctttctcgttcctcttgttttcgtaagcttgtttacctctcaatttcatagctatgactgttatggcccctgcccctatcgatcaacaagaagatgaggaaatgctcgtcccacagtctgatttgaccgacaatcaccagcccatggaagttgtagcgcaacccgaagctgcaaatactgtggaaaatcaaccagttgaggatcctccttcatcaagattcacttggaggattgaaaacttctctaggttaaacgctaagaagcattattctgaagtcttcgttgtcggtggttataaatggcgaatactgctatttccaaagggaaacaatgtggatcatttgtctatgtatttggatgttgctgactcagcaagcttaccctatgggtggagtagatatgcccagttcagtttggcagtagttaatcaaattcataataaatattctatcagaaaagacacacagcaccagttcaatgcacgagaaagtgattggggttttacatcctttatgcccctcggcgagttatatgatccttgcagagggtatcttgtgaatgacactttgattgttgaagcagaggtggttgtccgcaggattgttgattactggacatatgactcaaagaaggaaactggttatgttggacttaaaaatcaaggagcaacatgttacatgaattctctgcttcaaactctgtatcacattccttacttcaggaaggcagtgtatcatatgcctacaactgagaatgatatgccatcaggaagcatccctcttgctctgcagagtttattttacaaactccagtacagtgacagcagtgttgcaacaaaagagctgaccaaatcttttggatgggacacacatgattctttcatgcagcacgatgttcaagaacttaatagagttctgtgtgaaaaacttgaagataaaatgaagggaactgttgtggaaggcaccatacagcagttgtttgaggggcaccatatgaattacattgagtgcattaatgtggattataaatctacaaggaaggagtcattttatgatcttcagcttgatgttaaaggctgtcatgatgtatacgcttcttttgacaagtatgtagaggttgaacgccttgaaggtgataataaatatcatgccgaacaatatggcttgcaggatgctaagaagggtgtcttgtttattgacttccctccggtccttcagcttcagcttaagcgatttgaatatgattttatgcgggacactatggtcaagattaatgatcgctatgagttccctttgcaacttgaccttgaccgagatggtggaaaatacttatcaccagatgctgataggagagtccgcaatctttatacgcttcacagtgtcctcgttcacagtggtggggtgcatggtggacattattatgcatttatcaggccgactctttctgatcaatggtataaatttgatgatgaaagagtaacgaaagaagatatgaaaagggcattggaggagcagtatggtggtgaagaagagttaccacagacaaatccaggattcaataatactccttttaaatttaccaaatactcaaatgcatacatgctggtgtatatacgtgaaagtgacaaagacaagataatatgtaatgtggatgagaaggatattgccgaacatcttagggagaggttgaagaaagaacaagaagagaaggagcataagaaaaaagagaaggcagaggcacacctttacactattataaaggttgcacgagatgatgatcttgcagggcaaattgggaaggatatatattttgatcttgtggatcatgataaagtcaggagttttcgaattcagaagcagataactttcaatgtgtttaaggaagagattgctaaagagtttggcataccagtgcaatttcagcgtttctggttgtgggccaagcgtcaaaatcatacataccgtccaaaccgaccattgacacctttggaggaaacacaatctgttggaacactgcgggaggtatcaaataaagttcacaatgcagaattgaggttgttcttggaagttgagcttggactggatttacgcccaattgctcctccggataagacgaaggaggatattttacttttctttaagcactataatcctgagaaagaagagcttcgctttgttggaaggctgtttgtgaaaagcactggcaagccgattgaaattttatcaaaattaaacaaaatggcaggatatgctcctgatgaagagatcaacctttacgaggaaattaagtttgagcccagtgttatgtgtgaacccattgacaagaaaatcacattccgagctagccagcttgaggatggtgacatagtttgctttcaaaagtctcttcctgttgaaagcattgaacaattccgctatccagatgttccttcatttttggaatatgtgcataatcgccaaattgtacactttcggtctttggagaaacccaaggaagatgatttttgtcttgagatgtcaaggctttatacctatgatgatgttgttgaaagagtagctcagcaacttggtttgaatgatccgtcaaaaatcaggcttacatctcacaattgttactctcagcaacccaaacctcagcctattaagtatcgtggggtggatcatttgtctgacatgctggtccactacaatcagacttctgatattttatactatgaagttttagacatccctctaccagaattacaaggtttgaaaaccttgaaggtagcatttcatcatgctactaaggatgaagttgttatccatacaattaggcttccaaaacaaagcactgtgggcgatgtgattaatgatcttaagacaaaggtagagttgtctcatcctgatgcagaactgcggttgcttgaagttttctatcacaagatctacaagattttcccacctagtgagaagattgagaatataaatgaccagtactggacattacgggcagaagagattccagaagaagagaaaaatcttggtccaaatgatcgcctaattcatgtttaccacttcactaaagaaactgcacagaaccagatgcaaattctgaattttggagagccctttttcttggtgattcatgaaggtgagacactggctgaaataaaagtccgaatacaaaagaagctgcaagttcctgatgaggactttgctaagtggaagtttgcattcctctcacttggccggccagagtaccttcaagattctgatattgtatctagtcgttttcagagacgagatgtttatggtgcttgggagcagtatcttgggctggagcactctgacaatgctccgaaaagagcttatgctgctaatcagaaccggcacacctttgagaagcctgttaaaatatacaattagggactattttagattttacctccctttggtgacattgcacaaaagagtggcactctacatgaactaaaagcaaatgacaatgtgaggcaacaagttagcactgaaatggcatctgtgacctttgcttgttgatttgttggataaatgtaattctttcggtagtgtcgatttgaaggactacttccttttacgtaatcaaagtgtgcatctgcaaatgacaattacgatccgctgagatttttgctactactttccgtctttaaatcgaggttggttggttggttcaatcttcaatcaaaacgtaaatgggggcaagttgcctgtgtaatttgtcagtacataaacaagattttgattattagtgaatttatgtatacacagtatagttgggagaaggttgtgatttttgccattccctttggttggttgccctgattttgtccatgtagatcatctgatgcatttagcattagctgctgccctttgtaatggttgattgccattctttttcaagcctattattatggcttattattattatatctaaagattctcttc

SEQ ID NO: 2359 - DNA, 4135 bp, Glycine max
tcgagcaatagcaagacagcaatagcttctggtgatctcgttttcttacagtgctctcttccccctttctctctcctctttatctctctcttccattgctcctccacaagcaacgccgcgcgaggtcaattttcgcaatcgccatgactgtgatgactcctgctcccattgaccagcagcaggaggacgaggagatgcttgtcccgcacacggatttggctgagaataatcaccaacctatggaagttgtggctcaacctgatgctgccaacactgtggagagtcagcctgtcgaggatccttcgacatcaaggttcacatggaaaattgaaaacttttctaggatgaatacaaagaagctctattcagaaatatttgttgttggtggttataaatggcgagtactcattttcccaaaagggaacaacgtggactatttgtccatgtatttggatgttgcagattcagctagtttgccctatggctggagtagatatgcacagtttagcttggcagtcgttaatcaaatccataataaatactctgtgagaaaagacacacagcaccaattcaatgcgcgggaaagtgattggggtttcacgtctttcatgccacttggtgaattgtatgatcctagtagagggtatcttgtgaatgatactcttgtagttgaagctgaggttcttgttcgtagaattgttgattactggacctatgattcaaaaaaggagactggctatgttggacttaagaaccagggagctacatgttatatgaattctctacttcaaactttgtaccatattccttattttcgaaaggctgtataccatatgccaacaacagagaatgacatgccgtcgggaagcatccctttggctttgcaaagtttattctacaagctccagtatagtgacaccagtgttgcaacaaaggagctcactaaatctttcggatgggatacatatgattctttcatgcagcatgatgttcaagaactgaacagagtcctctgtgaaaaacttgaagataagatgaagggaactgttgttgagggaactatacagaagttatttgaagggcatcatatgaactatatcgaatgcatcaatgtggactataaatcaactagaaaggagtcattttatgaccttcagcttgatgtgaaaggctgtcctgatgtttatgcttcctttgacaagtatgttgaagttgaacgtcttgaaggggataacaaatatcatgcggaacaatatggtttgcaggttggttgcaattgtttattttggaatctacttgatgctaagaagggtgtcctgttcattgatttccctcctgttcttcagcttcaactgaaaagatttgaatatgactttatgcgggatactatggtcaagattaatgaccgttatgagtttcccttgcaacttgaccttgatcgtgagaatggaaaatatttatcacctgacgctgataggaatgtccgcaatctttacacacttcatagcgttttggttcacagtggtggtgtgcatggtggacattattatgcttttatcaggccaactctatctgagcagtggtataaatttgatgatgagagggtgactaaagaagacactaaacgggcattagaggagcaatatggtggcgaggaagagttaccgcagacaaatcctggatttaacaacactccttttaaattcaccaaatattcaaatgcttatatgctggtgtatatacgtgaagctgacaaggacaaagtaatatgcaatgtggatgaaaaagacattgctgaacatttaagggagaggttgaagaaagaacaagaagaaaaagagcacaaaaagaaagaaaaagcagaggctcacctttacactattataaaggtggcacgagatgaagaccttgcagagcagattggaaaggatatatattttgatcttgtagaccatgacaaagtgaggagtttccgtgtccaaaaacagacatcttttaacctttttaaggacgaggtggctaaagagtttggaataccagttcaattccagcgcttttggctatgggcaaagcggcaaaaccatacgtatcgtccaaatcgaccattgacacacatggaagaagcacaatctgttggacaattgagagaggtatccaacaaagttcacaatgcagaattaaaattgtttttggaagtggagcttgggctggatttacgtcccattgcaccgcctgacaagacaaaggatgatatattacttttcttcaagttatatgatactgaaaaagaggagctacgttatgttggaaggctctttgtgaaggctactggtaagccatcagaaattttaaccaggttaaataaaatggctggttatgatcctgatgaagagattggactatacgaggaaattaagtttgagccaaatgttatgtgtgaacctattgataagaaagtaacatttcgagcaagccagttagaagatggagatattatatgctttcagaaagctcctgctatagacaatgaacacgtccgctatccagatgtgccttcataccttgaatatgtgcacaatcgccaggttgttcactttcgatctctagaaaaaccaaaggaagatgacttctgcctggagatgtcaaggctctatacatatgatgatgtggtggagaaagtggctcaacaacttggtttggatgatccatccataattaggcttacccctcacaattgctactctcaacaaccaaaaccccaacctattaagtatcgtggtgtggaacatttgtctgatatgctggttcactacaatcagacttcggatatattgtactatgaagtacttgacatccctctgccagaactacaaggattgaaaactctgaaagttgcatttcaccatgctaccaaggatgaagtggttattcataccatcagactcccaaagcagagcactgtgggggatgtccttaatgatctgaaaacaaaggtggaattgtctgatcctgaagccgagcttaggttgcttgaagttttctatcacaagatatacaaggtcttccctcccaatgaaaagattgaaagtataaatgatcaatactggacattacgtgcagaggagattccagaagaagagaaaaatctgggtcctcatgatcgtctaatccatgtgtatcatttcactaaagacacagctcagaaccaaatgcaaattcagaactttggggaaccctttttcttggtcatacatgaaggggagactttggctgaaattaaagtaagaatacagaagaaacttcaagtccctgatgatgagtttgtcaagtggaaatttgcctttttttcattagggcgtcctgaataccttcaggattctgacattgtgtccagtcgttttcagaggagagatgtttatggtgcttgggagcaatatcttggtttggagcatactgataatgctcctaaaagatcatatgctgttaaccagaatcgccatactttcgagaagccagtaaagatttataattaaggaaactggtattgatgagttatcgtcttgcgtgggatgaatttgccatattctgctacatctatgggcttttgtaaaaacagggaaaatagcgaaaggctactccgtataggccacaattagtgagatcagcaatccaggtggtttctgcaggttttatattagaattgtggtatgtaattctttctgtcaacggatctcaacactgtctgccgaccacagcccgttgagctttactacttccaactttgtgtggaagttgttcaagttggggtcattgatcatcatcactgtactgtaccagtacataagatttttggattagtgagtgtatacagggtatagttggttgacttttttttttttttgttcatcttgattgcttccagattttgttcactcagtagtgttaatttaagtgatgggctgcaaaatggtgtagcagagttaatgtaatgttgtaaaagagactcgctagcctcggtataaccctttagcataaaaatatagtttcctgccgcaccatttgctccatttcatttggctttttttttttttttttgagttttttctgtttcttcgcctcaccttgttggctgtta

SEQ ID NO: 2360 - DNA, 3897 bp, Citrullus lanatus
agcacttcgcactcattttggttttctttttccccaccccaactctctcttccaaggctgcagagaccatgactgtgatgactcccgctcccgtcgatcaacaagaggacgaggagatgcttgtaccgcactcggatttggccgagaataatcaccaacctatggaagttgttccacaatcggaaacaggaaacacagtagagaatcaacctgtcgaggatcccccatcgtcaagatttacatggagaattgacaacttcacgaggctcaacataaagaagctatattctgaaatctttattgttggcggatataaatggcgaattcttattttcccaaaaggaaacaatgtagatcatctgtctatgtatttggatgttgcggattctgcaagtttgccatatgggtggagcagatatgctcaattcagcttgggtgtcatcaatcaaatccacaataaatattcagtgagaaaagatactcaacatcagttcaatgccagggaaagcgattggggcttcacgtcattcatgcccctcagcgaactgtatgaccctaccagaggatatcttgttaatgataccttaatagttgaagctgaggtccttgttcgaagagtggtcgattattggacatatgattcaaagaaagaaacaggttttgttggtcttaaaaatcagggagcaacatgttatatgaattcacttcttcaaactctttaccacattccatatttccggaaggccgtataccatatgcctactacagaaaatgatatgccatctgcaagcatccccttagctctgcagagcttattttataaacttcaatacagcgacagcagtgtagcaacaaaagaacttaccaaatcttttggatgggacacgtatgattcttttatgcagcatgatgtccaggaactgaacagggttttatctgaaaaacttgaagataaaatgaagggaactgttgtggagggaaccatacagaaattgtttgaagggcatcatatgaattacatcgaatgtataaacgtggactacaagtcaacaagaaaggaatcgttttatgatcttcagctcgatgtcaagggctgtcgtgatgtgtatgcttcttttgacaagtatgtagaagttgaacgccttgagggtgataataagtatcatgcagaacagtatgggttgcaggatgccaagaagggtgtattgttcattgatttcccccccgttcttcaactccagttgaagcgatttgagtatgacttcatgcgagacaccatggtaaagatcaatgatcgatatgaatttccccttcaactggaccttgatcgagaaaatgggaagtatttatcaccggaagctgatagaaccgtgcggaatctttacactctccatagtgtcttggttcacagcggtggggtgcatggtggacattattatgcctttatcaggccaaccctttcagagcaatggtacaaatttgatgatgaacgggtaacaaaagaagatgtaaaaagggcactagaggagcaatatggtggcgaggaagagttacctcagacgaatcctggattcaacaacactccttttaagttcaccaaatactcaaatgcatacatgctcgtgtatatacgtgaaagtgataaagacaaagtaatttgcaacgtggatgagaaggacattgccgaacatctcagggagaggttgaagaaagaacaagaagaaaaggaacacaagaagaaagaaaaggcagaggcacacctttatactatcataaaggttgctagagatgaagatctagttgaacaaattggaaaagatatattttttgatcttgttgatcatgacaaagtaaggagcttccgcatccagaagcaaatgccgtttaaccttttcaaggaggaggtggctaaggaatttggtatacccatccagtttcagcgatattggttgtgggcaaagcgtcagaaccatacttaccggcccaaccgaccattgacacccatggaggaagcacaatctgttggacaattaagagaggtatcaaataaggttcacaatgccgagttgaagttattactagaggtggaatatggactggattcgcggcctattgctccaccagacaagacaaaagatgatatcttattgttttttaagctttatgagcctgaaaaagaagagctgagatacgtgggaaggctctttgtgaagggtaatgggaagccttttgaaatattgacgaaattgaatgaaatggctggttatgctccagaagaagagattgaactttatgaggaaattaagtttgagccgaacattatgtgtgaacccattgacaagaaattcacatttcgagcaagtcagctggaagatggagatattgtttgctttcaaaaatcccctccagttgaaaatgcagaacagtatcgttatcctgacgttccctcatttttggagtatgtgcataaccgtcaagttgttcattttcgatccctagagaagccgaaggaagatgatttttgcctggagatgtcaaaactttatacatatgatgatgtggtggaaagactagcccaacaacttggtgtagacgatccatcaaaaattagattaacgtcacataattgttactctcagcaacctaaacctcagccaatcaagtatcgtggtgtggagcacttgtctgatatgctggttcattataatcagacgtcagatatattatactatgaagtattggacatccctcttccagagttacaaggtctgaaaactcttaaagtagcatttcatcatgcaactaaggatgaagtggttattcatacaattagattgccgaaacagagcactgtagcagatgtgattaatgatcttaaaacaaaggttgaattatctcatccagatgcagagctcagattgcttgaagttttctaccataagatctacaaggtgtttcctcctaatgaaaagattgagaacattaatgatcaatattggactttacgggcagaagagattccagaagaagaaaaaaaccttggtccgaatgatcgcctaatccatgtgtaccatttcactaaagatacctctcagaatcagatgcaaattcagaacttcggtgaaccctttttcttagtcataaatgagggagagactctggccgatattaaattgagaatacagaagaagttacaggttccagatgaggaatttgccaagtggaaatttgcatttctttcactaggtcgtccagagtacctccaagataccgacattgtgtcaaatcgttttcagagaagagatgtttatggtgcgtgggagcaatatcttggactggagcacactgacaacgcacccaaacgagcttatacagcaaatcagaatcgtcatacgtttgagaagccagtaaaaatctacaattagtgaaaagacaagacaggacatggtctttcatagaggcgtttagatgagttggaaaaatctaccacacaatttgggttgttagattggtgagcactgggctggcatagagtttgccagcaggattccattttgattctgttggccatttattctctagcaaatggatgaatatggatatggatgggggaaatggatttttttttcttcttcagtggatgtgtttgtttttagtgtcaaaaatccccccctgatctttgttaattacaggcggagagggttgctcttcctcctccctcttcctaaatcctacctttgacctcgcagagaaacaggccttccctcagcatcagttgagttgtaatctatagttcataaaacaagattttttgactagtagttgaatgtacacaaagtatagttggggacctgaaatattattattgttattattattaaattttttttccctttt

SEQ ID NO: 2361 - DNA, 3969 bp, Prunus persica
atgacagtcatgacccccgcccctattgatcaaccagaggacgaagagatgctcgtcccgcactcggatttgcccgaaaacaatcaccaacccatggaagttgttgcacaacctgaaactgctaataacgtggagaaccagccagtggaggatcctccatcatcaagattcacgtggagaattgacaatttttctaggatgaatacaaagaagctttattcagatatatttgtcgttggtggctataaatggcgtgtgcttatttttcctaagggaaacaatgtagatcatttgtctatgtatttggatgttgcggattcagcaagtttgccatatgggtggagtagatatgcacagttttgcttggggctcgtcaatcaaattcataacaagtattcagtacgaaaagacacacagcatcagttcaatgcgcgagaaagtgattggggtttcacatcctttatgcctcttagtgatctttatgatcccagtagagggtatcttgtgaatgatacacttataattgaagctgaggttctcgttcgtagggttgtagattactggacatatgactcgaaaaaggagacaggttatgtggggcttaagaaccaaggagcaacttgctacatgaactctctcctccagactttgtatcatattccttatttcagaaaggctgtttaccatatgcccacaactgagaatgatttgccatcgcaaagcatacctttggccctgcagagtctattttacaagcttcagtacagtgacaatagtgtggcaacaaaagagctgacgaagtcttttggatgggacacgtatgattcatttatgcagcatgacgtgcaagaactcaatagggttttgtgtgaaaaacttgaagacaaaatgaagggaactgttgtagagggaactatacagaagttgttcgaaggacaccatatgaactacattgaatgcatcaacgtggactacaaatcaacaagaaaggaatcattttatgaccttcagcttgatgtcaaaggttgtcgtgatgtatatgcttcttttgataagtacgtagaagttgaacgtctcgagggtgataacaagtatcatgctgaacagtatggattgcaggatgctaagaaaggtgttctgtttattgactttcccccggtgcttcaacttcagttgaaacgatttgagtacgactttatgcgggacacaatggtgaagattaatgatcgttatgagttcccattgcaacttgacctcgatcgagagaatggaaaatatttatcacctgaagctgataggagtgttcgcaacctttacacacttcacagtgttttggtacacagtggtggggtgcatggtgggcactattatgcctttatcaggccaacgctttctgatcagtggtataaattcgatgatgagagggtcacaaaagaagatataaagagggcactagaggagcagtatggtggtgaggaagagttaccacagacaaaccctggattcaataacactcctttcaaatttacgaagtactcaaatgcatacatgctggtgtacatacgtgaaagtgacaaagataaaataatctgcaatgtggatgagcaggacatcgctgaacatctaagggagaggttaaagaaagaacaagaagaaaaggaacacaagaagaaagaaaaggccgaggcacacctatatactattataaaggttgcccgggatgagaaccttgtcgagcagattgggaaggatatttattttgatcttgttgatcatgacaaagttagaagttttcgtatccagaagcagacgccttttaacgtatttaaggaggaggttgcgaaagagattggcataccagtgcaatttctgcgattttggttgtgggcgaagcgtcaaaaccatacatatcgtcctaaccgtccattgacacctgtggaggaaacacaatctgttggacagttgagggaggtatcaaacaaggttcataatgcagaactaaagttattcttagaagtagagcttgggctggatttacaccctatcgctccacctgacaagacaaaggatgacattctgcttttctttaagctttatgatccagaaaaagaagaactacgatatgttggaaggctttttgtgaagagtactggtaaggcagctgaaatattgtcaaaattaaatgaaatggctggctatgctcctgaggaagagattgacctttatgaggaaattaagtttgagcccaatgtcatgtgtgaacccatcgacaagaaattcacatttcgagcctgccagcttgaggatggagacattgtttgctttcagaagcccactccagttgaaaatggagaacatctccgctatccagatgtcccatcttttctggattatgtgcacaaccgtcaagttgttcacttccgatctcttgagaaacccaaagaagatgatttctccctagaattatcgaaactccatacctatgatgatgttgtggaacgagttgctcagcaacttggtttggatgatccatccaaaattaggcttacatcgcacaactgttactcacaacaacccaaaccccagccaattaagtatcggggggttgagcgcttgactgatatgctggtccactacaatcagactacggatatattgtactatgaagtattggacatccctctgcccgaattacaaggtttgaaaactctgaaagtcgcattccatcatgctactaaggaagaagttgttattcataccataagactgccaaaacagagcactgtgggggatgtaattaatgaccttaaaactaaggttgaattgtctcatccagatgcagaacttaggttgcttgaagttttctatcacaagatttacaaggtttttcctcacagtgaaaagattgagaacataaatgatcaatactggacgttacgggccgaagaggttcctgacgaagagaaaaatcttggtcctaatgatcgtgtaattcatgtctaccatttcactaaagacacagctcagaaccaaatgcaaattcaaaactttggggaaccttttttcttggtcatacatgaaggtgaaactttggctgaaattaaagctcgagtacaaaagaaattacaggttgcggatgaggagtttgccaagtggaagtttgcgtttctttccctaggtcgcccagaatatctccaggactccgacattgtgtctagtcggtttcagagaagagatgtttacggtgcttgggagcaatatcttgggctggaacactctgacagtgctcctaaaagagcgtatgcagctaaccagaatcgccacacatttgaaaagccagtaaaaatctacaactaggaaaatagttggatgaatgagttttcatcattccagagatgaattgggcaattctccacatcatctggctgtgaaagctggaaactagtgaaaatcgactctgtataggcatccagtgaggttagctttggaaaagttttcaacaaggttcggtggccggattttgttggctatatacttctcccagcgtgtggttggggaggacttgtccctaaatcagtgtgtatcttcaaccattgatcaaagcccctcttgagcttttactacatatttatagagagcttcctctttgggtgggcatggcaatggccttcgtcatcagtgcaatgtaactttgacagtaaataaagaaagattcttgaactagtgaatgtatacagtacaggtatagtttggtgagtcatttttcccatgttttcttcctgttttctgttcagtttagatagcaagatgagatggggttgtgtaatggttgattagttggttctcagactagtcagttctcagacacgtttatagatttttgtaaaagagacctcgtcagtcgctgccattgagggatattttcattttcaatacgtagctagtaaatagatattctcttatttctta

SEQ ID NO: 2362 - DNA, 4294 bp, Glycine max
aaataaaaaccaaagacatttctccctgtcgtctcgagcaatagcaacacagcaatagcttctggtgatctcgttttctcacattgctctcttccccctttctctctcctctttctctctcttccattgcttctccataagcaacgccacgcgaggtcaattgcgccatcgccatgactgtgatgactcctgctcccattgaccagcagcaggaggacgaggagatgcttgtcccgcacacggatttggctgagaataatcaccaacccatggaagttgtggctcaacctgatgctgccaacactgtggagagtcagcctgtcgaggatccttcaacgtcaaggttcacatggaaaattgacaacttttctaggatgaatacaaagaagctctattcagaaatatttgttgttggtggttataaatggcgtgtacttattttcccaaaagggaacaatgtggactatttgtccatgtatttggatgttgcagattcagctagtttaccctatggctggagtagatatgcacagtttggctggagtagatatgcacagtttagcttggcagttgttaatcaaatccataataaatactctgtgagaaaagacacacagcaccaattcaatgcgcgggaaagtgattggggtttcacatctttcatgccgcttggtgaattgtatgatcctagtagagggtatcttgtgaatgatactcttgtagttgaagccgaggttcttgttcgtagaattgttgattactggacttatgattcaaaaaaggagactggctatgttggacttaagaaccagggagctacatgttatatgaattctctactccaaactttgtaccatattccttattttcgaaaggctgtataccacatgccaacaacagagaatgacatgccctctggaagcatccctttggctttgcaaagtttattctacaagctccagtatagtgacaccagtgttgcaacaaaggagctcactaaatcttttggatgggatacatatgattctttcatgcagcatgatgttcaagaactgaacagagtcctctgtgaaaaacttgaagacaagatgaagggaactgttgttgagggaactatacagaagctatttgaagggcatcatatgaattatatcgaatgcatcaatgtggactataaatcaactagaaaggagtcattttatgaccttcagcttgatgtgaagggctgtcctgatgtttatgcttcctttgacaagtatgttgaagttgaacgtcttgaaggggataacaaatatcatgcggaacaatatggtttgcaggatgctaagaagggtgtcctgttcattgatttccctcctgttcttcagcttcaactgaaaagatttgaatatgactttatgcgggatactatggtcaagattaatgaccgctatgagtttcccttgcaacttgaccttgatcgtgagaatggaaaatatttatcacctgatgctgataggaatgtccgcaatctttacacacttcatagcgttttggttcacagtggtggtgtgcatggtggacattattatgcttttatcaggccgactctatctgagcagtggtataaatttgatgatgagagggtgactaaagaagacactaaacgggcattagaggagcaatatggtggtgaggaagagttaccacagacaaatcctggatttaacaacactccttttaaattcaccaaatattcaaatgcttatatgctggtgtatatacgtgaagctgacaaggacaaagtaatatgcaatgtggatgagaaagacattgctgaacatttaagggagaggttgaagaaagagcaagaagaaaaagagcacaaaaaaaaagaaaaagcagaggctcacctttacactattataaaggtggcacgagatgaagaccttgcagagcagattggaaaggatatatattttgatcttgtagaccatgacaaagtgaggagtttccgtgttcaaaaacagacgtcttttaacctttttaaggaagaggttgctaaagagtttggcataccagttcaattccagcgcttttggctatgggcaaagcggcaaaaccatacgtatcgtccaaatcgaccattgacacacatggaagaagcacaatctgttggacaattgagagaggtatcaaacaaggttcacaatgcagaattgaaattgtttttggaagtggagcttgggctggatgtatgtcccattgcaccgcctgacaagacaaaggatgatatattacttttcttcaagttatatgatcctgaaaaagaggagctacgttatgctggaaggctctttgtgaagagtactggtaagccatcagaaatcttaaccaggttaaataaaatggctggttatgatcctgatgaagagattggactatatgaggaaattaagtttgagccaaatgttatgtgtgaacccattgataagaaactaacatttcgagcaagccagttagaagatggagatattgtatgctttcagaaagctcctgctatagacagtgaacatgtccgctatccagatgtgccttcatacctagaatatgtgcacaatcgccaggttgttcactttcgatctctagaaaaacccaaggaagatgacttctgcctggagatgtcaaggctctatacatatgatgatgtggtggagaaagtggctcaacaacttggtttggaagatccatccataattaggcttacccctcataattgctactctcaacaacctaaaccccaacctattaagtatcgtggtgtggaccatttgtctgatatgctggttcactacaatcagacttcggatatattgtactatgaagtacttgacatccctctgccagaattacaaggattgaaaactctgaaagttgcatttcaccatgcaaccaaggatgaagtggttattcataccatcagactcccaaagcagagcactgtgggagatgtccttgatgatctgaaaacaaaggtggaattgtctgatcctgaagccgagcttaggttgcttgaagttttctatcacaagatatacaaggtcttccctcccaatgaaaagatcgaaagcattaatgatcaatactggacattacgtgcagaggagataccagaagaagagaaaaatctgggtcctcatgatcgtctaatccatgtgtatcattttactaaagacacagcacagaatcaaatgcaaattcagaactttggggaaccctttttcttggtcatacatgaaggggagactttggctgaaattaaagtaagaatacagaagaaacttcaagttcctgatgatgagtttgtcaagtggaaatttgcctttttttcattagggcgtcctgaatatcttcaggattctgacattgtatccagtcgttttcagaggagagatgtttatggtgcttgggagcagtatcttggcttggagcatactgacaatgctcctaaaagatcatatgctgttaaccagaatcgccacactttcgagaagccagtaaagatttataattaggaaactggtattgatgagttctcgtcttgcgagggatgaatttggcatattctgctacatctatgggcatttgtaaaaacagggaaaaatagcgaaaggctactctgtataggccataattagtgagatcagcaattccaggtggtttctgcaagttagaatttatattagaattgtggtatgtaattctttctgtcaacggatctcaacactgtctgccgaccactgcccgttgagctttactacttccaactgtgtggaagttgttcaagttgaggtcattgatcatcatcactccactgtatcagtacataagatttttggattagtgagtgtatacagggtatagttggttgactctttttttgttcatcttgattgcttccagattttgttcagtcagtagtgctactttaagtgagggctgcaaaatggtgtgtggcagagttaatgtaatgttgtaaaagagactcgccagcctaaaaatatagtttcctgccgcaccatttgctccaactcatgtgccttttttattttactttttcctgtttcttcgcctcaccattaagccacttttattgattagagtttggctgttaaagttaagctaaaaataagccaggctaaacatatagctcactcacattttgaactttaggtcagaagttaccacgattcctatatgataattttactttactcacatcatgaactttggtccagaagttataagcattaca

SEQ ID NO: 2363 - DNA, 4201 bp, Trigonella foenum-graecum
tctcgtctcgagctacaccttcttcttctggtgtgatctcgtttttttcacagtgcactttctctctcttctttctctctcctccattgttttccttcaaccaccgcaccgcgaggtcaatttccataaccgtcatgaccgtcatgactcctgctcccattgaccaacaacagcagcaggaggatgaggagatgcttgtgccgcacgcggttccgcatgcggatttggctgagaataataatcatcaacctatggatgttgttgctcaacctgaaactgccaacactgtggagcctgtcgaggatccttcaccatcaagattcacatggagaatcgacaacttttctagggtgaataccaaaaagctctattcagatgtctttgttgttgggagttacaaatggcgtgtacttattttcccaaaagggaacaatgtggactatttgtccatgtatttggatgttgcagattcaactagtttgccctatggttggagtagatatgcacagtttagcttggcagttgttaatcaaatccataataagtacactgtgagaaaagatacacaacatcagttcaatgcacgagaaagtgattggggtttcacatccttcatgcctctcggtgaattgtatgatcctaatagagggtatcttatgaatgattctattataattgaagccgaggtccttgtccgtaggattgttgattactggacttatgattcaaaaaaggagactggatatgttgggcttaagaatcagggagctacatgttatatgaattctctgctccaaactctgtaccatattccttacttccgaaaggctgtataccatatgcctacaacagagaatgatatgccctctggaagcatccccttggctctgcagagtttgttctacaagctccagtatagtgacaccagtgttgctacaaaagagttgacaaaatcttttggatgggatacatatgattctttcttgcagcatgatgttcaagaactaaatagagtcctttgtgaaaaacttgaagacaaaatgaaggcaactgttgttgagggaactatacagaaattgtttgaagggcaccacatgaactatatcgagtgcatcaatgtggattataaatcaacacgcaaggagtcattttacgatcttcaacttgatgtcaaaggctgtccagacgtttatgcttcctttgacaagtatgttgaagtagaacgtcttgagggggacaacaaataccacgctgaacaatatggtttgcaggatgctaagaaaggtgtcttgttcattgactttcctccagttttgcagcttcagctgaaaagatttgaatatgactttatgcgggatactatggtaaagattaatgatcgttatgagtttccgttgcaacttgatcttgatcgtgacaatggaaaatatttatcacctgatgctgataggaatgtccgcaatctttacacacttcatagtgttcttgttcacagtggtggtgtgcatggtggacactactatgcttttatcaggccgactctcactgatcagtggtacaaatttgatgatgagagggtgacaaaagaagaccctaaacgggcaatggaggagcaatatggtggtgaggaagagttaccacagacaaatcctggattcaataacactccttttaaattcaccaaatattcaaatgcttatatgctggtgtatatacgtgaagctgacaaggagaaagttatatgcaatgtggatgagaaagatatcgctgagcatttaagggagaggttgaagaaggaacaggaagaaaaagagcacaaaaagaaagaaaaggcagaagctcacctctacactatcataaaggtggcacgggatgaagaccttggagaacagattggaaaggatatatattttgatcttgtagaccatgacaaagtgcggagtttccgtgtccaaaagcagacgccatttaacgttttcaaggaagaggttgctaaagagtttggtataccggttcaattccagcgcttttggctatgggcaaagcgtcaaaaccatacatatcgtcctaatcggccattgacacacatcgaggaagcacaatctgttgggcaattgagagagatatcgaacaaggttcacaatgcagaattgaagttgtttttggaagtggaacgtgggccggatttatgtcccattgcaccacctgagaagaccaaggatgatatattgctttttttcaagttatatgatcctgaaaaagaggagctacgttatgttggcagagtctttgtgaacagtactggtaagccatcagaaatcttaacaaggttaaataaaatggctggtcatgatcctgatgaagagattggactttatgaggaaattaagtttgaaccaaatgtaatgtgcgagcctattgacaagaaattaacatttcgagcaagccagcttgaagatggagatattatatgctttcagaaagttcttgctatggataatgaggaacatatccgctatcctgatgtgccttcatacttagaatatgtgcataatcgccaggttgttcactttcggtctctggataaaccaaaggaagatgacttctgcctggagatgtcaaggctttttacctatgatgatgttgtcgagagagtagctgagcaacttggtttggacgacccatccaaaatcaggctcactccacacaactgctactctcaacaacccaaaccccagcctatcaagtaccgaggggtggaacatttatctgatatgctggctcactacaatcagacatcggatatattgtactatgaagtacttgacatccctctgccagaattacagggtttgaaaactctgaaagttgcatttcatcatgctaccacggatgaggtggttattcataccatcagactcccgaagcagagcactgtgggagatgtccttgatgatcttaaaaaaaaggttgaattgtcacgtcctgatgctgagcttaggttgcttgaagtcttctatcacaaaatatacaaggttttccctcccaatgaaaagattgaaaacataaatgatcaatactggactctacgagcagaggagataccagaagaagagaaaaatctcggtcctcatgatcgtctaatccatgtgtatcattttactaaagacaccactcagaaccaaatgcaaattcagaactttggggaacccttcttcttggtcatacacgaatgtgagactttggctgaaattagagtgcgattacagaagaagcttcaagttcccgatgaggagtttgtgaagtggaagtttgcctttttctcattagggcgtccggagtacctcgaggactctgacgttgtatcaaatcgttttcagagaagagacgtgtatggtgcttgggagcagtatcttggcttggagcatactgatactgctcctaaaagatcatatgctgctaaccagaatcgtcacacatttgagaagccagtgaagatttataattaggaaatcagtatggatgagccatcattttgcatgagatgaattcagcactcttctacatatatgggcttgtataaacaaaaacagggtaagtagcgaatggctaattctgcgtaggccaacttttgagatcagtgatcaaggcggtgtgtgcaggttttcatattagaattgtgatatgtagttctttcttttgatggagtgacattgttctctacactgtgtatctgccgaccacaaccccttgagctttttgctatttccattggtgcatggaagttgttctgcatgttgaggtccttgatcatcatcactgcactgtattagtacataagattttttggattagcaagtgtatacagagtatagttggttgactctttttgtcatcttggttgcttccagattctgttcagttagcacttagcagtgttaattctagtgagggctgcaaaatggtgtagcaaagttcatgttgtgttgtaaaggagactttgcagcctccatatactcgttagcataaatattccgaagcaccatttggtttgtttctcagctgttttctatttccttttgaccgaccaccttaagaaggaatattagtcaatgacactgtctctttaatctgaaaaagatagacatttcctgcccatacccttgtcgggctttgtatataaggatatgaagtttttgct

SEQ ID NO: 2364 - DNA, 4071 bp, Phaseolus vulgaris
cttctggtgttgatctcgttttctcaaacacactacactttctccttctccactctctctctctctctctctctaacgataaccctcgcaggttccaattcaccatgacggtgatgatgccagcacccattgatcagcaagaggacgaggaggtgctcgtgccgcacacggatttgcctgagaacaatcatcaacctatggaagttgtagctcaacctgaaactgccaatgctgtggagagtcagcctgttgaggatcctccatcgtctagattcacatggagaattgaaaacttttcgaggctgaatacaaagaagctctattcagaacaatttgttgttggtggctataaatggcgggtgcttattttcccaaaaggaaacaatgtggactatttgtctatgtatttggatgttgcagattcagctagtttgccctatggttggagtagatatgcacagtttagcttggcagttgttaatcaaatccataataagtattctgtgagaaaagacacacagcatcaatttaatgcacgtgaaagtgattggggtttcacgtccttcatgcctcttggtgaattgtatgatcctagtagagggtatcttgtgaatgatactcttatagttgaagctgaggttcttgttcgtaggattgttgattactggacttatgattcaaagaaggagactggctatgtcgggcttaagaaccaaggagctacctgttatatgaattctctactccaaaccttgtaccatattccttattttagaaaggctgtgtaccatatgccaacaactgaaaatgatatgccctctggtagcatccctttggctttacaaagtttattctacaagcttcaatacagtgacaccagtgttgcgacgaaggagctgacaaagtcttttggatgggatacatatgattctttcatgcagcatgatgttcaagaactaaatcgggttctctgtgaaaagcttgaagacaaaatgaagggaactgttgttgagggaaccatacaaaaattatttgaagggcaccatatgaattacatagaatgcatcaatgtagactacaaatcaactagaaaagagtcattttatgaccttcagcttgatgtcaaaggttgtcgtgatgtttatgcttcctttgataagtatgttgaagttgaaagacttgagggggataacaaatatcatgctgaacagtatggtttgcaggatgctaagaagggtgtcctatttgttgaatttcctcctgttcttcaacttcagctaaaaagatttgaatatgactttatgcgggatactatggttaagattaatgaccgttatgagtttcccttgcaacttgatcttgaccgtgatgatggaaaatatctttcacctgatgctgataggactgtccgcaatctttatacacttcacagtgttttggttcacagtggaggtgtgcatggcggacattattatgcttttatcaggccaaccctctctgaacagtggtataaatttgacgatgagagggtgacaaaagaagataataaaagagcattagaggagcaatatggtggtgaggaagagttaccacaggcaactcctgggttcaataacactccatttaagttcaccaaatactcaaatgcttatatgttggtgtatattcgtgaaagtgacaaggacaaaatcatatgcaatgtggatgagaaagacattgcagcacatttaagggagaggttgaagaaagaacaagaagagaaagagcacaaaaaaaaagaaaaggcagaagctcacctttatactattataaaggtggcacgagatgaagacctgaaagtgcagattggaaaggctatatactttgatcttgtagaccatgacaaagttcgtagtttcagagtccaaaagcagacatcttttaatcttttcaaggaagaggttgcaaaagaatttgatgttccagttcaatttcagcggtattggatatgggcaaagcggcaaaaccatacttatcgtcccaacagaccattgacacctgctgaggaagcacaatctgttggacaattgagagaagtatcaaacaaggttcacaatgcagaattaaaattgtttttggaagtggagatggggatggattctcgtcccatcgcaccacctgaaaagaccaaggatgatctattacttttcttcaagctgtatgatcctgaaaaagaggagctgcgttatgttggaaggatctttgtgaagtgtactggaaagccattggaaatcttaacgaggttaaatgaaatggctggttatgaccctgaagaagatattgcactttatgaggaaattaagtttgaaccaaatgtcatgtgcgaacctattgacaagaaagtaacctttcgaactagccagctggaagatggtgatatcatatgctttcagaaggcttcctctatggatattggggacaatgtccgttatccagatgtgccctcatatttagaatatgtgcacaatcgccaggtggttcactttcgatctctcgagagacctaaagaagatgactttttcttggagatgtcaaggctttttacctatgatgatgtagtcgagagagtagcccaacaacttggtttggatgatccgtccaaaatacggctgacaccacacaactgctactctcaacaaccaaaaccccagcccattaaatatcgaggggtagaacatttgtctgatatgttagttcattacaatcagacgtcagatatattgtactatgaagtacttgacatccctctaccagaattacaaggtttgaaaactctgaaagttgcatttcatcatgccattaaagatgaagtggttattcatactatccgactcccaaagcagagcactgttggggatgtcctggatgatcttaaaacaaaggtagagttatctgatcctaaagcggaacttaggttgcttgaagtcttctatcacaaaatatacaaggtctttcctcccaatgaaaagattgaaaacattaatgatcagtactggacattacgagcagaggagattccagatgaagagaaaagccttggtcctcatgatcgtctaattcacgtgtaccatttcaataaagacacagctcaaaaccaaatgcaaattcagaactttggggaacctttttttctggttatacatgaaggagaaactctatctgaaattaaggtgcgaatacaaaagaaacttcaagttcctgatgatgagtttggcaagtggaagtttgcatttctatcactagggcgtccggagtaccttcaagattctgacattgtatccagtcgttttcagagaagagatgtttatggtgcttgggagcaatatcttggcttggagcatactgacaatgctcctaaaagatcatatgctgtcaaccagaatcgccacacttttgagaagccagtaaagatttataattaaaaaacttctattgaagacagagttcatgcatggaatgaattcagcattattatatatctatgggcttgtaaacatggggaagatggcaaaaggctactatgtataggattaatgaaatcagcaattcaggtggtgtctgcagactttaagttagttatgtggtatgtaattctttctgtcaatgggtaatattgctctcaacgtcttgtatctgccaaccacagcgccttgagcttttttactacttccgattttgtatggaggttcttcaagttgaggtcattgatcatcgtcgctgaaactgtatcagtacataagatttttggattagtgagtgtatacagggtatagttggttgacttttgtcctttttcttgattgcttcctgattttgtccagttagaagtgttaatctaagttaagtaagagctgcataatggtgtagcagagacagcttttttatgtaatgtaaaagatttaccagcctccatatatctctggtcagcataaattcaccttttgatgtggttgtttctcctgttcccccggcccatctagctatgaatagacatcaaataagataattataaattcattctcacttcaacca

SEQ ID NO: 2365 - DNA, 4278 bp, Phaseolus vulgaris
gtctcgagcaataggaacacagcaatagcttctggtgatctcgttttttcacagtgctcttcccccttttctctttctctttctctgtttatctttctctctcttccattgctacaccacaagtaacgcaacgcgaggtcaattgcgtaatcgccatgactgtcatgactcctgctcccattgaccagcaggaggatgaggagatgcttgtcccacacactgatttgccggagaataatcaccaacccatggaagttgtggcacaacctgatgctgccaacactgtggagagccagcctgtcgaggatccttcatcgacaagattcacatggaaaattgacaacttttctagaatgaattcgaagaagctctattcagaaatatttgttgttggtggatataaatggcgtgtacttattttcccaaaagggaacaatgtggactatttgtccatgtatttggatgttgcagattcatctaatttgccctatggctggagtagatacgcacagtttagcttggctgttattaatcaaatccataataaatattctgtcagaaaagacacacaacaccaattcaatgcgcgagaaagtgattggggtttcacgtcctttatgccacttggtgaattgtatgatcctaccagagggtatcttgtgaatgacactcttgtagttgaagccgaggttcttgtccgtagaattgttgattactggacttatgattcaaaaaaagagactggctatgttggacttaagaaccagggtgctacatgttatatgaattctctactccaaactttatatcacattccttattttcgaaaggctgtgtatcacatgccaacaacagagaatgacatgccctctgcaagcatccctttggcattgcaaagtttattctacaagctccagtatagtgacaccagtgttgcaacaaaggagctcactaaatcttttggatgggacacgtatgattctttcatgcagcatgatgttcaagaactgaacagagtcctttctgaaaaacttgaagacaaaatgaagggaactgttgttgagggaactatacagaagttatttgaaggacatcatatgaactatattgaatgcattaatgtggactataaatcaactagaaaggagtcgttttatgatcttcagcttgatgtgaaaggctgtcctgacgtatatgcttcctttgacaaatatgttgaagttgaacgtcttgaaggggacaacaaatatcatgccgaacaatatggcttgcaggatgctaagaagggtgtcctatttattgatttccctcctgttcttcagcttcagctgaaaagatttgaatatgactttatgcgggataccatggtaaagattaatgaccgttatgagtttcccatgcaactcgaccttgatcgtgagaatggaaaatatttatcacccgaggctgataggaatgtccgcaatctttacacacttcatagtgttttggttcacagcggtggtgtacatggtggacactattacgcttttatccggccaactctctctgagcagtggtataaatttgatgacgagagggtaactaaagaagacactaaacgggcattagaggagcaatatggtggtgaggaagagctaccacagacaaatcctgggtttaacaacactccttttaaattcaccaaatattcaaatgcttatatgctggtgtatatacgtgaagctgacaaagacaaagtaatatgcaacgtggatgagaaagacatcgctgaacatttaagggagaggttgaagaaagaacaagaagaaaaggagcacaaaaagaaagaaaaggcggaggctcacctttacactattataaaggtggcacgagacgaagaccttggagagcagcttggaaaggatatatattttgatcttgtagaccatgccaaagtgaggtctttccgtgttcaaaaacagatttcttttaacttttttaaggaagaggttgctaaagagtttggcataccagtccaattccagcgcttttggctatgggcaaagcggcaaaaccatacataccgtccaaaccgaccgttgacactcatggaagaagcacaatctgttggacaattgagagaggtatcaaacaaggttcccaatgcagaattgaaattgtttttggaagtggagcttgggctggatttacgtcccattgcaccacctgacaagacaaaggatgatatattacttttcttcaagttatatgatcctgagaaagaggagctacgttatgttggaaggctctttgtgaagaatactggtaagccattggaaatcttgacaaagttaaacaaaatggctggttatgaccctgatgaagagattggactatatgaggaaattaagtttgagccaaatgttatgtgtgaacctattgataagaaattgacatttcgagctagccagttagaagatggagatattatatgctttcagaaagctcctgctatatacaatgtggaacatgtacgctatccagatgtgccgtcatacctagaatatgtgcacaaccgccaggttgttcactttcgatctcttgataaacccaaggaagatgacttctgtctggagatgtcaaggctatataaatacgatgatgtagtggagagagtggctcaacaactaggtttggatgatccatccataatcaggcttactcctcacaattgttactctcagcagccaaaacctcagccggttaagtatcggggtgtggagcatttgtctgaaatgctggttcactataatcagacttcggacatattgtactatgaagtacttgacatccctctgccagaattacaaggtttgaaaactctgaaagttgcatttcaccatgctaccaaggatgaagtggttattcataccaccagacttccaaagcagagcactgtgggggatgtccttgatgatctgaaaacaaaggtggaattgtccgaccctgaagctgagcttaggttgcttgaagttttctatcacaagatatacaaggttttccctcccaatgaaaagattgaaaacattaatgatcaatactggactttacgtgcagaggagattccagaagaggagaaaaatctgggtcctcatgatcgcctaatccatgtgtatcatttcactaaagatacggctcagaaccaaatgcaaattcagaactttggggaaccatttttcttggtcatacatgaaggggagactttgacagaaattaaagttcgaatacaaaagaaacttcaagttcctgatgatgagtttgcaaagtggaaatttgcttttttttctttagggcgtcctgagtaccttcaggattctgacattgtatccagtcgttttcagaggagagatgtttatggtgcttgggagcagtatcttggcttggagcatactgataatgctccaaaaagatcatatgctgtcaaccagaatcgccatacatttgagaagccagtaaagatttataattagaaaacttggtattgacgagctctcgtcttgcgtgggatgaatttggcattcttctacatctatgggcttgtaaaaacagggaaacagcaaaagctactctgtataggccaactagtgagatcagcaatccaggtggtttctgcagattttatattaaaattgtggtatgtaattctttctgtcaaaaggagtgacattgctctcaacactatctgctgaccacagcccgttgagctttactacttccaactgtggaagttcttcaagttgaggtcattgatcatcatcgctgcactgtatcagtacataagatttttggattagtgagtgtatacagggtatagttggttgactttttttttgttcatcttaattgcttccagattttgttcagtcagtagttgtcaaattatgtgagagctgtggaatggtgtagcagagttcatgtaatgttgtaaaagagacctgtcagcctcagtataacccgatagcataaatatagtttcctgccgcaccatttggtccatttctatttcctttggctgttttacctttttattttctgtttcttcctgcacctgacccatctttagtaagagctgaataagcgttatcatggtagtctcaattaactttagagtagaagtaatgcattgatatatgggttatagccacatgtgcctattccttcatttcatattttcaactttgttggacatgatgacaatagtataatctgctttatatggcactttattatttttcc

SEQ ID NO: 2366 - DNA, 4407 bp, Populus trichocarpa
tctttctctctctagccactgcctttgcgagtgtctcatctggctacactcagaaaaatcccgctttcgcttcttcttctcattgtctcctctcgatttcattctcgcctctctgattcgctcgatcgtacggtccatatccacccatgactatgatgactccttcaccgttggatcaagaagacgaggagatgctcgtgccgcattcagatttagttgaaggcccacaaccaatagaagtggcacaagtggagcaaactagtacggtggaaaatcagccagtggaggatcccccgtccatgaaatttacgtggactattgagaattttactaggttgaacacaaagaagcattattccgatgtatttattgttggcagttacaaatggcgagtactgatcttccctaaaggaaacaatgtggaccacttgtcgatgtatttggatgttgctgattctacgactttgccatatggatggagtagatatgcgcaattcagcttggccgtggtcaatcaaattcataacaagtactcaattagaaaggacacacaacatcagttcaacgcaagagagagtgactggggttttacatctttcatgcctctgagtgaactttatgatccaagtagaggatatctagtgaacgatacagttgttattgaagctgaagttgctgtccgtaagcttctagattattggtcctatgactcgaagaaggagacaggctatgtaggactgaagaaccagggagcaacatgttacatgaactctctcctacagactcagtaccatattccttacttccgaaaggctgtgtaccacatgccaacaactgagaatgacatgcctacaggaagcattccattggccctgcagagtttattctataagcttcaatataatgataccagtgttgcaacaaaggaactgaccaaatcttttggctgggatacatatgattccttcatgcaacatgatgtgcaagaactcaacagagtcctatgtgagaagctagaggataaaatgaaggggactgttgtggaggggactatacagcagttgtttgagggtcaccatatgaactacattgagtgcatcaatgtggactacaaatctacaaggaaggagtcattttacgatctccagcttgatgtgaaaggttgtcgagatgtttatgcttcttttgacaaatatgtggaagttgaacggcttgagggtgataacaaataccatgctgaagaacatggtttgcaggatgcaaagaagggtgtcttgtttattgacttcccccctgttcttcaactccaattaaagcgttttgaatatgattttatgcgtgacaccatggtgaagattaatgatcgctatgaatttcctcttcaacttgacctggatagggagaatgggaaatatttatcacctgatgcagacaggagtgttcgcaatctatacacacttcacagcgttttggttcatagcggaggggtgcatggtggacattattatgcttttatcaggccaaccctctctgatcagtggttcaaatttgatgatgaacgggtgacaaaagaagatatgaagagggcattagaagaacagtatggtggtgaggaagagctacctcagaccaatcctggctttaacaatactccatttaaattcacaaaatactcaaatgcatacatgcttgtgtatatacgggaaagtgacaaggacaagataatttgtaatgtcgatgagaaagatattgctgaacacttgaggataaggctgaagaaagaacaagaagaaaaagaagacaagagaagatataaagcacaagctcacctttacacaattataaaggtcgcacgagatgaggaccttaaagagcaaattggaaaggatatttattttgaccttgtggatcatgacaaagtccataacttccggattcagaaacagatgcagtttagtctttttaaggaggaggttgctaaagagtttggtataccagtacaatttcagcgattttggatatgggcaaagcgccaaaaccacacatataggccaaatcgatcattgacaccccaggaagaagcacaatcagttggacagctgagagaggtgtcaaataagacgcataatgctgaattaaaattgttcttggaaatcgagcttggactggatttacgtcccattgcgccacctgaaaaaactaaagaagatattctgcttttcttcaagctttatgaccctgaaaaacaagaattgcgatatgttggtaggcttttcgtgaagagttctggcaagccaatagaaattctagcaaagctcaatcaaatggctggctttccacccgatgaagagattgaactttatgaggaaatcaagttcgagccttgtgtcatgtgtgaacatcttgataatagggcctcatttcgaataagtcagatcgaagatggggacataatatgctttcagaaatctcctcctcttgaaaaggaagaagaatgtcgatatccagatgtgccttcatatttggaatatgtgcacaatcgacagatagttcatttccgatctctggaaaagccgaaggaggatgatttttgtctagagttgtcgaaggtacatacttatgatgatgttgtcgaaagagtggcccgccaaattggcttggatgatccatccaaaatcaggttgacatcccacaactgctactctcagcagcctaagccgcaaccaattaaatatcgaggagtggagcatctatcagatatgttagttcactacaatcagacttctgatatcttgtattacgaagttctggatattcctcttccagaattgcaaggtctaaaaaatttgaaagttgctttccatcatgctattaaagacgaagtggtaattcataacattagattgcctaaacaaagcaccgtgggagatgtgattaatgaacttaaaacaaaggtagaattgtctcacccaaatgctgaacttcgactgcttgaagttttctatcacaagatttataagatctttccacccaatgaaaaaatcgagaatataaatgatcagtattggacattacgggcagaggagatccctgaggaagaaaaaaatcttggtccccaagatcgcctgattcacgtgtatcacttcacaaaagagtctggacagaatcaaatgcaagtacagaattttggtgaaccctttttcttggtcatccatgaaggtgaaactttagctcaagttaaaatgcgcatacaaaagaaactgcaggtccctgacgaggagtttgcaaagtggaaatttgcatttctgtcgctgggtcgtccagagtacttgcaggattctgatgttgtgttcacccgctttcagagaagagatgtttatggcgcttgggagcagtaccttggcttggagcaccctgataatactcctaaaaggtcttatgcagttaatcagaaccgccacacgtttgagaagccagttaaaatatacaattagggaagagctgattaccctctacctgcacataaagccgagtaggacatctcatgctacaatatagaggatgagaaaagtggtacattgaagggagaagacaatgaagctcgaattaaagtaatttctgtaggatttgataattggttttgtagggtatatgtctctctgacgcgatcgggggaaggtggaaggtctcccctcccttatgtagttttttttgttattgttgatatgccctgcttgagctcccgtcttttctagcctttctcctaatgaagacacctccttgctttatataaaggtccagggtaatttagcagtacataagaagattttgactagggggatgcataccgggtatagttggccgagtttgacatttgattctttgtttttccttgtcttgggggatgggcttgtaaaatggttgctttacatttccgagcttagctggtgtagaagaaccgtctgctgtgcagctcaggttggttttatagcacctttgttaattaatataagtgttggttcacatttgtttccggaaggcttttgctgctgtgcaaaatctcttaatgggtcaagacttgagaatttttctctcctaaaagtctctatccaaggcacaggggagccctatggtgggtctttaccgaccactataatggtctttcgctgggaggtaatgggatgtcgttttattccgtggcctgtgggccgtggatcgtcatgaactcacattcaaagcggtgaatctcgcaatcctttcttaccttatggtggtgttcgatctcaccaagttactgcaacaaatgaagaatgatatcgagcggcgggttagcttggatagatgaaccccagcgctaactgttaggccttgcttgcagtttgttgacagaatttcaaaatatggttg

SEQ ID NO: 2367 - DNA, 4278 bp, Phaseolus vulgaris
gtctcgagcaataggaacacagcaatagcttctggtgatctcgttttttcacagtgctcttcccccttttctctttctctttctctgtttatctttctctctcttccattgctacaccacaagtaacgcaacgcgaggtcaattgcgtaatcgccatgactgtcatgactcctgctcccattgaccagcaggaggatgaggagatgcttgtcccacacactgatttgccggagaataatcaccaacccatggaagttgtggcacaacctgatgctgccaacactgtggagagccagcctgtcgaggatccttcatcgacaagattcacatggaaaattgacaacttttctagaatgaattcgaagaagctctattcagaaatatttgttgttggtggatataaatggcgtgtacttattttcccaaaagggaacaatgtggactatttgtccatgtatttggatgttgcagattcatctaatttgccctatggctggagtagatacgcacagtttagcttggctgttattaatcaaatccataataaatattctgtcagaaaagacacacaacaccaattcaatgcgcgagaaagtgattggggtttcacgtcctttatgccacttggtgaattgtatgatcctaccagagggtatcttgtgaatgacactcttgtagttgaagccgaggttcttgtccgtagaattgttgattactggacttatgattcaaaaaaagagactggctatgttggacttaagaaccagggtgctacatgttatatgaattctctactccaaactttatatcacattccttattttcgaaaggctgtgtatcacatgccaacaacagagaatgacatgccctctgcaagcatccctttggcattgcaaagtttattctacaagctccagtatagtgacaccagtgttgcaacaaaggagctcactaaatcttttggatgggacacgtatgattctttcatgcagcatgatgttcaagaactgaacagagtcctttctgaaaaacttgaagacaaaatgaagggaactgttgttgagggaactatacagaagttatttgaaggacatcatatgaactatattgaatgcattaatgtggactataaatcaactagaaaggagtcgttttatgaccttcagcttgatgtcaaaggttgtcgtgatgtttatgcttcctttgataagtatgttgaagttgaaagacttgagggggataacaaatatcatgctgaacagtatggtttgcaggatgctaagaagggtgtcctatttgttgaatttcctcctgttcttcaacttcagctaaaaagatttgaatatgactttatgcgggatactatggttaagattaatgaccgttatgagtttcccatgcaactcgaccttgatcgtgagaatggaaaatatttatcacccgaggctgataggaatgtccgcaatctttacacacttcatagtgttttggttcacagcggtggtgtacatggtggacactattacgcttttatccggccaactctctctgagcagtggtataaatttgatgacgagagggtaactaaagaagacactaaacgggcattagaggagcaatatggtggtgaggaagagctaccacagacaaatcctgggtttaacaacactccttttaaattcaccaaatattcaaatgcttatatgctggtgtatatacgtgaagctgacaaagacaaagtaatatgcaacgtggatgagaaagacatcgctgaacatttaagggagaggttgaagaaagaacaagaagaaaaggagcacaaaaagaaagaaaaggcggaggctcacctttacactattataaaggtggcacgagacgaagaccttggagagcagcttggaaaggatatatattttgatcttgtagaccatgccaaagtgaggtctttccgtgttcaaaaacagatttcttttaacttttttaaggaagaggttgctaaagagtttggcataccagtccaattccagcgcttttggctatgggcaaagcggcaaaaccatacataccgtccaaaccgaccgttgacactcatggaagaagcacaatctgttggacaattgagagaggtatcaaacaaggttcccaatgcagaattgaaattgtttttggaagtggagcttgggctggatttacgtcccattgcaccacctgacaagacaaaggatgatatattacttttcttcaagttatatgatcctgagaaagaggagctacgttatgttggaaggctctttgtgaagaatactggtaagccattggaaatcttgacaaagttaaacaaaatggctggttatgaccctgatgaagagattggactatatgaggaaattaagtttgagccaaatgttatgtgtgaacctattgataagaaattgacatttcgagctagccagttagaagatggagatattatatgctttcagaaagctcctgctatatacaatgtggaacatgtacgctatccagatgtgccgtcatacctagaatatgtgcacaaccgccaggttgttcactttcgatctcttgataaacccaaggaagatgacttctgtctggagatgtcaaggctatataaatacgatgatgtagtggagagagtggctcaacaactaggtttggatgatccatccataatcaggcttactcctcacaattgttactctcagcagccaaaacctcagccggttaagtatcggggtgtggagcatttgtctgaaatgctggttcactataatcagacttcggacatattgtactatgaagtacttgacatccctctgccagaattacaaggtttgaaaactctgaaagttgcatttcaccatgctaccaaggatgaagtggttattcataccaccagacttccaaagcagagcactgtgggggatgtccttgatgatctgaaaacaaaggtggaattgtccgaccctgaagctgagcttaggttgcttgaagttttctatcacaagatatacaaggttttccctcccaatgaaaagattgaaaacattaatgatcaatactggactttacgtgcagaggagattccagaagaggagaaaaatctgggtcctcatgatcgcctaatccatgtgtatcatttcactaaagatacggctcagaaccaaatgcaaattcagaactttggggaaccatttttcttggtcatacatgaaggggagactttgacagaaattaaagttcgaatacaaaagaaacttcaagttcctgatgatgagtttgcaaagtggaaatttgcttttttttctttagggcgtcctgagtaccttcaggattctgacattgtatccagtcgttttcagaggagagatgtttatggtgcttgggagcagtatcttggcttggagcatactgataatgctccaaaaagatcatatgctgtcaaccagaatcgccatacatttgagaagccagtaaagatttataattagaaaacttggtattgacgagctctcgtcttgcgtgggatgaatttggcattcttctacatctatgggcttgtaaaaacagggaaacagcaaaagctactctgtataggccaactagtgagatcagcaatccaggtggtttctgcagattttatattaaaattgtggtatgtaattctttctgtcaaaaggagtgacattgctctcaacactatctgctgaccacagcccgttgagctttactacttccaactgtggaagttcttcaagttgaggtcattgatcatcatcgctgcactgtatcagtacataagatttttggattagtgagtgtatacagggtatagttggttgactttttttttgttcatcttaattgcttccagattttgttcagtcagtagttgtcaaattatgtgagagctgtggaatggtgtagcagagttcatgtaatgttgtaaaagagacctgtcagcctcagtataacccgatagcataaatatagtttcctgccgcaccatttggtccatttctatttcctttggctgttttacctttttattttctgtttcttcctgcacctgacccatctttagtaagagctgaataagcgttatcatggtagtctcaattaactttagagtagaagtaatgcattgatatatgggttatagccacatgtgcctattccttcatttcatattttcaactttgttggacatgatgacaatagtataatctgctttatatggcactttattatttttcc

SEQ ID NO: 2368 - DNA, 3520 bp, Manihot esculenta
gcagagcccgctttcgcttcttctctctctttccctctctctatctctcttccctctatttatctctcactgtgtttttcttcttttcctttatttgctttcgattctgtttcgcttctcagatttgtcgatcgaacggctcctccgtctctccttccatgactatgatgactcctccaccgttagatcaagaagacgaggagatgctcgtaccgcattcagatttggttgagggtccacagcctatggaagtagcacaagtggagtcagctagtaccgtggagaatcagccagtggaggatcctccatccatgaaattctcatggacaattcagaatttctctaggttgaacactaagaagcactattcagatgtattcatcgttggcggttacaaatggcggatactaatttttcccaagggaaacaatgtggatcacttgtctatgtatttggatgtagctgattctgccacattgccatatggatggagtagatacgcacaattcagcttggctgtagtcaatcaaattcataacaagtattcaattaaaaaagatacgcagcatcaatttaatggaagagaaagtgactggggtttcacatcgtttatgcctcttagtgatctttatgatcccagtagaggataccttgtgaatgatattgttgttgtggaagctgaagttgctgttcgtaaggttctggattattggtcatatgactcaaagaaggagactgggtatgtaggactgaagaaccaaggagcaacatgttatatgaactctctcttgcagactctctaccacattccttactttaggaaggctgtgtaccacatgccaacaactgaaaatgacatgcctacaggaagcattcctttagctctacagagtttattctataagctgcaatataatgacacaagtgttgcaacaaaggaattgaccaaatcttttggatgggatacgtatgattccttcatgcagcatgatgtacaagaactcaatagggtactgtgtgagaagctagaagataagatgaaggggactgtggtggaggggacgatacagcagttatttgagggtcaccatatgaattatatcgagtgtatcaatgtggattataaatcaacaagaaaagaatcattttacgatctccagcttgatgtaaaaggttgtcgggatgtttatgcttcttttgacaagtatgtagaagttgaacgacttgagggtgataacaaataccatgctgaagaacacggtttgcaggatgctaagaagggtgtcctatttattgactttccccctgttcttcaactccaactgaagaggtttgagtatgactttatgcgagacactatggtgaagattaatgaccgatatgagtttcctcttcaacttgaccttgacagagagaatggaaaatatctgtcgccggaagcggacaggagtgttcgtaacctttacacacttcatagtgtgttggttcatagtggaggggtgcatggtggacattattatgctttcatcaggccaaccctttctgatcaatggttcaaatttgatgatgaacgggtgacaaaggaggatatgaagagggcactagaagagcagtatggcggtgaggaagagcttccacagaccaatcctggttttaataatgctccatttaagttcacaaaatactcaaacgcttacatgctagtttatatacgtgaatgtgacaaggacaagataatttgtaatgtcgatgaaaaagacattgctgaacacctgaggattaggttgaagaaagaacaagaagagaaggaagacaagagaagatataaagcacaagcccacctttatacaataataaaggttgcacgagacgaggaccttaaagagcagattggaagggatatatattttgacctggtggatcatgacaaagttcgtaatttccgtatccaaaagcagacaccgtttagtcattttaaggaggaggttaccaaagaatttggtgtacctgtacagtttcagcgattttggatatgggcgaagcgtcaaaatcatacataccgtccgaatcgaccactaacacctcaagaggaagcacaatcagttggacagctgagggaagtgtcaaataaagcacacactgcagaattgaagttgttcttggaagtagagcttggacaggatttacgtcctattgctcctcctgacaaaactaaagaagatattcttcttttcttcaagctttatgatcctgagaaaggagaattacgatatgtcggtaggctttttgtgaagagttctggtaaaccaatggaaatcttggcaaaacttaatcaaatggctggctttgcacctgacgaagagattgaactttatgaggaaataaagtttgatccctgtgtcatgtgtgaacatcttgataagaggacgtcatttcgattaagtcagattgaagatggagacataatttgctttcagaaatctcctcctcttgagggtgaagaagattgccgctacccagatgtgccttcatttctggaatatgtgcacaatcggcaggtagttcattttcgttctctagagaaaccaaaagaggatgatttttgtctggagttgtcaaagctacatacctatgatgatgttgtggaaagagtagctcaacaaattggtttagatgatccatccaagattaggttaacatctcacaactgttactcccagcagcctaagccccagccaattaaatatcgaggagtggatcatctttcagatatgttagttcactataatcagacttctgatattttgtactatgaagttctggacattcctcttccagaattgcaaggtttgaaaaatctgaaagttgctttccatcatgctactaaagatgaggtggtaattcataatattagactacctaaacagagcactgtaggggatgtgattaatgaacttaaaacaaaggtggagttgtctcatccaaatgcagaacttcgtcttcttgaagttttctatcacaagatatacaagatctttcctcccaatgaaaaaatcgaaaatataaatgatcagtactggacattgcgtgcagaggaggcaaaggaagagaaaaatcttggacctcatgatcgcttgattcatgtttatcacttcacaaaggagacggctcaaaatcaaatgcaagtacagaattttggggagccatttttcttggtcatccatgaaggtgaaactttagctgaagttaaagcacgcattcaaaagaaactgcaggttcctgatgaggacttttctaagtggaaatttgcatttctctcactaggtcgtccagagtatctgcaggattctgatatagttttcacccgttttcagagaagagatgtttatggtgcttgggaacagtaccttgggttggagcattctgacaatacgcccaagaggtcttacgcggtaaaccagaaccgtcatacgtttgagaagccagttaaaatatacaattaggcaagagctgatgatcc

SEQ ID NO: 2369 - DNA, 4128 bp, Populus trichocarpa
cgaaatcagaacagtaaacccctcttcccctctccctttttctacaccaatcttccttcctcttagttctcccccccccttctctctcaaattctcactttacacttctctccgattcctcgatcggacggtcaccaatcatcttccactcatgactctcatgactcctcctccgttagaccaacaagaagacgatgagatgttggtcccacacactgaatttactgagggacctcagcctatggaagtagcacaagcagaaacagcgacggcagttgatgcacagtcagtggatgatccaccatcagctaggtttacatggacaattgataatttttcgaggtttaatactaagaagctttactccgatgtttttgttgttggaggctacaagtggcggatactggtttttccaaaggggaacaatgtggatcatttatccatgtatttagatgttgcagattcaactaatttgccatatgggtggagtcgatatgcgcagtttagcttgactgtcatcaatcaacttcaccaaaaatattcaattcggaaagacacgcagcaccagttcaatgcacgtgagagtgattggggcttcacttcatttatgccacttggggaattgtatgaccctgggagagggtatcttgtaaatgactcatgcatagttgaagctgatgttgctgttcgtagggttattgattactggtcacatgattcaaaaaaggagaccggttatgttggtctcaagaaccaaggagctacatgctacatgaactctctccttcaaacgctgtatcatattccttattttagaaaggctgtatatcatatgccaacaactgagaatgatatcccatcagggagcattccactggcgttgcagagtttgttttataaacttcaatacagtgacactagtgtagcaacaaaagagttgacaaagtctttcggctgggatacatatgactctttcatgcagcatgatgtccaagaacttaatagggttctttctgaaaagcttgaagataaaatgaagggaactgtcgtggagggcactatacaacagttatttgaagggcaccatatgaattatattgaatgcatcaatgttgactataagtcgacaagaaaggagtcattttatgatcttcagcttgatgtcaaaggctgtcgagatgtttatgcttcttttgataagtacgtggaggtggaacgtcttgagggtgacaataagtaccatgctgaacaacatggattgcaggatgctaggaagggtgtcctattcattgacttcccccctgttctccaacttcaacttaaaaggtttgagtatgattttatgcgggatacgatggtgaagataaatgatcgctatgagttccctttgcaacttgatctggatagagagaatggaaaatatttatcacctgaggccgactgcagtgtccgcaatctctacacccttcacagtgttttggttcacagtggcggcgtgcatggtggacactactatgcttatatcagaccaactctatcagatcagtggttcaaatttgatgatgagcgggtaaccaaagaggatgtgaaaagggcattagaggagcagtatggtggtgaggaagagttaccacagacaaatcctggctttaacaactctcccttcaagtttacaaaatactcgaatgcttatatgcttgtgtatatacgtgaaagtgacaaggaaaaagtaatctgtaatgtggatgagaaggatattgcagagcacctcaggataagactgaagaaagaacaggaagagaaagagcaaaagagaaaggaaaaagctgaggcccacttgtacactatcataaaggttgcacgtagtgaggatctacttgaacagattggcaaagatgtatattttgatctcgtggatcatgacaaagttcgtagtttccgtatccagaaacaaataacctttaaccttttcaaggaagaagttgctaaagaatttggtattccagtgcaatttcaacgtttttggctgtgggcaaaacgacaaaatcatacataccgtccaaatcggccactgactcctcaggaggaatcacaatctgttggacaattgagagaggtttctaataaggcaaataatgcagagctgaagttgtttctggaagtagaagttgggcaggattcgcgacctgttcctccacctgagaagactaaagaggatatccttcttttctttaaactttatgatccatcaaaagaggaactccggtatgttgggaggctgtttgtgaagggtagtggtaaaccattggagatcctgacaaaactaaatgaaatggctggctttgctcctgaccaggagattgaactttatgaggaaataaaatttgaacctaatgtcatgtgtgaacacattgacaagaggctcacttttcgttctagccagcttgaagatggagatattgtttgctttcagaaaccccctcaaatgggaagcaatgaacagtgccgctaccctgatgtgccttcattccttgagtatatgcacaatcgccaggttgttcgatttcgatctttggagaaatcaaaagaggatgaattttgtcttgagctatcaaagctccacacttatgatgatgttgtggaaagagtagctaaccatcttggcttggatgacccatccaaaattaggcttacatcccataactgttactcccagcaacctaaacctcaacccatcaagtaccggggagtggatcatttatctgatatgctggtgcactacaatcagacatctgatattctatactatgaagtattggacatccctcttccagaactgcaaggccttaaaacattaaaggttgcatttcatcatgctaccaaggatgaggtagtgattcataccatcagattgccaaaacagagcactgtaggtgatgtcatcaatgaccttaagacaaaggtggagctgtctcatcccagtgctgaacttagattgcttgaggttttctatcacaagatctacaagatctttccacataatgaaaaaatcgagaacattaatgatcaatactggacactacgtgcagaggagatacctgaagaagagaaaaaccttggtcctcatgatcgtttgattcatgtatatcatttcatgaaagacacaactcaaaaccaggtgcaggttcagaattttggagaaccatttttcctggtcattcatgagggcgaggctttagctgacgtcaaaatgcgtgtacagagaaaattgcaggttcctgatgaagaattttcaaagtggaagtttgcatttttgtcactaggtcgccccgagtaccttcaagactcagacattgtgtccaatcgttttcagagaagggacatttatggtgcctgggagcaatatcttggactcgagcattctgacaatgctcccaaaaggtcatatgctgctaatcagaatcgtcatacatttgagaagccggtaaaaatctacaattaggaagcaatgaggaagtaacacgagtgcatcaagtgactttaataccctgtttgcatacaaaatgagcaaacaaggaagaagcaggctttcaagcagtgcaaatcagtgggttttgatagatgtgtaattctttcatgtagggagagggtaaacttatgcctaagaactgcgttccctcaatagttttgacctctctcttgcactcggctttcgggtgtagtagatgacatttgatccttaaatccattgtaatttagtacataagattttgatatgggggatgtatagagggtataggtgtgtgttcttaagttattgtctttcctttcgcaatcatcccttttgtggatttccctagatgtattagagaatcatttgagtctccttttgaggcacatgtataatttgttgtttgtttacttgttcttggcttccctgtttttctgcaaatgaaacaccaattcccttcaaaccgatcctcagtttcctctttagtcttcctctttctctgtctcatacccgaggttaaccttcagccaggtcggccaaaatggaatcagcttggatcaaattagagctgccacactttccttgtgtcattcctccttcatgtttgatgtgcaact

SEQ ID NO: 2370 - DNA, 3791 bp, Triticum aestivum
atgttgcagactcggggaacctcccttacggatggagccggtatgctcagttcagcctagccgttgtaaaccagatccatcagaagtatacagcacgcaaagatactcaacatcagtttaatgcacgtgaaagtgactggggtttcacatcttttatgcctctgagtgagctctatgatccaagtaggggctatctcgtgaatgatactgttgttgttgaagctgaggttgctgttcgcaaaatggttgactattggacttatgactcgaaaaaggaaacaggttatgttggtctcaagaatcagggtgctacctgttatatgaactctcttctgcaaaccctgtatcatataccttactttcggaaggctgtatatcacatgccaactactgagaatgacatgccatctgggagtattcctttagccctgcagagccttttttacaagctccagtatagcgacaatagtgtagctacaaaagagttgactaaatctttcgggtgggacacctatgattctttcatgcagcatgatgtgcaagagctcaatagagttctatgcgagaaacttgaagacaaaatgaagggaactgttgtggaaggaacaattgaacaactatttgaaggccaccacattaattacatcgagtgcattaatgttgactataaatctaacagaaaagagtccttttatgatctacaacttgatgtcaaaggttgtcgtgatgtttatgcatcatttgataaatatgtcgaagtggagcgtctagagggtgataacaaataccaggctgaacaacatggcttacaggatgcaagaaagggcgtactctttcttgatttccctcctgttttgcaacttcaactgaagcgtttcgaatatgattacatgcgagacacaatggttaagattaatgaccgttatgagttcccactacaactcgatcttgataaggatgatggaaaatatcttactccagatgcagatagaagtattaggaacctttacactcttcacagtgttcttgttcatagtggaggagtacatggtggtcactactacgctttcatacgacctacactctcagaccagtggtataaatttgatgatgagcgagtaacaaaagaagatactaaaaagacgcttgaagagcagtacggggcgaggaagagttgcctcaagttaaccctggtttcaataacaccccatttaagttcacaaagtattcaaatgcctacatgcttgtatatattcgtgagagtgacaaggagaaaataatgtgtaatgttgatgagaaggacattgctgagcatttgaggataaggttaaagaaagaacaagaagagaaagaacacaagaaaaaggaaaaagctgaagctcacctctacaccatcataaaggttgctcgagatgaagatttgaaggagcagattggaagaatatatattttgatctggtggaccatgaaaaagtccgtaattttcgtatacagaaacaattaccctttaattcattcaaggaggaagttgcaaaggaatacggcattccggtacagtctcagcgcttctggttgtgggctaagaggcaaaatcatacataccggcccaaccgtccgctggcccctcatgaagaagcacaatcagtggggcaacttagggaggtatcaaacaaggcacacaatgctgagctgaagctatttcttgaagtagagctaggattggatttgcgcccaattcgtcctcccgagaagagcaaggaagatattttacttttcttcaagctttataatcctgaaaaggaagagcttcgttttgttggtaggctttttgttaaggctttgggaaagccatctgatatcctgacaaaacttaatgaaatggctggattttccccaaatgaagaaatcgaactttatgaggaaattaagttcgagcctaatgtgatgtgtgaacatattgacaagaaacttagtttccgatctagtcagcttgaagatggggacataatcagtttccaaaagccatctataccaggtggcgatactcaagtgcgctataaagatgttccttctttcttggagtatgttcataataggcaggttgtgcacttccggtgtctggagaaaccaaaggaggagggattttgtttggaattgtcgaagcttcatacttatgatgatgttgttgagagagttgcacgccaacttggattaaatgatccatcaaaagttcggcttacgtctcacaattgctattctcagcaacctaaaccacagcccatcagatatcgtggagtagagcatctattggatatgcttgtccattataatcagacttctgacatactgtattatgaagtcttggacattccactgccagaattgcagtgtttaaaaacacttaaagttgcatttcaccatgcaacgaaagatgaggttgtaattcacagcatcaggctttcgaaaaatagcaccatcagtgatgtgatcactgacttgaagaccaaggttgaactatccaatcctgatgctgagctccgcttgcttgaagttttctaccacaagatttataagatatttccacctcatgagaagatagagaacataaatgatcagtactggacactacgtgctgaggagattccagaggaggagaagaatctcactgcacaggatcggttgattcacgtctatcatttcatgaaagatcctaatcagaaccagcagattcagaattttggagatccctttttgctggtcatccgtgaaggtgagactgctgcagaggtaatggaccgtgtgcagaaaaaactccgagttcccaatgaagaattcgccaagtggaaggttgcattcatatccatgaatcgtccagaatacctccaggatattgatgctgtgtctgcacgctttcagaggagagatgtctatggagcttgggaacaataccttggtttggagcatactgacacaacacccaaaaggtcttacgcagctaatcagaatcgacacacatatgagaagcctgtgaagatttacaattgagaaaccttccatctgggctgcaagcctcgggacaaaggcctcatccgagaaagtatgctaaagaggccaagtgacctcaacagaagggaaatgctgtcaaatatatggttatttgtgtgccaaggcctatattacttgctacttgttgacagtcggtgctgtggttggcagaaggatatattctttgaggctttccctcttgcctgctccctgacaacgaagcaagcatgctgatttcgttgtcctgagtgtgatagaccccactaggatagatgttgcttcttttgtgcagagcagagctggtacataagaaaatgattttggtaggggcatgtatacatggttatagccgagactgattgctttatttgctgctccggcattggaacaatggggtagattgtataatgggtttgtggctggttccagtttttggtgtccattgtgaatgtaggcagtaacttcagcagaaagtagtctcatgagtttcagcacagcccgtgttcttggcattgatttgatttaacctaggagatactgatgatagttctatagacgcactagttttctcccgccttgtagaatgagaaccaagtaattattttgactcgatagctttattctaaatcctttttgaacttaaaaggtctctgttcaatagtaggtcaattctgacaaactaaggtataatttcagtcttgtggagataatttgaatatgagaaatgctgaaagtccattcttctg

SEQ ID NO: 2371 - DNA, 3849 bp, Musa acuminata
atgaccatgacgactccaccgcctctcgatcaggaggaggacgagttgttggtcccacgcccggagatcgcggaagggccccagccaatggaagttgctcagagtgaaactactagtactgctgagaaccatcaggtagaggaaccttcgtcctccaggtttacatggacaatcgagaatttctctaggttgaataccaagaagctctactctgatatgtttatagtcggtggctaccagtggagagtgcttatctttccaaaaggtaataatgttgattatttgtcgatgtacctggatgttgctgattcagcaagcctaccatatgggtggagtaggtttgcacagttcagtttggctgtggtcaatcaaatccaaagcaagtattcaataaggaaagacacccaacaccaatttaactcacgtgaaagtgattggggtttcacatcgtttatgcctctaagcgaagtatatgacccaagcagaggatttctagtaaatgataccatagtagttgaagctgatgttgctgtccgcagagtcattgattattggtcttatgactcaaaaaaggagacaggttatgttggtctcaagaatcagggggctacttgttacatgaattcccttctccagactttgtatcatattccttatttcaggaaggctgtgtaccatatgcctacaactgagaatgatatgccatcaggaagcattccattggccctgcagagtttgttttataagctccaatacagtgatggcagtgttgctacaaaagatttgacgaaatctttcggatgggatacatatgattcgtttatgcaacatgatgtccaagaactcaatagggttctttgtgagaagttggaagacaagatgaagggaactgttgttgagggcactatacaacagttatttgaaggtcatcacacgaattacatagagtgcattaatgtggattacaaatccagcagaaaggagtctttttatgatcttcagcttgatgtcaaaggttgtcatgatgtttatgcttcttttgataagttcgttgaagttgagcgtcttgaaggagataacaaatatcatgcagaacagtatggtctacaggatgccaagaagggtgttctctttgctgatttcccccctgttttgcaacttcaactcaaacgttttgaatatgatttcatgcgagatactatgattaagataaatgaccgttatgagtttccagtgcaattagaccttgatcgagaaaatggcaaatatctttctcctgatgcagacagaagggtccgcaacctatacacaattcacagtgtgcttgttcacagtggtggagtgcatggtggacactactatgcctttatccgtccaaatctttctgaccagtggtataagtttgatgatgagcgtgtgacaaaagaagatacaaagagggcaattgaggaacagtatggtggtgaggaggagttaccacagataaatcccggtttcaataatactccattcaagtttacaaagtattcaaatgcttacatgcttgtatatattcgtgaaagtgacaaggataaaataatgtgtaatgtagatgagaaggatattgccgagcaccttaggataagattgaagagagaacaagaagaaaaagaacaaaaaaagaaagagaaagctgaggctcacctgtatactatcattaaggtggcccgggataaggacctgatggaacagataggaagggatatttattttgacctggttgatcatgacaaagtttgcagctttcgcatacaaaagcaattgcctttcagtattttcaaggaggaggtggcgagagaatttggtataccagtacacttccaacgattttggttgtgggctaaacgacagaatcatacataccgtccaaacaggcctttaagtcctcaagaagaagcacaatctgttgggcagttgagggagatatctaataaggcacagaatgctgaacttaagctactcctagaagtagagcttggaccggacttgcatccttctcccccacctgaaaaaactaaggaagatatactgcttttcttcaagctttatgaccctgaaaaggaggagcttagatatcttgggaggttgtttgtgaaggggcttggaaagccagcagatatacttactaaattgaatgagatggctggtttttcaccaaatgaagaaattgaacttttcgaggaaataaaatttgagccaaatgtgatgtgcgaacgcattgacaagagacttccctttcgttctagccagctggaggatggtgacattatatgctatcagaaatccccttcacttggcaataatgagccaatccgttatcctgatgttccatcttttttggaatatgttcgtaataggcaggtggttcattttcgattgctagagaagccaaaggaagatgatttttgcttagagctgtcaaaacttgatacctacgatgatgttgtagaaaaggtggcacgccaacttagcctaaatgatccatcaaaaatccggcttacatcacataactgctactctcagcagcctaaacctcaacccatcaaatataggggtgtggatcatttatctgatatgcttgtccatttcacacagacatctgatatattatattatgaagtgctggatataccattgcctgaattgcaaggtttaaaaactctaaaagttgcatttcatcatgccaccaaggatgaggttgcaattcatagcattagactaccaaagaatagtattgtcggtgatgtgatcaatgacctaaaggcaaaggttgagctgtcccaccctaatgctgaacttcgattactagaggtcttctatcacaagatttacaagatattcccacctagtgaaaaaatagaaaacataaatgatcagtattggacattgcgtgcagaggagattccagaggaagagaaaaaccttggccctcaagatcgcttaattcatgtatatcatttcatgaaagatccaaatcagaatcagatgcaaattcagaactttggggaaccttttcttctggttattcatgagggtgaaactttagctgaagtgaaagtacgtatccaaaaaaaacttcagattccggatgatgacttctctaagtggaagtttgcattcttatctatgggtcgtccagattacctgcaagattcagaaattgtatctaatcgtttccagagaagagatgtttatggagcttgggagcagtaccttggattagaacattcggacactgctccaaaaagggcttacacagcaaatcagaaccgtcatacttttgacaaaccagtgagaatctataactaaaatgtggtcagacacatatattgtgtttatgccttgaagagatgccattttccctggtcaatcaagttcatgataggagaggtctaaacaccacactgatccttgattcaaaagcagcaagccgttccttttgttatttacattcccaggctggttgaggaaagcgtacggagctcctaaatttcattttgggtttttgtccttatttgccatggccaccacctgaacagcagttggcttgtttctagtggaatatagtgcataaagaagattttgtattaggaaatgtttacaggaggtatatctgttcctactagtctgttgattctagcctctgctgtttgtcttcttttctattaaagttgggcaacatggggttgtatattgtggtgattactgttcatagctgagttgaacagttactgtaagatttatatacccccgctttgccacctatattattagttgtttcattcatgctataaaactataccttgtttg

SEQ ID NO: 2372 - DNA, 3779 bp, Euphorbia peplus
tcttctattttccattatctacttggtttctctcccggcgacgacactctcagatttgccgatcggacggctaatctcgctccgcccatgactatgatgactccaccgccgttagatcaggaagacgaggagatgcttgtaccgcattcagatttggttgaaggtccgcagcctatggaagtagctcaagtggaacctgctagtactgttgaaaatcaacctgtggaggatcctccttcgatgaaattcacatggacgattgagaatttcacaagactgaatactaagaagcactactctgatatgttcgtcgttggcggttataaatggcgggtacttatttttcccaagggaaacaatgtggaccacttgtctatgtacttagatgttgctgattcttctacattgccatatggatggagtagatatgcgcagttcagcttggctgtggttaatcaggcccataacaagtactctattagaaaagacacacaacatcagttcaatgcaagagagagtgactggggtttcacctcatttatgccccttagtgatctttatgatcctactagaggataccttgtgaatgatacagttattgttgaagctgaagttgctgtgcggaaggttcttgattattggtcatacgactctaagaaggagactggttttgtaggactaaagaaccaaggagcaacttgttacatgaactctctcttgcagacactttatcatattccatactttagaaaggctgtgtaccacatgccaacaactgaaaatgacatgccgacaggaagcattcctttggctctacagagtctattctataagctgcaatataatgataccagtgttgctacaaaggaattaactaaatcttttggatgggatacatatgactccttcatgcaacatgatgtgcaagaactgaatagagttctatgtgagaaactggaggataagatgaagggaactgttgtagaggggacaattcagcagttatttgagggccaccacatgaattatattgcatgcattaatgtggactataaatctacaagaaaggagtcattttatgatctccagcttgatgttaaaggttgccgggatgtttatgcctcttttgacaaatatgtagaagttgaacgacttgagggtgataacaagtatcatgctgaagaacatggtttgcaggatgctaagaagggcgtcttatttattgactttcctcctgtacttcaactgcaactaaagcggtttgaatatgattttatgcgagacactatggtgaagattaatgaccgctatgagttccctctccaactcgaccttgatagagaggatggaaaatatttatcaccagaagcggacaggagtgttcgtaacctttatacgcttcacagtgtcttggtccatagtggaggagtgcatggtggacactattatgcttttatccggccaacactcaccgatcaatggttcaaatttgatgatgagagagtgacaaaggaggatgtgaaaagggcattagaggagcagtatggtggcgaggaagagctaccacagacaaatccaggtttcaataatgctccatttaagttcacaaaatactcgaatgcgtacatgcttgtctatattcgtgaaagcgacaaggacaagataatatgtaatgttgatgaaaaagacattgctgaacatctgaggattagattgaagaaagaacaagaagagaaggaagataagagaagatataaagcccaagcccacctttataccatcataaaggttgcccgtgatgaagatctcaaagagcagattggcagagatatatattttgatctcgtagatcatgacaaagttcggaatttccgtatccagaagcagacaccatttaacattttcaaggaggaagttgcaaaagagttcggcgtaccagtccaatttcagcgtttctggatatgggctaagcgccagaaccatacatatcgtccgaaccgacctctgacaccacaagaggaagcacaatctgttggacaactgagggaggtgtcaaataaagcacataatgcagaattgaagttgttcttggaagtagagcttggtctggatttacatcctattgctccaccagacaagaccaaagaagatattcttcttttcttcaagttctatgatccagagaaaggagaattacgatatgtaggtaggctttttgtgaagagctctggtaagccaatggaaattttgtcaaagataaatcaaatggctggatttgcacccgatgaagagatcgaactttatgaggaaataaaatttgaaccatgtgtcatgtgtgaacaccttgataagaggacgtcatttcgtctaagtcagattgaggatggggatataatttgctttcagaaatcttctcctgtagagactgaagaagattgtcgatacccagatgtacctgcatttttggaatatgtgcataatcgccaagtagttcatttccgatctttagagaaaccaaaggatgatgatttttgtctggagttgtcaaaacagcatacatatgatgatgttgtcgaaagggtggctcgacaaattggtttagacgacccatccaagattaggctaacgtcccacaactgctactctcagcagcctaagccccaaccggttaaatatcggggagttgagcatctgtcagatatgttagctcattataatcagacatctgatattctgtattatgaagttctggacattccactcccagaattgcaaggtttaaaaaatctgaaagttgcattccatcatgctactaaagatgaggtggtaattcataatatcagattacctaaacaaagcactgtgggggatgtgattaatgaacttaaaacgaaggtggacttgtctcaccctaatgcagaacttcgacttcttgaagttttctaccataagatatacaagatctttcctcccaatgagaaaattgagaacataaatgaccagtactggacactgcgtgctgaggagatcccagaagaagaaaagaatctcggtcctcatgatcgcttgattcatgtgtatcactttacaaaggagacagctcagaatcaaatgcaagtgcagaattttggagagccatttttcttagttatccatgaaggtgaaaccttagctgaagttaaattgcggatacagaagaaattgcaggttcctgatgaggaatttgccaagtggaaatttgcatttctgtcgctgggtcgtccagagtacctgcttgatgctgatatagtgttcacccgtttccagagaagagatgtttatggtgcatgggagcagtaccttgggttagaacattccgataatacacccaaaaggtcttatgctgtaaatcagaatcgtcatacatttgagaagccagttaaaatatacaattagggaagagctgatgggtcctccaactccacctgcacattggaatgatgaatcagatgtcacgataacaaggatcacagaagacaaacgagtgggcagattttgaatggaaggaaacaaatgaagctcaaagggtgattatttatgtaggggtaggtaattgtttttgtaggatatacttgttcgttcaagctctcttctctgcttacctccatccttggttttagagattggtggtttaccaaatatgcagctagctcccagtgtaatttagcagtacataacaggatttttgactaggggatgatggatgtataccgggtacagctctactcgtcgcgtttgtc

SEQ ID NO: 2373 - DNA, 4062 bp, Populus trichocarpa
ttctcccccccccttctctctcaaattctcactttacacttctctccgattcctcgatcggacggtcaccaatcatcttccactcatgactctcatgactcctcctccgttagaccaacaagaagacgatgagatgttggtcccacacactgaatttactgagggacctcagcctatggaagtagcacaagcagaaacagcgacggcagttgatgcacagtcagtggatgatccaccatcagctaggtttacatggacaattgataatttttcgaggtttaatactaagaagctttactccgatgtttttgttgttggaggctacaagtggcggatactggtttttccaaaggggaacaatgtggatcatttatccatgtatttagatgttgcagattcaactaatttgccatatgggtggagtcgatatgcgcagtttagcttgactgtcatcaatcaacttcaccaaaaatattcaattcggaaagacacgcagcaccagttcaatgcacgtgagagtgattggggcttcacttcatttatgccacttggggaattgtatgaccctgggagagggtatcttgtaaatgactcatgcatagttgaagctgatgttgctgttcgtagggttattgattactggtcacatgattcaaaaaaggagaccggttatgttggtctcaagaaccaaggagctacatgctacatgaactctctccttcaaacgctgtatcatattccttattttagaaaggctgtatatcatatgccaacaactgagaatgatatcccatcagggagcattccactggcgttgcagagtttgttttataaacttcaatacagtgacactagtgtagcaacaaaagagttgacaaagtctttcggctgggatacatatgactctttcatgcagcatgatgtccaagaacttaatagggttctttctgaaaagcttgaagataaaatgaagggaactgtcgtggagggcactatacaacagttatttgaagggcaccatatgaattatattgaatgcatcaatgttgactataagtcgacaagaaaggagtcattttatgatcttcagcttgatgtcaaaggctgtcgagatgtttatgcttcttttgataagtacgtggaggtggaacgtcttgagggtgacaataagtaccatgctgaacaacatggattgcaggatgctaggaagggtgtcctattcattgacttcccccctgttctccaacttcaacttaaaaggtttgagtatgattttatgcgggatacgatggtgaagataaatgatcgctatgagttccctttgcaacttgatctggatagagagaatggaaaatatttatcacctgaggccgactgcagtgtccgcaatctctacacccttcacagtgttttggttcacagtggcggcgtgcatggtggacactactatgcttatatcagaccaactctatcagatcagtggttcaaatttgatgatgagcgggtaaccaaagaggatgtgaaaagggcattagaggagcagtatggtggtgaggaagagttaccacagacaaatcctggctttaacaactctcccttcaagtttacaaaatactcgaatgcttatatgcttgtgtatatacgtgaaagtgacaaggaaaaagtaatctgtaatgtggatgagaaggatattgcagagcacctcaggataagactgaagaaagaacaggaagagaaagagcaaaagagaaaggaaaaagctgaggcccacttgtacactatcataaaggttgcacgtagtgaggatctacttgaacagattggcaaagatgtatattttgatctcgtggatcatgacaaagttcgtagtttccgtatccagaaacaaataacctttaaccttttcaaggaagaagttgctaaagaatttggtattccagtgcaatttcaacgtttttggctgtgggcaaaacgacaaaatcatacataccgtccaaatcggccactgactcctcaggaggaatcacaatctgttggacaattgagagaggtttctaataaggcaaataatgcagagctgaagttgtttctggaagtagaagttgggcaggattcgcgacctgttcctccacctgagaagactaaagaggatatccttcttttctttaaactttatgatccatcaaaagagaaactccggtatgttgggaggctgtttgtgaagggcagtggtaaaccattggagatcctgacaaaattaaatgaaatggctggctttgctcctgaccaggagattgaactttatgaggaaataaaatttgaacctaatgtcatgtgtgaacacattgacaagaggctcacttttcgttctagccagcttgaagatggagatattgtttgctttcagaaaccccctcaaatgggaagcaatgaacagtgccgctaccctgatgtgccttcattcctcgagtatatgcacaatcgccaggttgttcgatttcgatctttggagaaatcaaaagaggatgaattttgtcttgagctatcaaagctccacacttatgatgatgttgtggaaagagtagctaaccatcttggcttggatgacccatccaaaattaggcttacatcccataactgttactcccagcaacctaaacctcaacccatcaagtaccggggagtggatcatttatctgatatgctggtgcactacaatcagacatctgatattctatactatgaagtattggacatccctcttccagaactgcaaggccttaaaacattaaaggttgcatttcatcatgctaccaaggatgaggtagtgattcataccatcagattgccaaaacagagcactgtaggtgatgtcatcaatgaccttaagacaaaggtggagctgtctcatcccagtgctgaacttagattgcttgaggttttctatcacaagatctacaagatctttccacataatgaaaaaatcgagaacattaatgatcaatactggacactacgtgcagaggagatacctgaagaagagaaaaaccttggtcctcatgatcgtttgattcatgtatatcatttcatgaaagacacaactcaaaaccaggtgcaggttcagaattttggagaaccatttttcctggtcattcatgagggcgaggctttagctgacgtcaaaatgcgtgtacagagaaaattgcaggttcctgatgaagaattttcaaagtggaagtttgcatttttgtcactaggtcgccccgagtaccttcaagactcagacattgtgtccaatcgttttcagagaagggacatttatggtgcctgggagcaatatcttggactcgagcattctgacaatgctcccaaaaggtcatatgctgctaatcagaatcgtcatacatttgagaagccggtaaaaatctacaattaggaagcaatgaggaagtaacacgagtgcatcaagtgactttaataccctgtttgcatacaaaatgagcaaacaaggaagaagcaggctttcaagcagtgcaaagcagtgggttttgatagatgtgtaattctttcatgtagggagagggtaaacttatgcctaagaactgcgttccctcaatagttttgacctctctcttgcactcggctctcgggtgtagtagatgacatttgatccttaaatccattgtaatttagtacataagattttgatatggggaatgtatagagggtataggtgtgtgttcttaagttattgtctttcctttcgcaatcatcccttttgtggatttccctagatgtattagagaatcatttgagtctccttttgaggcacatgtataatttgttgtttgtttacttgttcttggcttccctgtttttctgcaaatgaaacaccaattcccttcaaaccgatcctcagtttcctctttagtcttcctctttctctgtctcatacccgaggttaaccttcagccaggtcggccaaaatggaatcagcttggatcaaattagagctgccacactttccttgtgtcattcctccttcatgtttgatgtgcaact

SEQ ID NO: 2374 - DNA, 4343 bp, Cicer arietinum
cagtgatgaaattgtatttttgtagtttgtaatgaaatgcaatgatgttgttcacgtagtaaaaaaaaaaaaaaaaaaatctaggcccaaagaggaacacgaaatctcccaattgcccaaacccccaaataaaaaccgaagacctctttgcttctctcttctctggaaccagcttcttctggtgatctcattttttcacaacattttctctttctctttctctctcataattccccactcgcttctcaacaattaaccgcgcaggttccaatttcctctgaacaaattcatcatgaccgtgatgatgtctgctcccattgaccagcaagaggatgaggaggtgctcgtgcctcacgctgatttgccagataacaatcatcagccaatggaagttgtagctcaacctgaagctgccaatactgtggagagccagcctgtcagtgatcctccacaatccagattcacatggagaattgacaactttactaggctgaatacaaagaagctctattcagaagtattcgttgttggtagttataaatggcgtgtccttattttcccaaaaggaaacaatgtggactatttgtccatgtatttggatgtcgcagattcagctagtttgccctatggttggagtagatatgcacagtttagcttggcaattgttaatcaaatccatagtaaatattccgtcagaaaagacacacaacatcaatttaatgcacgggaaagtgattggggtttcacatccttcatgcctcttggtgaattgtatgatcctagtagagggtatctcgtgaatgatactcttataattgaagccgaggttcttgttcgtaagattgttgactattggaattatgactcaaagaaggagaccggctatgttgggcttaagaaccaaggagctacatgttatatgaattctctactccaaactctgtaccatattccttattttagaaaggctgtgtaccatatgccaacaactgagaatgatatgccctctggaagcatccctttggctctacaaagtttattctacaagctccaatacagtgacaccagcgttgcaacaaaggagctgacaaaatcttttggatgggatacatacgattctttcatgcaacatgatgttcaagagctaaatagggtcctctgtgaaaaacttgaagataaaatgaagggaaccgttgttgagggaactatacaaaagttgttcgaaggacatcatatgaactacatagagtgcatcaatgtggactacaaatcaactagaaaggagtcattttatgaccttcagcttgatgtcaaaggttgtcgcgatgtatatgcttcctttgataagtatgttgaagttgaacgtcttgagggggataacaaatatcatgccgaacagtatggtttgcaggatgctaagaagggtgtcctatttattgattttcctcctgtccttcagcttcaactgaaaagatttgaatatgactttatgcgggatactatggttaagattaatgaccgttatgagtttcctttacaacttgatcttgatcgtgagaatggaaaatatctatcacctgatgctgataggagtgtccgcaatctttatacgcttcacagtgttttggttcacagtgggggcgtgcacggtgggcattattatgcttttatcaggccaactctctctgaacagtggtacaaatttgacgacgagagggtgacgaaagaagacaataagcgagcattagaggagcaatatggtggtgaggaagagttaccccagacaaatcctggattcaataatacaccgtttaaattcaccaaatattcaaatgcttatatgctggtgtatatacgtgaaagtgacaaggacaaaatcatatgcaatgtggatgaaaaagacattgctgaacatttaagggagaggttgaagaaagaacaagaagaaaaagagcacaaaaagaaagaaaaggccgaggcccatctttatacaattataaaggtggcaagagatgaagatattgaagtgcagatgggaaaagatatctactttgatcttgtagaccacgacaaagtgaggagttttcgtgtacaaaagcagactccttttaacgttttcaaggaagaggttgcaaaagagtttggcgtaccagttcaatttcagcgcttttggctatgggctaagcggcaaaaccatacttatcgacctaatagaccgttgacacatgctgaggaagcacaaactgtcgggcaattgagagaagtgtcaaacaaggttcacaatgcagaactgaagttgtttttggaggtggagaaggggatggatttatgtcccattgcaccacctgacaagacaaaggatgatatattacttttcttcaagctatatgatcctgaaaaagaagagcttcgttatgtcggaaggctctttgtgaagtgtactggcaagccatcagaaatcataacaaggctaaatgaaatggctggttatgatcctgaagaagatattgcactttatgaggagattaagtttgaaccaaatgttatgtgtgaacctattgataagaaagtaacatttcgagcaagccagctggaggatggagatattgtatgctttcagaaagctctggctatcgatagcgaggaacaagtccgctatccagatgttccctcatatttagaatatgttcacaatcgccaggtagtccattttcgatctctggacagacccaaggaggatgacttttccttggagatgtcaaggctttatacatacgatgatgtggtggagagagttgctcaacaacttggcctggatgatccatccaaaatacgtcttacccctcacaactgctactctcaacaaccaaaaccccagcctattaagtaccgaggcgtcgatcatttgtctgatatgctagttcattacaatcagacgtcagatatattatactatgaagtgcttgacatcccgctacccgaattacaaggcttgaaaactctgaaagttgcatttcatcatgccatcaaggacgaggtggttagtcacaccatcagactcccaaagcagagcactgttggagatgtccttgatgatcttaaaacaaaggtggagctatctcatactgatgccgaactaaggttgcttgaagtcttctatcacaagatttacaaggtgttcccatccaatgaaaagattgaaaacattaatgatcaatactggacattgcgagcagaggagattccagaagaagagaaaaacattggtcaacaggatcgattaattcacgtataccattttactaaagacactgctcaaaatcaaatgcaaattcaaaactttggggatccttttttcttggttatacatgagggtgaagctctatctgaaattaaagttcgaatacagaagaaacttcaagttcctgatgaagagtttagcaagtggaagtttgcttttctatcactcgggcgtcctgagtaccttcaggattcggacattgtatccagtcgatttcagaggagagatgtttatggtgcttgggagcaatatcttggcttggagcatactgacaatgctcctaaaagatcatatgcggtaaaccagaatcgtcacacatatgagaagccagtaaagatttataattaggaaaccagtatgaatgagttaatgcatgggatgaatttcggcattgttctagacctttgggcttgtaaacaaggcgaagatagcaaaaggatactctgtataggcaactaatgaaattagcaattcagatggtgtctgcagtcttttagttatgtggtatgtaattctttctgtcagtggagtaacattattatcaacaccttctgtatctgcggaccacagcgccttgagcttatttatacttccgttttatacggaggttcttcaaattgaggtcattgatcgtcgtcgttgaactgtatcagtacataagatttttggattagtgagtgtatacagagtatagttggttgacttttggtcattttctttattgcttcctgattttgtctagttagaagtgttgatctaagtgagggctgcattatggtgtagcaaaaacaacttttatttatgtaatgttgtaaaacagatttgccagcttccataaatctatggtcatcataatttttttaccatttgatatggtctactgtttctctctctcgtagctatatgaataaaaaggacaccagataaggagtggacgcattattagctttagtgcaaaaaagtgaaaagctaatgaaaggattggataaatggaggaatggattaagctggcattttagtttgtacttgcttcagaagctgc

SEQ ID NO: 2375 - DNA, 4095 bp, Populus trichocarpa
agaacagtaaacccctcttcctctctctctctctctccttctccccccctcctttttctacaccaatccccccccccctctctctctgaactactcactttacactcctctctgattcctccatccatgactctcatgactcctcctccgttaaatcaacaagaagacgacgagatgttggtcccacaaactgaatttgctgatggacctcagccaatggaagtagcacaagccgaaactgcaacagcagttgatgcacagtcggtggatgatccaccatctgctaggtttacatggacgattgataatttttcgaggctaaatgctaagaagctctactctgatgtttttgttgttggaggctacaagtggcggatattgatttttccaaagggtaacaatgtggatcatttatccatgtatctagatgttgctgattcagcaactttgccatatggctggagtcgatatgcgcagtttagcttgactgttatcaatcaacttcatcaaaagtactcaattcggaaagacacgcagcaccagttcaatgcacgtgagagtgattggggattcacttcattcatgcctcttggggaattgtatgaccctgggagagggtatcttgtaaatgacacgtgtgtggttgaagctgatgttgctgttcgtaaggtcattgattactggtcacatgattcgaagaaggagaccggttatgttggtctaaagaaccaaggagctacatgctacatgaactctctccttcagacgctgtatcatattccttatttcagaaaggctgtatatcatatgccaacaactgagaatgatatcccatcagggagcattcctctggctttgcagagtttgttttataaacttcaatacagtgacactagcgtagctacaaaagagttgacaaagtcttttggctgggatacatatgactctttcatgcagcatgatgtccaagaacttaatagggttctgtgtgaaaagcttgaagataaaatgaagggaactgttgtggagggcactatacaacagctatttgaagggcaccatatgaattatattgaatgcatcaatgttgactataagtcgacaagaaaggagtcattttatgatcttcagcttgatgtcaaaggctgtcgggatgtttatgcttcttttgataagtatgtggaggtggaacgtcttgaaggtgacaataaatatcatgctgaacaacatggattacaggatgctagaaagggtgtcctattcattgacttccccccagttctccaacttcaacttaaaaggttcgagtatgattttatgcgggatacaatggtgaagataaatgatcgctatgagttccctttgcaacttgatcttgatagagagaatgggaaatatttatcaccagaggctgaccgcagtgtccgcaatctatacacccttcacagtgttttggttcacagtggtggtgtgcatggtggacactactatgcttatatcagaccaactctctcagatcagtggttcaaatttgatgatgagcgggtgaccaaagaggatatcaaaagggcattagaggagcagtatggtggtgaggaagagttaccacagacaaatcctggcttcaacaactctcccttcaagtttacaaagtactcaaatgcttatatgcttgtgtatattcgtgaaagtgacaaggaaaaaataatctgtaatgtggacgagaaggacattgcagagcacctcaggataagattgaagaaagaacaggaggaaaaggagcaaaagagaaaggaaaaagcggaggcgcacttgtacaccataataaaggttgcacgcagtgaggatctacttgaacagattggcaaggatgtatattttgatcttgtggaccatgacaaagtacgaagtttccgtatccagaaacagataaccttcaaccttttcaaggaagaagttgctaaagaatttggtataccagtgcaacttcaacgtttttggctgtgggcaaagcgacaaaatcatacataccgtccaaatcggccactgactcctcaggaggaagcacagtctgttggacaattgagagaggtttctaataaggcaaataacgcggagctaaagctgtttctggaagcagaaattggacaggatttgcgacctgttcctccacctgagaagactaaagatgatatccttcttttctttaaactttatgatccatcgaaggaggaactccggtatgtagggaggctgtttgtaaagggtagcggcaagccgttggagatcctgacgaaactaaatgaaatcgctggctttgctcctgaccaggagattgaactttacgaggaaataaagtttgaacctaatgtcatgtgcgaacacattgacaagaggctcacttttcgttctagtcagcttgaagatggagatattgtttgctatcagaaaccccctccaatgggaagtgacgaacagtgccgctaccctgatgtgccttccttccttgagtacatgcacaatcgccaggttgttcgttttcgatctttggagaaatcgaaagaggatgaattctgtcttgagctttcaaagctccacacttatgatgatgttgcggaaagagtagctcaccatcttggcttggatgacccatccaaaattaggcttacatctcataactgttactcccagcaacctaaaccccagcccatcaaattccgaggagtggatcatttgtctgatatgctggtgcactacaatcagacatctgatattctatactatgaagtattagacatccctctaccagaattgcaaggccttaaaacattaaaagttgcttttcatcatgctactaaggatgaggtagtgattcataccattagattgccaaaacagagcactgtaggtgatgtcattaatgaccttaaggcaaaggtggagctgtctcatcctagtgctgaacttagattgcttgaggttttctatcacaagatctacaagatctttccacacaatgaaaaaatcgagaacattaatgatcaatactggacactacgtgcagaggaggttcctgaagaagagaaaaaccttgctcctcacgatcgcttgattcatgtctatcatttcatgaaagacacaactcaaaaccaggtgcaggttcagaattttggagaaccatttttcctggtcattcacgagggtgagactttgactgaagtcaaaatgcgcatacagaaaaaattgcaggttcccgatgaagaattttcaaagtggaagtttgcttttttgtctctaggtcgccctgagtaccttcaagattcagacatcgtgtccagccgttttcagagaagggatgtttatggtgcttgggagcagtatcttggattggagcattctgacaatgctcctaaaaggtcatatgctgctaatcagaatcgtcatacatttgagaagccggtaaaaatctacaactaggaagcaatgaggaagcgaaactagtgcatcagctgaatcaaagaccgtgattcccctacaaactgttgcaaaatggaccaaggaagaaacaagcttgcaaccagagcaaaatagtggttttgatagatgtgtaattctttcatgtagggagagggtgaactcatggcataaaaacatgttccctcaatagttttgacctctctctctctctttcggtgaagtagatgacatttgatccttaaaatcccattgtaatctagtacataagattttgttgtgggggatgtataggggggtataggtgtgtgtttttaaattattttgtctttccttttgcaagcatccttctgtggatttgcctagatgtattagagaatcattagagcctccttgaggcgcatgtataatgtgctgtttgtctgcttgttctgtgcttccctgaagctgtgcaaatgaaacgaacgccgtatctcttcgagtccaccctcactttcttcttctttacctttgattgctatgtggtcgtctttctactatgttgatgacacttgtagcttcattgccccttcaatttgaattccaatttatgacatctatccattcatggctgcagcctgc

SEQ ID NO: 2376 - DNA, 4038 bp, Medicago truncatula
ttctctctctctcgaaccagcttctgctgatctcattcttcatcactctctctcttctttctctctctacaattacccgcgcaggttccaatttcaccatgaccgtcatgatgtccgctcccattgaccagcaagaggatgaagaagtgctcgtgccacacgctgatttgcccgagaacaacaatcatcagcctatggaagttgtagctcaacctgaaactgccaataccgtggagagccagcctgtcccggatcctccacaaaccagattcacatggagaattgacaattttactaggctgaatacaaaaaagctctattcagaagtattcgttgttggtgcttataaatggcgtgtgcttattttcccaaaaggaaacaatgtggactatttgtccatgtatttggatgtcgcggattcaactagtttgccctatggttggagtagatatgcacagtttagtttggcaattgttaatcaaatccataataagttcaccgtgagaaaagacacacaacatcaatttaatgcgcgagaaagtgattggggtttcacatctttcatgcctcttggtgaattgtatgatcctagtagagggtatctcgtgaatgatactcttataatcgaagcagaggttcttgttcgtaagattgttgattactggaattatgactcaaagaaggagaccggctatgttgggctcaagaatcaaggagctacctgttatatgaattctctacttcaaacattgtaccatattccttattttaggaaggctgtgtaccatatgccaacaactgaaaatgatatgccctcgggaagcatccctttggctctgcaaagtttattctacaagctccaatatagtgacaccagcgttgcaacaaaggagctgacaaaatcttttggatgggatacatatgattctttcatgcagcatgatgttcaagaactaaatcgggtcctctgtgaaaaacttgaagacaaaatgaagggaaccgttgttgagggaactatacaaaagctatttgaaggacaccatatgaactacatagagtgcatcaatgtggactacaaatcaactagaaaggagtcattttatgaccttcagcttgatgtcaaaggctgtcgcgatgtttatgcttcctttgataagtatgttgaagttgaacgtcttgagggggataacaaatatcacgctgaacaatatggtttgcaggatgctaagaagggtgtcctatttattgattttcctcctgttcttcagcttcagctcaaaagatttgaatatgactttatgcgggatactatggttaagattaatgaccgttatgagtttccctcacaacttgatcttgatcgtgagaatggaaaatatctatcacctgatgctgacaggagtgtccgcaatctttacacacttcacagtgttttggttcacagtgggggcgtgcatggtgggcattattatgcttttatcaggccaactctctctgaacagtggtacaaattcgatgatgagagggtgacgaaagaagacaataagcgggcactagaggagcaatatggtggtgaggaagagttaccgcaaacaaatcctgggttcaataacccaccatttaaattcaccaaatattcaaatgcttatatgctggtgtatatacgtgaaagtgacaaggacaaaatcatatgcaacgtggatgagaaagacattgctgaacatttaagggagaggttgaagaaagaacaagaagaaaaagagcacaaaaagaaagaaaaggctgaggcgcatctttatacaattatcaaggtggcacgggatgaagacattgaagggcagatgggaaaggatatctactttgatcttgtagaccacgacaaagtgagaagtttccgtgtacaaaagcagacaccttttaatgttttcaaggaagaggttgcaaaagagtttggtataccagttcaatttcagcgcttttggctgtgggctaagcgtcaaaaccatacttatcggcctaatagaccgctgacacaaattgaggaaacacaaactgtcggacaattgagagaagtgtcaaacaaggttcataatgcagaactgaagttgtttttggaagtggagaaggggatggatttatgtcccattgcaccacctgacaagacaaaggacgatatattacttttctttaagctatatgatcctgaaaaagaggagcttcgctatgttggaaggctctttgtgaagtgtactggcaagccatcagaaatcttaacaaggctaaatgaaatggctggttatgttcctgaagaagatattgtactttatgaggagattaagtttgagccaaatgtcatgtgcgaacctattgataagaaagtaacatttcgagcaagccagctggaggatggagatattgtatgctttcagaaagctcccttagtagataatgaggaacaagttcgctatccagatgtgccctcatatttagaatatgttcataaccgccaggtggttcattttcgatcattggacagacccaaggaagatgacttctctttggagatgtcaagactttatacatatgatgatgtggtggagagagtagctcaacaacttggcttggatgatccatccaaaatacgtcttacccctcacaactgctactctcaacaaccgaaaccccagcctattaagcaccgaggggtggatcatttgtctgatatgctagttcattacaatcagacatcagatatattatactatgaagtgctcgacatccctctacccgaattacaaggcttgaaaactctgaaagttgcatttcatcatgccatcaaggacgaggtggttagtcacactatcagactcccaaagcagagcactgttggagatgtccttgatgatcttaaaaccaaggtggagttatctcatcctgatgctgagctaaggttgcttgaagtcttctatcacaagatatacaaggtgtttccatccaatgaaaagattgaaaatattaatgatcaatactggacattgcgagcagaggagattccagaagaagagaaaaacattggtccacaggatcgtctaattcatgtgtaccattttactaaagacactgctcaaaatcaaatgcaaattcaaaacttcggggatccctttttcttggttatacacgaaggtgaagctctatctgaaattaaagtgcgaatacagaagaaacttcaagttcctgacgaagagtttagcaagtggaagtttgcttttctatcacttgggcgtccagagtaccttcaggattcagacattgtatccagtcgttttcagaggcgagatgtttatggtgcttgggagcaatatcttggcttggagcatactgacaatgctcctaaaagatcatatgctgtcaaccagaatcgtcacacgtttgagaagccagtaaagatttataattaggagatcacaaaatgagttactgcatgggatgaattcggcattgttctacacccttgggattgtaaacaaggcgaagatagcaaaaggctactctgtataggcaactaattaaattagcaactcagatggtgtctgcagtcttttagttgtgtggtatgtaattctttctgtcaatggagtaacattaatatcaacaccttctgtatctgctgaccacgtctccttgaacttatttatacttccattttcatatggaggtttttcaaattgaggtcattaatcattgtcattgaactgtatcagtacataagatttttggattagtgagtgtatacagggtatagttgcttgacttttggtcattttatttattgctttttgattttgtctagttcctaatgttgatttaagtgagggctgcataatgattggtgtagcaaagaaaacttttatgtaatgtaaaaaagatttgccagcttccataaatctctggccaacataatcttattaccatttcatatttcctactgtttttctctctctcccagttatgaatgaaatacgacataaaaaaaaaaaa

SEQ ID NO: 2377 - DNA, 3896 bp, Cicer arietinum
cccactcgcttctcaacaattaaccgcgcaggttccaatttcctctgaacaaattcatcatgaccgtgatgatgtctgctcccattgaccagcaagaggatgaggaggtgctcgtgcctcacgctgatttgccagataacaatcatcagccaatggaagttgtagctcaacctgaagctgccaatactgtggagagccagcctgtcagtgatcctccacaatccagattcacatggagaattgacaactttactaggctgaatacaaagaagctctattcagaagtattcgttgttggtagttataaatggcgtgtccttattttcccaaaaggaaacaatgtggactatttgtccatgtatttggatgtcgcagattcagctagtttgccctatggttggagtagatatgcacagtttagcttggcaattgttaatcaaatccatagtaaatattccgtcagaaaagacacacaacatcaatttaatgcacgggaaagtgattggggtttcacatccttcatgcctcttggtgaattgtatgatcctagtagagggtatctcgtgaatgatactcttataattgaagccgaggttcttgttcgtaagattgttgactattggaattatgactcaaagaaggagaccggctatgttgggcttaagaaccaaggagctacatgttatatgaattctctactccaaactctgtaccatattccttattttagaaaggctgtgtaccatatgccaacaactgagaatgatatgccctctggaagcatccctttggctctacaaagtttattctacaagctccaatacagtgacaccagcgttgcaacaaaggagctgacaaaatcttttggatgggatacatacgattctttcatgcaacatgatgttcaagagctaaatagggtcctctgtgaaaaacttgaagataaaatgaagggaaccgttgttgagggaactatacaaaagttgttcgaaggacatcatatgaactacatagagtgcatcaatgtggactacaaatcaactagaaaggagtcattttatgaccttcagcttgatgtcaaaggttgtcgcgatgtatatgcttcctttgataagtatgttgaagttgaacgtcttgagggggataacaaatatcatgccgaacagtatggtttgcaggatgctaagaagggtgtcctatttattgattttcctcctgtccttcagcttcaactgaaaagatttgaatatgactttatgcgggatactatggttaagattaatgaccgttatgagtttcctttacaacttgatcttgatcgtgagaatggaaaatatctatcacctgatgctgataggagtgtccgcaatctttatacgcttcacagtgttttggttcacagtgggggcgtgcacggtgggcattattatgcttttatcaggccaactctctctgaacagtggtacaaatttgacgacgagagggtgacgaaagaagacaataagcgagcattagaggagcaatatggtggtgaggaagagttaccccagacaaatcctggattcaataatacaccgtttaaattcaccaaatattcaaatgcttatatgctggtgtatatacgtgaaagtgacaaggacaaaatcatatgcaatgtggatgaaaaagacattgctgaacatttaagggagaggttgaagaaagaacaagaagaaaaagagcacaaaaagaagaaaaggccgaggcccatctttatacaattataaaggtggcaagagatgaagatattgaagtgcagatgggaaaagatatctactttgatcttgtagaccacgacaaagtgaggagttttcgtgtacaaaagcagactccttttaacgttttcaaggaagaggttgcaaaagagtttggcgtaccagttcaatttcagcgcttttggctatgggctaagcggcaaaaccatacttatcgacctaatagaccgttgacacatgctgaggaagcacaaactgtcgggcaattgagagaagtgtcaaacaaggttcacaatgcagaactgaagttgtttttggaggtggagaaggggatggatttatgtcccattgcaccacctgacaagacaaaggatgatatattacttttcttcaagctatatgatcctgaaaaagaagagcttcgttatgtcggaaggctctttgtgaagtgtactggcaagccatcagaaatcataacaaggctaaatgaaatggctggttatgatcctgaagaagatattgcactttatgaggagattaagtttgaaccaaatgttatgtgtgaacctattgataagaaagtaacatttcgagcaagccagctggaggatggagatattgtatgctttcagaaagctctggctatcgatagcgaggaacaagtccgctatccagatgttccctcatatttagaatatgttcacaatcgccaggtagtccattttcgatctctggacagacccaaggaggatgacttttccttggagatgtcaaggctttatacatacgatgatgtggtggagagagttgctcaacaacttggcctggatgatccatccaaaatacgtcttacccctcacaactgctactctcaacaaccaaaaccccagcctattaagtaccgaggcgtcgatcatttgtctgatatgctagttcattacaatcagacgtcagatatattatactatgaagtgcttgacatcccgctacccgaattacaaggcttgaaaactctgaaagttgcatttcatcatgccatcaaggacgaggtggttagtcacaccatcagactcccaaagcagagcactgttggagatgtccttgatgatcttaaaacaaaggtggagctatctcatactgatgccgaactaaggttgcttgaagtcttctatcacaagatttacaaggtgttcccatccaatgaaaagattgaaaacattaatgatcaatactggacattgcgagcagaggagattccagaagaagagaaaaacattggtcaacaggatcgattaattcacgtataccattttactaaagacactgctcaaaatcaaatgcaaattcaaaactttggggatcctttttcttggttatacatgagggtgaagctctatctgaaattaaagttcgaatacagaagaaacttcaagttcctgatgaagagtttagcaagtggaagtttgcttttctatcactcgggcgtcctgagtaccttcaggattcggacattgtatccagtcgatttcagaggagagatgtttatggtgcttgggagcaatatcttggcttggagcatactgacaatgctcctaaaagatcatatgcggtaaaccagaatcgtcacacatatgagaagccagtaaagatttataattaggaaaccagtatgaatgagttaatgcatgggatgaatttcggcattgttctagacctttgggcttgtaaacaaggcgaagatagcaaaaggatactctgtataggcaactaatgaaattagcaattcagatggtgtctgcagtcttttagttatgtggtatgtaattctttctgtcagtggagtaacattattatcaacaccttctgtatctgcggaccacagcgccttgagcttatttatacttccgttttatacggaggttcttcaaattgaggtcattgatcgtcgtcgttgaactgtatcagtacataagatttttggattagtgagtgtatacagagtatagttggttgacttttggtcattttctttattgcttcctgattttgtctagttagaagtgttgatctaagtgagggctgcattatggtgtagcaaaaacaacttttatttatgtaatgttgtaaaacagatttgccagc

SEQ ID NO: 2378 - DNA, 4312 bp, Glycine max
gtggaaccagctctttctggtgttgttgatctcgttttctctctcaaacaaacactactctctctctctctctaacgataaccctcgcagtcgcaggtttcaattcaccatgaccgtgatgatgcccgctcccattgatcagcaagaggacgaggaggttctcgtgccgcacgcggatttgcctgcgaacaatcaccaacccatggaagttgtagctcaacctgaaaatgccaataccgtggagagtcaacccgttgaagatcctccatcatctagatttacatggagaattgacaatttttcaaggctgaatacaaagaagctctattcagaaatatttgttgttggtgcctataaatggcgtgtgcttattttcccaaagggaaacaatgtggactatttgtccatgtatttggatgttgcagattcagccactttgccctatggttggagtagatatgcacagtttagcttggcagttgttcatcaaacgcataataagtattccgtgagaaaagacacacagcaccagtttaatgcacgcgaaagtgattggggtttcacatctttcatgcctcttggtgaattgtatgatcctagtagagggtatcttgtgaatgatactcttatagtcgaagctgaggttcttgttcgtaggattgttgattactggacttatgattccaagaaggagactggctatgttgggcttaagaaccaaggagctacctgttatatgaattctctacttcaaaccttgtaccatattccttatttcagaaaggctgtgtaccatatgccaacaactgagaatgatatgcccactggtagcatccctttggccttacaaagtttattctacaagcttcaatacagtgacactagtgttgcaacaaaggagctgacaaagtcttttggatgggatacatatgattctttcatgcagcatgatgttcaagaactaaatcgggttctctgtgaaaaacttgaagacaaaatgaaggaaactgttgttgagggaactatacaaaagttatttgaaggacaccatatgaattacattgaatgcatcaatgtagactacaaatcaactagaaaggagtcattttatgatcttcagcttgatgtcaaaggttgtcgtgatgtttatgcttcctttgataagtatgttgaagttgaaagtcttgagggggataacaaatatcatgctgaacagtatggtttgcaggatgctaagaaaggtgtcctatttattgattttcctcctgtccttcaactccagctaaaaagatttgaatatgactttatgcgggatactatggttaagattaatgaccgttatgagtttcccttacaacttgatcttgatcgtgaggatgggaaatatctatcacctgatgctgataggagtgtccgcaatctttacacacttcacagtgttttggttcacagtggaggtgtgcatggtggacattattatgcttttatcaggccaaccctctctgaacagtggtacaaatttgatgatgagagggtgacaaaagaagataataaaagagcattggaggagcaatatggtggtgaggaagagttaccacagacaaatcctggattcaacaacactccatttaagttcaccaagtactcaaatgcttatatgcttgtgtatatacgtgaaagtgacaaggacaaaatcatatgcaatgtggatgagaaagacattgcagcacatttaagggagaggttgaagaaagaacaagaagagaaagagcacaaaaagaaagaaaaggcagaagctcacctttatactattataaaggtggcaagagatgaagaacttaaagagcagattggaaaggatatatactttgatcttgtagaccatgacaaagtgagaagtttcagagtccaaaagcagacatcttttaaccttttcaaggaagaggttgcaaaagagtatggcatacctgttcaatttcagcgctattggctatgggcaaagcggcaaaaccatacctatcgtcctaatagaccattgacacatattgaagaagcacaatctgttggacaattgagagaagtgtccaacaaggttcacaatgcagaactgaaattgtttttggaagtggagctggggatggattcacgtcccatcgcaccacctgacaagaccaaggatgatatattacttttcttcaagctatatgatcctgaaaaagaggagctgcgttatgttggaaggctctttgtgaagtgtactggcaagccattggaaatcttaacgaggttaaatgaaatggctggttatgaccctgaagaagatattgcactttatgaggaaattaagtttgaaccaaatgtcatgtgtgaacctattgacaagaaagtaacatttcgaacaagccagctggaagatggagatatcatatgctttcagaaggcttcctctatggacagtgaggaaaatgcccggtatccagacgtgccctcatatttagaatatgtgcacaatcgccaggtggttcactttcgatctctggatagaccgaaggaagatgactttttcctggagatgtcaaggctttttacgtatgatgatgtggtggagagagtagcccaacaacttggtctggatgatccatccaaaatacggcttacaccacacaactgctactcccaacaaccaaaaccccagcctattaaataccgaggggtagaacatttgtctgatatgttagttcattacaatcagacgtcggatatattatactatgaagtacttgacatccctctaccagaattacaagggttgaaaactctaaaagttgcatttcatcatgccactaaggaggaagtggttattcatactatccgactcccaaagcagagcactgttggggatgtccttgatgatcttaaaacaaaggtagagttatctgatcctgaagctgaacttcggttgcttgaagtcttctatcacaaaatatacaaggtcttccctcccaatgaaaagattgaaagcattaatgatcaatactggacactacgagcagaggagattccagaagaagagaaaaatcttggttctcatgatcgtctaattcatgtttaccatttcaataaagagacagctcaaaaccaaatgcaaattcaaaactttggggaacctttttttctggttatacatgaaggtgaaactcttgacgaaattaaagtgcgaatacaaaagaaacttcaagttcctgatgatgaattctgcaagtggaagtttgcatttctatcactagggcgtcctgagtaccttcaagattctgacgttgtttccagtcgttttcagagaagagatgtttatggtgcttgggagcaatatcttggtttggagcatactgacaatgctcctaaaagatcatatgctgtcaaccagaatcgccacacatttgagaagccagtaaagatttataattaggaaactgctatattgatgaagatggcattgttatatttctatgggcttgtaaacatggtgaagatggcaaaaggcaactatttataggactaatgaatccagcaattcaggtggtgtctgcagactttaagttaatttgtggtatgtaattctttgtcaatggagtagcattgctctcaacatcttgtatctgccaaccgcagcgccttgagctttttactgcttccgtttttatatggaggttctacaagttgaggtcattgatcatcatcgctgaaactgtatcagtacataagatttttggaatagtgagtgtatacagggtatagttggttgacttttgtcattttctttgattgcttgctgattttgtccagttagaagaagtgttaatctaagtgagggctgcataatggtgtagcagagacagcttttttatgtaatgtaaaagatttacgagcttccatatatctatttggtcagcataaaattttcatatgatgttttttcttgttcccccgtcacatttagctatgaatagaacattggagaaaaaaaaattgtaagcgctttctcacttcagctatatgaataatggctattatattggatgttgacattttccttctagttgtggaaaaaatgtaaacgccagttaggtgattagatgctagtaggaagagaaatgcgtttttgttattttattttccttgtctcgagcttaatgagagaaatatcgatgctgcattgtatcctctcgagtttaatgtcagaaacgatgctgcttctttgttacttcatttcattgcactcgtacaaaggtgtatattattgtgattattgagc

SEQ ID NO: 2379 - DNA, 3620 bp, Triticum aestivum
actactctgatgtgtttgtcgtcggtgggtacaaatggcgtgttcttattttccccaaggggaataatgtggagcacctgtcaatgtacttggacgtcgctgactcggccaatctcccatatggttggagccgttctgcccagtttagcttatctgttgtaaaccagattgatcagaagtatacgacacgaaaagatactcaacatcaatttagtgcacgtgagagtgattggggtttcacttcttttatgcctttgagtgagctatatgatccaagtagaggttaccttgtgaatgatactattgttgtggaggcagaggttgctgtccgcaaaatggttgactattggacatatgactcaaaaaaggaaacaggttatgttggtttgaaaaaccaaggagcgacctgttatatgaactctcttctacaaacattgtaccacataccatacttcagaaaggctgtgtatcatatgccaaccaccgaaaacgacatgccatctggaagtattcccttggcgctgcaaagccttttttataagctccagtacagtgacaacagtgtagctacaaaagagttgacgaaatcttttggatgggacacatatgattccttcatgcagcatgatgtacaagagctcaacagagttctctgtgagaaacttgaagataagatgaagggaactgttgtagaaggaacaatcgagcaattatttgaaggtcaccacattaattatattgagtgtatgaacgtggactataaatctaacaggaaggagtccttttatgaccttcaacttgatgtcaaaggttgtcgtgacgtgtatgcatcgttcgataaatatgttgaggttgagcgtctcgagggtgataacaagtatcatgcagagaatcatggtttacaggatgcaaaaaagggcgttctcttcctcgatttcccccctgttttgcaacttcagcttaagcgttttgagtacgattatatgagagataccatggttaagattaatgaccgctacgagtttcctttgcaacttgatctggatagagatgatggcaagtatcttgctccagatgcagatagaagtataagaaacctttatactctccacagcgttcttgttcatagcggaggagtacatggtggtcactactatgcattcatacggccaacgctagcagatcaatggtataaatttgatgatgagcgtgtaacaaaagaagatactaaaaaggcctttgaagatcagtatgggggtgaggaagagttacctcaaataaaccctggattcaacaacactccattcaaattcacgaagtattcaaatgcctacatgcttgtatacatccgtgagagtgacaaagagaaaataatgtgtaatgttgatgagaaggacattgctgaacatttaaggataaggttgaagaaagaacaagaagagaaaggacataagaagaaagaaaaagctgaagcccatctctataccatcataaagattgcccgggatgaggatttaaaggagcaaactggtaaggacatatattttgatctggtggaccatgaaaaggtccgtagcttccgaatacagaagcaattgccatttagtactttcaaggaggaagttgcaaaggaatatggcatcccagtacagtttcagcgcttctggctgtgggctaagaggcaaaaccatacatacagaccaaatcgcccattgaatcctcatgaagaaacacaatctgtggggcaactgagggagatatcaaataaggcacagaatgctgaactgaagctgtttttggaagtggaatttggactggatttgcagcctcttcctcctcctgagaagagcaaggaagatattcttcttttcttcaaactgtacaatcccgaaaaagaagtgctttgttttgtggggaggctctttgtaaaggccttggggaaaccttcagatattctgagaaaactaactgaaatggctgggtttaccccggatgaagagatcgagctatatgaggaaattaagtttgagccaaatgtaatgtgcgaacatattgacaagaagcttactttccgtgctagtcagcttgaagatggggacatagtctgtttccaaaagtcacctaaagcagacagtggtactcaagtgcgctatcctgacgtcccttcgtttttggagtatgttcataataggcaggttgtgcactttcggtcgttggagaaaccaaaggatgatgaattttgtttggaattgtcaaagcttcacacatatgatgatgttgttgagagagttgcccgccagcttgggttggatgatccagcgaaaattcgccttacatcccataactgctattcacagcagcctaaaccgcaacccatcagatatcagggtgtggagcatttattggacatgctcgtccactataatcagacgtctgacatcttgtattacgaagtattggatattccattgccggaattgcagttccttaaaacccttaaagttgcattccaccatgctacaaaggaggaggttgtcattcacagcatcaggcttcctaagaacagcaccattgctgatgtgataattgacttgaaaactaaggttgatctatccagtcccactgccgagctacgcgtgctagaggtcttttaccacaagatctataagatctttccacttcacgagaagatagagaatataaatgatcagtactggacgctacgtgctgaagaggttccagaggaggagaaaaatcccagtcagcatgatcgcttaatccatgtttatcacttcacgaaagatcctcttcagaatcaacagattcagaattttggagatcctttttttcttgctatccttgaaggtgagactttagcagaagtaaagggccgcatacagagaaaactccaggtccctgatgaagaattctccaagtggaaatttgcattcatatctatgaatcggccagactacctacaagattctgatgttgtatctgctcgtttccagaggagagatgtctatggagcttgggaacaatatcttgggctggagcacactgacactgcaccgaaaagggcctatacagccaatcagaaccgtcacacgcatgagaagccggtgaggatatacaattagtacgccttaaaactgtgttggtcccctgatgaaggcgttggtctgggagtggaaaaggagtaggctgcaacaggtgaaagcagcagcatgtttggccatttgggtgctacggcatatctatcgcttgctacagtttttgctcttgatgcatggccatgacgattttttcaaggttcatcatcttgcctttcaggcaagggtgcatgatatcaagtttctgtaaattgggtgtaaaggccaccctcctaagggtagatgttggatgttggttcatttttagagcaaagtcgagtacatatgattttggtagtgggcttgtatacaagggtatagttttgcgacttgatattggcatttgttgtaatctggtgatgacggaagattaatggatcttttcttggtttaagtagctgcactagtaaaaatgtgactaacaattcttattgcagccagagttacatgatactgagaattatgatc

SEQ ID NO: 2380 - DNA, 4652 bp, Populus trichocarpa
ctttcccacactacccccgcttgtttcctataatcacataaatagccttcagacaccaaaagcccccttcttttctttctctctctagccagtgcttttgcgagtgtctcttctggctacacagaaaaatcccgctttcgcttctcttctcttattctcagtccctgctctcgttttcattcttgtccctctgattcgctcgatcgaacggtccatatccacccatgactatgatgactccttcaccgttagaccaagaagacgaggagatgctcgtaccgcattcagatttagttgaaggtcctcagccaatggaagtggcacaagtggagcaaactagtaccgtggagaatcagcctgtggaggatcctccatcgatgaaatttacttggactattgagaattttactaggttgaacacgaagaagcattattctgatatatttattgttggcagttacaaatggagagtactgatattccctaaaggaaacaacgtggaccacctgtcgatgtatttggatgttgcagattcgacagctttgccatatggatggagtagatatgcgcaattcagtttggctgtggtcaatcaaattcataacaaatactcgattagaaaggacacacaacatcagttcaatgcaagagagagtgactggggctttacatctttcatgcctctgagtgaactttatgatcctagcagaggatacttagtgaatgatacagttgttattgaagctgaagttgctgtttgcaaggttttagattattggtcctatgactcaaagaaggagacgggctatgtaggactgaaaaaccaaggagcaacatgttacatgaactctctcctacagactctataccatatttcctacttccgaaaggcggtgtaccacatgccaacaactgagaatgacatgcctacaggaagcattccattggccctgcagagtttattctttaagcttcaatataatgataccagtgttgcaacaaaggaactgaccaaatcttttggctgggatacgtatgattccttcatgcaacatgacgtgcaagagcttaacagggtcctgtgtgagaagctagaggataaaatgaaggggactgttgtggagggcactatacagcagttgtttgagggtcaccatatgaactacattgagtgcatcaatgtggaatacaaatctacaagaaaggagtcattttatgatcttcagcttgatgtgaaaggttgtcgagatgtttatgcttcttttgacaaatatgtggaagttgaacgacttgagggtgataacaaatatcatgccgaagaacatggtttgcaggatgcaaagaagggtgtcttatttatcgacttcccgcctgttcttcaactccaattaaagcggtttgaatatgattttatgcgcgatactatggtgaagattaatgatcgctatgaatttcctcttcaacttgacctggacagggagaatgggaaatatttatcacctgaatctgacaggagtgtgcgaaatctatacacacttcacagtgttttggttcacagtggaggtgtgcatggtggacattattatgcttttatcaggcctaccctctctgatcaatggttcaaatttgatgatgaacgcgtgacaaaggaagatgtgaagagggccttagaagaacagtatggtggtgaggaagagctacctcagaccaatcctggctttaacaatactccatttaaattcacaaaatactcaaatgcatacatgcttgtgtatatacgggaaagtgacaaggacaagataatttgtaatgttgatgagaaagacattgctgaacacttgaggataaggctgaagaaagaacaagaagaaaaggaagacaagagaagatataaagcacaagctcacctttacacaattataaaggttgcgcgagatgaggaccttaaagagcaaattggaaaggatatttattttgaccttgtggatcatgacaaagtccgtaacttccgtattcagaaacagacgcagtttagtctgtttaaggaggaggttgctaaagagcttggtataccagtacaatttcagagattttggatatgggcaaagcgccaaaaccacacatatagacccaatcggccattgactccccaggaggaagcacaatcagttggacaactgagagaggtgtcaaataagacacataatgctgaattaaagttgttcttggaagttgagcttgggctggatttacgtcccattgctccacctgaaaaaactaaagaagatattctgcttttcgtcaagctttatgaccctgaaaaacaagaattacgatatgttggtaggctttttgtgaagaattctagtaaaccgatagaaattctagcaaagcttaatcaaatggctggctttgcatctgaggaagagattgaactttatgaggaaatcaagtttgagccttgtgtcatgtgtgaacaccttgataagagagcctcatttcgaacaagtcagattgaagatggggacataatatgctttcagaaatctcctcctgaaaatgaagaagactgtcgaaatccagatgtgccttcatatttggaatatgtgcacaatcggcagatagttcatttccgatctctagagaaggcaaaagaggatgatttttgtctagagttgtcaaaattacacacttatgatgatgttgtcgaaagagtagctcgccagattggtttggacgatccatccaaaatcaggttaacatcccacaactgctactctcagcagcctaagccacagccaattaaatatcgaggagtggagcatctatcagatatgttagttcactacaatcagacttccgatatcttgtattatgaagttctagatattcctcttccagagttgcaaggtctaaaaaatttgaaagttgctttccatcacgctaccaaagatgaagtggtaattcataacattagattgcctaaacaaagcaccgtgggggatgtgattaatgaacttaaaactaaggtagaattgtctcacccaaatgctgaacttcgactgcttgaagtattttatcacaagatttataagatctttccacccaatgaaaaaattgagaatataaatgaccagtattggacgctgcgggcagaggagattcccgaggaagaaaaaaatcttggtccccaagatcgcctgattcacgtttatcacttcacgaaagagtctggacagaatcaaatgcaagtacagaattttggtgaaccctttttcttggccatccatgaaggtgaaaccttagccgaagttaaaatgcgtatacaaaagaagctgcaggttcctgatgaggagtttgctaagtggaaatttgcatttctgtcactgggtcgtccagagtacttgcaggattctgatgttgtgttcacccgctttcagagaagagatgtatatggtgcttgggagcagtaccttgggttggagcactctgataatactcctaaaaggtcttatgcagtaaatcagaaccgtcacacatttgagaagcctgttaaaatatacaattagggaagagcagattaccctccaccggcacgtaaagctgagtcggacatctttcatgctacaatgtaggggatgagaatggatggtacatctgaaggaagaagacaatgaagcgcgaattaaagtgatttctgtaggatttgataattggttttgtaggccatatatgtttctctgatgtgacgggggggaggtggaaggaggccccccatatgtagtgtgttattatggttgagacacaccctgcttgagctcctggtcctttcttgcctttctcctaatgcagacacctccttgtttcaagaggttggtgtgatattcccacgatatacagctccagggtaatttagcagcagtacataagaagattttgactaggggattgtataccggggtataggtggctgtgtttgacattgattctttctttttccctgtcttgggggatgggcttgtaaaatgattggcttacggttccgagcttagatagtgtagtggtggttcagggtggttttatagcaccacctttatcacctaatatagtggtggtggttctcatttgtttccaaagggtttttgctggcgcacttgtttttgacaaaatccttatattgttgagtttttgtttcgtatttctccctcgatccaggtcacgtgtgaaagccctatcactttagtttggggtattcaccatccacgataatggcacttctgctgggtggcaacgggacatcgctttatgctgactgcggcctatgtggtggatctcaaactcaatcgtttccaaatattttatcctagtgcgtgcgtgcatggtgagtcgccagattcgtgtgataatctcttcgacatagatagatatttaacacctttgaaacctcagcctgaattcaaagggaatgttgtgggttggtttgcccctagtgaaataggatttggtatgttaattaatctagccttcctcgtccctggtgattggattttcaagatgcaccaagcttccaatttcttagaccacctttccttagcagccgtgaaataattaaaactcttaaaataaaaaataaaaaataaattttacatccc

SEQ ID NO: 2381 - DNA, 3937 bp, Aquilegia formosa
atgacaatgatgaatcccgctccattagatcaacagcaagaggatgatgagatgttggttcctaattcagatatagttgaaggtcctcaaccaatggaagtagcagcacaagtagaagctgttagtacagtagagaatcaaccagttgaagatcctccgtcatcgagatttacttggaggatagagaattttactaggttgaacaataagaagcattattcagatgcttttgtggtaggcggttacaaatggcgagtgctgattttcccgaaaggcaacaatgtggaccaattgtcgatgtacttagacgttgctgactcatcaaccttgccctatggctggagtagatatgcacagtttagtttatctgttgttaaccaagtttatggaaagtacacagtgaggaaagatacacaacaccaattcaatgcacgagagagtgattggggtttcacatcgttcatgccacttagtgagctttacgaccctggaagagggtatcttgttagtgatacatgtataattgaagcggaggttgctgttcgcaaggttgtcgattattggacttatgattcaaagaaggaaactggttatgttggccttaagaaccaaggagcaacctgttatatgaattctctgcttcaaacgctatatcatattccttattttagaaaggctgtgtaccatatgccaacaactgagaatgatatgccatcgggaagtattcccctggctttgcagagcttattctataagctccagtacagcgacaacagtgttgcaacgaaagagcttaccaaatcgtttggatgggacacatacgattcctttatgcagcacgatgtgcaagaactcaatagggttctctgcgaaaagcttgaagataaaatgaagggaactgttgtggagggcacaatacaacaattatttgaaggacaccacatgaattatattgaatgcatcaatgtagactacaaatctacaagaaaggaatcattttatgatctccaacttgatgtcaaaggttgccgcgatgtttatgcttcatttgacaagtacgttgaagttgaacgtcttgaaggtgataataagtaccacgctgaacaacatgggttgcaggatgccaagaagggtgtcttgttcattgacttccctcctgttctgcaacttcagctcaaacggtttgaatatgattttatgcgagatacgatggtaaagataaatgaccgttatgagttcccgttaactcttgaccttgacagagagaatggaaaatatttgtccccggatgcggataggggagttcgcaatctgtacacactacatagtgttttggttcacagtgggggcgtgcatggtgggcactattatgcatttatcaggccaaccctttctgatcagtggtttaaatttgatgatgaaagggtaacaaaagaagatctgaagagggcacttgaagagcagtatggcggggaggaagagttacctcagacaaatcctggatttaacaatactcctttcaagttcacaaaatattcaaatgcctacatgctcgtgtatatacgcgacagtgacaaggacaaaataatttgtaatgttgatgaaaaggacattgctgaacatcttcggatgagattgaagaaagaacaagaagaaaaggaacataagaaaaaggaaaaagcagaggcacacctctataccattataaaggttgcacgaaatgaagacctagttgaacagattggaagggatatatattttgatcttgttgatcatgacaaagttcgcagtttccgtatccagaaacaaatgtcttttaacgtatttaaggaggaggttgcaaaagagtttggtgtgccagttgaatttcagcgtttttggctgtgggcaaagcgccaaaaccatacatatcgtcccaatcgacctctgacacatcaagaagaaacacaatctgttggacagttaagagaggtgtcaaataaggctcataatgctgaactaaagttgttcctggaagtggagcttgggccggagtcaattcccatttctccgcctgagaagacgaaagaagacattcttctgtttttcaaactttatgaccccaaaaaggaagaacttcggtatgttgggagactttttgtgaagggcagtggtaagccgattgaaatccttccaaaactgaatgagatggctggtttctccccagatgaagagattgatctttatgaggaaattaagtttgaacctagtgtgatgtgtgaacctattgagaagaaagtgactttccgcagtagtcagctagaagatggcgatatagtttgttttcagaaatctcttacagctgaaagtggggaagaattccgccatgccgaagtgccttctttcttggaatatgtgcataatcgccaggttgtccatttccgatctcttgagaaacccaaagaggatgatttctgccttgagctgtcaaagactttcacttatgatgacgtcgttgaaaaagttgctggtcatcttggtttggatgatccatctaaaatcagactcacatctcacaattgttattctcagcaacctaagcctcagccgattaagttccgaggtgttgaccatttatcagatatgttggtccactacaaccagacttccgacattttgtattacgaggtcttagacattcctctaccagagttacaaaccttaaagactttgaaggttgcttttcatcatgctgcaaaggacgaggttgtcattcacagtattagactcccaaaacaaagcactgtgggtgatgtaatcgaagacttgaagaaaaaggttgagctgtctgatcctgaagcagagcttaggttacttgaagttttctatcacaagatatacaagattttcccccctggtgaaaagattgagaacataaatgatcagtactggactttacgtgcggaagaggcaagtatttatgcgccatttataccagaagaagagaaaaaccttggaccccatgatcgcttgattcatgtttaccatttcaccaaggatgcatctcaaaaccagctgcagcaggttcaaaattttggggaacccttcttcttggttatccatgaaggagaaaccttatccgaagttaaagtgcgtattcagaagaaattgcaggtcacagatgaggaattctcgaagtggaaatttgcttttttgtcattgggtcggcccgagtaccttttggattccgacattgtctctagtcggtttcagagacgagatgtttatggagcttgggagcagtacctggggttggagcattcagacactgctcctaaaagggcttatgcagccaatcagaatcgacacacgtatgagaagcctgtaaaaatatacaactagaaaaagctgatggcctgtggctgtgctactggtgtagctgtactcagtatcccttgaaaattgcattccttatgatgtgatgacaaattgaaaatatgaacatggaaatatggctggtagctgaagcagtgcgatgctggtgtctacaacgtttggggtattgaatttgttatcagtgtattctttatctacagaaggttggggaagtctttccagggatgcagtgttgtttctttagctttgacaatgatcccttgaggtctttttcctttttatattatgaaggccccttatagggtgatgtcagtggccttcaagcttaatatccagtgtagtttagtagtacataagaagattttgaagtaggctgtatacaggtatagtctgaagttgacattcttgattcattttgggagttacttgttttttggaatatttggaagtgtggggggagttggtttgtataattattggttcttttgtttctgatcttcttggaagtttcatgtataagaatgacactcctgctgcaatccaattcattttcaatgtctta

SEQ ID NO: 2382 - DNA, 3671 bp, Flaveria ramosissima
caccgatctccgccgatgactctcatgactcctcctcccaccatggatgctgaggatgacgagatgctagttcctcattcggatttcgctgcaccggaaggacctcagccaatggaagctacaccagcagaagctcccaatgttgttgatgcgccaactgttgttgatgatccaccgtctgcacggttcacttggactatagaaaatttttcgaggttgaattcgaaaaagatgtactctgacgttttctttgttggaggatataaatggcgagttctcatattcccgaaaggaaacaatgttgaccatctgtcaatgtaccttgatgttgctgattcctctacgttgccttatggttggagtagatatgctcagttcagcttggctgtggttaatcaaattcataacaagttcacaattagaaaagatacacaacaccagttcaattcacgagagagtgattggggtttcacctcatttatgcctctaagtgagctttatgatcccaacaaaggctatcttctgaatgacacatgcatagttgaagctgatgtggcagtccggaagattgttgattactggtcacatgattcaaagaaggagactggttatgttggccttaaaaatcaaggtgctacttgctatatgaactccctgctacagacattataccatatcccttatttcaggaaggctgtgtatcatatgccaacgactgaaaatgatatgccatcagggagcattcctcttgctttgcagagtttattttataagcttcagtatagtgacacaagtgttgccacaaaagagttgactaagtcttttggctgggatacatatgattcttttatgcagcatgatgttcaagaactaaatcgagttctctgtgagaaacttgaagataaaatgaagggaactgttgtggagggtacgatacagcagttatttgaaggacaccatatgaactatattgaatgtataaatgttgattacaaatcaaccagaaaggagtcgttttatgatcttcagcttgatgtgaaaggctgccgagatgtgtatgcctcatttgacaagtacgttgaagtagaaaggcttgaaggtgataacaaatatcatgctgaacaacatgggctacaggatgcaaagaagggcgtcctattcattgatttcccacctgttcttcaactccagttaaaacgttttgaatatgatttcatgcgagatacgatggtgaagataaatgatcggtatgaatttcccttgcaactggatcttgatagagaagatgggaaatatttatcaccacaggcagacagaagtgttcgcaacctttacactcttcacagtgtgctggttcacagcggtggggtgcatggcggacattattatgcttatatcaggcctaccctttctgatcaatggtttaagtttgatgatgaacgtgttaccaaagaagacatgaagagggcattggatgaacagtatgggggagaggaggagttaccccaagcaaaccctgggtttaataattctccatttaaatttacaaaatattcaaatgcatatatgctcgtgtatatacgtgaaagtgacaaggagaaaataatctgtaatgtcgatgagaaggatatagcagagcacctaagaataaggttgaaaaaggaacaagaagaaaaggaacaaaaaagaaaggagaaggcagaggctcatttatatactattataaaggttgctagagatgaggacctccgtgaacagataggaagagatatttactttgatctggtggatcatgacaaagttcgtagcttccgtatccaaaaacaaacatcttttgccctttttaaggaagatgtagctaaagaatttggtgtaccagtgcaatatcaacgtttctggctatgggcaaagcgccaaaaccacacttaccgtccaaatcgtccattgacacctcaagaagaagctcagtctgttggacatttgaaagaggtatcaaataaggctaacaatgctgagcttaagttgtttctggaagtagaacttggacaggatctacgccctatttctccacctgagaagactaaagaggagattctacttttcttcaaactttatgatcctttgaaggaagaacttcggtttgttgggcggctctttgtgaaggctactggaaagcctatggaaatactggctaagctaaatgaaatggctggcttcgcacctgatgaagaaatcgaactgtttgaggaaattaagtttgagcccaatgttatgtgtgaacacgttgacaagaagctaacttttaggggtagccagcttgaagatggagacatcatttgctttcagaaacctcttacagttgaaaatacagaaacatgtcgttatcctgatgttccctcttttcttgagtatgttcataatcgtcaggttgtacggtttcgttcactggagaagcccaaggaggatgagttctctctggaattgtcaaaacttaacaattatgatgacgttgtggaaagacttgctcgccatctaaacttggatgatccatctaaaatcaggcttacatctcacaactgttattctcaacaaccaaaacctcagccaatcaagtatcgtggagtggaacatctatcagacatgcttgctcactacaatcagacttcagatattttgtactatgaagtattggatatccctctgccagaactacaaggcctgaaaactctaaaagttgcctttcatcatgctcttaaagacgaggtggtaatacatactattagattgccaaagcaaagcacagtaggggatgttatcaatgaccttaagaccaaggttgaattgtctaacccaaatgcagaacttcgtctacttgaggttttctaccataaaatttacaagattttccccctgaatgaaaaaatcgagaacatcaatgatcaatactggacgttacgagctgaggagattccagaagaagaaaaaaatttgggaccccaggaccgtctaattcacgtttaccattttacaaaagacacaactcagaatcagcaggtccagaactttggggaaccattcttcctggtaattcgtgagggggagacattagctgaagttaaagtaaggatacagaagaagttacaggttccagaagaggagttttctaagtggaagtttgcatttctgtctttgggacgtcccacataccttcaagactcagatatcgtctctagtcgttttcagagaagagatgtttatggtgcatgggaacaatatttgggactggagcactctgacaatacaccgaagaggtcttatgctgcaaatcagaaccgtcacacatttgagaaaccggttagaatttacaactaagttagagcatatggtcagcccatggcccagttataagctttgtgtatggggggaagcatgaatcaaaccacatgaacctagcagcaactcaagagaatgcaagcataaacaatcatccttgtggtagatgtgtaattctttgtgaaaaaaggtgcagatcatatcatatagcagccgcaggtactctttcgttatgtagcatcctccttcaggtgatgtagtttagcttatatatttcctccctccccatctttcatttgactgtatcttagaccatcatgcataagttttgcgttcat

SEQ ID NO: 2383 - DNA, 4016 bp, Trigonella foenum-graecum
tactcccactttaccctaaaccccaaactaaaagaagagacctgatttcttctcttctctcgaaccagcttctgctgatctcattcttcatcaccacaccactctctctctctctctacaattacccgcgcaggttccaatttcaccatgaccgtcatgatgtccgctcccattgaccagcaagaggatgaggaagtgctcgtgccacacgcggatttgcctgagaacaacaatcatcagcctatggatgttgtagctcaacctgaacctgccaatactgtggagagccagcctgtcccggatcctccacaaaccagattcacatggagaattgacaattttactaggctgaatacaaaaaagctctattcagaagtattcgttgttggtgcttataaatggcgcgtgctaattttcccaaaaggaaacaacgtggactatttgtccatgtatttggatgtcgcggattcaactagtttgccctatggttggagtagatatgcacagtttagcttggcaattgttaatcaaatccataataagttcaccgtgagaaaagacacacaacatcaatttaatgcacgagaaagtgattggggtttcacatctttcatgcctcttggtgaattgtatgatcctagtagagggtatctcgtgaatgatactcttataatcgaagctgaggttcttgttcgtaagattgttgactactggaattacgactcaaagaaggagaccggctatgttgggctgaagaaccaaggagctacctgttatatgaattctctacttcaaactttgtaccatattccttattttaggaaggctgtgtaccatatgccaacaactgaaaatgatatgccctctggaagcatccctttggctctgcaaagtttattctacaagctccaatatagtgacaccagcgttgcaacaaaggagctgacaaaatcttttggatgggatacatatgactctttcatgcagcatgatgttcaagaactaaatcgggtcctctgtgaaaaacttgaagataaaatgaagggaaccgttgttgagggaactatacaaaagttatttgaaggacaccatatgaactacatagagtgcatcaatgtggactacaaatcaactagaaaggagtcattttatgaccttcagcttgatgtcaaaggttgtcgtgatgtttatgcttcctttgataagtatgttgaagttgaacgtcttgagggggataacaaatatcacgcggaacaatatggtttgcaggatgctaagaagggtgtcctatttattgattttcctcctgtccttcagcttcagctgaaaagatttgaatatgactttatgcgggatactatggttaagattaatgaccgttatgagtttccctcacaacttgatcttgatcgtgagaatggaaaatatctgtcacctgatgctgacaggagtgtccgcaatctttacacacttcacagtgttttggttcacagtgggggcgtgcatggcgggcactattatgcttttataaggccaactctctctgaacagtggtacaaatttgatgatgagagggtgacgaaagaagacaataagcgggcactcgaggagcaatatggtggtgaggaagagttaccacaaacaaatcctggattcaataacccaccatttaaattcaccaaatattcaaatgcttatatgctggtgtatatacgtgaaagtgacaaggacaaaatcatatgcaatgtggatgagaaagacattgctgaacatttaagggagaggttgaagaaagaacaagaagaaaaagagcacaaaaagaaagaaaaggcagaggctcatctttatacaattataaaggtggcacgagacgaagacattgaagggcagatgggaaaggatatctactttgatcttgtagaccatgacaaagtgagaagtttccgtgtacaaaagcagacaccttttaacgttttcaaggaagaggttgcaaaagagtttggtataccagttcaatttcaacgcttttggctatgggctaagcgtcaaaaccatacttatcggcctaatagaccgctgacacacattgaggaaacacaaactgtcggacaattgagagaagtgtcaaacaaggttcacaatgcagaactgaagttgtttttggaggtggagaaggggatggatttatgtcccattgcaccacctgacaagacaaaggatgatatattacttttctttaagctatatgatcctgaaaaagaggagcttcgctatgttggaaggctctttgtgaagtgtactggcaagccatcagaaatcttaacaaggctaaatgaaatggctggttatgatcctgaagaagatattgtactttatgaggagatcaagtttgagccaaatgtcatgtgtgaacctattgataagaaagtaacatttcgagcaagccagctggaggatggagatattgtatgctttcagaaagctcccttagtagataacgaggaacaagttcgctatccagatgtgccctcatatttagaatacgttcacaaccgccaggtggttcattttcgatctctggacagacccaaggaagatgacttttctttggagatgtcaaggctgtatacatatgatgatgttgtagagagagtagctcaacaacttggcttggatgatccatccaaaatacgtcttacccctcacaactgctactctcaacaaccgaaaccccagcctattaagcaccgaggggtggatcatttgtctgatatgttagttcattacaatcagatgtcggatatattatactatgaagtgctcgacatccctctacccgaattacaaggcttgaaaactctgaaagttgcatttcatcatgctatcaaggatgaggtggttagtcacactatcagactcccaaagcagagcactgttggagatgtccttgatgatcttaaaaccaaggtggaattatctcatcctgatgctgagctaaggttgcttgaagtcttctatcacaagatatacaaggtgttcccatccaatgaaaagattgaaaatattaatgatcaatactggacattgcgggcagaggagattccagaagaagaaaaaacattggtccacaggatcgtctaattcacgtgtatcattttactaaagacactgctcaaaatcaaatgcaaattcaaaacttcggggatccctttttcttggttatacacgaaggtgaagctctatctgaaattaaagtgcggatacagaagaaacttcaagttcctgatgaagagtttagcaagtggaagtttgcttttctatcacttgggcgtccagagtaccttcaggattcagacattgtatccagtcgttttcagaggcgagatgtttatggtgcttgggagcaatatcttggcttggagcatactgacaatgctcctaaaagatcatatgctgtcaaccagaaccgtcacacgtttgagaagccagtaaagatttataattaggagatcactataaatgagttaatgcatgggatgaattcagcattgttctacacctttgggattgtaaacaaggcgaagatagcaaaaggctactctgtataggcaactaattaaattagcaattcagatggtgtctgcagtcttttagttatgtggtatgtaattctttctgtctatggagtaacattattatcaacaccttctgtatctgccgaccacatcgccttgaacttatttatacttccattttcatatggaggttcttcaaattgaggtcattgatcattgtcattgaactgtatcagtacataagatttttggattagtgagtgtatacagggtatagttgcttgacttttggtcattttatttattgcttcttgattttgtctagttcctaagtgtttatttaagtgagggctgcataatgttgtagcaaagaaaacttttatgtaatgtaaaaggatttgccagattccatgaatctctggccaacataatcttactacc

SEQ ID NO: 2384 - DNA, 4066 bp, Abies balsamea
gttcatgccataaatttttgtaggatctttactccgatctagcgatccagaaaggatttgaaggcaagtggtttggttattggaggtagttgacatctgcagagggcgacttcgatcaacagatatacctacaaacgcaatgacaatgatggcccctcctcctctcgatcaggaagaggacgaaatgctggtcccgcatccggagttcaatgacggggctcagcccatggaagttgcagggcaaggagagacggtcagtaccgtggagaatcaacccccggacgatcctccctcctcccgatttacctgggctatcgaaaacttttcgaggttaaatgtgaagaagcattactcagaaattttcaccgtgggaggttacaaatggcgggtgttaacttttccgaagggaaacaatgtagaccacttatcgatgtacttggatgtggcggattcttctaccttgccttatggctggagcagatatgcacaatttagcttggctgttgttaatcagattagccccaagtattctatccggaaagatacgcaacatcaattcaatgcccgagagagtgactggggtttcacatcatttatgccgcttggagatgtgtatgaccattcaaaaggttatctggtgaatgatactctcataattgaagcggatgttgttgtccgaagggtaattgactattggtcatatgactcaaagaaagaaacaggttatgttgggctgaaaaatcaaggagcaacatgctatatgaactcacttcttcagacactgtatcatattccttacttcagaaaggctgtgtatcatatgcccacgacggaaaatgacatgccatctagcagcattccattggctttacagagtttgttttataagctccagtacagtgacaccagtgttgcgacaaaggagttaacaaaatcttttggatgggacacttacgattcttttatgcaacatgatgtccaggagttgaacagagtgttatctgagaagctagaagacaaaatgaagggtacagtggttgagggcacaatacagcaactgtttgagggccatcatatgaattacattgaatgcataaacgtagattacaagtcaacaaggaaagagtcattttatgatctgcagctcgatgtcaaaggttgccgagatgtctatgcttcatttgataaatatgttgaagtggaacgccttgaaggggataataaatatcatgctgaacaatatggtttacaggatgcaaagaagggtgttcttttcattgattttcctcctgtgctacaacttcaactgaagcgctttgaatatgatttcatgcgagacacaatggttaagataaatgatcgctatgagtttcctttgcaacttgatctcgatagagacaatgggaaatatctttctccagatgcagatcgaagtgtacgcaatttgtatactctccacagtgttttagtgcacagcggaggtgttcacgggggccactattatgcctttatccgtccaactctctcagaccagtggttgaagtttgatgatgagcgtgtaacaaaggaagatataaagagggcactagaggagcaatatggtggggaggaagagctacctcagacaaatccaggtttcaacaacactccatttaagtttacaaaatactccaatgcttacatgcttgtctatatcagagagagtgacaaggataagattatctgtaacgttgatgagaaggatatagcagagcatcttagggtaagattaaagaaagagcaagaggagaaggagcacaaaagaaaggagaaggcagaggcacacctttataccatcataaaggttgcacgggatgaagatcttgctgagcagattggaaaggatatattttttgatctggtcgatcatgacaaagttcggagttttcggattcagaaacaaacaccttttactgtttttaaggaggaggtggcaaaagaatttggcatccctgttcaatttcagcgtttctggttatgggcaaaacgacagaaccatacctatcgtcccaacaggcctttgtcacaacttgaagagtctcaatctgttggccacttgagagaggcttctaacaaggcaaacaatgcagagttgaaattatttcttgaagtagaacttgccctggatcttcgtccactaccactacctgaaaagacaaaggatgaaatactgctcttcttcaaactttatgaccctgagaaagaagaactccgttttgttggcaggaattttgtgaaggcaatggggaagccgacggaaattttaagaagcttgaatgagatggctggtttttccccaaatgaagaaattgaactttttgaggaaataaagtttgaaccgaatgttatgtgtgagcatattgacaagaggctcacatttcgtggcagccaacttgaagatggagatattatctgttatcaaaagatcctttcaagggaagatgaagaacgctatagatatcccgatgttccatcatttctggaatatgttcacaaccgacagattgttcattttcgttgcctggataagccaaaggaagatgaattttgtcttgaactatcaaaactctctacatatgatgacgttgtggacagagtcgcacagcatcttggactggatgatccttcgaaaatcagactgacatcacacaattgctattctcagcaacctaaaccccaacccattaagtatcgtggcgtggatcacttatctgatatgctagttcactataatcagtcttccgatatcttgtactatgaagtcttggacataccactcccagagttgcaagggttaaaatcgttaaaagtagcttttcatcattcaaccaaagatgaagtatctgttcacagtattcgattgcccaaacagagtactgttggggacgtcattaatgagctgaggacaaaggttgagctgtcgaaccctacagcagaaattcgattgctcgaggtcttttatcacaaaatttacaagatttttccacttaatgaaaagattgagaacataaatgatcagtattggacattgcgagcagaggagattccagaagaggagaagaatctaggtcctcatgaccgtttaatccatgtttatcattttacaagagatgcatctcagaatcacatggtccaaaattttggagagcctttctttctgattattcgggaaggtgaaaccttagcagatgttaaagaaagaatccagaagaagttgcaggttcctgatgaagaatttgccaaatggaagtttgcattcctctccttgggtcgcccagagtaccttcaagatacggatgttatttcaagtcgctttcagcggagagatgtttatggagcttgggagcaatatcttggattggagcattccgatagtgcacccaaacgatctcaccaaacaaatcagaatcgtcacacttttgaaaagcctgtaaagatatacaactgaaagcaaagctaaaattgtgatttctttgtactcggaatgggaaaataggaaagagaattgtactatttatagtcgcctcctttttgttagatggtccctgggaatgtcaatgtagccatctatgatgtattgaagagaaatctgcatctctatattttctgatgccatttatttggcttgttaaaattatagaaaacattgtcttgtttggttccccaattaaaagaactcaggttcagatcagtgttaggccagctgatttttacccacaactatattgtcatgacagatctgctgtctggtggtatcctgttatttcttcgattacattttcatgtcaatttaaatctcttcttaccgtgccttgaaacatggcttccaatgtccaggatgtgatcagcagcataatttatggtattgattgcctgccctacagggagcaactatgtaagctaagttgttcatagcacattttggaggaagttctccaatctggttcattttgtaggttcttctgaggccacttgtcaattttgttagtaatgtaatgatacaatctagtaaattgttcattcttgt

SEQ ID NO: 2385 - DNA, 3994 bp, Eucalyptus grandis
aagttcgaccgcgaccagcttctgggaaccccagcgagagcgagagataaagaggaagcgcccgcgacgccccccgattctcggtatcctccactcatgaccgtcatgactcctgcccccatcgatcaacaggaggatgaagagatgctcgttccgcactcggatttggccgagaacaatcaccagcccatggaagcgcccgctgaagcccctaacccagcagacaatcagccagtggatgatcctccaccatcaagattcacatggcgaattgacaacttctctaggctgaacaccaagaagctttactctgaaatattcgtagttggtggttataaatggcgggtacttgttttcccaaaaggaaataacgtggagtacttgtctatgtatttggatgtggctgattcggcaagcttgccatatggatggagtagatatgcgcagttcagtttaggggttttaaatcaaatacataacaaatatactgtcagaaaagatacgcaacaccagttcaatgcccgggaaagtgattggggtttcacatcctttatgcctcttagtgaactttatgatcctgctagaggttatctaatgcatgatactcttatagtggaagctgaggttattgttcgtagagttgtagattactggacatatgactccaaaaaagagactggttatgttggtctcaagaaccaaggagcgacatgttatatgaactctctcctccagacactataccatattccttacttcaggaaggctgtgtaccatatgcctactactgagaatgacatgccatctgcaagcatccctctggctctccagagtttattttataagctccagtacagcgacagcagtgtagcgacgaaagagttgaccaagtcatttggatgggacacgtacgattctttcatgcagcatgatgtgcaagaactaaatagggttctatgcgaaaagcttgaagacaaaatgaagggtactgtcgtcgaggggactatacagaaattatttgaaggacatcatatgaattatattgaatgcattaatgtggactacaaatctacgagaaaggagtcattttatgaccttcagcttgatgtcaagggctgtcgagatgtttacgcttcttttgataagtatgtcgaagttgaacgcctcgagggtgataataagtaccatgctgagcaatatggcttgcaggatgcaaaaaagggggttctgttcattgacttcccccccgttcttcaactccaattgaaacgatttgaatatgattttatgcgggacactatggtgaagatcaatgatcgctatgagtttcctctgcaacttgatcttgaccgcgaggatggtaaatatttgtctcctgatgctgataggagcgtccgcaatctctacacactccacagtgttctggttcacagcggtggggtgcatggtggacattattatgcatttatcagacctactctttctgaccaatggtataaattcgatgatgagagagtaacaaaagaagatgtaaagagagcactagaggagcaatatggtggagaggaagagctgccgccaacaaatcctggatttaacaacactccatttaagtttactaaatactcaaatgcatacatgctggtgtatatacgtgagagtgacaaggacaagatcatctgtgatgtggatgagaaggacattgccgaacatctgagggagagattgaaaaaagaacaagaagaaaaggaacataagaagaaagagaaggccgaggcacacttgtacacaatcattaaggttgcacgggatgaagaccttgctgaacagattggcaaggatatttattttgatctggtggatcatgacaaagttaaaagtttccgcattcaaaagcagatgccttttaacatcttcaaggaggaggttgctaaagaatttggcgttccggtgcaatttcagcggttctggctatgggcaaaacgccagaaccacacttatcgtcctaatcggccattgactccggcagaggaaatgcaatctgtaggacagttgagagaagtgtcaaataaagttccgaatgccgaattgaagttgttcttggaagtagaactcgggctggatatgcaccccattgccccacctgacaagtcaaaggaagatatattattgttctttaagctttatgatcccgagaagggagagctgcgatatgttggaaggcttttcgtgaagggtactggtaaacctgcagaaatcttgaccaagttaaatgaaatggccggctattctcctgaccaagaaatcgagctttacgaggaaataaagttcgagcctaatgtcatgtgtgaacctgttgacaagaaagtgacatttcgagctagccagcttgaagatggagatatcctgtgcttccagaaatcttttccaactgaaaatggtgaacaattttcctatccagatgtcccttcctttctggagtatgtgcacaatcgtcaaattgtccacttccgttctcttgaaaaacctaaggaggatgatttctctttggagatgtctaagctgtatacctatgatgatgttgtggaaagagttgctcagcagcttggtttggatgatccatcaaagatcaggctcacatctcacaactgttactctcagcaacccaagccccatcctataaagtatcgtggagtggatcatttgtctgatatgttggttcactataaccagagttcggatatattgtactatgaagtgctagatatacctcttccagaactgcaaggtttaaaaactttaaaagtagcatttcatcatgctactaaggatgaagtggtcatccatacgatcagacttccaaagcagagtaccgttggggatgtgcttagtgatctcaagacaaaggttgagttatccgatcctaatgcagaacttaggttgctcgaagttttctaccacaagatctacaagatctttcccctcaacgagaaaattgagaacataaatgatcagtattggacattgcgtgcagaagagattccggaagaagagaaaaatcttggtcaaactgatcgtctaatccatgtataccatttcacaaaagacactgctcagaaccagcaagttcagaattttggagaaccctttttcttagtaattcatgaaggtgagacattggctgaaataaaggtacgagtacagaagaaattgcaagtgccagatgaggagtttgctaagtggaggtttgcgttcctctcattaggtcgtccagagtaccttcaggatcatgatatagtgtcaaatcgttttcagagacgagatgtttatggtgcttgggagcaatatcttggattggagcactctgacactgctcctaaaagagcttatgcagctaatcagaatcgccacacatttgagaagccagtgaaaatatataattaaaatccaactgatggatcttctttaactgtattgttgagctcgatacaagatggcaccatttgtttgtggaaaatcagcaaggtggttatggtcaaggtgatttcagttgatctgatgtttttgttggctcgtttgttcctagtgtggatggagaagtttagcctgaagcaaattacatattctgaccgcacatactgcttccatttcttgagatggagtcttgggcgatctccggtgggccgtcactggtagtgtattttaacggtatataaacgaaagattttggactggttattgtatacatggtatagtaggttgccttagtctttatcttttgcttcatctgcttcttcgatttttgtttacttgagttatgtctagaaaagatggggattctgtagtggcttttaggtactctttgcatctttcttgatttgtaaaggaaatttgaaagatgctgtatttacattggactcttaatttttagtctccaaaggcctattttcggcgcggaggaatcattttggattttcgcaaaaaaggcccctcg

SEQ ID NO: 2386 - DNA, 3593 bp, Flaveria ramosissima
accgccgattctccgatcgccaccaatcgccgtcgatgactctcctgactccgcctcccattgatccggaagaggaagagatgcttgttccgcattctgagtttgcgggggctgaaggacctcaaccaatggaagttacacctgcagaagctcctaatgttgttgatgcacccgtagttgatgatccaccatcagcaaggttcacatggacaatagagaatttctcaagattgactggcaaaaagctgtactctgatgttttcactgttggaggatataaatggcgggtgctcatattcccaaaaggaaacaatgtggaccatttgtcaatgtatcttgatgttgctgattccacaactttgccgtatggttggagtagatatgcacagtttagccttgctgtggttaatcaaattcatagcaagttgaccatgcgaaaagatacccaacatcagttcaatgcaagagaaagtgattggggtttcacgtcatttatgcctcttagtgagctatatgaacccactagaggatatcttctgaatgatacatgcatagttgaagctgatgtagcagtccggaaggtggttgattactggtcacatgactcgaagaaagaaactggttatgttgggcttaaaaatcaaggtgctacttgctatatgaactctttacttcagacattgtaccacatcccttatttcaggaaggctgtttatcacatgcccacaaccgagaatgatatgccatcagggagcattcctttggctttacagagcttattttataagcttcagtacagtgacacaagtgtagccacaaaagagttgaccaaatcttttggttgggatacatatgactcttttatgcagcatgatgttcaagaactcaatagggttctttgtgagaaacttgaagataaaatgaagggaactgttgtggagggcacaattcaacaattattcgaagggcatcatatgaactatatcgaatgcattaatgtagactacaaatcaactaggaaggaatcattttatgaccttcagcttgacgtcaagggctgccgtgatgtttatgcttcttttgacaagtatgtggaagtggaaagacttgaaggtgataacaagtatcatgctgagcaacatgggttacaggatgcaaagaagggtgttctgttcattgatttcccccctgttcttcagctccaactaaaacgttttgaatatgatttcatgcgagatacaatggttaagataaatgatcgctatgaatttccattgcaacttgatcttgatagagaaaatgggaagtatttatcaccccaggcagacagaactgttcgcaatctctatacccttcacagtgtattggttcacagtggtggggtccatggtggacactattatgcctatattcggccaacactctctgatcaatggctgaaatttgatgatgaacgtgtaaccaaagaagacatgaagagagcaatggacgaacaatatggaggcgaggaagagttaccgcaagcaaatcctgggttcaataactccccatttaagtttaccaagtattcaaatgcgtacatgcttgtgtatatacgtgaaagtgacaaggagaaaatagtctgtaatgtggatgagaaggatgtagcagagcacctaaggattagattaaagaaagaacaagaagagaaagagcagaaaaggaaggagaaagcagaggcacatttgtatactattataaaggttgctcgtgatgagaatcttcatgaacaaatagggaaaaatatattttttgatctagtggatcatgataaagttcgtagtttccgtatccaaaagcaaatatcttttgcccttttcaaggaggaagtagctaaagagttaggtataccggtacaatgtcaacgtttctggctttgggcaaaacgccaaaatcatacttaccgcccgaatcgtccattaactcctctagaagaagctcaatctgttggacatttgagggaggtgtcaaataaggctaacaatgctgaacttaagttgtttctagaggtagaacttggacagaactcgcagcctgttcccccacctgcgaagactaaggaggagattctgcttttctttaagctttatgaccctttaaaagaggagcttcggtatgttgggcggctctttgtgaagggtactggaaagcctgctgaaatactgacaaagctaaatgagctggctggctttgcacctaatgaagaaatagaactatatgaggaaataaagtttgaacctactgttatgtgtgaacatgttgataaaaagctcacatttcgggctagtcagctcgaagacggggacatcatttgctttcagaaacctcttcaggttggaactgtaaaatgtcgctatcctgatgttccatcttttctggagtatgttcacaatcgccaggttgtgcgtttccgctcattggagagacccaaggaggacgagttctcattggaattgtcaaagctccacaattatgatgatgttgttgaaagagttgcctcccatttaaacttagatgatccatctaaaatcaggcttacgtctcataactgttattcccagcaacccaaacctcaaccaataaaataccgaggagtggaacacctgtcagacatcttggcccactacaatcagacttcagatattctgtattatgaagtactggatattcctcttcctgaactacaaggcctgaaaaccctgaaggttgcttttcatcatgcaacaaaagatgaagtagtcatacataccattagattgccaaaacaaagcactgtgggtgatgtgatcaatgaccttaaggcaaaggttgagttatctcataaagatgcagagcttcgattgcttgaagttttttaccacaagatttacaagattttccctctgaacgaaaagatagagaacattaacgatcaatactggacgttacgtgctgaggagatcccagaagaggaaaagaaccttggtccacaggatcgtctaattcatgtctatcattttacgaaagacacatctcagaaccagcaagtgcagaactttggggaaccgtttttccttgtgattcgagagggtgaaacattagctgaagttaaaatacgcatacagaagaaactacaggttcctgatgaggaattttcaaagtggaagtttgcatttctctctttgggtcgtcctacataccttcaggattctgatgttgtctccacccgttttcagaggagagatgtttatggtgcttgggaacagtacttgggattggagcattctgacactacatccaagcggtcatatgctgcaaatcagaaccgacacacatttgagaaacccgttagaatctacaactagctaaaagcacgaatttcttggtagtcgtgcgcggacattttacgaaaatgtttaccacaatgcataatttgttggtagatctgtaattctttgtttaaaagtttgtgaagcatccctctgtggggtgacaatcaggtttagataatgttcccccattattgtaccttagagagtatgcataagattttggatctgggatgtatagaggta

SEQ ID NO: 2387 - DNA, 4239 bp, Vitis vinifera
attacgtaattccgaagatatccctggactctggcccttttctacactttctccttcgtgtttacgttgcaagggctgcttctccctggcgctctctccaattcctgtctcagattcgccgatcggacggccattcttgtccgccaatgactctcatgactcctccgcctttggatgtatctaccacttaaccttcttcaactctgctctttcactttctctcaattcgatcttcatactgttggcttagggatttcgataattcccgaaatcgaccccaatttcatcctttcctctggtccatggttagctcctagggttactttcaccagatcggagctcttatatttcaccttgttttgcagcaggaggacgatgagatgcttgttccgcacaccgacttcgccgacggtcctcagcccatggaagtggcgcagccagatactgctagtgcagtggatgcgcagacagtggaagatcccccgtcggctaggttcacgtggacaattgagaacttttctaggttgaataccaagaagctctactcggatgtgttctatgttggaggctacaaatggagggttcttatttttcccaaggggaacaacgtggaccatttgtcaatgtacttagatgtagctgattcagcaaccttgccatatggatggagtagatatgctcagttcagcttggctgtgatcaatcaaattcataacaagttcacaattaggaaagatacacaacaccagttcaatgcacgtgaaagtgattggggattcacttcattcatgcctcttggtgaactgtatgaccctgcaagaggttatcttgtgaatgatacatgcatagttgaagctgatgttgctgtacgtagggttattgattactggactcatgactcaaagaaggagactggttatgttggactgaagaaccaaggagctacctgttacatgaattcccttcttcagacactctaccatattccttacttcagaaaggctgtgtatcatatgccgacaactgagaatgatatgccatcagggagtatccctctggctttgcagagtttattctataagctccaatacagtgacactagtgtagcgacgaaagagttgacaaagtcttttgggtgggatacttatgattctttcatgcagcatgacgtgcaagaactcaatagggttctttgtgaaaagcttgaggataaaatgaagggaactgttgtggagggtactatacagcagttatttgaagggcaccatatgaactatattgaatgcattaatgtggactataaatcaacaagaaaggaatcattttatgatcttcagcttgatgtcaaaggctgtcgcgatgtttatgcttcatttgacaagtatgttgaggttgaacgtctcgagggtgataataagtatcatgctgaaatccatgggctacaggatgccagaaaaggtgttttattcattgattttcctcctgtccttcaacttcagctaaaacggtttgagtatgattttatgcgggatactatggtcaagataaatgaccgctatgagttccctttgcaacttgatcttgatagagagaatggcaaatatctatcaccagatgccgataggagtgttcgcaatctttacacccttcacagtgttttggttcacagtggtggggtgcatggtggacattattatgcttatataaggccaacactctctgatcagtggttcaaatttgatgatgaacgggtgacaaaagaagatattaagagggcactagaggagcagtatggtggtgaggaagagctaccccagacaaatcccggattcaacaactctccattcaaatttacaaaatactcaaatgcatacatgcttgtgtatatacgtgaaagtgacaaggagaaaataatttgtaatgtggacgagaaggatattgctgaacaccttagaataaggttgaagaaagaacaagaagaaaaagagcaaaagagaaaggaaaaagcagaggctcacctttacactatcataaaggttgctcggaatgaggaccttattgaacagattggaagggacatatattttgaccttgtggatcatgacaaagttcgtagttttcggattcagaaacagactccttttaaccttttcaaggaggaagttgcgaaagagttcggtataccagtgcaatttcaacgtttctggctgtgggcaaagcgccaaaaccatacatatcgtccaaatcgtcctttgacactccaggaggaagcacaatctgttggacaattgagggaagtatccaataaggcaaatcatgctgagctaaagttgtttttggaagttgaacttgggcaggatttacggccggttcccccacctgagaagacaaaagaggagattctccttttctttaaactttatgaccctttgaaagaggagctccggtatgttgggaggctatttgtgaaggggagtggaaagccaattgaaatattgtcaaaactgaatgaattggctggctttagtcccaatgaagagattgaactttttgaggaaataaaatttgaacctaatgtcatgtgtgaacacattgataagaggctcacttttcgtgctagtcagcttgaggatggtgatataatttgctatcagagactccttcaaattgacagtagtcaacaatgtcgctatcctgatgttccttcatttctggaatatgttcataatcgtcaggttgttcgctttcgctctctagagaagcctaaggaggatgaattttgtcttgagttgtcaaagcttttcaattatgatgatgttgtggaaagagtagctgctcatctgggattggatgactcttccaaaatcaggcttacatcacataactgttactcccaacaacctaaaccccaacctatcaagtacagaggagtggaacatttatcagacatgttgctccactacaatcagacttctgatatactatattatgaagtattggacatccctctgccagaactacaaggtcttaaaactttgaaagttgcctttcaccatgctacaaaggaagaagtagtgattcatactattagattgccaaaacagagcactgtaggggatgtgataaatgaccttaagtccaaggtggagttgtctcatcctaatgcagaacttagattgcttgaagttttctatcacaagatctacaagattttcccactcaatgagaagattgagaacattaatgatcaatactggacattacgtgcagaggagattcctgaagaggagaaaaacctaggtcctcatgatcggttgattcatgtttatcattttatgaaagacacaactcagaatcaggtgcaggttcagaattttggagaaccctttttcttggtcatccatgagggtgagactttagctgaagttaaagtgcgcatacagaagaaattacaggttcctgatgaggagttctcaaagtggaagtttgcatttttgtccctcggtcgccctgagtatcttcaggactctgacattgtctctagtcgattccagagaagagatgtctatggtgcttgggagcagtatcttggtttggagcactccgacaatgctcccaaaaggtcatatgcagctaatcagaatcgccacacatttgagaagccagtaaaaatttacaattaggaaaatcagacaatttccacctttgcatcagctgcatcagatatgggttcaatggggatgttcagcattttgggaagagcagaagatgcgaaagaaaggaagctagcagtgagagttactgctggattcggttattgattttgttaggatgtgtaattctttgttagagggtggtggaaggattttaacctgcaatttatgtttcctttatagtttgaacctgcctcccaagtttttctctgtggaatgcacccgtctcaggggtgaggtaggtggtatttcatattttattccattgtaatctagaagtacataagattttggattttgggttgggagggatgtatagagaatataggcttgggtttcaacgtccttttttcctttgtcctacactcccttggtggtttgtcttttagatgaatgagagaatgggagaggggtctgtataatgtttgacttggttactgcgcttctgtgcaaaagaaacaactactattctccacatttgagttgctcttggtcttgcgctttcttagctgggcaaagttccctg

SEQ ID NO: 2388 - DNA, 3686 bp, Euphorbia peplus
cgattttaccgatcagacggcgacacgtgtcaccattcatgactctgatgactcctccgccattagatcaggagcaagatgagatgctcgtcccgcacactgactttgttgaaggtcctcagcctatggaagtagcacctgcagaaaatgcgactgcagttgatgcgcagtcagtggatgatccaccatcagcaaggttcacatggaccatagataatttttcaaggcttaatactaagaagctgtactctgatgttttcgtcgttggaggctacaaatggcggatactgatattcccaaaggggaataatgtggatcacttgtcgatgtatctagatgttgcagattcagcaaccctgccttatgggtggagcagatatgctcagtttagtttaactattgccaatcaaatgcatcaaaaatattctattcggaaagacacacaacaccaattcaatgcacgcgagagtgattggggcttcacttctttcatgcctcttggggaactatatgaccctaatagaggttatcttgctaatgatacatgcatagttgaagctgatgttgctgtacgtagggtcattgattactggtctcatgattccaagaaggagactgggtatgttggacttaagaaccaaggagctacctgttacatgaactctctgcttcagacactgtaccatattccttatttcagaaaggctgtgtatcatatgccaacaactgagaatgacatgccatctgggagcattcctcttgctttgcaaagcttgttctataagcttcaatacagcgacactagtgtggcaaccaaagagctgacaaagtcttttggctgggatacatacgattccttcatgcaacatgatgtgcaagagctcaacagagtactttgtgaaaagcttgaggataaaatgaagggaacagttgtggagggaaccatacaacagttgtttgaagggcaccatatgaattatattgaatgcatcaatgtggattataagtcaacaagaaaggaatcattttatgatcttcagcttgatgtcaaaggctgtagggatgtttatgctcttttgacaaatatgtggaggtagaacgtctagaaggtgataataaatatcacgctgaacaacatgggttgcaagatgctaggaagggtgttctatttattgacttcccccctgtccttcagcttcagttgaagcgatttgagtatgatttcatgcgagatactatggtgaagataaatgaccgctatgagttcccgttgcaacttgatcttgatagagaagatggtaaatatttatcacctgatgcagacagaagtgtccgcaacctttacactcttcacagtgtcttagttcatagcggtggcgtgcatggtggacattactatgcatatatccgacctactctttcagatcaatggtttaaatttgatgatgaaagggtgacaaaagaggatatgaaaagggcactagaggaacagtatggtggtgaggaagagttaccgcaagcaaatcctggtttcaacaactctccttttaagttcacaaaatactcaaatgcttatatgcttgtatacatacgtgagagtgataaggaaaagataatttgtaatgtggatgaaaaagacattgcagaacacctcagggtaagattgaaaaaagaacaggaggaaaaagaactaaagagaaaggaaaaagctgaggcccacttgtatacaataataaaggttgctcgaagtgaggacctcctcgaacaaattggaaaggatatatattttgatcttgtagatcacgacaaagttcgcagtttccgcatccaaaaacaaatgtcctttaatctatttaaggaagaagttgctaaagaatttggaatacctgtgcaatttcaacgcttttggctgtgggcaaaacgccaaaaccatacgtatcgtccaaatcggcctctgactcctcaggaagaagcacaatcagttggacagctgagagaggtttccaataaagcaaataatgccgagctaaagttgttcttggaagtggaattgggacatgatttacggcctatccctccacccgagaagaccaaagaggatatcctccttttctttaaactttatgatccttcgaaagaggagcttcggttcattggaaggctgtttgtgaaggggagtgggaagcctattgagatattgactaagttaaatgaaatagctggcttcccttctgatcaagatattgatcttttcgaggaaataaaatttgaacctaatgtcatgtgtgaacacattgacaagaagctcactttccgtgctagtcagcttgaagatggagatattgtttgctttcagaaatccactcaagttagtagcggtgaacaataccgctatcctgatgtaccttcatttcttgaatatgtacataaccgtcaggttgttcgcttccgatctttggagagacctaaggatgatgaattttgtcttgagctgtcaaagcttcacaattatgatgatgttgtcgaaagagtagctagacatcttgcattggaggacccttccaaaattaggcttacttctcacaactgttattcccaacaaccgaaaccccaacccatcaagtatcgaggagtggatcatttgacggacatgctggctcattacaatcagacaagtgatatcctatactatgaagtacttgatatccctctgccagaactgcaatgcttaaaaacattaaaagttgcttttcatcatgctaccaaggatgaggtggtgattcatactattagactgccaaaacagagtactgtaggcgatgtaattaatgacttaaagacaaaggttgagctgtctaatcccaatgcagaacttagattgcttgaggttttctatcataagatttacaagatatttccgctcaacgaaaaaattgagaatatcaatgatcagtattggacattgcgtgctgaggagattcccgaagaggagaaagacctcagtcctaatgatcgcttgattcatgtttatcattttatgaaagacccagctcaaaatcaggtccaaaattttggggaacctttttcctagtcattcatgagggtgagacattatctgaagttaaagcgcggatacagaaaaaattgcaggtccctgatgaggagtttgctaagtggaaatttgcatttttgtcgcttggtcgtcccgagtatcttcaagacatggacatcatttccagtcgatttcagagaagggatgtctatggtgcttgggagcaatatcttggactagagcactctgacaatactccaaaaagatcatatgcagctaatcagaatcgacacacatttgaaaagccagtaaaaatctacaattagaacaaagaaagatggggtttaaattattcgaaggggttaccctgttgaaatttgaacagctgcaaaatgagagaagcaggctggaaaagcaaattattagatgtggtagaatgtgattctttcatgtagggcgacgaggcagaggacttaatcataagacctcactagttttgacttctctctggtcttgtgcctgtgtgtatcaggtgaaatagtagagaccgcatccaactcttaaatccgattgtaatttagtacataagattttgttgtgggggatgtatagagggtataggtttgtgtacttg

SEQ ID NO: 2389 - DNA, 4015 bp, Helianthus annuus
ggatcccaaaactaccctccgtcatgtctaaaatctagtgagccaacacaacaccaacacctcttttatatcaatctctatcgcgttttctacagtgtccccctcaatttttccgatttcaatttcagccaccaatctccgccgatgactctcatgactcctcctcccatcgatgctgaggaggatgagatgctagttccacattcagatttcgttgctccggaaggtcctcaaccgatggaagctacaccagctgaagctcccaatgttgttgatgcgccaacggttgacgatccgccgtcggcgcggtttacgtggactatagagaatttttctaggttgaattcaaagaagttgtactcggacgtgttctttgttggaggatataaatggcgtgttcttatatttcctaaaggaaacaatgtcgaccatctgtcaatgtaccttgatgttgcggattcatcgacgctgccatatggttggagtagatatgctcagtttagcttagctgtggttaatcaaattcataacaagttcactgttagaaaagatacccaacatcagtttaattcacgagagagcgattggggtttcacttcatttatgcctctaagcgaactttatgatcccagcaaaggctatcttctgaatgacacatgcatagttgaagctgacgtgactgtccggaaggttgttgactactggtcacatgattcaaagaaggagactggttacgttggccttaaaaaccaaggtgctacttgctacatgaactccctgctacagacattataccatataccttatttcaggaaggctgtgtatcacatgccaacaacggaaaatgatatgccatcagggagcattcctcttgctttacagagtttattttataagcttcagtatagtgacacaagtgtcgccacaaaagagttgaccaagtcttttggctgggatacatatgattcttttatgcaacatgatgttcaagaactaaatcgagttttatgtgagaaacttgaagacaaaatgaagggaacagttgtggagggtacgattcagcagttatttgaaggacaccatatgaattatattgaatgtataaatgttgactacaaatcaacaagaaaggagtctttttatgatcttcagcttgatgtcaaaggttgccgagatgtgtatgcctcatttgacaagtatgttgaagtagaaaggcttgaaggtgacaacaaatatcatgctgaacaacatgggttacaggatgcaaagaagggagtcctgttcatcgatttcccacctgttcttcaactccagttaaaacgtttcgaatatgatttcatgcgagacactatggtgaagataaatgatcggtatgaattcccgttgcaactggatctagatagagaagatgggaaatatttatcaccacaagcagatagaagtgtacgcaacctttacactcttcacagtgtgttggttcacagcggtggggtacatggcggacattattatgcttatatacggccaacgctttctgatcaatggtttaagtttgatgatgaacgtgttaccaaagaagacatgaagagggcattggatgaacaatatggtggagaagaggagttacctcaagcaaaccctggtttcaataactctccttttaaatttacaaagtactctaatgcatatatgcttgtgtatatacgtgaaagtgacaaggagaaaataatatgtaatgtggacgagaaggatatagcagagcacttaagaataaggttgaaaaaagaacaagaagaaaaggagcaaaaaagaaaggagaaagcagaggctcatttatatactattataaaggttgcgagagatgaggaccttcatgaacagataggaaaagatatttattttgatctagtggatcatgacaaagttcgtagcttccgtatccaaaaacaaacaccttttgctctttttaaggaagatgtagctaaagaattgggtataccagtgcaatatcaacgtttctggctatgggcaaagcgccaaaatcacacttaccggcccaatcgtccgttgacacctcaagaagaagcccagtctgttggacatttgaaagaggtatcaaacaaggctaacaatgctgagctcaagttgtttctggaagtagaagttggacaggatctacgccctattgctccacctgagaagactaaagatgagattctacttttcttcaaactttatgatcctttgaaggaagaacttcggtttgttgggcggctctttgtgaaggctactggaaagccgatagaaatactggcaaagctaaatgaactggctggcttcacacctgatgaagaaattgaactattcgaggaaattaagtttgagcccaatgttatgtgtgaacatgttgacaagaagctaacttttaggggtagccagcttgaagatggggacatcatttgctttcagaaacctcttaaagttgaaaatgcagaaacatgtcgttatcctgatgttccctcttttctggagtatgttcacaatcgtcaggttgtacggtttcgttctctggagaagcctaaggaggatgagttttctctggaactgtcaaagctcaacaattacgatgacgttgtggaacgacttgctcgccatttaaacttagacgatccatctaaaatcaggcttacatctcacaactgttactctcaacaacccaaacctcagccaatcaagtatcgtggagtcgaacatctatccgacatgctggctcactacaatcagacttctgatattttgtattatgaagtattggatattcctctgccagaactacaaggcctgaaaactctgaaagttgcctttcatcatgctactaaagatgaagtggtcatacatactattagattgccaaagcaaagcacagtaggggatgttatcaatgaccttaagaccaaggttgagttgtctaatccaaatgcagaacttcgcctacttgaggttttctaccacaaaatttacaagatattccccctgaatgaaaaaatcgagaatatcaatgatcaatactggacgttacgcgctgaggaggttccagaagaagaaaaggatctgggtcctcaggaccgtctaattcacgtttaccattttacaaaagacacaactcagaaccaggtccagaacttcggggaaccattcttcctggtaatccgtgaaggtgagacattagccgaagttaaagtaaggatacagaagaagttacaggttccagatgaggagttttccaagtggaagtttgcattcctgtctttgggacgtcccacataccttcaggactcggatattgtctctagtcgatttcagagaagagatgtttatggtgcttgggaacaatatttgggattggagcactctgacaatacacccaagaggtcttatgctgcaaatcagaaccgtcacacatttgaaaaaccggttagaatctacaactaagttagagaaattatatggtgaagccattggcaagttacgtgtacgggggaaaagcatgaatcaaaccacatgaacctagcagcaagagaatgcaagcataatcgaacttctggtagatgtgtaattctttgtgaaaaaaggtagccgatcatatcatatcatatagaagcgcatactctttctttgtgtagcatcctccttgaggtgatgtagtttaggttatatatttccccctctcaacttttattcgactgtatcttttagacaaccatgcataagttttgggttcgtgttgtatagaggtatagtttgtgttgttctttaacttcaattcacccgttctatattgtgactttatcatacaaaactaggtatatgagatttctgtgttatgccatattgattcaacttttatcatctgtaactgtacattgttgcaagattgcccatagataaagatagtgtatgtgatggtgtattagcaaccaggttttgttgagtgatatcatcgaacacctttaag

SEQ ID NO: 2390 - DNA, 4096 bp, Fagus grandifolia
aactcacaaaatacccctcccgagtcttttctctcagccactctctctcggcacagtccctcctttgccaagcccgcttggctttccttctcacactcactcactgtttttccctccatctcgttcccagattcatcgatcgcacggtccgtctctctccaccaatgaccatgatgactcctccgccgttagatcaagaggaagaagagatgctcgtgccgcattcggatttagtcgagggccctcagcctatggaagtagtggcgcaagtcgagtctgcaagtacggtggagaatcaaccagttgaggatccaccgtctatgaaattcacatggacaattgagaatttctctaggttaaataccaagaagcactactcggaagtttttgtcgtcggcggttataaatggaggatacttgtttttccgaaagggaacaatgtggaccacttgtcaatgtatttggatgtcgcggattccactgcattgccatatggttggagtagatatgcgcaattcagcttggctgtggttaatcaggttcatagcaagtactcaatgagaaaagacacacaacaccagttcaatacaagagagagtgactggggttttacatcattcatgcctctcagtgatctttatgaccctgctagagggtacctcgtaaatgacacatgcgtcgttgaagctgaggttgctgtacgcaaggttttggattactggtcatatgactcaaaaaagagactggttatgttggacttaagaaccaaggagcaacgtgttacatgaactctcttctgcagactctctaccatattccttacttcagaaaggctgtctaccatatgccaacaactgaaaatgacatgccctcgggaagcattccactggcgttacagagtttattctataagcttcaatataatgacagcagtgttgcaactaaagaattgaccaaatcttttggatgggatacatatgattctttcatgcaacatgatgtgcaagaacttaatagagtcctgtgtgaaaagcttgaagacaaaatgaaggggactgttgtggaggggacaatacagcaattatttgagggacaccacatgaattacattgaatgcatcaatgtggactacaaatctacaagaaaagaatcattttatgacctccagcttgatgtcaaaggctgtcgggatgtttatgcttcttttgacaaatatgtggaagttgaacgtcttgagggcgataataaataccatgctgaagaacatggtttgcaggatgctaagaagggtgtcttgtttattgactttcccccagttcttcaacttcagctaaagcgatttgaatatgattttatgcgggacactatggttaagataaatgatcgctatgaatttcctcttcaacttgaccttgatagggagaatggaaaatatctgtcacctgatgcagatcggagtgttcgcaacctttacacacttcatagtgttttggtccatagtggtggggtgcatggtggacattactatgcttttatcaggccaaccctctcagatcagtggttcaaatttgatgatgagcgggtgacaaaggaggatgtgaagagggcactagaagagcagtatggtggtgaggaagagttgccaccgaccaatcctggcttcaataacactcccttcaaatttacaaaatactcaaatgcttacatgcttgtgtatatacgtgaaagtgacaaggacaaaataatatgtaatgttgatgagaaggatatagctgaacacctaaggataaggttgaagaaagaacaagaagagaaggaggacaagagaagatataaagcacaggcacacttgtatactatcataaaggtcgcacgagatgaggaccttgcagagcagattggaagggatatatattttgaccttgtggatcatgaaaaagttcataatttccgtattcagaaacagacacccttcaatcttttcaaggaggaggttgccaaagagtttggcataccagtgcaatgtcagcgattttggatttgggcaaagcggcaaaaccatacgtatcgtcccaatcgaccattgacacctcaggaggaagtacaatctgttggacagttgagggaggtgtcaaataagacacataatgcagaactaaggttgtttctggaagtagagcttggtctggatctacgtcctatccctcctcctgacaaaactaaagaagagattcttcttttcttcaagctttatgaccctgagaaaggggagctacgatatgttggtaggttctttgtgaagagttctggtaagcccatggaaatagtagaaaaacttaaccaaatggctggatttgcccctgaagaggagatacaactttacgaggaaataaagtttgacccctgtgtaatgtgcgagcaccttgataagaggacctcatttcgattaagtcagattgaagatggggacattatttgcttccagaaatcttccccacttgaaagcgcagaagaatgccgatacccagatgttccctcatttttggaatatgtgcacaatcgccaggttgttcattttcgatctttggagagaccgaaggaggatgatttttgtctagagctgtcgaaggtacacagttatgatgaggttgtggagagagtggcacggcgaattggtttggatgatccatcaaaaataagactcacatctcacaactgctattctcagcaacctaagccccaacctattaaatatcggggagtagagcatttatcagatatgctagtccattacaatcagacctctgatatattgtactatgaagttttggacatccccctgcctgaattgcaaggtcttaaaaatctgaaagttgcttttcatcatgctacaaaggatgaagtggtaattcacaacatcagattacctaaacagagcactgttggagatgtgattaatgtattaaaaacgaaggtagagttgtctcatccaaatgctgaaattagactacttgaggttttctatcacaagatctataagatctttccacacaatgaaaaaattgagaatataaatgaccaatactggacattgcgtgcagaggagatcccagaggaggagaaaaatcttgggccccatgatcgtttgattcacgtttatcacttcacgaaagagactgcacaaaaccaaatgcaagtacaaaattttggggaaccctttttcttagtcatacatgaaggcgagactttagcagaagttaaagggcgcatccaaaagaaattgcaggttccagatgaagagttttcaaagtggaagtttgcctttttgtcaatgggccgtccggagtacctgcaggactctgatgttgtatctagccgttttcagagaagagatgtttatggtgcttgggagcagtaccttggattggagcattctgataataccccaaagagggcttatgcagtacatcagaaccgtcacacatttgagaagccagttaaaatatacaactaggttagagctgatgatccttcaccagcacattagctatacagagcatccttcaatctctacatggaatggaaatggaggatcagaacaagttttacagttgaaggatacaagtgaagctcacattgagtttatttacgtcagattttgtaggctgtattattctttctccgacgtgggtggggaagggagaggtttttccttgatttagtgtatttatattgtttacgcacccttcttttgctctgcccttttttcttttctaaatgaaatcaccttccttcgtttgaggttggttgcttttccatatacagctctagtgtaatttagtagtacataagaagattttgactaggggatgtatattgggtacagttggttatttgatgttcttccctttcttgccatttttctcttccctttttgttttttaccgttgtgttggggatgggtttgtaaaatctttggttaaatcaccaagtctggtcgtaggaatgtgtaaaagaaatatactgctatcgatccttttctgtttgatctatgaattaatgaatcccttatattttcaaagtcttattgtggcca

SEQ ID NO: 2391 - DNA, 3872 bp, Prunus mume
ctctctctctcctcgaccagcttctggtgatcgccattttgcacttctcttactgcacctcctttactctctctctctctctctctctctctagtacctcgcggtgaggtattctcatatcccattccttagactcgttcagccatgactgtcatgacccccgcccctattgatcaaccagaggacgaggagatgctcgtcccgcactcggatttgcccgaaaacaatcaccaacccatggaagttgttgcacaacctgaaactgctaataatgtggagaaccagccagtggaggatcctccatcatcaagattcacgtggagaattgacaatttttctaggatgaatacaaagaagctttattcagatatatttgtcgttggtggctataaatggcgtgtgcttatttttcctaagggaaacaatgtagatcatttgtctatgtatttggatgttgcggattcagcaagtttgccatatggctggagtagatatgcacagttttgcttgggggtcgtcaatcaaattcataacaagtattcagtacgaaaagacacacagcatcagttcaatgcgcgagaaagtgattggggtttcacatccttcatgcctcttagtgatctttacgatcccagtagagggtatcttgtgcatgatacacttataattgaagctgaagttctcgttcgtagggttgtagattactggacatatgactcgaaaaaggagacaggttatgtggggcttaagaaccaaggagcaacttgctacatgaactctctcctccagactttgtatcatattccttatttcagaaaggctgtttaccatatgcccacaactgagaatgatttgccatcgcaaagcatacctttggccctgcagagtctattttacaagcttcagtacagtgacaatagtgtggcaacaaaagagctgacgaagtcttttggatgggacacgtatgattcatttatgcagcatgacgtacaagaactcaatagggttttgtgtgaaaaacttgaagacaaaatgaagggaactgttgtagagggaactatacagaagttgttcgaaggacaccatatgaactacattgaatgcatcaacgtggactacaaatcaacaagaaaggaatcattttatgaccttcagcttgatgtcaaaggttgtcgtgatgtatatgcttcttttgataagtacgtagaagttgaacgtctcgagggtgataacaagtatcatgctgaacagtatggattgcaggatgctaagaaaggtgttttgtttattgactttcccccggtgcttcaacttcagttgaaacgatttgagtacgactttatgcgggacacaatggtgaagattaatgatcgttatgagttcccattgcaacttgacctcgatcgagagaatggaaaatatttatcacctgaagctgataggagtgttcgtaacctttacacacttcacagtgttttggtacacagtggtggggtgcatggtgggcactattatgcctttatcaggccaacactttctgatcagtggtataaattcgatgatgagagggtcacaaaagaagatataaagagggcactagaggagcagtatggtggtgaggaagagttaccacagacaaaccctggattcaataacactcctttcaaatttacgaagtactcaaatgcgtacatgctggtgtacatacgtgaaagtgacaaagataaaataatctgcaatgtggatgagcaggacatcgctgaacatctaagggggaggttaaagaaagaacaagaagaaaaggaacacaagaagaaagaaaaggcagaggcacacctatatactattataaaggttgcccgggacgagaaccttgtcgagcagattgggaaggatatttattttgatcttgttgatcatgacaaagttagaagttttcgtatccagaagcagacgccttttaacgtatttaaggaggaggttgcgaaagagattggtataccagtgcaatttctgcgattttggttttgggcgaagcgtcaaaaccatacatatcgtcctaaccgtccattgacgcctgtggaggaaacacaatctgttggacagttgagggaggtatcaaacaaggttcataatgcagaactaaagttattcttagaagtagagcttgggctggatttacaccctatcgctccacctgacaagacaaaggatgacattctgcttttctttaagctttatgatccagaaaaagaagaactacgatatgttggaaggctttttgtgaagagtactggtaaggcagctgaaatattgtcaaaattaaatgaaatggctggctatgctcctgaggaagagattgacctttatgaggaaattaagtttgagccgaatgtcatgtgtgaacccatcgacaagaaattcacatttcgagcctgccagcttgaggatggagacattgtttgctttcagaagcccactccagttgaaaatggagaacatctccgctatccagatgtcccatcttttctggactatgtgcacaaccgtcaagttgttcacttccgatctcttgagaaacccaaagaagatgatttctccctagaattatcgaaactccatacctatgatgatgttgtggaacgagttgctcagcaacttggtttggatgatccatccaaaattaggcttacatcgcacaactgttactcacaacaacccaaaccccagccaattaagtatcggggggttgaacgcttgactgatatgctggtccactacaatcagacttcggatatattgtactatgaagtattggacatccctctgcccgaattacaaggtttgaaaactctgaaagtcgcattccatcatgctactaaggaagaagttgttattcataccataagactgccaaaacagagcactgtgggggatgtaattaatgaccttaaaactaaggttgaattgtctcatccagatgcagaacttaggttgcttgaagttttctatcacaagatttacaaggtttttcctcacagtgaaaagattgagaacataaatgatcaatactggacgttacgggccgaagaggttcctgacgaagagaaaaatcttggtcctaatgatcgtgtaattcatgtctaccatttcactaaagacacagctcagaaccaaatgcaaattcaaaactttggggaaccttttttcttggtcatacatgaaggtgaaactttggctgaaattaaagctcgagtacaaaagaaattacaggttgcggatgaggagtttgccaaggactctgacattgtgtctagtcggtttcagagaagagatgtttacggtgcttgggagcaatatcttgggctggaacactctgacagtgctcctaaaagagcgtatgcagctaatcagaatcgccacacatttgaaaagccagtaaaaatctacaactaggaaaatagttggatgaacgagttttcatcattccagagatgaattgggcaattctccccatcatctggttgtgaaagctggaaactggtgaaaattgactctgtataggcatccagtgaggttagcttttgaaaaggtttcaacaaggttcggtgaccggattttgttggctatatacttccttctcccagcgtgtggttggggaggacttttccctaaatcagtgtgtatcttcaaccattgatcaaagcccctcttgagcttttactacatatttatagagagcttcctctttgggtgggcatggcaatggccttcatcatcagttcaatgtaactttgacagtaaataaagaaagattcttgaactagtgaatgtatacagtacaggtatagtttggtgactcatttttccca

SEQ ID NO: 2392 - DNA, 4008 bp, Malus domestica
caaccagaggacgaggagatgcttgtcccacattcggatttgcccgaaaacaatcaccagcccatggaagttgttgcacaacctgaaactgctaataatgtggagaaccagccagtggaggatcctccatcatcaagattcacatggagaattgacaactttactaggatgaatacaaagaagcattattcagatgtatttgtagttggcagctacaaatggcgcgtgcttatttttccaaagggaaataatgtggatcatttgtccatgtatttggatgttgcggattcttcaagtttgccatatgggtggagcagatatgcacaatttagcttgggggttatcaatcaaattcataacaagtattcagtacgaaaagacacacaacatcagttcaatgcgcgggaaagtgattggggttttacatcctttatgcctctcagtgaactttacgatcccagtagagggtatcttgtgaatgatacgattatagttgaagccgaggttctcgttcgtagggttgtagattactggacatatgactcaaaaaaggagacaggttatgtggggcttaaaaaccaaggagcaacgtgctacatgaactccctcctccagactttgtatcatattccttatttcagaaaggctgtttaccatatgcccacaactgagaatgatttgccgtcacaaagcataccattggctcttcagagtctattttacaagctccagtacagtgacaacagtgtcgcaaccaaagagctgacaaagtcttttggatgggacacatatgattcatttatgcagcatgatgtacaagaactcaatagagttttgtgtgaaaaacttgaggataaaatgaagggaactgttgtagagggaactatacagaagttatttgaaggacaccatatgaactacattgaatgtatcaacgtggactacaaatctacaagaaaggaatcattttatgaccttcagcttgacgttaaaggctgtcgtgatgtttatgcttcttttgataagtatgttgaagtggaacgtcttgagggtgataacaagtatcatgctgaacattatggattacaggatgccaagaagggtgttctgttcattgacttcccccctgtgcttcaacttcaactgaaacgatttgagtacgacttcatgcgggacacaatggtgaagattaatgatcgttatgagttcccgttgcaacttgaccttgatcgagagaatggaaaatatttatcacctgaagctgataggagcgttcgcaacctttacacacttcacagtgttttggtgcatagtggtggggtgcacggtggacactattatgcctttatcaggccaacacttactgatctgtggtataaatttgacgatgagagggtaactaaagaagatataaagagggcactagaggagcagtatggtggtgaggaagagttaccgcagacaaaccctggatttaataatactcctttcaaattcacgaaatattcaaatgcatacatgctggtgtacatacgggaaagtgacagagataaaataatctgcaatgtggatgaaaaggacattgctgaacatctgagggagaggttaaagaaagaacaagaagaaaaggagcacaagaagaaagaaaaggcagaagcacacctgtatactattataaaggttgctcgggatgagaacctcatggagcaaattgggaaggatatttattttgatcttgtggatcatgacaaagttagaagttttcgtattcagaagcagactccttttaacatttttaaggaggaggttgcaaaagagtttggcataccagtgcaatttcagcgtttttggctgtgggcaaaacgtcaaaaccatacatatcgtcctaaccgtccattgacgcctatggaggaaacacaatctgttggacagttgagggaggtatcgaacaaggttcataatgcagaactaaagttattcttagaagtagagcttgggccggatttacaccatattgctccacctgacaaaacaaaggatgatatcctgcttttctttaagctttatgatccagaaaaagaagaactgcgatatgttggaagactttttgtgaagagcactggtaaggcagctgaaatcttgtcaaaattaaatgaaatggctggctatgctcccgaggaagagattgacctatatgaggaaatcaagtttgagcccactgtcatgtgtgaacccattgataagaaattcacatttcgagcctgccagcttgaggatggagacattgtctgctttcagaagccaacttcagttgaaattgaacatctccgctatcctgatgtcccatcttttctggaatatgtgcacaaccgtcaagttgttcacttccgatcccttgagaaacccaaggaagatgatttctccctagaactgtcaaaacttcatacctatgatgatgttgtggaacgagtagctcaacaacttggtttggacgatccatccaaacttaggcttacaccgcacaactgttactcacaacaacccaaaccccagccaattaagtatcgtggggttgaccacttgactgatatgctggtccactacaatcagacttcagatatactgtactatgaagtgttggacatccctctgcctgaattacaaggtttgaaaactctgaaagttgcattccatcttgctactaaggaagaagtggttattcacaccataagactgccaaaacagagcactgtgggggatgtaattaatgatcttaaaactaaggttgaattgtctcatccggatgcagaacttaggctgcttgaagttttctatcacaagatttacaaggtttttcctcacagtgaaaagattgagaacataaacgatcaatactggacattgcgagctgaagaggttcctgaggaagagaaaaatcttggtcctaatgatcgtgtaattcatgtgtaccatttcactaaagacacagctcagaaccaaatgcaaattcaaaactttggggaaccttttttcttggtcatacatgaaggcgaaactttggctgaagttaaagctcgagtgcaaaagaaattacaggttgcagatgaggagtttgctaagtggaagtttgcgtttctttccttaggtcgcccagaatatcttcaggactcggatattgtgtctagtcggtttcagagaagagatgtctatggtgcttgggagcaatatcttgggctggagcactctgacagtgctcctaaaagatcttatgcagctaatcagaatcgtcatatgtttgaaaagccagtaaaaatttacaactaggaaatagttggatgaatgaacttttcatcactccagagatgcgttggtaaattcttcgcatcatgtggcggtgaaagtgggaattggtgaagggtgatggtgcagccatccagtgatattagcttttgaaaaggtgtcaggcaagactttgtaggcagatttgttagctatttaattcttttcccagagttgttggggacgactcttcgtaaatcagtctgcaagcattgatcttaactgcagttttagacacaggcagttcgtcttttggtgtcatggcaatggactgcaccatcggttgaatgtgaaagtttgacagtaaataaacaagatttttgaactagtgaatgtatacgggtacagtttgagagctttttgcgtgtttctcttcgcgtttctgttcagtttaggtagcgaggtggacgggggtggtgtcgtgcgtgattagtcagttccaaacatgtttctggacttttgtaaaacagattttccttccaggcgctgccggtgaattgagggcagtaaatctctaccctgtgttttttgttatggaagccctgttctgatgttctgcaacagctgttttgcttgtagcaacctcttccgaatcctggaaccagcatcgttatcgtttgttgatttatccgctaacctcgcatttgaacgagggatttaaactttaaa

SEQ ID NO: 2393 - DNA, 4169 bp, Manihot esculenta
gcagagcccgctttcctttctccccccatctctctttctatttctatattttctctgtatttgtctcactgttcttctgttctttctcattatctgcttttgattcggtttcgatactcagattttccgatcaaacggcttcgccctttcgctatccatgactctgatgactccacctccgttagatcaagaagacgaggagatgctcgtgccgcattcagatttggttgagggtccacagcctatggaagtggctcaagtggattcagctagcactgtggataatcaagcggtggaggatcctccttccatgaaatttacatggacaattgagaatttctctaggttgaacactaagaagcactattctgatacattcctcgttggcagttataaatggcgaatactaatttttcccaagggaaacaatgtggaccacttgtctatgtatttggatgtagcagattctgccacattgccatatggatggagtagatatgcacaattcagtttggctgtagtcaatcaaattcataacaagtattcaattagaaaagacacacagcatcaattcaatgtaagagagagtgattggggtttcacatcatttatgcctcttagtgatctttatgatcctagtagaggataccttgtaaatgatacagttattgtggaagctgaagttgctgttcgtaagattctggattattggtcatatgactcaaaaaaagagactggatatgtaggattgaagaaccaaggagcaacatgttatatgaactctctcctgcagactctctaccacattccttattttagaaaggctgtgtaccacatgccaacaactgagaatgacatgcctacaggaagcattcctttggctctgcagagtttattctataagctgcaatataatgacaccagtgttgcaacaaaggaactgacaaaatcttttggatgggatacatatgattccttcatgcagcatgatgtacaagaactcaatagggttctatgtgagaagctagaagataagatgaagggaactgttgtggaggggacaatacagcagctttttgagggccatcacatgaattatatcgagtgcattaatgtagattataaatctacaagaaaagagtcatattatgatctccagcttgatgtgaaaggttgccgggatgtatatgcttcttttgacaagtatgtagaagttgaaagacttgagggtgataacaaataccacgctgaagaacatggtctgcaggatgctaagaagggtgtcttgtttattgactttcctcctgttcttcaacttcaactgaagaggtttgagtatgattttatgcgagacaccatggtgaagattaatgaccgctatgagtttcctcttcaacttgaccttgatagagagaatggaaaatatctatcgccggaagcagacaggagcgttcgtaacctttacacgcttcacagtgtcttggtccatagtggaggggtgcatggtggacattattatgctttcatcaggccaaccctttctgatcagtggttcaaatttgatgatgaacgggtgactaaggaggatatgaagagggcattagaagagcagtatggaggcgaggaagagcttccacagaccaatcctggctttaacaatgctccctttaagttcacaaaatactcaaatgcatacatgcttgtgtatatacgcgaaagtgacaaggacaatataatttgtaatgttgatgaaaaagacattgctgaacacctgagggttaggttgaaaaaagaacaagaggagaaggaagacaagagaagatataaagcacaagcccatctctataccattataaaggttgcacgagatgaggatcttaaagagcagattggaagggatatttattttgaccttgtggatcatgacaaagtccgtaatttccgtatccagaagcagacatcatttagtcattttaaggaagaggttgccaaagaatttggtgtaccagtacaacttcagcgattttggatatgggcaaagcgtcaaaatcatacatatcgtcccaatcgaccactaactgctcatgaggaagcgcaatcagttggacagctgagggaagtttcaaataaagcacacaatgcagaattgaagttgttcttggaagtagagtttggactggatttacgtcctattgctcctcctgaaaaaactaaagaagatattcttcttttcttcaagctttatgatcctgccaaaggagaattacgatatgttggtaggctttttgtgaagggttctggaaaaccaatggaaatcttggcaaagcttaaacaaatggctgttattgcatctgatgaagagattgaactttatgaggaaataaagtttgagccttgtgtcatgtgtgaacatcttgataaaaggacctcatttcgattaagtcagcttgaagatggagacataatttgctttcagaaaactcctcttgcgggtgaagaagattgccgatacccagatgtgccttcatttttggaatatgtgcacaatcggcagatagttcattttcggtctctcgagaaaccaaaagaggatgatttttgcctagagttgtcaaagctacatacttatgatgatgttgtggaaagagtagctcgccaaattggtttagatgatccatccaagatcaggttaacatctcacaactgctactcccagcagcctaagccccaaccaattaaatatcgaggagtggagcatctgtcagatatgttagttcactataaccagacatctgatattttatactatgaagttctggatatccctcttccagaattgcaaggtttgaaaaatctgaaagttgctttccatcatgctactaaagatgaggtggtaattcataatattagattacctaaacagagcactgtgggggatgtgattaatgaacttagaacaaaggtagagttgtctcacccaaatgcagaacttcgtcttcttgaagttttctatcacaagatttacaagatctttcctcataatgaaaaaattgaaaatataaatgaccagtactggacactgcgtgctgaggagattcctgaggaagagaaaagtcttggaccccatgatcgtttgattcatgtttatcactttacaaaggagacggctcagaatcaaatgcaagtacagaattttggggagccatttttcttggtcatccatgaaggtgaaactttagctgaagttaaatctcgcatacaaaagaaattgcaggttcctgatgaggaatttgctaagtggaaatttgcatttctgtcactaggtcgtccagaatatctgcaggattctgacatagtgtttacccgttttcagagaagagatgtttatggtgcttgggagcagtaccttgggttagagcattctgacaacacaccaaagaggtcttatgcagtaaaccagaaccgtcatacatttgagaagccagttaaaatatacaattagacgagctgatgatcctgcacctgcacttttaagtagaatcaacatccttaatgctatataatgttttatggagatgcggaggattgagtggtacatttgaaggaaggaaatgaatgaattgcaaagaacaaatgaaaaaggcgaaaaatgtagggggtaggcaattggttttgtaggatacatgctcccctttttatgcgggtgaggaaggggaggggttctcctttatgtagtgtggtttttatgtggatacaaccttttcttgagctcctcctcctaatgagggtacctccttgcttttggagattggtgggtttaccaattaacagctaccagtgtaatttagccaagtacataacaggattttgactaggggatgtataccgggtatagttggttgcgcttgacatttcaattcttttctcttcttatttgtcattatctccagtgaagggatggcgttgtaaaatggttgggttgaatttacagttgtgggctcaggatttcctgtaaaagaattgcattactatgctgtccacaggtttttatggcgcctcctttttctactgtttatgtagtgcatctcatttgttcttcaagagcctttaagctttgctgtttcccattagtttttatgatatgataaatagctaccagtttttagttc

SEQ ID NO: 2394 - DNA, 4415 bp, Citrus clementina
ccctctctctctctctcttttctcttcctcttgtcaccctcaccttacagtgtcccccgcttcccttctcttctcttctcttatattactctctcttttcattttcttccttcttacacaaattgacaatactgccattccgataaatctctcgcttctcgacttttcgatttcgcgatcggacggtcatgactatgatgactcctccaccgttagatcaagaagaggaggagatgcttgtgccgcattcggacatagtcgagggtcctcagccaatggaagtggtttcgcaagtggagccggctagtactgtggagaatcagcaagtggaagatcctcctacaatgaaattcacttggactatagagaatttctctagattgaataccaagaaacattattctgatgtatttgtcgttggcggttacaaatggcggatacttattttcccaaagggaaacaatgtggaccacttgtctatgtatttggatgttgccgactctggaacattgccatacggatggagtagatatgcacagtttagtctggctgtagttaaccaaattcattccaaatattcaatcagaaaggatactcaacatcaattcaatgcaagagagagtgattggggtttcacatcctttatgccacttggtgatctttatgaccctagtagaggatatttggtgaacgatagtgttgtcgttgaagctgaggttgctgttcgtaaagtcctggattattggtcatacgactcgaaaaaggagactggttatgttggacttaagaatcaaggagcaacctgttacatgaattctctcttgcagactttgtaccatataccttacttcagaaaagccgtgtaccacatgccgacaactgaaaatgatttgccttcaggaagcattcctttagctctgcagagtttattttataagcttcagtataatgacaccagcgttgcaacaaaggaattgaccaaatcatttggatgggatacatatgattctttcatgcaacatgatgtacaggaacttaatagggtcttgtgtgaaaaacttgaagacaaaatgaagggaactgttgtggaagggacaattcagcagttatttgaaggtcaccatatgaattatatcgagtgcataaatgtggactacaagtctacaagaaaggaatcattttatgacctccaacttgatgtcaaaggctgtagagatgtctatgcttcttttgacaagtatgttgaagttgagcgtctggagggtgataataaataccatgccgaagaacatggcttacaggatgccaagaagggagtcttatttattgattttccgcctgtgcttcaactccagttgaagcggtttgagtatgattttatgcgagatgctatggtgaagataaatgaccgctatgagtttcctcttcaacttgaccttgatagagagaatgggaagtatctatcaccagatgcagataggagtgtccgcaatctttacacgcttcacagtgtcttggttcacagcggaggggtacacggtgggcattattatgcttttatcaggccaacactctctgatcagtggtacaaatttgatgatgagcgggtaaccaaagaagatgtgaagagggctttggaagaacagtatggtggtgaagaagagttgccaccgaccaatcctggtttcaataacactccttttaagttcacaaaatactcaaatgcatacatgcttgtgtacatacgtgaaagtgataaggacaaaataatatgtaatgttgatgagaaggacattgctgaacacctgaggataaggttaaagaaagaacaggaagagaaggaggacaagagaagatataaagcacaagcccatctttacactatcatcaaggttgcacgagatgaggaccttgcagagcagattggaagggatatatattttgacctggtggatcatgacaaagttcgtagtttccgtgttcagaaacaaacgtcatttatggcttttaaggaggaaattgccaaagagtttggtataccaatacagcttcagcgtttttggatttgggcaaagcgtcaaaatcatacatatcgtcccaatagaccattgctaccccaggaggaagcacaaactgttggacaattgagagaggtttcaaataagacgcacaccgccgaactaaggttgttcttggaagtagagtttgggccggatctacatcctattgctccacctgataaatctaaagatgacattctgcttttcttcaagctttatgatcccgagaaaggagaacttcgatatgttggtaggctatttttaaagagttccagtaagccaatagaaattttgaggaagctaaatcaaatggctggctttgatcctgatgaagaaatagaactctatgaggaaatcaagtttgagccgtgtgttatgtgtgaacatcttgataagaggacctcattccggttaagtcagattgaagatggagatatcatctgctttcagaaatctcctccgctcgaaagtgaacaagaatgccgatatccagatgtgccttcatttttggaatacgtgcataaccggcagattgtccgttttcgagctttggacagaccaaaagaagatgctttttgtctagagttgtctaagcaacatagttatgatgaggttgtggaaagagtggctcgaaaaattggtttggatgatccatccaaaatcaggctcactcctcataactgctactcacagcaacctaagcctcaacccattaaatatcgaggagttgagcatctgtcagacatgttagtacactacaatcagacctctgacattttgtactacgaagttttagatattcctcttcccgaattgcaaggtttgaaaaatctgaaagttgcattccatcatgctaccaaggatgaggtggtaattcacaacattagattacccaaacagagcactgtaggtgatgtgattaatgaacttaaaacaaaggtggaattatcccatccaaatgcagaactaagattgcttgaagttttctatcacaagatatataagatctttgcccccaatgaaaaaatagagaatataaatgatcaatactggacccttcgtgcagaggagatcccagaggaagagaagaaccttggtcccaacgatcgcttgattcatgtttaccactttacgaaagagtctgcacagaatcaaatgcaagtacaaaattttggggaaccatttttcttggttatccatgaaggtgaaacattagccgaagttaaagagcgcatacaaaggaaattgcaagttcctgatgaggagttctctaagtggaagtttgctttcttatcactgggtcgtccagagtaccttgtggatactgacactgttttcaaccgttttcagagacgagacgtttatggtgcttgggaacagtaccttgggttggagcattctgataatgctcccaagagagcttattccgtaaatcagaaccggcacacatatgagaagcccgtcaaaatatacaactaatgcaagagcctatgatccaccaacacataagctgagaagaaaaaccttcaatgccttgatgtaattatgtaattgggcaggattgacaatgaacaaatgatggatttgaaggtacaaacaaggctcgccttgagatgtttctgtggggctccattgtttgtttgtgggctatatctgtttctttgattgatgtgggtgggcaagcagagattttagtagtgtgttctgtcattgtcaacacaacctgcatgagcaatctcttttgttttttcctggctttaggaagacaccttgcctccaggctttgagaggctggtggtttttatgtatacagctccagtgtaatttagcaagcagtatataagaagattttgacggggatgtatactgggtatagtttgttgcagctgatacttaattcttctttttttttccttttcgaccctgttccttctttctgagttgatttggtatcttcaggatgagcttgtaaaatggtcattttcagtctgcaattctgggcttagtacttaccagcagcagtgcagattgcaatttataacaccttgagcttaattacaagtagtcaggattcatcgtccttttttaaaataatagcgctattctctctatttgaatgcacttgcttatttattgctaagcattagctgatatgctgaacggaataattttagctgcattttttttttccgttagggcatttctaggtacttggtcctgttattttaatctaagtaatgaaattatattgtattaatttgtaagacccattctccgcttttgaacgtgcttaagaatgtggtttgtggtttgtggtggagctataacctattgtacaaatttaatttaagcaat

SEQ ID NO: 2395 - DNA, 4101 bp, Pinus taeda
gtaagtggttttgttattggaggtggttgacatccgcagagggcgatttgcatcaacagatataccctcaaaggcaatgacaatgatggcccctcctcctttagatcaggaagaggacgaaatgctggtcccgcatcccgagttcaatgacggggctcagcccatggaagggcaaggagagacggttagtaccgcggagaatcaacctccggacgatcctccttcctctcgatttacctgggctgtcgataatttttcgaggttaaatttgaagaagcattactcagaagttttcaccgtgggaggttacaaatggcgggtgctaatatttccgaagggaaacaatgtggatcacttatcgatgtacttggatgtggcggattctgctacattgccttatggttggagcagatatgcacagtttagcttggcggttgttaatcagattagccctaagtattccatccggaaagatacacaacatcagttcaatgcccgagagagtgactggggtttcacatcgtttatgccgcttggagatgtgtatgatcattcaaaaggttatctggtgaatgatactctcataatagaagcagacgttgttgttcgcagagtaattgattattggtcctatgactcaaagaaagaaacaggttatgttgggctcaagaatcaaggagcaacatgctacatgaactcacttcttcagacgttatatcatattccttacttcagaaaggccgtgtatcatatgcccacaactgaaaatgacatgccatctagcagcattccattggctttacagagtttgttttataagctccagtatagtgacaccagtgttgcgacaaaggagttaacgaaatcttttggatgggacacatatgattcttttatgcaacatgatgttcaggagttgaacagagtgttatctgagaagttagaagacaaaatgaaggggacagttgttgagggcacaatacagcaactgtttgagggccatcatatgaattatattgaatgcataaatgtagattacaagtcaacaaggaaagagtcattttatgatctgcagcttgatgtcaaaggttgtcgagatgtctatgcttcatttgataaatatgttgaagtggaacgccttgaaggggataataaatatcatgctgagcaatatggtttacaggatgcaaagaagggtgttcttttcattgattttcctcctgtactacaacttcaactgaagcgctttgaatatgacttcatgcgagacacaatggttaagataaatgatcgctatgagtttcctttgcaacttgatcttgatagagacgatgggaaatatctttctccagatgcagatagaagtgtccgcaatttatatactctccacagtgttttagtacacagcggaggtgttcatgggggccattactatgcttttatccgtccgactctttcagaccagtggttcaagtttgatgatgagcgtgtaacaaaggaagacataaagagggcactagaggagcaatatggcggggaggaagagctacctcagacaaatccaggtttcaacaacactccatttaagtttacaaaatactccaatgcttacatgcttgtttatatcagagagagtgacaaggataaaattatctgcaatgttgatgagaaggatatagcagagcatcttagggtaaggctaaagaaagagcaagaggagaaagagcacaaaagaaaagagaaggccgaggcacacctttataccatcataaaggttgctcgtgatgaagatcttgctgagcagattggaaaggacatattttttgatctcgttgaccatgacaaagttcgtagttttcggattcagaaacaaacaccatttactgttttcaaggaagaagtggcaaaggaatttggtatccctattcaatttcagcgtttctggttatgggcaaaacgacagaaccatacatatcgccccaacaggcctttgtcacaacttgaggagtcccaatctgttggccacttgagagaggcttctaacaaggcaaacaacgcagagttgaaactatttcttgaagtggaacttaccgtggatcttcgtccactaccactacctgaaaagacaaaggatgaaatactgctcttcttcaaactttatgaccctgagaaagaagaactccgttttgttggcaggagttttgtgaaggcagtgggcaagccaacagaaattttaagaagcttgaatgagatggctggtttttccccaaatgaagaaattgagctttttgaggaaataaagtttgaaccaaatgttatgtgtgagcatgttgacaagagacttacatttcgtggcagccaacttgaagatggagatattatctgctaccaaaaggttctttcaagggaagaagaggaacgctatagatatccagatgttccatcatttctggaatatgttcacaaccgacagattgttcattttcgttgcctggataagccaaaggaagatgaattttgtcttgaactatcaaaactctctacatatgatgatgttgtggagagagtcgcacagcaacttggactagatgatccttcgaaaatcagacttacatcacacaattgctattctcagcagcctaaaccccaagctatcaaatatcgtggcgtggatcacttatctgatatgctagttcattacaatcagtcttctgatatcttgtactatgaagtcttggacataccactgccagagttgcaaggcttaaaatcattaaaagtagcttttcatcattcaacaaaagatgaagtatctattcacagtatacgattgcccaaacaaagtactgttggggatgttattaatgagctgaggacaaaggttgagctgtcacaccctaccgctgaaattcgattgctcgaggtgttttatcacaaaatttacaagatttttccaccaactgaaaagattgagaacataaatgatcagtattggacattgcgagcagaggagatcccagaagaggagaagaatctaggccctcatgatcgtttaatccatgtttatcattttacaagagatgcattgcagaatcacatggtccaaaattttggagagcctttctttctggtcattcgggaaggtgaaactttatcagatgttaaggaaagaatccagaagaagttgcaggttcctgatgaagaattttccaaatggaagtttgcattcctctccttgggtcgcccagagtaccttcaggatacggatgttatttcgagtcgttttcagcggagagatgtttatggagcttgggagcaatatcttggattggagcattcagatagtgcacccaaacgatctcaccaaaccaaccagaatcgtcacacttttgaaaagcctgtaaagatatacaactgaaagaaaatctaaaacggtgatttctttatacttgcaatggaagagagagaattgtaccatttatagttgcctccattttgttagaaacttagatggtacttgggaaggtgaatgcagtcgtttatgatatagtgaagagaagtcagcatctctatatttgttgatgccatatctatggcttgtcaaagttatagaaaacaatgtcttgtttggttccccaattagagaactcagattcagatcagtgttagaccagcagatttttatagacgactgtattttcatgtcagagctgctgactggtggtgtccaattatttctttgattatattttaatgtcaaattaaaactctgcttaccatgccttgaaacatgctttccaatatccgggatgtggtcagcagcatagtttatggtattgattgcccaccccacagtgagcaactatgtaagcaaagttgtgcatagcacattttggggagtttctccaagctggtttcattttgtagggtcttctgagaccacttctcaattttgttgtaatgtaatgttacaatctggaaatttcagtcttgtatgaagaagctgcagattgtgacatatattgtttcccttttgaatgtattattgtattatttgtgatggaaaataggtatcatatattctgagcttgtcaaaaaaaa

SEQ ID NO: 2396 - DNA, 3984 bp, Citrus clementina
cctctccacccccatcttctggtgatctctatagcttcagtgtaatctttataattccttctttttgattcccctattcaattctcttattattcttccttttacaacaaaacgacgcgtcgtacactctcctcacaccatgactatcatgaccccagctccaatcgatcaacaagaggatgaggagatgctcgtcccacactctgatttggccgacaatcaccagcccatggaagttgttgctcaacctgaaactgccaatgctgtggagaataatcagccattggatgatcctccatcgtcaagatttacatggaggattgagaacttttctaggttgaatacgaaaaagcactattctgagattttcattgttggtggcttcaaatggcgtgtgcttatttttccaaaaggaaacaatgtggaccatctgtcaatgtatctagatgttgctgattcatcaagtttaccatatggttggagtagatatgcacagtttagcttggcagtgattaatcaaatccattcaaagtactcggtgagaaaagatacacaacaccaattcaatgctcgagaaagtgattggggttttacatcctttatgcctcttggtgaactctatgaccctaatagagggtatcttgtgaatgatacacttatagttgaagcagaggttattgtgcgtagggttgtggattactggtcatatgactcaaaaaaagagactggttatgttggacttaagaatcaaggggccacatgttacatgaactctcttctccaaactctatttcacattccttattttcggaaggctgtataccatatgcctacaacagaaaatgatatgccatctggtagcatcccattggctctgcagagtttgttttacaagctccaatacagcgacagcagtgttgcaaccaaggagctgaccaaatcttttggatgggacacatatgactccttcatgcaacatgatgtgcaagagcttaatcgagttctgtctgaaaaacttgaagataaaatgaagggaactgttgtagagggcaccatacaacagttgtttgaagggcaccacatgaactacattgagtgcatcaatgtagattacaagtcaacaagaaaagagtcattttatgaccttcagcttgacgtcaaaggctgtcgtgatgtttatgcttctttcgataaatatgtagaagttgaacgtcttgagggtgataacaagtatcatgccgagcaatatggattgcaggatgctaagaaaggtgtgttgttcattgactttccccctgtccttcaacttcagctaaagcgatttgaatatgattttatgcgggataccatggtgaagattaatgaccgttatgagttccctctgcaacttgaccttgatcgagagaatggcaagtatttgtcacctgatgctgacaggagtgttcgcaacctttacacacttcacagtgttttggttcacagtggcggggtgcatggtggtcattattatgcctttatcagaccgactctttctgatcagtggtataaatttgatgatgaaagggtaacaaaagaagatctgaaaagggcactagaagagcagtatggtggtgaagaggagttaccacagacaaatccgggatttaacaacactccttttaaatttaccaaatattcgaatgcatatatgctggtgtatatacgtgaaagtgacaaggacaagataatttgtaatgtggatgagcaggatattgcagaacaccttcgtgaaaggttgaaaaaagagcaagaagaaaaagaacacaagaagaaagagaaggcagaagcacacctttataccgttatcaaggttgcaagggatgatgaccttttggaacagattggaaaggatatctattttgatcttgtggatcatgacaaagttaggagttttcgtattcagaagcagatacctttcaaccttttcaaggaagaggttgccaaagagtttggtgttccggtgcaacttcagcgcttttggctgtgggcaaagcgtcaaaaccatacataccgtcctaataggccattgacacatctagaagaaacacaaactgttggacagttgagggaggtgtcaaataaggtccataatgcagaactgaagttattcttagaagtagaacgtggaccggatttacgccctattgctccacctgagaagacaaaggaagatattttgctcttcttcaagctttatgaccctgagaaagaagagctgcgttatgttggaaggctttttgtgaaaagtactggtaagccgatggaatatttgccaaaactaaatgaaatggctggttatgctcctgatgaagaaatcgatctatatgaggaaattaagtttgagcccagtgtaatgtgtgagcccatagaaaagagatgcacgtttcgagctagccagcttgaagatggagacattatttgctttcaaaaatctactccaattgaaggtgttggtaaatttcgctatccggaagtgccttcattcttggactatgtgcacaatcgccaagtggttcattttcggtctcttgaaaaacccaaggaagatgatttctgtctagagatgtcaaagctttatacttatgatgacgttgtagaaagagtagctcagcaactgggtttggatgatccatctaagatcaggcttacatcacacaactgttactttcagcaactaaacccccacccattaagtaccgtggggttgatcatttatctgacatgcgtgatccactacaaccagacttctgatgtattatattatgaagtattggacattccacttccagaattacaatgtctgaaaacactcaaagtcgcatttcatcatgctaccaaggatgaagtgagcgttcatactattagactaccaaagcagagtactgtaggggatgtgattaatgatcttaaaacaaaggtggaattgtcacatcctgatgcagaacttcgattgctggaagttttctatcataagatctataagatttttccacttaatgaaaagattgagaatataaatgatcaatactggacattaagggcagaagagattccagaagaagaaaaaaatctcggtccacatgatcgtctaattcatgtttatcactttacaaaagagacagctcagaaccagatgcaaattcagaacttcggtgaaccgtttttcttagttatacatgaaggtgagactctgcaagaaataaaagtgcgaatacagaggaaactgcaagttccagatgaagagtttgctaagtggaagtttgcattcctttctcttggtcgcccagaataccttcaggacacggacattgtttccagtcgttttcagagaagagatgtttatggtgcttgggagcaatatcttggattggaacactcagacagtgctcctaaaagggcatatgctgctaaccagaatcggcatacgtatgagaagccagttaaaatctacaattaggaaacatttgaagatgcatgaatttcattcatggcggtggattcagttggtaagcctcaacaccaattgatctgtaaaaatgggcaaaatgaaaagggatcgaggctataaaggtgaaaagggaaagcatatggttgttgactttattggggtattgtaattcttcttcagctagcatggattgggaggacatttcccctttagcaaatgtgtatctatctgcaagtgttgtcacagatatatttatagggtatagtgggtgatccttgttttcttttttttcccctttttaattaatccttgtttctttattttcctttttcatcatgtttgctttcctgatttttgttttcatgtagatggctgatcagccactgttgtgagcctgtttccacacagagagatatatatacatatttttttgtatacggaagtttacaggccctgcattttcaattgtcattagataatattagttgccttctatt

SEQ ID NO: 2397 - DNA, 3525 bp, Cucumis sativus
atgcttgttccgcactcggatttggcggagaataatcatcaacctatggaagttgttccacaatcggaaacaggaaacacagtagagaatcagcccgtcgaggatcccccatcgtcaagatttacatggagaattgataacttcacgaggctcaacataaagaagctatattctgaaatctttattgttggcggatacaaatggcgaattcttattttcccaaaaggaaacaatgtagatcatctgtctatgtatttggatgttgcggattctgcaagtttgccatatgggtggagcagatatgctcaattcagcttgggtgtcatcaatcaaatccataataaatattcagtgagaaaagatactcaacatcagttcaatgccagggaaagcgattggggcttcacgtcgttcatgcccctcagcgaactgtatgaccctacaagaggatatcttgttaatgataccttaatagttgaagctgaggtccttgttcgaagagtggtcgattattggacatatgattcaaagaaagagacaggttttgttggtcttaaaaatcaaggagcaacatgttatatgaattcacttcttcaaactctttaccacattccatatttccggaaggccgtgtaccatatgcctactacagaaaatgatatgccatctgcgagcatccctttagctctgcagagcttattttacaagcttcaatacagtgacagtagtgtagcaacaaaagaacttaccaaatcttttggatgggacacatatgattcttttatgcagcatgatgtccaggaactgaatagggttttatctgaaaaacttgaagataaaatgaagggaactgtcgtggagggaaccatacaaaaattgtttgaagggcatcatatgaattacattgaatgtataaacgtggactataagtcaacaagaaaggaatcgttttatgatcttcagctcgatgtcaagggctgtcgtgatgtgtatgcttcttttgacaagtatgtagaagtagaacgccttgagggtgataataagtatcatgctgaacagtatggattgcaggatgccaagaagggcgtattgttcattgacttcccccctgttcttcaactccagttaaaacgatttgagtatgacttcatgcgagacactatggtaaagatcaatgatcgatatgaatttccccttcaacttgaccttgatcgagaaaatgggaagtatttatcaccggaagctgataaaaccgtgcggaatctttacactctccatagtgtcttggttcacagtggtggggtgcatggtggacattattatgcctttatcaggccgaccctctccgagcaatggtacaaatttgatgatgagcgggtaacaaaagaagatgtaaaaagggcactagaggagcaatatggcggtgaggaagagttacctcagacgaatcctggtttcaacaacactccttttaagtttaccaaatactcaaatgcatacatgctcgtgtacatacgtgaaagtgacaaagacaaagtaatttgcaacgtggatgagaaggacattgccgaacatctcagggaaaggttaaagaaagagcaagaggaaaaagaacacaagaagaaagaaaaggcagaggcacacctctatactatcataaaggttgctagagatgaagatctagttgaacaaattggaaaagatatattttttgatcttgttgatcatgacaaagtacggagctttcgcatccagaagcaaatgccatttaaccttttcaaggaggaggtggctaaggaatttggtatacccatccagtttcagcgatattggttgtgggcaaagcgtcagaaccacacttaccgacccaaccgaccattgacacctatggaagaagcacaatccgttggacaattaagagaggtatcaaataaggttcacaacgctgagttgaagttattactggaggtggaatatggaccggattcccggcctattgctccaccagacaagacaaaagatgatatcctattgttttttaagctttatgagcctgagaaagaagagctgagatacgttggaaggctctttgtgaagggtaatgggaagccttttgaaatattgacgaaattgaatgaaatggctggttatgctcctgaagaagagattgaactttatgaggaaattaagtttgagccgaacattatgtgtgaacctattgacaagaaattcacatttcgagcaagtcagctggaagatggagatattgtttgctttcaaaagtcccctccagttgaaaatacagaacagtatcgttaccctgatgtcccctcatttttggagtatgtgcataaccgtcaagttgttcatttccgatccctagagaagccaaaggaagatgatttttgtctggaaatgtcaaaactttatacatatgatgaagtggtggaaagactagcccaacagcttggtgtagatgatccatcaaaaattagattaacgtcacataattgttactctcagcaacctaaaccgcagccaatcaaatatcgtggtgtggaacacttgtccgatatgctggttcattataatcagacgtcagatatattatactatgaagtattggacatccctcttccagagttacaaggtctgaaaactcttaaagtagcatttcatcatgcaactaaggatgaagtggttattcatacaattagattgccaaaacagagcaccgtagcggatgtgatcaatgatcttaaaacaaaggttgaattgtctcatccagatgcagagctcagattgcttgaagttttctaccataagatctacaaggtgtttcctcctaatgaaaagattgagaacattaatgatcaatattggactttgcgggcagaagagattccagaagaagagaaaaaccttggtccaaacgatcgcctaattcatgtgtaccatttcactaaagacaccgctcagaatcagatgcaaattcagaacttcggcgagccctttttcctagtcataaacgagggagagactctggccgatattaaattgagaatacagaagaagttacaggttccagatgaggaatttgccaagtggaaatttgcatttctttcactaggtcgtccagagtacctccaagacacagacattgtgtcaaatcgttttcagagaagagatgtttatggtgcgtgggagcaatatcttggactggagcacactgacaatgcacccaaacgagcttatacagcaaatcagaatcgtcatacgtttgagaagccagtaaaaatctacaattagtgaaaagaaagaagataaagacaaagagaagacatggctggggttggttgtgtctttgatagaggcaatttagtagatgagttggaaaagctaccacacatatggggttgttagattggtgagcactggagcaggattccatttagattctgttggccatttattctctagcaatgcgatggatatgggatattctatggattatggataacggat

SEQ ID NO: 2398 - DNA, 4414 bp, Citrus sinensis
ccctctctctctctctcttttctcttcctcttgtcaccctcaccttacagtgtccccccgcttcccttctcttctcttctcttatattactctgtcttttcattttcttccttcttacacaaattgacaatactgccattccgataaatctcctcgcttctcgacttttcgatttagcgatcggacggtcatgactatgatgactcctccaccgttagatcaagaagaggaggagatgcttgtgccgcattcggacatagtcgagggtcctcagccaatggaagtggtttcgcaagtggagccggctagtactgtggagaatcagcaagtggaagatcctcctacaatgaaattcacttggactatagagaatttctctagattgaataccaagaaacattattctgatgtatttgtcgttggcggttacaaatggcggatacttattttcccaaagggaaacaatgtggaccacttgtctatgtatttggatgttgccgactctggaacattgccatacggatggagtagatatgcacagtttagtctggctgtagttaaccaaattcattccaaatattcaatcagaaaggatactcaacatcaattcaatgcaagagagagtgattggggtttcacatcctttatgccacttggtgatctttatgaccctagtagaggatatttggtgaacgatagtgttgtcgttgaagctgaggttgctgttcgtaaagtcctggattattggtcatacgactcgaaaaaggagactggttatgttggacttaagaatcaaggagcaacctgttacatgaattctctcttgcagactttgtaccatataccttacttcagaaaagccgtgtaccacatgccgacaactgaaaatgatttgccttcaggaagcattcctttagctctgcagagtttattttataagcttcagtataatgacaccagcgttgcaacaaaggaattgaccaaatcatttggttgggatacatatgattctttcatgcaacatgatgtacaggaacttaatagggtcttgtgtgaaaaacttgaagacaaaatgaagggaactgttgtggaagggacaattcagcagttatttgaaggtcaccatatgaattatatcgagtgcataaatgtggactacaagtctacaagaaaggaatcattttatgacctccaacttgatgtcaaaggctgtagagatgtctatgcttcttttgacaagtatgttgaagttgagcgtctggagggtgataataaataccatgccgaagaacatggcttacaggatgccaagaagggagtcttatttattgattttcctcctgtgcttcaactccagttgaagcggtttgagtatgattttatgcgagatgctatggtgaagataaatgaccgctatgagtttcctcttcaacttgaccttgatagagagaatgggaagtatctatcaccagatgcagataggagtgtccgcaatctttacacgcttcacagtgtcttggttcacagcggaggggtacacggtgggcattattatgcttttatcaggccaacactctctgatcagtggtacaaatttgatgatgagcgggtaaccaaagaagatgtgaagagggctttggaagaacagtatggtggtgaagaagagttgccaccgaccaatcctggtttcaataacactccttttaagttcacaaaatactcaaatgcatacatgcttgtgtacatacgtgaaagtgataaggacaaaataatatgtaatgttgatgagaaggacattgctgaacacctgaggataaggttaaagaaagaacaggaagagaaggaggacaagagaagatataaagcacaagcccatctttacactatcatcaaggttgcacgagatgaggaccttgcagagcagattggaagggatatatattttgacctggtggatcatgacaaagttcgtagtttccgtgttcagaaacaaacgtcatttatggcttttaaggaggaaattgccaaagagtttggtataccaatacagcttcagcgtttttggatttgggcaaagcgtcaaaatcatacatatcgtcccaatagaccattgctaccccaggaggaagcacaaactgttggacaattgagagaggtttcaaataagacgcacaccgccgaactaaggttgttcttggaagtagagtttgggccggatctacatcctattgctccacctgataaatctaaagatgacattctgcttttcttcaagctttatgatcccgagaaaggagaacttcgatatgttggtaggctttttttaaagagttccagtaagccaatagaaattttgaggaagctaaatcaaatggctggctttgatcctgatgaagaaatagaactctatgaggaaatcaagtttgagccgtgtgttatgtgtgaacatcttgataagaggacctcattccggttaagtcagattgaagatggagatatcatctgctttcagaaatctcctccgctcgaaagtgaacaagaatgccgatatccagatgtgccttcatttttggaatacgtgcataaccggcagattgtccgttttcgagctttggacagaccaaaagaagatgctttttgtctagagttgtctaagcaacatagttatgatgaggtcgtggaaagagtggctcgaaaaattggtttggatgatccatccaaaatcaggctcactcctcataactgctactcacagcaacctaagcctcaacccattaaatatcgaggagttgagcatctgtcagacatgttagtacactacaatcagacctctgacattttgtactacgaagttttagatattcctcttcctgaattgcaaggtttgaaaaatctgaaagttgcattccatcatgctaccaaggatgaggtggtaattcacaacattagattacccaaacagagcactgtaggtgatgtgattaatgaacttaaaacaaaggtggaattatcccatccaaatgcagaactaagattgcttgaagttttctatcacaagatatataagatctttgcccccaatgaaaaaatagagaatataaatgatcaatactggacccttcgtgcagaggagatcccggaggaagagaagaaccttggtcccaacgatcgcttgattcatgtttaccactttacgaaagagtctgcacagaatcaaatgcaagtacaaaattttggggaaccatttttcttggttatccatgaaggtgaaacattagccgaagttaaagagcgcatacaaaggaaattgcaagttcttgatgaggagttctctaagtggaagtttgctttcttatcactgggtcgtccagagtaccttgtggatactgacactgttttcaaccgttttcagagacgagacgtttatggtgcttgggaacagtaccttgggctggagcattctgataatgctcccaagagagcttattccgtaaatcagaaccggcacacatatgagaagcccgtcaaaatatacaactaatgcaagagcctatgatccacctacacataagctgagaagaaaaaccttcaatgccttgatgtaattatgtaattgggcaggattgacaatgaacaaatgatggatttgaaggtacaaacaaggctcgccttgagatgtttctgtggggctccattgtttgtttgtgggctatatctgtttctttgattgatgtgggtgggcaagcagagattttagtagtgtgttctgtcattgtcaacacaacctgcatgagcaatctcttttgttttttcctggctttaggaagacaccttgcctccatgctttgagaggctggtggtttttatgtatacagctccagtgtaatttagcaagcagtatataagaagattttgacggggatgtatactgggtatagtttgttgcagctgatacttaattcttctttttttttccttttcgaccctgttccttctttctgagttgatttggtatcttcaggatgagcttgtaaaatggtcattttcagtctgcaattctgggcttagtacttaccagcagcagtgcagattgcaatttataacaccttcttgagcttaattacaagtagtcaggattcatcgtccttttttacaataatagtgctattctctctatttgaatgcacttgcttatttattgctaagcattagctgatatgctgaacggaatagttttagctgcattttttttttcccgttagggcatttctaggtacttggtcctgttattttaatctaagtaatgaaactatattgtattaatttgtaagatccgttctccgcttttgaacgtgcttaagaatgtggtttgtggtggagctataacctattgtacaaatttaatttaagcaat

SEQ ID NO: 2399 - DNA, 3727 bp, Aquilegia formosa
atgactgtgatgactccaccaccgccaatagatcaagaagatgaagatatgttggttcctcactctgatttggttgaaggtcctcaaccaatggaagctcaagcagacactgctgttagtactgtagagaatcagccagtggaagatcctgcatcttctaggtttacttggcagattgagaatttttctaggttgaacaccaagaagcattattcggaggtttttatcgttggtggttataaatggcgggtgctgattttccctaaaggaaacaatgtagatcatttgtcaatgtacttagatgttgctgattcagctaatttgccttatgggtggagtagatttgctcagttcagtttggcagtcgttaatcaagggtccaaccgctacactgtccgaaaagacacacaacaccaatttaacgttcgcgagagtgattggggtttcacatcgttcatgcctcttagtgaattgtatgacattagtaaagggtttctccataatgatacattagttattgaagcagaggttgccgttcgtaaagttgtggattactggtcatatgactcgaaaaaggaaactggttacgttggacttaagaaccaaggagcaacctgctacatgaactccttacttcagactctgtatcatattccttactttcgaaaggctgtttaccatatgccaacaacagaaaatgatatgccatcaggaagcatccctcttgctttgcagagcttgttctataagctccaatacagtgacaacagtgttgcaacaaaagagcttaccaaatcttttggttgggatacatacgattctttcatgcagcatgatgtgcaagaacttaatagggttctttgtgaaaagctcgaagttaaaatgaagggaactgttgtggagggtaccatacaacaattatttgagggacatcacatgaattacattgaatgcatcaacgtagactacaaatccaccagaaaggagtcattttatgaccttcagcttgatgtcaaaggctgtcgagatgtttatgcttctttcgataagtatgttgaagttgagcgtcttgaaggtgataacaagtaccatgcggaacaacatggtctacaggatgctaagaagggtgtcctcttcattgatttcccacccgttcttcaacttcagctaaaacgatttgaatatgatttcatgcgggatacgatggtgaagataaatgatcgatatgagtttcccttgcaacttgaccttgacagagagaatagaaaatatttatcgccagatgcggatagcagagttcggaacctttatacgctacacagtgttttggttcatagcggtggtgtgcatggtggacactattatgcttttatcaggccaacactctctgaccagtggttaaaatttgatgatgagcgagtaacgaaagaggatatgaagagggcattagaggaacagtatggtggggaggaagagctacctcagacaaatcctgggttcaacaacactccatttaaatttacaaaatactcaaatgcatacatgcttgtctatatacgtgacagtgacaaggataaaataatttgtaatgtagacgaacaagacattgctgaacacctcagggttaggttgaagaaggaacaagaagagaaggaacacaagaaaaaggaaaaagcagaagctcacctttataccattataaaggttgctcggaatgaagaccttgccgaacagattggaagagatatatattttgatctcgtggatcatgataaagttcgcagttttcgtatacaaaagcagacggctttcaatgttttcaaggaagaagttgcaaaggagtttggtataccagtacagtatcaacgtttttggctgtgggctaagcgtcaaaaccatacctatcggcccaacagaccattgacccctcaggaggagacacaatctgttggaatgttgagggaagtatcaaataaggctcacaatgcagaactaaagttgttcttagaagtagaacttggacaggatttgcttcccattgagcctcctgagaagaccaaagaggatatattgcttttctttaaactttatgaccctgtgaaagaagagcttcgttatattggaagaatttttgtgaagggtagtggtaagccatccgaaattttgacaaagctaaatgaaatggctggtttcccatctaatcaagaaattgaactttatgaggaaataaagttcgagccaagtgtcatgtgtgaacacatcgacaagaaggtttcgtttcgatctagccagcttgaagacggggacatagtatgttttcagaaatcccctccagttgaaagtgggcaacaatgccgttaccctgatgttccttcgtttctagaatatgtacataatcgccaggttgttcatttccggtctctggagaagccaaaggaagacgatttttgtttagagctatcaaaacttttcaattatgacgaggttgtggaaagagttgctcgccaacttggtcttgatgatccatcaaaaatcaggctaacaccgcacaactgttactctcagcaaccgaaaccagctcctatcaaatacaggggtatggagcatttgtcagagatgctggtccactataatcagacttcagatattttgtactatgaagtattggacatttctctaccagaattgcaatggttaaaaactctgaaggttgcctatcatcatgccacaaaagaagatgttgtgattcacagtattagactgccaaagcacagcactgtcggtgacgtgcttcttcacctgaaatctaaggttgaactatctcatcctgatgcagagcttaggttgcttgaagtattttatcataagatctacaagattttcccaactagtgaaaagattgagaatataaatgaccagtactggacattacgtgcagaggagattccagaggaagaaaaaaaccttggtctcaatgatcgcctgattcacgtttaccatttcactaaagatacctctcagaatcagatgcaggttcagaattttggagaaccattcttttttatcattcacgagggtgagaccttggctgaagttaaagggcgcattcagaagaagttgcaagtttcagatgaagagttttctaagtggaagttcgcgtttttgtcattgggtcgccccgaataccttctggatagtgatattgtgtctagtcgtttccagagaagagatgtctatggtgcatgggagcaatatcttggattggagcactcggatagtgctccaaaaagggcatatgcagccaatcagaatcgtcatacatttgagaagccggtaaaaatctacaactgaaatgcgagctggtgaacccccaccttatcgttggttgtacccccgtggcgcggatgtgatataattataattggcgaggaagaaattatcaagttgtaaccacatccaaaggttaaaatgaggctggtattgggggtgttgtccagaaggttggggtattggttgtgggctttgtattctttgccatgtgaatggagaagtagacgcttttttgtttttctaattgcagtgtgtttcttctaccaatgacgacaaccccctcgtgagcttttccttcagttctttattatgaaggccgcttcttgggtgagagattggtcgcttttatccatctgtaatttagaacatcagggattttggattgtagggagtgtat

SEQ ID NO: 2400 - DNA, 4024 bp, Musa acuminata
atgactatgatgactccgccccctctcgacgtaccgctgatctttgtgcctctatttttgcagcaggaggacgaggagatgctggtcccgcaccaagagttccccgagggaccccagcccatggaagttataccgaatgagatgggcaccgcgccggagagtcagcaagtggaggatccaccttcgttcaaatttagatggaccatcgagaacttctccaggttgaacattaagaagctttactctgacattttctacgtcggaggatacaagtggcgggtgctaattttccccaagggaaataatgtagaccacttgtccatatacctggatgttgctgattcagccactttgccatatggttggagtagatatgcacagtttgcactcgccgtcgttaatcaaattcacagcaagtacacaataagaaaagatacgcaacaccaatttaattcacgtgaaagtgactggggattcacttcatttatgtctctgagtgaactctatgatccgagtagaggatatcttgtcaatgatacatgtgtaattgaagctgaagttgttgtccgtagggtggtagactactggagttatgactcgaaaaaggaaacgggctttgttggtcttaagaaccaaggagctacttgttacatgaactctcttcttcagactttgtatcatattccatatttcagaaaggctgtttatcatatgccaacaacagagaatgatatgccatctggaagcattccgttggctctgcagagcctgttctataagcttcagtacagtgacaacagtgttgctacaaaagagctgacaaagtcgtttggctgggacacatatgattcttttatgcaacatgacgtccaggaactcaacagggttctttgtgaaaaattggaagacaagatgaagggtactgttgttgagggcacaatccagcatttatttgagggacatcatatgaactatattgaatgcattaatgttgactacaaatccacgagaaaggagtcgttctatgacctacagttagatgtaaagggttgtcgagatgtttatgcatcatttgataagtatgtagaagtcgagcggctggagggtgataacaaatatcatgctgaaaatcatggcttacaggatgctaagaaaggtgttctatttattgatttcccccctgttttgcaactccagctcaagcgttttgaatacgatttcatgcgggatacaatggtgaagataaatgaccgttatgagttcccacttcagctagacctcgatagtgacaatggcaaatatctttctccagaagcagacaggagggttcgtaatctctatactcttcacagtgttcttgttcacagtggtggggtgcacggaggacattactatgctttcatccgaccaactctatcggatcagtggtttaagttcgatgatgagcgagtgacaaaggaagacgctaaaagggcactagaggagcagtatggtggtgaagaagagttgcctcagacaaatcccggcttcaataacactccatttaaatttaccaaatattcaaatgcttacatgcttgtgtacattcgtgagagcgacaaggagaaaattatgtgtgatgtggatgagaaagacatagcagagcacctaagaataagattgaagaaagaacaagaagagaaggagaacaaaaagaaggagaaggctgaggctcatctttataccatcataaaggttgctcggaatgaggatttggcagaacagattggaaaggaaatatttttcgatctagtagaccatgacaaagttcggaactttcgtgtccagaaacaactgccattcagccattttaaggaggaagtggccaaagaatttggtataccggtgcagtttcatcgcttttggctgtgggccaagcggcaaaaccacacataccgccccaatcggcctttaacacctcaggaggaagcacagcctgttggacagcttagagaggtatcaaataaggcacataatgctgaactgaagctattcttggaagtagagctggggccggatctttgccctgttcctccaccatcaaagaccaaggaagagatacttctttttttcaagctctatgaccctgaaaaagaagaactgagatttgtaggaaggctgttcctgaagtctttaggaaagccaattgaagtactgacaaaattgaatgaaatggctggtttccctccaaatgaagaaattgaactttatgaggttggtttttcatttgaagtactgatattgtttctagcaaatctttatataacaaggaaaaaaaaggtctcacaagaaataaagtttgagccaaatgtaatgtgtgaacacatcgacaagcggatctcttttcgatctagccagattgaagatggagacatcatttgctatcaaagagcttcagcattaggaaatgaagaccaatatcggtaccctgatgttccttctttcttggagtacgttcataatcgccaggttgttcacttccggtcattggagaagccaaaggaggatgatttttctttagaattgtcaaaaatgtttacttacgatgatgttgttgaaagagttgctcatcaacttggagtggatgatccatcaaaaattcgtcttacatcacacaactgctattctcagcagcccaaaccccaacccatcaagtaccgaggtgtggatcatctttcggacatgctggttcactataaccagacttctgatatattatattatgaggtattggatattcctctgcccgaattgcaaggtttaaaaactctaaaggttgcattccaccatgccacaaaggatgaggttgcagttcacagcatcagacttccaaaaaatagtactgtagctgatgtaattaatgacctgaggacaaaggttgagctttctcatcctgatgctgaactcaggttgcttgaggtcttctatcacaagatctataagatctttccacctggtgaaaagatagaaaatattaatgaccaatattggactttacgtgcagaggagattccagaagaggagaaaaaccttagtcctcatgatcgtttgattcatgtttaccacttcactaaagatcctaatcagaatcaaacgcaagttcaaaactttggggagccattcttcatggttattcgggaaggcgagactttagctgatgtaaaaatacgcattcaaaagaaactgcaagttccagaagaagatttctcaaagtggcagttagcatttgtagcacttgggcgccctgaatacctccaggattcagatatagtgtccaatagatttcagaggagagacatttatggagcctgggagcagtaccttggactcgagcactctgacactgctccaaaaagggcttatacagctaatcagaaccgccacacatttgagaagcctgtgaaaatttacaattgaaaggtggctcatggctggatctcccatggcattcaatctgtcacctcactatcgcatggacagatgatgaaacttgagcttttaaccacaaatgcaccatggtgaggtggaattaaggggattcaccaccaagtttattgttgtggtgtaatatgtgtgtcaacgttagccaggaccgacacgggagaatatgcttgatcactagctctctcaatggcaccacctcgtttgataagttgtggttttctgatcaggccctctgccagatttccttctctttgagcccgtataatttagtacatgagattttggactagaagggtatatatagggaatagttggtgtccttgacattattattattattattattttttgggtttatccctgcctcgggtatggctccatatttttcttcctttatcctggcctataaaaacctagggctgtaaaatgggatggtttgatgtaactggctggctttccgagagcaccggatcctgtaaaagaaatgcctgtgttgggaacttatcttcatatatttcaatcttgtatacattttttcgtg

SEQ ID NO: 2401 - DNA, 4022 bp, Ricinus communis
tctctgtatagctagttccttcgcaagtgtctctccttgcagagcccgctttcgcttctctcccattttatttatccctctaactcactgtttcctgttgtaattttattttcgattatctgctttcgattctcagatttgccgatcgaacggcctatatcgcttcactcatgactatgatgactcctccaccgttagatcaagaagacgaagagatgctcgtgccacattcagatttggttgaaggtccacagcctatggaagtggcacaagtcgaaccagctagtactgtggagaatcaacctgtggaggatcctccgtctatgaaattcacatggacaattgagaatttctctaggctgaacacaaagaagcactattctgatgtattcgttgttggcggctacaaatggcggatactgatttttcccaagggtaacaatgtggaccacttgtctatgtatttggatgtttcagattcgtctaccttgccatatggatggagtagatatgcacaattcagcttggctgtggttaatcaaatccataataagtactcaattaggaaagatacacaacatcaattcaatgcaagagagagtgactggggtttcacatcatttatgccccttagtgatctctatgatcctagtagaggatatcttgtgaatgatacagttattgttgaagctgaagttgctgttcgcaaggttctggattattggtcatacgactccaaaaaggagactggttatgtgggattgaaaaaccaaggagcgacatgttacatgaactctctcttgcagactctttaccatattccttactttagaaaggctgtctaccacatgccgacaaccgagaatgacatgcctacaggaagcattcctttggctctgcaaagtttattctataagcttcaatataatgacaccagtgttgctacaaaagaattaaccaaatcttttggatgggatacatacgattccttcatgcaacatgacgtgcaagaacttaatagggtcctgtgcgagaagctagaagataagatgaagggaactgttgtggaggggacgatacagcagttatttgagggccaccatatgaattacattgagtgcatcaatgttgattataaatccacaaggaaggagtcattttatgatctccagcttgatgtgaaaggttgtcgggatgtttatgcttcctttgacaagtatgttgaagttgaacgacttgagggtgataataaataccatgccgaagaacatggtctgcaggatgctaagaagggtgtcttgtttattgatttcccccctgtacttcaactccaattaaagcggttcgagtatgactttatgcgagacactatggtgaagatcaatgatcgttatgagttccctcttcaacttgaccttgatagagagaatggaaaatatttatcaccagaagcagaccggagtgttcgtaatctttacacacttcacagtgtcttggttcatagtggaggagtgcatggtggacattattatgcttttatccgaccaactctttctgaccagtggttcaaatttgatgatgagcgggtgacaaaagaggatatgaaaagggcgttagaagagcagtatggtggcgaggaggagctacaacagaccaatcctggttttaataatgctccatttaagttcacaaaatactcaaatgcatacatgcttgtatatattcgtgaaagtgacaaagacaagatcatttgtaatgttgatgaaaaagacattgctgaacacctgaggattaggttgaagaaagaacaagaagagaaggaagataagagaagatataaagcacaagcccacctctataccatcataaaggtggcacgggatgaggatctcaaagagcagattggaagggacatatattttgaccttgtggatcatgataaagtccgtaatttccgtatccagaagcagacaccttttaatttttttaaggaggaggttgcaaaagaatttggaataccagtacaatttcagcgattttggatatgggcaaagcgtcaaaatcatacatatcgtcccaatcgaccactgacaccccaggaggaagcacaatcagttggacaactgagggaggcgtcaaataaagcacacagtgcagaattgaagttgttcttggaagtagagcttgggctggatttacgacccattgctcctcctgacaaaactaaagaagatattcttcttttcttcaagctttatgttcctgagaaaggagaattacggtacattggcagactatttgtgaagagttctggtaagcctatagaaattttggcaaagcttaatgaaatggctggttttgcaactgatgaagagattgaactatatgaggagataaagtttgagccctgcgtaatgtgtgaacacctagacaagaggacctcatttcgattaagtcagattgaggatggggacattatttgctttcagaaatctcctcctcttgaggttgaagaagattgcaaatacccagatgtgccttcatttttggaatatgtgcacaatcggcaagtagttcattttcgatctctggagaaaccaaaggaggatgatttttgtctagagttgtcgaagctacacacttatgatgatgttgtggaaaaagtggctcaacaaattggtttagatgatccatccaaaattaggttaacatcacacaactgctattctcagcagccgaagccccaaccaattaaatatcgaggagttgagcatctatcggatatgttagttcattacaatcagacatctgacattttgtattatgaagttctggacattcctcttccagaattgcaaggtctcaaaaatctgaaagttgctttccatcatgccactaaagacgaggtggtaattcataatattcgattgcctaaacagagcactgtaggggatgtaattaatgaactcaaagcaaaggtagagttgtctcacccgaatgcagaacttcgacttcttgaagttttctatcacaagatttacaagatctttcctccaaatgaaaaaatcgagaatataaatgatcagtactggacattgcgagcagaggaggtcccagaagaagagaagaatcttggtcctcatgatcgcttgattcatgtttaccactttgcgaaggagactgctcagaatcagctgcaagtgcagaattttggtgaaccatttttcttggtcatccatgaaggtgaaactttatctgatgttaaagtgcgcatacagaacaagttacaggttccagatgaggaatttgctaaatggaaatttgcatttttatcactaggtcgtccagagtacttgcaggattccgacatagtgttcacccgttttcagaggagagatgtctatggtgcttgggagcagtaccttgggttagagcattctgacaacacacctaagaggtcatatgcagtaaaccagggaagagctgatgatcctccacctgcacgttatgttgaatttgggaccacgccataatttatttcagaaattcagaagacaaatgagcggcattctgaagggagcaaatgaagctcgaaaagtgaaagtgatctgtagggttaggtggggaaggggagaggatgtgtatcgtgcttttattgttgatacaactgtgcttgggctcctcttctttgcttgcctcgtacatcgcatttagagactggtggttttaccaatatacagctccagtgtaatttagcagtacataacaggattttgactaggggatgtataccgggtatagttggttgcgtttgatcttttctattgttttgctttttatctgccgttgtcttttggggaagggggatgatgggcttgtaaaatcttgggatatcatggattcgtgtaaaggagttgtaatgcttcacagtccagattggctttttttttttttaacaacgcctccacttgctctacagaatgctggttcccatttgttttcatagatcttgttcaaaaaaa

SEQ ID NO: 2402 - DNA, 4259 bp, Fragaria vesca
aagccccgctttggctttccccttctctctaaatctctctctctttctctctcttctctctctctctcacagtttttcactgtttcgattcgactctcagatttgtggatcggtccattgctcagcatccatgactatgatgactcctccacctgtagatcaagaggacgaagagatgctggtgccgtctacggatgtggtcgtcgaaggtcctcagcccatggaagtagctcaagtggagccggctagtacagttgataatcagcctgtggaggagcctccaaccatgaaattcacttggacaattgagaacttttctagattgaacaccaaaaagcactactctgacatgttcatcgtcggtggttataaatggcggatactgattttccctaaaggaaacaatgtggactacttgtcaatgtatttggatgtggcggattcgcaggcgctgccttatggttggagtagatatgcgcagttcagcttggcgatagtgaatcagattcacaacaagtactcaattagaaaggatacacagcaccaattcaatgcacgagaaagtgattggggattcacatcattcatgcctctcggtgatctttatgaccccggtaggggttacctggtgaatgatacagtcgttgttgaagccgaggttgttgtccgtaaagtccttgattactggtcgtatgactcgaaaaaggaaaccggttatgttgggctcaagaatcagggagcaacttgttatatgaattcacttctccagactttataccatataccttacttcagaaaggctgtgtatcatatgccaacaactgagaatgacatgccttcaggaagcattcctttggctcttcaaagtttattctataagcttcaatacaacgaaagcagtgttgcaactaaagaactaaccaagtcttttggatgggatacatatgattcgtttatgcaacatgatgtgcaggaactcaatagagttctatgtgaaaagcttgaggacaaaatgaagggaactgtggtggagggtacaatacagcagttatttgaaggacatcacatgaattacattgaatgcatcaatgtggactacaaatctacaagaaaggagtcattttatgatctccagcttgatgtaaaaggatgtcgtgatgtttacgcttcttttgataagtatgtggaagttgaacgtcttgagggtgacaataagtaccatgctgaagaacatggtttgcaggatgctaagaagggtgtcctgtttattgacttccctccagttcttcagcttcagctaaagcgatttgagtatgattttatgagggacactatggtaaagataaatgatcgttatgaatttcctcttcaacttgaccttgatagggagaatggcaaatatttgtcaccggaatcagataagagtgtgcggaacctctacactcttcatagtgtcctggttcatagtggtggcgtgcatggaggacattactatgctttcatcaggccaacccttactgatcagtggtataagtttgatgatgaacgtgtgacaaaagaggatgtgaagagggcattagaagaacagtatggtggcgaggaagagatgccgcagactaatcctggttttaataatactcctttcaagtttacaaagtactcgaatgcgtacatgcttgtgtatattcgggatagtgacaaggacaaaataatatgtgatgtggatgagaaggacatagctgaacatctaagggtaaggttgaagaaagaacaagaggagaaggaggacaagaggagatataaagcacaggcccatctttatactattatcaaggttgctcgagacgaggacctggcagaacaaatcggaagggacatatattttgaccttgtggaccatgacaaagttcgtagttttcgaatccagaaacagacaccctttaaccttttcaaggaggaagttgcgaaagagttgggaataccagtacaatttcagcgattctggatttgggcaaagcggcaaaaccacacatatcggcccaaccgaccattgacaccccaggaagaattacaaacagttggacaattgagggaggcatcaaataaaacacacaatgcagagctaaagttgtttctggaagtagagcttgggccggagcaagttcctatccctccaccggacaaaaccaaggatgatattctacttttctttaagctctatgaacctgagaaacgagaattacggtttgttggtcggctttttgtgaagagttctaccaagccaatagaaataatagcaaaaattaatcaaatggctggttttgctcctgatgaagaaatagaactctatgaggaaataaagtttgagccttgtatcatgtgtgaacatcttgacaagaggacctcatttcgattaagtcagattgaagatggtgacattatatgctttcaaaaacctactccactagaaagtgaagaatgtaaatatcctgatgtaccttcatttttggaatatgtacacaaccgtcagattgttcattttcgctctttggagaaaccaaaagaagatgatttttctttagaattgtctaagctacacacttatgatgatgtggtggagaaggtggcttcccaaattggtttggacgatcctacgaaaatcagactcactgcgcataactgctattctcagcaacctaaaccccaacccatcaaatatcgaggagtagagcatttaacagatatgctagtccactataatcaaagttctgatattttgtattatgaagtcttggacatccccctgccagaattacaaggccttaaaaatctgaaagttgcatttcatcatgctacaaaagatgaggtggtgattcacaatataagattgcccaagcaaagcaccgttggggatgtgattaatgtactaaaaacgaaggtagagctatctcaaccaaatgcagaacttcggcttcttgaggtgttctatcacaagatctacaagatcttcccacacagtgaaaaaattgagaatataaatgaccagtactggacattgcgtgcagaggagattccagaagaagagaaaaacttgggtgctaatgatcgcttgattcatgtttaccacttcacgaaagagaccgcacagaaccagatgcaggtacagaatttcggggaacctttcttcttggttattcatgaaggtgaaactttagctgaagtgaaagcgcgcatacaaaagaaattgcaggtccctgatgaggagtttgcaaagtggaagtttgcattcttgtcattgggtcgtcccgagtacctacaggacactgatgtagtttctagtcgttttcagagaagagatgtttatggtgcttgggagcagtacctggggttggagcatgctgatactgctccaaagagatcatatgcagtaaatcagaaccgtcacacatatgagaagccagttaagatatacaactaagaaagctgttgatcctcgaccattgcatcagtttgtactaagcatcctttgctgcaacagaagcagtttggaaataaccaggatgagagctgagtggtacagctaaagaaacaatgaagctcacatagaggtcacttggtaggatttttcaatatttttgtgggcccaaatattttttcatgtgggtggggagagggaggtataatcccttaggatgtgtagtattgctagtactccctgcctgagttctgctgtctgttattttccttttatttatttctccgtggtgacggcagcccctttcttccggaaggttgattgctttccattatacagctccatagaaatttagcagtacataagaagatttttgagggcatgtatattgcgggtacagtcagctgcattttggattgcttggttataatatttatttctgtatctccattacttttagcttggtggaaatgagttgtaagagcttgtaatacatggttgagtgatgcacaattctggcctttgaattgggcaaggcacataattcacattgtagtaatttttattttttattttgtagccctctaccctttctacatgtaggacttttttattttattttatttattgttattctatatattctcctcaaatgacttggtacttattttcatgttggaatttagtattttggataaatatgagggttcatggtttcacgcttcttgttcacccccaaaatgaaacgtttaatgaacttcctagatagaagccaaacgattgt

SEQ ID NO: 2403 - DNA, 3574 bp, Valeriana officinalis
ccaatggatccagaggaggacgagatgcttgtacctaatcaagaattggtggcagaaggtcctcagccaatggaagttgcgccagctgaagctgctagtactgttgatgctcctgcagttgaggatccgccatctgctcgtttcacgtggacaattgagaacttttcgaggctgaacactaagaagttgtattcggatgttttctacgttggcggttacaaatggcgagtgcttatatttccaaagggaaacaatgtggatcatttgtcaatgtaccttgatgtcgctgattcatcaaatttgccgtatggttggagcagatacgctcaattcagcttagctgtggtcaatcaaattcataataagttcgttgtgaggaaagagacacaacaccagttcaatgcacgagaaagtgattggggattcacatcattcatgcctctgagtgaactatatgatcctggtagaggctatcttgtgaatgatacgtgcatagttgaagctgatgttgccgttcgtaaggttgtagattattggtcacatgactcaaaaaaggaaactggatttgtcgggctcaagaatcaaggcgctacatgctatatgaattctcttctccagactctctatcatattccttattttagaaaggctgtgtatcatatgccgacaactgagaacgatatgccttctggaagcattcctttggctttacagagtttattctataagctccagtacagtgacactagtgtagcaacaaaggagttaaccaagtcttttgggtgggacacttatgattccttcatgcaacatgatgttcaagaacttaatagggttctttgtgagaagctcgaagacaaaatgaagggaactgttgtggagggtactatacaacaattatttgaaggacatcatatgaattatatcgaatgcatcaatgtagactacaagtcaacaagaaaagagtcattttatgatctccagcttgatgttaaaggttgtcgcgatgtttatgcttcttttgataagtatgttgaagtggaacgtcttgagggtgataatagatatcacgctgaacaacatggcttgcaggatgcgaagaaaggtgtcctattcattgactttcctcctgttcttcagcttcaactaaaacggtttgaatatgatttcatgagagataccatggttaagataaatgatcgttatgagtttcctttgcaacttgatctcgacagagagaatgggaaatatttgtcaccagatgcagatagaagagtacgcaatctgtacactcttcatagcgtattggtacacagcggtggagttcatgggggacattattatgcatatatccggccagttctctctgatcaatggtttaaatttgatgatgagcgtgtaacaaaagaagacatgaagagggctttggaggaacagtatggaggagaggaagagttaccgcagactaatcctgggttcaataactccccatttaagtttacaaaatattcaaatgcgtacatgcttgtgtatattcgcgagagtgacaaggataaaattatatgtaatgtggatgagaaagacatagctgaacatttaaggatacgattgaaaaaagagcaagaagaaaaagagcaaaagagaaaggagaaggcagaggctcacctttatacaatcatcaaggttgctcgtgatgaggatcttgttgaacaaatcgggcgtgatatatattttgatcttgtcgatcatgacaaagttcgtagcttccgcatccagaaacaaatatccttcaacctctttaaggaagaagttgctaaagaattgggcataccagttcaatttcaacggttctggttgtgggcaaagcgccaaaaccacacatatcgtccaaatcggccattgacacctcaggaggaagcacagtctgttggtcaattaagggaagtatcgaacaaggccaataatgctgaactgaagttattcttggaagttgaacttggacaggacctgaagccgatcccaccacctgaaaagattaaagaagatattcttctcttcttcaaattatacgatcctgtgaaagaggaactccggtatgttgggcggctatttgtgaaaggcagctcgaagccagctgaaatactgacaaagctaaacgaattggtcggctttgctcctgatcaagaaattgaactattcgaggagatcaaattcgaaccaagtgtcatgtgtgaacacattgataagaagctcacttttcggggtagtcagcttgaagacggtgacatcatatgctttcagaaacctgttagtgctgaaaatactgaacaataccgctatcctgatgttccttcctttttggaatacgtgcataatcgtcaggttgttcggttccgttcgttagaaaaaccaaaggaggacgagttctgtcttgagctatcaaagcttcacaattatgacgatgttgtggaaagagtagctcgtcatcttaacttggacgatccatctaaaatcagacttacacctcataattgctattctcagcagcccaaacctactcctattaagtaccgaggagctgaacatctctctgacatgctcgttcactacaatcagacttcagacattttgtattatgaagtattagatattcctcttccggaactgcaaggcctgaagactcttaaagttgcttttcaccatgctacaaaagatgaagttgtaattcatactatcagattacctaaacaaagtactgttggggatgtcattagtgatcttaaaacaaaagttgaattatcccagccaaatgcagaacttcgacttcttgaagttttctaccacaagatctataagatcttccctctaaatgagaagattgaaaacataaatgatcaatattggacgttacgtgctgaggagattccggaagaggagaagaaccttggttctcatgaccgtttaatacatgtttatcattttatgaaagattctgctcagaatcaagtgcaggttcagaatttcggtgagccatttttccttgtcatccatgaaagcgaaacgctggctgatgttaaagtacgcattcaaaagaaactacaggttcccgatgaggactttgctaagtggaaatttgcatttttggctttgggtcgtcctgagtatttacaagacacagacattgtctcttctcgatttcagaggagagacgtgtatggcgcatgggaacagtaccttggattggagcactctgataatactcccaagaggtcatatgccgcaagtcagaatcgacacacattcgagaagccagtcagaatctacaactagggcaaaacacgtttgtcagaagataaattacacggagatcgagtaagtttggctttgtgaagaaacagatgcaacaggccagagatggattaaagccaataagcgagaacacgtgatgatgattgacgattcactagtcagttgttttatttattttccacttctattaatttataaattttgtactttctttcgtcgtggaaattcttttttatctctttctgtttttttgtttcctttcaat

SEQ ID NO: 2404 - DNA, 3845 bp, Ambrosia trifida
cctatcaccgccaccaatctccgccagatgactctcttgactcctcctcccatcgacgcagaggatgacgagatgctagttccacattcagatttcgctccccctgaaggacctcaaccaatggaagctacaccagctgaagctccaaatgttgttgatgcgccgactgttgttgacgatccaccgtccgcgcggtttacatggactatagagaatttttctaggttgaattcgaagaagttgtactcggatgttttctttgttggaggatataaatggcgagttttaatatttccgaaagggaataatgttgaccatctgtcgatgtaccttgatgttgctgattcctcgacgctgccgtatggttggagtagatatgcccagtttagcttagctgtggttaatcaaattcataacaagttcacggttaggaaagacacccaacaccagtttaattcacgagagagtgattggggtttcacttcatttatgcctctaagcgagctttatgatcccagcaaaggctatcttatgaatgacacatgcatagttgaagctgacgtggcagttcggaaggttgttgattactggtcacacgattcaaagaaggagactggttatgttggcctcaaaaatcaaggtgctacttgctatatgaactccctgctacagaccttataccataccccttatttcaggaaggctgtgtatcatatgccaacaactgaaaatgatatgccatcagggagcattcctcttgctttgcagagtttattttataagcttcagtatagtgacacaagtgttgccacaaaagagttgaccaagtcttttggttgggatacatatgattcttttatgcaacatgatgtccaagaactaaatcgagttctatgtgagaaacttgaagacaaaatgaagggaactgttgtggagggtacgattcagcagttatttgaaggacaccatatgaactatattgaatgtataaatgttgactacaaatcaacaagaaaggagtctttttatgatcttcagcttgatgtcaaaggttgccgagatgtgtatgcctcatttgacaagtatgttgaagtagaaaggcttgaaggtgacaacaaatatcatgctgaacaacatgggttgcaggatgcaaagaagggtgtcctgttcattgatttcccacctgttcttcaactccagttaaaacgttttgaatatgatttcatgcgagacacaatggtgaagataaatgatcgttacgaattccccttgcaactggatcttgatagagaagatgggaaatatttatcaccacaggcagacagaagtgttcgcaacctttacacccttcacagtgtgttggttcacagcggtggggtacatggtggacattattatgcttatattcggccaacactttctgatcaatggtttaatttgatgatgagcgtgttaccaaagaagacatgaagagggcattggatgaacaatatgggggagaagaagagttacctcaagcaaaccctggtttcaataattctccatttaaatttacaaagtattcaaatgcatatatgcttgtgtatatacgtgaaagtgacaaggagaaaataatctgtaatgtggacgagaaggatatagcagagcacctaagaataaggttgaagaaggagcaagaagaaaaggagccaaaaagaaaggagaaagcagaggctcatttatatactattataaaggttgctagagatgaggaccttcataaacagataggaaaagatatttattttgatctagtggatcatgacaaagttcgaagcttccgtatccaaaaacaaacaccttttgccctttttaaggaagatgtagctaaagaattgggtataccagtgcaacatcaacgtttctggctatgggcaaagcgccaaaatcacacttaccggcccaatcgtccgttgacacctcaagaagaagcccagtctgttggacatttaaaagaggtatcaaataaggctaacaatgctgagcttaagttgtttctggaagtagaagttggacaggatcttcgcccgatttctccacctgagaagactaaagaggagattctacttttcttcaaactttatgatcctttgaaggaagaacttcggtttgttgggcggctctttgtgaaggctactggaaagccaatggaaatactggcaaagctgaatgaactggctggcttcaaacctgatgaagaaattgaactttttgaggaaattaagtttgagcccaatgttatgtgtgaacatgttgacaagaagctaacttttaggggcagccagcttgaagatggggacatcatttgctttcagaaacctcttaaggttgaaagtgcagaaacttgtcgttatcctgacgttccctcttttctggagtatgttcacaatcgtcaggttgtacggtttcgttcactggagaagcccaaggaggatgagttttctctggaactgtcaaaactcaacaattatgatgatgttgtggaaagacttgctcgccatctaaacttagacgatccatctaaaatcaggcttacatctcacaactgttattctcaacaacccaaacctcagccaatcaagtatcgtggagtggaacatctatcagacatgctggctcactataatcagacttctgatattttgtattatgaagtattggatatccctctgccagaactacaaggcttgaaaactctaaaagttgcctttcatcatgctactaaagatgaagtggtaatacatactattagattgcccaagcaaagcacagtaggggatgttatcaatgaccttaagaccaaggttgagttgtctaatacaaatgcagaacttcgcctacttgaggttttctaccacaaaatttacaagattttccccctgaatgaaaaaatcgagaatatcaatgatcaatactggactctacgtgctgaggaggttcctgaagaagaaaaggatctgggtcctcaggaccgtctaattcacgtttaccattttacaaaagacacaactcagaaccagcaggtccagaactttggggaaccattcttcctggtaattcgtgagggcgagacattagctgaagttaaagttaggatacagaagaagttacaggttccagacgaggagttttccaagtggaagtttgcgtttctgtctttgggacgtcccacataccttcaggactcggatatcgtctctagtcgtttccagagaagagatgtttatggtgcttgggaacaatatttgggattagagcactctgacaattcacccaagaggtcttatgctgcaaatcagaatcgtcacacatttgagaaaccagttagaatttacaactgagttgagaggaactatatggtgaggctatgggcaagttatgtgtattgggggaagcatgaatcaaaccacatgaacctagcagcaagagaatgcaagcgtaatcatccgtctggtagatgtgtaattctttgtgaaaagaggtagcagatcatatcatatagaaagcgcgtactctttctttgtgtagcatcctccttcaggtgatgtagtttaggttatatatttccccctctcatctttcatttgattgtatcttagacaaccatgcataagttttgggttcgtgttgtatagaggtatagtttacctttgattcacccgttctatattgtgattttatttatacaaaactagattatatgaaatttcctgtgtaatgccatattgatccaacttttatcacttcgtaaattcagcacaatgtaacctgtactatgtatcaagattgagtcgtggataagttaa

SEQ ID NO: 2405 - DNA, 3754 bp, Gossypium hirsutum
caacaggaagacgaggaaatgctcgtgccacactctgatttgaccgacaatcatcagcccatggaagttgtatcacaagctgagaacgcaaatacagtggaaaatcaaaaagtggaggatcctccttcgtcaagattcacttggaagattgataatttctctagattaaacaccaagaagcattattcagatgtttttgtagttggtggttataaatggcgaatactgatattccaaagggtaacaatgtggatcatttgtccatgtatctggatgttgctgactcagcaagtttaccctatgggtggagtagatatgcgcagttcagcttggctgtagttaatcaaattcatagtaaatattcaatcagaaaagacacacaacaccagtttaatgcaagagaaagtgattggggttttacatcctttatgccccttggtgagctatatgatccttgcagagggtatcttgtgaatgacactttggttgttgaagcagaggtcgttgtccgcaaaattgtggattactgggcatatgactcaaagaaggaaactggttatgtcggacttaagaatcaaggagcaacatgttacatgaactctctgctccaaaccctgtatcatattccttacttcaggaaggcagtttatcatatgcctacaactgaaaacgatatgccatctggaagtatccctcttgctctgcagagtttattttacaaactccagtacagtgacagtagtgttgcaacaaaagagctgaccaaatcttttggatgggacacatatgattctttcatgcagcatgatgttcaagaacttaatagagttctatgtgaaaaacttgaagataaaatgaagggtactgttgtggagggcaccatacaacagttgtttgaagggcatcatatgaactacattgagtgcattaatgtggattataaatctacaaggaaggaatcattttatgacctacagcttgatgttaaaggctgtcgagatgtatatgcttcttttgacaagtatgttgaagttgaacggcttgaaggtgataataaatatcaggctgagcaatatggattgcaggatgctaagaagggtgtgttgttcattgatttccctccagtccttcaaattcagcttaaacgttttgaatatgattttatgcgagatactatggttaagattaatgaccgctatgagttccctttgcaacttgaccttgatcgagatgatggaaaatacttatcaccagaagctgataggagtgttcggaatctttacacacttcacagtgtccttgttcatagtggtggagtgcatggtggacattattatgcatatatcaggccgactctttctgatcagtggtataaatttgatgatgaaagagtaaccaaagaagatttgaaaaaggcattagaggagcagtatggtggggaagagttaccgcagacaaacccagggttcaataatactccttttaaatttaccaaatattcaaatgcatacatgctggtgtatatacgtgaaagcgacaaagacaagataatatgtaatgtggatgagaaggatatcgcagaacatcttagggagagattgaagaaagaacaagaagagaaagagcataaaaagaaagagaaggcagaggcacacctttacactattataaaggttgctcgagatgatgatcttgcagagcagattgggaaagatatatgttttgatcttgtggatcatgataaagtcaggagttttcatattcagaagcagatgcctttcaatgtgtttaaggaagaggttgctagagagtttggcataccagtgcaatttcagcgattctggttgtgggccaagcgtcaaaaccatacctaccgtccaaaccgaccattgatacctttggaggaaacacaatctgttggagccttgaaggaggtatcaaataaggttcacaacgcagaactgaagttgttcctggaagttgagcttggactggatttacgcccaattgcgccgccatataagacaaaggaagatattttacttttcttcaagcactatgatcctgagaaagaagagcttcgctatgttggaaggctgttcgtgaaaagtgcaggcaagccaatagaaattttgtccagattaaacaaaatggcagggtatgctcctgatgaagatatcaatctttacgaggaaataaagtttgagcccagtgttatgtgtgaaccaattgacaagaaaatcacgtttcgtgctagccagcttgaggatggtgacattgtttgctttcaaaagtctctccctgttgaaagtactaatcagtaccgctatccagatgttccttcatttctggaatacgtgcataatcgccaggttgtacactttcgttttctggaaaaacccaaggaagatgatttctgtctggagatgtcaaggctttatacttatgatgatgttgttgaaagagtagctcagcaacttggtttggatgatccaactaaaatcaggcttacatcacacaactgttactcccagcagcccaaacctcagcctatgaagtatcgtggagtggatcatttgtctgacatgctgttccactacaatcagacgtctgatattttatactttgaagtattagacatccctctgccagaactacaaggtttgaaaacgctgaaggtagcatttcatcatgctacaaaagatgaagttgttatccatactattaggcttccaaaacagagcactgttggtgatgtgattaatgatcttaagacaaaagtggagttgtctcaccctgatgcagaattgagattgcttgaagttttctataacaagatctacaagattttcccacccaatgagaagattgacaatataaatgaccaatactggacactacgagcagaagagataccagaggaagagaaaaatcttggtccaaatgatcgcctaattcatgtataccactttactaaggaaacagctcagaaccagatgcaaattctgaattttggagaaccctttttcttggtgattcatgaaggtgagactttggccgaaataaaagtccgtatacagaggaagctgcaagttcccgatgaggagtttaccaagtggaagtttgcattcctctcacttggtcggccagagtaccttcaagattctgatattgtatctagtcgttttcagagaagagatgtttacggtgcttgggagcagtatcttgggttggagcactctgacaatattcctaaaagagcttgtgcaattaatcagaaccgacacacttttgagaagccagtaaaaatctacaattagggagcatttttagattaccttccttgataaaacatagcacaaaaatcaggctctggacctggattatatagagtggggagaacacttctagcaaatgacaatgtgaggcaactagttagcgtgcggtttgttggatatgtaattcttttggtagtggtgattggaaggtatcttttgtcctaatcaaagtgtgccatctagaaatgtcgattatgatctgctgatgcttttggtacttgcgtgtcttttaatggagatcgaggttaaggtcaaagttgcctgtgtaagttgacagtacataaacaagattttggattagtgaaatatgtatagagagaggagtatagtcgggacgtgggaggctattatcattattcccctccctttgtttgcttcttgattttgacaatgtagatgattgattatgcatttag

SEQ ID NO: 2406 - DNA, 4000 bp, Populus trichocarpa
gtaaacccctcttcctctctctctctctctccttctccccccctcctttttctacaccaatccccccccccctctctctctgaactactcactttacactcctctctgattcctccatccatgactctcatgactcctcctccgttaaatcaacaagaagacgacgagatgttggtcccacaaactgaatttgctgatggacctcagccaatggaagtagcacaagccgaaactgcaacagcagttgatgcacagtcggtggatgatccaccatctgctaggtttacatggacgattgataatttttcgaggctaaatgctaagaagctctactctgatgtttttgttgttggaggctacaagtggcggatattgatttttccaaagggtaacaatgtggatcatttatccatgtatctagatgttgctgattcagcaactttgccatatggctggagtcgatatgcgcagtttagcttgactgttatcaatcaacttcatcaaaagtactcaattcggaaagacacgcagcaccagttcaatgcacgtgagagtgattggggattcacttcattcatgcctcttggggaattgtatgaccctgggagagggtatcttgtaaatgacacgtgtgtggttgaagctgatgttgctgttcgtaaggtcattgattactggtcacatgattcgaagaaggagaccggttatgttggtctaaagaaccaaggagctacatgctacatgaactctctccttcagacgctgtatcatattccttatttcagaaaggctgtatatcatatgccaacaactgagaatgatatcccatcagggagcattcctctggctttgcagagtttgttttataaacttcaatacagtgacactagcgtagctacaaaagagttgacaaagtcttttggctgggatacatatgactctttcatgcagcatgatgtccaagaacttaatagggttctgtgtgaaaagcttgaagataaaatgaagggaactgttgtggagggcactatacaacagctatttgaagggcaccatatgaattatattgaatgcatcaatgttgactataagtcgacaagaaaggagtcattttatgatcttcagcttgatgtcaaaggctgtcgggatgtttatgcttcttttgataagtatgtggaggtggaacgtcttgaaggtgacaataaatatcatgctgaacaacatggattacaggatgctagaaagggtgtcctattcattgacttccccccagttctccaacttcaacttaaaaggttcgagtatgattttatgcgggatacaatggtgaagataaatgatcgctatgagttccctttgcaacttgatcttgatagagagaatgggaaatatttatcaccagaggctgaccgcagtgtccgcaatctatacacccttcacagtgttttggttcacagtggtggtgtgcatggtggacactactatgcttatatcagaccaactctctcagatcagtggttcaaatttgatgatgagcgggtgaccaaagaggatatcaaaagggcattagaggagcagtatggtggtgaggaagagttaccacagacaaatcctggcttcaacaactctcccttcaagtttacaaagtactcaaatgcttatatgcttgtgtatattcgtgaaagtgacaaggaaaaaataatctgtaatgtggacgagaaggacattgcagagcacctcaggataagattgaagaaagaacaggaggaaaaggagcaaaagagaaaggaaaaagcggaggcgcacttgtacaccataataaaggttgcacgcagtgaggatctacttgaacagattggcaaggatgtatattttgatcttgtggaccatgacaaagtacgaagtttccgtatccagaaacagataaccttcaaccttttcaaggaagaagttgctaaagaatttggtataccagtgcaacttcaacgtttttggctgtgggcaaagcgacaaaatcatacataccgtccaaatcggccactgactcctcaggaggaagcacagtctgttggacaattgagagaggtttctaataaggcaaataacgcggagctaaagctgtttctggaagcagaaattggacaggatttgcgacctgttcctccacctgagaagactaaagatgatatccttcttttctttaaactttatgatccatcgaaggaggaactccggtatgtagggaggctgtttgtaaagggtagcggcaagccgttggagatcctgacgaaactaaatgaaatcgctggctttgctcctgaccaggagattgaactttacgaggctagtcattacatttataaatatctctctcctgttttctttcaggaaataaagtttgaacctaatgtcatgtgcgaacacattgacaagaggctcacttttcgttctagtcagcttgaagatggagatattgtttgctatcagaaaccccctccaatgggaagtgacgaacagtgccgctaccctgatgtgccttccttccttgagtacatgcacaatcgccaggttgttcgttttcgatctttggagaaatcgaaagaggatgaattctgtcttgagctttcaaagctccacacttatgatgatgttgcggaaagagtagctcaccatcttggcttggatgacccatccaaaattaggcttacatctcataactgttactcccagcaacctaaaccccagcccatcaaattccgaggagtggatcatttgtctgatatgctggtgcactacaatcagacatctgatattctatactatgaagtattagacatccctctaccagaattgcaaggccttaaaacattaaaagttgcttttcatcatgctactaaggatgaggtagtgattcataccattagattgccaaaacagagcactgtaggtgatgtcattaatgaccttaaggcaaaggtggagctgtctcatcctagtgctgaacttagattgcttgaggttttctatcacaagatctacaagatctttccacacaatgaaaaaatcgagaacattaatgatcaatactggacactacgtgcagaggaggttcctgaagaagagaaaaaccttgctcctcacgatcgcttgattcatgtctatcatttcatgaaagacacaactcaaaaccaggtgcaggttcagaattttggagaaccatttttcctggtcattcacgagggtgagactttgactgaagtcaaaatgcgcatacagaaaaaattgcaggttcccgatgaagaattttcaaagtggaagtttgcttttttgtctctaggtcgccctgagtaccttcaagattcagacatcgtgtccagccgttttcagagaagggatgtttatggtgcttgggagcagtatcttggattggagcattctgacaatgctcctaaaaggtcatatgctgctaatcagaatcgtcatacatttgagaagccggtaaaaatctacaactaggaagcaatgaggaagcgaaactagtgcatcagctgaatcaaagaccgtgattcccctacaaactgttgcaaaatggaccaaggaagaaacaagcttgcaaccagagcaaaatagtggttttgatagatgtgtaattctttcatgtagggagagggtgaactcatggcataaaaacatgttccctcaatagttttgacctctctctctcttctttcggtgaagtagatgacatttgatccttaaaatcccattgtaatctagtacataagattttgttgtgggggatgtataggggggtataggtgtgtgtttttaaattattttgtctttccttttgcaagcatccttctgtggatttgcctagatgtattagagaatcattagagcctccttgaggcgcatgtataatgtgctgtttgtctgcttgttctgtgcttccctgaagctgtgcaattgaaacaaacgccgtatctcttcgagtcca

SEQ ID NO: 2407 - DNA, 3622 bp, Helianthus annuus
ctatgactccgcctcctattgatccggaagaggaagagatgctagtcccgcattctgagtttgcaaccgctgaaggacctcaaccaatggatgttacacctgcagaagctactaatacagttgaggcatcagtagttgatgatccaccatcagcaatgttcacatggactatagaaaatttctcaagattgacaggcaaaaagttatactctgatgttttcttcgttggaggatataaatggcgtgtgctcatattcccaaaaggaaacaatgtggaccatttgtcaatgtatcttgacgttgctgattccgcaacgttgccatatggctggagcagatacgctcagtttagcctagccgtggttaatcaagttcacaacaagtttactatgagaaaagatacacaacatcagtttaatgcacgagaaagtgattggggtttcacttcatttatgcctcttagcgagctatatgaacccagtagaggctatcttctgaatgacacatgtataattgaagctgatgtgacggttcggaaggttgttgattactggtcacatgattctaaaaaagaaactggttatgttgggctaaaaaatcaaggtgctacctgctatatgaattctctactacagacattgtaccacatcccgtatttcagaaaggctgtgtatcatatgccaacaactgaaaacgatatgccgtcagggagcatcccgttggctttacaaagtttattttataagcttcagtacagcgacaccagtgtagctacaaaagagttgaccaaatcttttggttgggatacctatgattcttttatgcagcatgatgttcaagaactcaatagggttctttgtgagaaacttgaagacaaaatgaagggaactgttgtagaaggcacaattcaacagttatttgaagggcatcatatgaactacattgaatgtataaatgtagactacaaatcaacaaggaaggaatcattttatgaccttcaacttgatgtcaaaggctgtcgtgatgtgtatgcctcttttgacaagtatgtggaagtggaacgacttgaaggtgataacaagtatcatgctgaacaacatgggttgcaggatgcgaagaagggcgttctgttcattgatttcccccctgttctacaactacaacttaaacgttttgaatatgatttcatgcgagatacaatggtgaagataaatgatcgatatgaatttccgttacaacttgatcttgatagagaaaatgggaaatatttatcaccccacgcagacagaagtgttcgcaatctttatactcttcacagtgtactggttcacagtggtggggtccacggcgggcattattatgcctatatccgaccaacgctctctgatcaatggctgaaatttgatgatgaacgtgtaactaaagaagacatgaagagagcattggatgaacaatatgggggtgaggaagagttgcctctagcaaatcctgggttcaataactccccatttaaatttacgaagtattcaaatgcatacatgcttgtgtatattcgtgaaagtgacaaagagaaaataatctgtaatgtggatgagaaggatgtggcggaacacttgcgaattagattgaagaaagaacaagaagaaaaggagcaaaaaaggaaggagaaagcagaagcacatttgtataccatcataaaggttgctcgtgatgagaatctccatgaacaaatagggaaaaacatatttttcgatctagtggatcatgataaagttcgtagtttccgtatccaaaagcaagtatcttttgcccttttcaaggaggaagtagctaaagaattgggtataccggtacaatgtcaacgtttctggctttgggctaagcgtcaaaatcatacttatcgtccaaatcgtccgttgactcctctagaagaagctcagtctgttgggcatttgagggaggtatcgaataaggctaacaatgctgaacttaagttgtttcttgaggtagaacttgggcagaattcacagccaattcccccacctgcaaaaactaaggaggagattttacttttctttaagctttatgaccctttaaaagaggagcttcggtatgttgggcggctcttcgtgaagggtactggaaagcctacagaaatactgacaaagctaaacgaactggctggctttgcgcctaatgaagaaatagaactctttgaggaaattaagtttgaacctaatgttatgtgcgaacatgttgataaaaagctcacatttagggctagtcagcttgaagacggggacatcatttgcttccagaaacctcttcaggctggaactgtaaaatgtcgctatcctgatgttccatcgtttctagagtatgttcataatcgccaggttgtgcgttttcgttcactggagaaaccgaaggaggatgagttctcactggaattgtcaaaactccacaattatgatgatgttgttgaaagggttgcctcccatttaaacttagacgatccatcgaaaatcaggcttacgtctcataactgttattcccaacaacccaaacctcaaccaattaaatacagaggagtggaacatctgtcagacattctggcacactacaatcagacttcagatattttgtattatgaagtacttgatattcctcttcctgaactacaaggtctgaaaaccctaaaggttgcttttcatcacgcaacaaaagatgaagtggttatacatactattagattgccaaaacaaagcactgtcggtgatgtcatcaatgaccttaagacaaaggtcgagttgtctcataaagatgcagagcttcgattgcttgaagtcttttaccacaaaatttacaagatttttcctctgaacgaaaagattgagaacattaatgatcaatactggacgttacgtgctgaggagattccagaagaggaaaaggaccttggtccacaggatcgtctaattcatgtttatcattttacgaaagacacatctcagaaccagcaagtgcagaacttcggggaaccattttttcttgttattcgagagggtgaaacgttagctgaagttaaattacgcatacagaagaaactacaggttcctgatgaggaattttctaagtggaagtttgcatttctctctttgggtcgtcctacataccttcaggattctgatgttgtctccacccgttttcagagaagagatgtttatggcgcttgggaacagtacttgggattggagcattccgacacaacatccaaacgctcatatgctgcaaatcagaaccgacatacatttgaaaaaccagttagaatctacaactagctaaaagcacgaatatgttggcggtcgtgcaagggcagtttggtaaaatgttttaccgcactgaaaagaaaacataattatggtaatgttagatgtgtaattctttgtttaaagtttgtgaagcatccctgtatatggggtaacagttaggtttagatgatgttcccccattactgtaccttagagagtgtgaacaagattttggatctgggatgtatagaggtatagatgtgtcatgtatgtttgtgtgtgttcctcaactttaaatttttatcctttaa

SEQ ID NO: 2408 - DNA, 3617 bp, Vinca minor
catccaattcatgactctcatgaccactcctccagtggatccagaagaggacgagatgcttgttcctcattctgagtttccggtagaaggtcctcaacctatggaagttaccccagcaccagcagaagctaccacagtggatgcacaagcggcagtggatgatccaccttcagctcggttttcatggacgattgagaactttgcaaggttgaatacaaagaagctatactctgaagtcttcaatgtgggaggatataaatggcgggtgctgatattccccaaaggaaacaatgtggaccatttgtccatgtatcttgatgttgcagatgcttctgctttgccatatggatggagtagatatgcccagtttagcttagctgtggtcaatcaggttcataacaagttcacagtgcgaaaagatacacatcaccaatttaatgcaagagaaagtgactggggtttcacttcattcatgcctcttagtgaactatatgatccggggagaggttatcttgtgaatgatacatgtattgttgaagccgatgttgctgttcgtagggttgttgattattggtcgcatgactcaaaaaaggagactggttatgttggactaaaaaatcaaggagctacttgttacatgaactcactcctccagacattgtatcacattccttacttcagaaaggctgtgtatcacatgcccacaactgagaatgatatgccatctgggagcatccctttggctctgcagagtttgttctataagcttcagtacagtgatactagtgtagcaacgaaagaattgacaaaatcatttgggtgggatacgtatgattctttcatgcaacatgatgttcaagaacttaatagggttctctgtgagaagcttgaagacaaaatgaagggaaccgttgtggagggcactattcagaagttgtttgaagggcaccacatgaattacattgagtgtattaatgtggactacaagtcaactagaaaagaatctttttatgatcttcagcttgatgtcaaaggatgccgtgatgtttatgcttcttttgataagtatgtggaagtggagcgtcttgagggtgacaacaaatatcacgctgaacaatatgggcttcaggatgccaagaaaggagttctcttcattgactttcctcctgttcttcaacttcagttaaaacgatttgagtatgactttgtacgagataccatggtaaagataaatgatcgatatgagttcccgttgcaacttgatctggatcgagacaatggaaaatatctatctcctgatgctgatcgaagtgttaggaacctctacaccctccacagtgttttggttcatagtggtgggcttcatggtgggcattattatgcttatatcaggccaacactctcagatcagtggttcaaattcgatgatgaacgtgtaacgaaagaagatatgaagagggctttggaagagcagtatggtggtgaggaagagttaccacattcaaatcctgggttcaacaactcgccatttaaatttaccaagtattcaaatgcgtacatgattgtgtatataagagagagcgacaaagagaacataatttgtaatgtagatgaaaaggatattgctgagcaccttaggatacggttgaagaaagaacaagaagaaaaggagcaaaagagaaaggaaaaagcagaggcacatctctacactattattaaggttgctcgtgatgaggatttagttgaacaaattggaaaggacatatattttgatcttgttgaccatgataaggtccgatgtttcagaattcagaaacagaccccgtttaaccttttcaaggaagacgttgctaaggagtttggtataccagttcagtgtcagcgtttttggctatgggcaaagcgtcagaaccacacatatcgtccaaatcgcccactgactcctcatgaagaggctcaatctgttggccaactcagagaggtatcaaataaagcaaataatgcggagttgaaggtgtttttggaagtagatatgagcctggagttgcagccacttcctccccctcagaagactaaggaggagattcttctgtttttcaaactttatgatcctgtcaaagagaaattacgttatgttggacggatgtttgtcaaaggtaatggaaagcccatagagatattgagtaaactaaatgaattggctggctttgctcctgatgaagaaattgatctctttgaggaaataaaatttgagcctaatgtcatgtgcgaacatatagacaagaagctcaatttccgcagcagtcagcttgaagatggggacattatttgctttcagaagtctcttcaaggtcaaaatgttgaacagtctcgttatcccgatgttccttcatttttggaatatgtgcataatcgtcaggttgtgcgattccgctcaattgagaaaccgaaggaggatgagttttctcttgagttgtcaaagcagaacaactatgatgaagttgtagaaagtgttgctcgtcatctttccttggatgacccatctaaaattcgacttacatcacataactgttactcccagcaaccgaaaccccaacctataaagtatagaggagtagaacatctcacagacatgctaatacattacaatcagacttctgatattttgtactatgaagtgttggatatccctttgccggagctacagggcttgaaaactctgaaagttgcctttcatcatgctacaaaagatgaagtagttattcatacgataagactgcctaaacaaagtaccgttggggatgttattaatgatctgaagacaaaggttgagttgtcccatcccaatgctgaattaagactactggaggtcttttatcacaagatatacaagattttccctctccatgaaaagattgagaacatcaatgatcaatactggacgttacgtgctgaggagattcctgaggaagataaaaatcttgggcctcatgatcgcttgattcatgtttaccatttcatgaaggacacatcgcagaaccaagtgcaggtccagaatttcggtgaaccttttttcctagcaattcatgaaggtgagacgctagctgaagttaaattacggatacagaagaagttgcaggttccagatgaggagttttcaaagtggaagttcgcatttttgtcattgggccgtccggagtatcttcaggactcggacattttgtccactcgttttcagaggagagatgtctatggtgcttgggaacaataccttggtttagagcactctgacaatgctcccaaaaggtcttatgctgcaaatcagaaccggcacacgtatgagaagcccgttagaatctataattagcaaatatcaagctaacgcttgaacctctgcttgcgctgaactctaaccgccccctacgctgcatgtccgttaagaagattgcacaatgacagtgaatggatttttcggggagaaatggcatatcaatgtgggattggccagaactaggaaagcaaaagaagatccatcatcatcatcatcatcatcatcatctatgcaggtgtctgcaagtccggaccggcatccttctcacacgcccgtcactgggttg

SEQ ID NO: 2409 - DNA, 4035 bp, Prunus mume
ctctcattttgaccttgtttttgcagcagcagcagcagcaacagcaggaggacgatgagatgctggtcccgcactctgagttccccgatggtcctcagcccatggaggaagctcaagcagaaactaacaatacagtggatgctcagtcagtggatgatccattgtcagctagatttacgtggacaattgagagcttttcaaggcttaataccaagaagctatattctgatattttccttgttggaggctacaaatggcggatactaattttcccaaaagggaacaatgtggatcatctgtcaatgtatctagatgttgcagattcgggaactttgccttatgggtggagtagatatgcccagtttagcttgtctattgtcaatcaacttcatagtaaatattcaattagaaaagaaacacagcaccagtttaatgcacgggagagtgactggggtttcacttcgttcatgcctcttggtgaattatacgaccctggtagaggttatattgtgaatgatacatgcatagttgaagctgatgttgctgttcgtagagttattgattactggtcacatgactctaaaaaggaaactggttatgttggactgaaaaaccaaggagctacttgttatatgaactctctccttcagactttgtaccatattccttattttagaaaggctgtgtatcatatgccaacaacggagaatgataatccatctggaagcatccctctggccttgcaaagcctattctacaaacttcagtacaatgatactagtgtagcgaccaaagagctgacaaagtcattcggatgggatgcatatgattcatttatgcagcatgatgtccaagaacttaatagggttctttctgaaaagcttgaagacaaaatgaaaggaactgttgtggagggtacaatacagcagttatttgaagggcaccagatgaactatattgaatgcatcaatgtggactataaatcgacgagaaaagaatcattttatgatcttcaactggatgtcaaaggctgtcgggatatttatgcttcattcgataagtatgtggaagtggaacgccttgagggtgataataagtatcatgctgaacaatatggtttacaggatgctaagaagggtgtcctattcattgattttccacctgtccttcaacttcagctaaaacgttttgagtatgattttatgcgggacaccatggtaaagataaatgatcgctatgagttccccttgcaacttgatcttgatagggagaacgggaaatatctatccccggatgctgacaggagcgttcgcaacctttacactcttcatagtgttttggtgcacagtggtggggtgcatggtgggcactactatgcatatatcaggccaaccctttctgatcagtggtttaaatttgatgatgaacgagtaacaaaagaagatatgaagagggctctagaggagcagtatggtggtgaagaagagttaccacagacaaatcctgggttcaacaatgctccatttaaatttacaaaatattcaaatgcctacatgcttgtttatatacgtgaaattgacaaggagaagataatttgtaatgtggatgagaaagacattgcggaacatctgaggataaggctgaaaaaagaacaggaagaaaaggaacaaaagagaaaggaaaaagctgaagcgcacctttatactatcataaaggttgcacgaaacgaggacctgcttgaacagataggaaagaatatctattttgatcttgtggatcatgacaaagttcatagtttccgtattcagaagcagatgcccttcaacctctttaaggaagaggttgccaaagagtttggtataccagttcaatttcaacgtttctggctgtgggcaaagcgtcaaaaccatacataccggccaaatcgaccactgacacctcttgaggaaacacaatctgttggacagttgagggaagtttccaataagtcaaataatgcagagctaaagttgtttcttgaaatagaacttgggccggatttgctgcctctttctcctccggaaaagaccaaagaagagattcttctatttttcaaactctatgatcctgtgaaagaggagctccggtatgttgggaggctgtttgtgaagggaagtggtaagcctgttgaattattcgcaaaactaaatgaaatggctggtttcagtcctgatgaaaagatagaactttttgaggaaataaagtttgaacctaatatcatgtgtgaacacattgatgagaaggcaacctttcgtgttagtcagcttgaagatggggacatcatttgctatcagaaatctcctcaggctggaagcagtgaacaattccgttatccagatgttccttcattccttgattatgttcgtaaccgtcaggttgttcgttttcgttctttggacaaaccgaaggaagatgaattctgtcttgagttgtcaaagttccacacctatgatgatgttgtggaaagagttgctcaacatcttggcttggatgatccaactaaaattaggctcacatctcataattgttattcacagcaacctaaaccccaaccaatcaagtttcgaggagtagaacatttgtctgacatgctggtacactacaatcagactacggatgtactgtattatgaagtattggatatccctctcccagagctgcaaggcctcaaaactctgaaagttgcttttcatcatgctaccaaggatgaagttgtggttcatactattagattaccaaaacagagtagtgtaggagatgtgattgatgaccttaagacaaaggtggagttgtctcaccctgatgctgaactcagattgctagaagttttctatcacaagatctacaagattttcccaccaaatgaaaagattgagaacataaatgatcagtactggacattacgtgcagaagagatccctgaagaagagaaaaactttgggccacatgatcgcctgatccatgtttatcattttatgaaggacacagctcagaaccaggttcagaattttggagaaccatttttcttggtcattcgtgaggatgagacattagcggaagtgaaagtgcgtgtacagaaaaagttacaagtcccagatgaggagtattcaaagtggaaatttgcatttttgtccatgggtcgtcctgagtacctccaggacgatgacattgtggccagccgatttcagagaagggatgtgtatggagcatgggaacagtaccttggtttggaacacactgatcatgctcctaaaaggtcacatacaacaaatcagaatcggcacacatttgagaagccagtgaaaatctacaactaaaactactgcaatgactttgtcagctcatttcacagattcaacctcctatacatatgcagaatcttgtgaagagcccgagatgcacaaaggaagctttgttacagtttgccatagttattgaccttactgggcataaaattctttagtagagtgacggggcaatttttagcctgaacttttgtatcctcgatggttcggacacttctccctttcaggcacctgtcgttgaggtgtgaggtaggaggcatctcattttgaatccatgtaattccgtatataagattttggggtgagcaatgtacagagggtataggtgcaggtttaaatgcagtttcttgtccagttatattgtgttgatctttttgaatccttgatggaaaaagctctgtataatattggatcgttggcttccctggtgttttatttgtttctgtatgtttggagtgcattggtaggctgctgttgctgtgacctgtggaggttgaaatgacactattattttgccaatatgaaactagttagctgccgttacatttggcacaaccagtcttaccagtttttactcatccttcgtgagttttcgagtttttttgtgttcgattcgtatgggtctctctattgggtttgtgggctttgtttgggcttatagttaattgtggtgatgttgactactagtttt

SEQ ID NO: 2410 - DNA, 4176 bp, Cephalotaxus harringtonia
gaacgcggtctctcattctcaaaatttgctgtcaacttttttttctttcgcaggggcgatttgagtcaaacctacaatctatatatacacactcaaagtatatatactctcaacaatgacgatgatgacccctccgcctctggatcaacagcaggaggaagaagaaatgcttgtaccacattctgagtacaacaacgagggtgctcaacccatggaagttgtagggcaaggcgagactgtcagtaccgtggaaaatcaaccctctgaagatcctccttcatctcgatttacgtgggcaatcgataacttttcaagattaaacgtgaagaaacattattctgacgtttttactgttggaggatttaagtggcgggtgctaatttttcccaaaggaaataatgtagaccagctatctatgtatttggatgtggctgatgctgctactttaccttatggttggagcagacaagcacaatttagccttgctgttgtcaatcaaattaactccaaatattctatacgaaaagatacacagcatcagttcaatgctcgagagagtgattggggtttcacgtcattcatgcctcttggagaaatttatgatcctttgaaaggctatctggtgaatgatgctcttgttgtagaagcagatgtcgttgtccgaaaagttgatagttgttggcaatatgactcgaagaaagaaacagggtttgtgggactaaagaatcaaggagcaacatgctacatgaactcgcttcttcaaactctgtatcatgttccttactttagaaaggctgtgtatcacatgcctacaactgaaaatgacatgccatctggtagcattccattagctttacagagcttgttctataagctccagtacagtgatagcagtgttgcaacaaaggagttgacaaaatcttttggatgggatacatatgattccttcatgcagcatgatgttcaagaattaaacagagtgctgtccgagaaactagaagacaagatgaaggggacagttgttgaaggaacaatacaacaactatttgagggccatcacatgaattacattgaatgcataaatgtggattacaagtcaacaaggaaagagtcattctatgatctgcagcttgatgtcaaagggtgccgagacgtctatgcatcatttgataaatatgttgaagttgaacgccttgaaggcgataataaataccatgctgaacaacatggtttacaggatgcaaagaagggtgttctgttcattgattttcctcctgtgctacaactccagttaaagcgctttgaatatgatttcatgcgggatacgatggttaagataaatgatcgttacgagtttcctttacaacttgatcttgatagagaaaatggaaagtatctttctccagatgcagatagaagcgtacgcaatctgtacactctccacagtgttttagttcatagtggaggtgtgcatggtggccattattacgcatatatcagacctactctctcagatcagtggtttaagtttgatgacgagcgtgtaacaaaggaggacatgaaaaaagcactcgaggagcaatatggaggggaggaggagctgcctcagacaaatccaggattcaacaacactccatttaagtttacaaaatattccaatgcctacatgctcgtctatattagagagagtgacagggacaagattatctgtaatgttgatgagaaggatatagcagagcacctaagggttagattaaagaaagagcaagaggagaaggaacagaaaagaaaagagaaagccgaggcacatctttatacaatcataaaggttgcgcgtgatgaagatctttctgagcagatagggaaggacatatttttcgatcttgtagatcatgacaaggttcgaagttttcgcattcagaagcaaacaccatttatagttttcaaggaagaggtggcaaaagaatttggcatccctgtacaatttctacgattctggttttgggcaaaacggcagaaccatacctaccgtcccaacaggcctttgtcactggcagaggagtcccaaattgtttgccacttgagagaggcttctaacaagacaaacaatgcagagttaaaactatttcttgaaatagaaccaagcccagatcttaatccacttcccctacctgaaaagacaaatgcggatatattactcttcttcaaactttatgatcccgagaaagaggagctaaggtatgttggcaggtcatttgtgaaggctttaggcaagccaactgaaattttaacaaagttgaatgagttggctgggttcgcaccaaatgaagaaattgagcttttcgaggaaatcaagtttgagccaaatgttatgtgtgagcatattgacaagaggcttactttccgtggcagtcaacttgaagatggagacattatttgttaccagagggtcatttcaaaggaagatgaagaacgatttcggtttccagatgttccagcttttttggaatatgtgcacaaccgacagattgttcattttcggtgcctggagaagccaaaggaagacgacttttgtcttgagctgtcaaaactctacacttatgatgatgttgtagatagagttgctcataaacttggtttagttgatccttccaaaatcagacttacagcgcacaattgttactctcagcaaccaaagcctcaacctatcaagtaccgtggcgtggatcacttatctgatatgctggttcattacaatcagacttctgatatcttgtactatgaagttctggatatacctctcccagagttgcaaggactaaagaccttgaaagtagcttttcatcattcaacaaaagatgaagtatctgttcatactataagattgccaaaacaaagtactgttggagatgtcattaatgacctcaagacaaaggtggacttatccaaccctgatgcggaaatacgattgctcgaggttttctaccacaaaatttacaagatttttccacttcttgaaaagatcgagaatataaatgatcagtactggactttaagagcagaggagattccggaagaggagaagaatctaggtcctcatgaccgtttaatccatgtttatcatttcaccaaagatgcatcccagaatcacatggttcaaaattttggagagccattctttctgcttatacatgaaggtgagactctggcagaggttaagcaacgaatccagaagaagttgcaggtttctgatgacgaatttgctaagtggaagtttgcgtttctctccttgggtcggcctgattatcttcaagatacagaaattgtttcaagtcgctttcagaggagagatgtttatggagcttgggagcaatatcttgggttggagcattctgacaatgccccaaaaagatcgtaccaaactaatcagaaccgtcacacttttgaaaagcctgtgaagatatacaattgaagccaaagctgaaatgtgatgcctttgtactgatagccacctgcaattcaatgtaactatgattaattggagacaaattcaggtcccactattttttgaagcagtatatctggtttgtcaaaagcatagaaatagtttctcacgtttggctctactgaaagaactcccttagagagaagttccttgccagctcatttctctttccctgtatttcatgtcggttcttgtatccgttagtcttctcttattattaaatgagaagttaaaattctgctttgtcttgaccttggaatatggcatgcacaacgctatggtcagcagcagatagtttcttattgattctgtgcctgaagtaagcaattgtggaagctgagtttcatgcaacatattttggacaaagtactccaagttggttcattttgtagaatcatgtgagggctcatcaattttgttgtaatttaatatttgtttctggaatcgtctgctcttgtatacagtggtgggagatatatgtcacaatcttcctctcgtagagttgctcatgggagtttatcactgcattatttgtgatacacagtagttattttagattgtgaagttataggatatgtgaacatagttttctgaatcagttcccaaaactgtcagtactacatgcaaatgaatttgaactctaaacatatagatctgaccgtatatatccc

SEQ ID NO: 2411 - DNA, 3911 bp, Prunus persica
ctctcattttgaccttgtttttgcagcagcagcagcagcaacagcaggaggacgatgagatgctggtgccgcactctgagttccccgatggtcctcagcccatggaggaagctcaagcagaaactaacaatacagtggatgctcagtcagtggatgatccattgtcagctagatttacatggacaattgagagcttttcaaggcttaataccaagaagctatattctgatattttccttgttggaggctacaaatggcggatactaattttcccaaaagggaacaatgtggatcatctgtcaatgtatctagatgttgcagattcgggaactttgccttatgggtggagtagatatgcccagtttagcttgtctattgtcaatcaaattcatagtaaatattcaattagaaaagaaacacagcaccagtttaatgcacgggagagtgactggggtttcacttcgttcatgcctcttggtgaattatacgaccctggtagaggttatattgtgaatgatacatgcatagttgaagctgatgttgctgttcgtagagttattgattactggtcacatgactcgaaaaaggaaactggttatgttggactgaaaaaccaaggagctacttgttatatgaactctctccttcagactttgtaccatattccttattttagaaaggctgtgtatcatatgccaacaacggagaatgataatccatctggaagcatccctctggccttgcaaagcttattctacaaacttcagtacaatgatactagtgtagcgaccaaagagctgacaaagtcattcggatgggatgcatatgattcatttatgcagcatgatgtccaagaacttaatagggttctttctgaaaagcttgaagacaaaatgaaaggaactgtagtggagggtacaatacagcagttatttgaagggcaccagatgaactatattgaatgcatcaatgtggactataaatcgacgagaaaagaatcattttatgatcttcaactggatgtcaaaggctgtcgggatatttatgcttcattcgataagtatgtggaagtggaacgccttgagggtgataataagtatcatgctgaacaatatggtttacaggatgctaagaagggtgtcctattcattgattttccacctgtccttcaacttcagctaaaacgttttgagtatgattttatgcgggacaccatggtaaagataaatgatcgctatgagttccccttgcaacttgatcttgatagggagaacgggaaatatctatccccggatgctgacaggagcgttcgcaacctttacactcttcatagtgttttggtgcacagtggtggggtgcatggtgggcactactatgcttatatcaggccaaccctttctgatcagtggtttaaatttgatgatgaacgagtaacaaaagaagatatgaagagggctctagaggagcagtatggtggtgaagaagagttaccacagacaaatcctgggttcaacaatgctccatttaaatttacaaaatattcaaatgcctacatgcttgtttatatacgtgaaattgacaaggagaagataatttgtaatgtggatgagaaagacattgcggaacatctgaggataaggctgaaaaaagaacaggaagaaaaggaacaaaagagaaaggaaaaagctgaagcgcacctttatactatcataaaggttgcacgaaacgaggacctgcatgaacagataggaaagaatatctattttgatcttgtggatcatgacaaagttcatagtttccgtattcagaagcagatgcccttcaacctctttaaggaagaggttgccaaagagtttggtataccagttcaatttcaacgtttctggttgtgggcaaagcgtcaaaaccatacataccggccaaatcgaccactgacacctcttgaggaagcgcaatctgttggagagttgagggaagtttccaataagtcaaataatgcagagctaaagttgtttcttgaaatagaacttgggccggatttgctgcctctttctcctccggaaaagaccaaagaagagattcttctatttttcaaactctatgatcctgtgaaagaggagctccggtatgttgggaggctgtttgtgaagggaagtggtaagcctgttgaattattcgcaaaactaaatgaaatggctggtttcagtcctgatgaaaagatagaactttttgaggaaataaagtttgaacctaatatcatgtgtgaacacattgatgagaaggcaacctttcgtgttagtcagcttgaagatggggacatcatttgctatcagaaatctcctcaggctggaagcagtgaacaattccgttatccagatgttccttcattcctggattatgttcgtaaccgtcaggttgttcgttttcgttctttggacaaaccgaaggaagatgaattctgtcttgagttgtcaaagttccacacctatgatgatgttgtggaaagagttgctcaacatcttggcttggatgatccaactaaaattaggctcacatctcataattgttattcacagcaacctaaaccccaaccaatcaagtttcgaggagtagaacatttgtctgacatgctggtacactacaatcagactacggatgtactctattatgaagtattggatatacctctcccagagctgcaaggcctcaaaactctgaaagttgcctttcatcatgctaccaaggatgaagttgtggttcataccattagattaccaaaacagagtagtgtaggagatgtgattgatgaccttaagacaaaggtggagttgtctcaccctgatgctgaactcagattgctagaagttttctatcacaagatctacaagattttcccaccaaatgaaaagattgagaacataaatgatcagtactggacattgcgtgcagaagagatccctgaagaagagaaaaactttgggcctcatgatcgcctgatccatgtttatcattttatgaaggacacagctcagaaccaggttcagaattttggagaaccatttttcttggtcattcgtgaggatgagacattagcggaagtgaaagtgcgtgtacagaaaaagttacaagtcccagatgaggagtattcaaagtggaaatttgcgtttttgtccatgggtcgtcctgagtacctccaggacgatgacattgtggccagccgatttcagagaagggatgtgtatggagcatgggaacagtaccttggtttggaacacactgatcatgctcctaaaaggtcacatacaacaaatcagaatcgtcacacatttgagaagccagtgaaaatctacaactaaaactactgcaatgactttgtcagctcatttcacagattcaacctttatacatatgcagaatcttgtgaagagcccgagatgcacaaaggaagctttgttacagtttgccatagttattgaccttactgggcataaaattctttagtagagtgacagaaatttttagcctaaacttttgtatcctcgatggttcggacacttctccctttcaggcacctgtcgttgaggtgtgaggtaggaggcatctcattttgaatccatgtaattccgtatataagattttggggtgagcaatgtatagagggtataggtgcaggtttaaatgcagtttcttgtccagttatattgtgttgatctttttgaatccttggtggaaaaagctctgtataatattggagttggcttccctggtgttttatttatttctgtatgttttggggtgcaatggtaggctgctgttgctgtgacctgtggaggttgaaatgacttcaatattttgccaataagaaactagttagctgccgttacatttggcacaaccagttttaccagttt

SEQ ID NO: 2412 - DNA, 4560 bp, Theobroma cacao
ttgaaagaataaaatggagataaacgaaaacagaaaatttgatatttaaggacaaaaatgttacatactttttaaaataaataaatttatattagaatctcattttgattaattggaataaagtaaaagggattaaaatagaaggttgaccttgtgattgtgtatatctacaaatatcatacacagtattattattgtacgtcgtatttgtatatgtatattacttttacctttcttagtggagttgcaagaaaaaaatataaagtgcagaaaataattcgaaatcccgaaaacgcccatttcccaaataaagaccatcgaaagacctttctttctccccctcgaccaccttctggtgatctctctctctctcctttcttctcttctcttcactgtaataaatcaccatatagaattgaacgaaaagaaagagaaaacatttctcccatttccccttctctcttttctctgtttcgtaagcttcgaattcacctctcaatttcatagccatgacagtcatgacccctgcccccgtcgatcaacaagaagatgaggaaatgctcgtgccacactctgatttgaccgacaatcaccagcccatggaagttgctgcgcaacccgagactgcgagtactgtggaaaatcagccggtggaggatcctccttcatcaagattcacttggaagattgagaacttctctagattaaacactaaaaagcattattccgaagtcttccccgtcggtggtttcaaatggcgaatactgatatttccaaagggaaacaatgtggatcatttgtctatgtatttggatgttgctgactcggcaagtttaccctatgggtggagtagatatgcgcagtttagtttggctgtggttaatcaaattcataataaatattccataagaaaagacacacaacaccagtttaatgcacgagaaagtgattggggtttcacatccttcatgccccttggcgagttgtatgatccttgcagagggtatcttgtgaatgacactttgattgttgaagcagaggttattgtgcgcagaattgtggattactggacatatgactcaaagaaggaaactggttatgttggtcttaagaatcaaggggcaacttgttacatgaactctctgctccaaactctgtatcacattccttactttaggaaggcagtgtatcatatgcctacaactgagaatgatatgccatctggaagcatccctcttgctctacagagtttattttataaactccagtacagtgacagcagcgttgcaacaaaagagctgaccaaatcttttggatgggacacatatgattctttcatgcaacatgatgttcaagaacttaatagggtcttgtgtgaaaaacttgaagataaaatgaagggaactgttgtggagggcaccatacagcagttgtttgaagggcaccatatgaactacattgagtgcattaatgtggattacaaatctacaaggaaggagtcattttatgaccttcagcttgatgttaaaggctgtcgcgatgtatatgcttcttttgacaagtatgtagaagttgaacgtcttgaaggtgataacaaatatcaggctgaacaatatggattgcaggatgctaagaagggtgtgttgttcattgactttcctccagtccttcaacttcaacttaaacgatttgaatatgattttatgcgggacaccatggttaagattaatgaccgctatgagttccctttgcaacttgaccttgaccgagacgaaggaaaatacttatcaccagaagctgataggagtgttcgcaatctttacacacttcacagtgtccttgttcacagtggtggagtgcatggaggacattattatgcatttatcaggccgactctttctgatcaatggtataaatttgatgatgaaagagtaaccaaagaagatatgaaaagggcattagaggagcagtatggtggtgaagaagagttaccacagacaaatccaggattcaataatactccttttaaatttaccaaatattcaaatgcatacatgctggtgtatatacgtgaaagtgacaaagacaagataatatgtaatgtggatgagaaggatattgccgaacatcttagggagaggctgaagaaagagcaagaagaaaaggagcataaaaagaaagaaaaggcggaggcacacctttacactattataaaggttgcacgagatgatgatcttgcagagcagattgggaaggatatatattttgatcttgtggatcatgataaagtcaggagttttcgaattcagaagcagacacctttcaatgtgtttaaggaagaggtttctaaagagtatggcataccaatacaatttcagcgtttttggttgtgggccaagcgtcaaaaccatacataccgtcctaaccgaccattgacacctttggaggagacacaatcggttggagcattgagggaggtatcaaataaggctcataatgcagaactaaagttgttcctggaagttgagcttggactggatttacgcccaattgctccaccagataagacgaaggaagatattttgcttttcttcaagcactatgatcctgagaaagaagagcttcactttgtcggaaggctgtttgtgaaaagtacaggcaagccgatagaaattttgtccaaattaaacaaaatggcaggatatgctcctgatcaagagatcgatctttatgaggtttgcttctgcaattttgcgttctcagtcaactttttccagtgtcttgacattcttatgaaggataataccttgattttgctctaatgtccaggaaattaagtttgagcccagtgttatgtgtgaaccaattgacaagaaactcacggtccgagctagccagcttgaggatggtgacataatttgctttcaaaagtctctccctgttgaaagtactgaacaattccgctatccagatgttccgtcatttttggaatatgtgcataatcgccaggttgtacacttccggtctttggaaaagcccaaggaagatgatttttgtctagagatgtcaaggctttatagttatgatgatgttgttgaaagagtagctcagaaacttgatttggatgatccatcgaaaatcaggcttacttctcacaactgttactctcagcaacccaaaccccagcctattaagtatcgtggagtggatcatttgtctgacatgctgatccactataatcagacttctgatattttatactatgaagtattagacatccctctgccagaattacaatgtttgaaaaccctgaaggtagcatttcatcatgctactaaggatgaagttgttatccatacaatcaggcttccaaaacagagcactgtgggcgatgtgattaatgatcttaagacaaaggtggagttgtctcatcctaatgcagaactgaggttgcttgaagttttctatcacaagatctacaagattttcccgcctaatgagaagattgagaatataaatgaccaatactggacattacgggcagaagagattccagaagaagagaaaaatcttggtccaaatgatcgcctaattcatgtttaccactttactaaggaaacagctcaaaaccagatgcaaattctgaattttggagaaccctttttcttggtgattcgggaaggtgagactttggctgaaataaaagtccgagtacagaagaagctgcaagtgccagacgaggagtttgctaagtggaagtttgcattcctttcacttggccggccagagtaccttcaagattctgacattgtatctggtcgttttcagagacgagatgtgtatggtgcttgggagcagtatcttgggttggagcactctgacaatgctcctaaaagagcttatgcagctaatcagaaccggcacacctttgagaagccagttaaaatctacaactagggagcattttagataagtcccttgatgacattgtgaaaaagggtgcctgtctactcggatgataagggtggagaggaacacttaaagcaaatgagaatgtgaggcaacaagttagagttgagatggcatgtgcagcatttgcttgttgatttgttggatatgtaattctttggcttgtgtggattggaaggggacttttacctaagcaagtgtgcatctgcaaatgtgaaatacaatccattgagcttttgctacttgaggttttgtcccggttaatgggtaagttgcctttgtattttggaaggtacataaacaagattttggattagtgaatatgtatacagagtatagttgggagaacgatgtcattgtccccccccccccttgtttgcttcctgattttgtccatgtagatgccttttagcgaaatgggggggctttgtaatggttgattgccattcttttcaagcctatggctatatctagtttctcatataagaaatttacctaactttttctggaaggcacttgtatatctcctcctttttacctttttctcttacaaaatttaaatattttaataattaaataattttaaataaa

SEQ ID NO: 2413 - DNA, 3977 bp, Eutrema halophilum
tatcgaagccgagaaagagtaggaatgagcgattgtatttctccctagtcactttgccttctcttttttccccttctctttgattttttctctgtttctcggtctctcgatcccccaccgtcaattcttctccggccaatgactatgatgaccccgcctccggttgatcagcaagaggatgaggagatgctcgtgccacattcagatttggtcgacggccctactcagcccatggaagtcacccaacctgagactcctgcgagtaccgtggagaaccagccagctgaggatcctcccactctgaaattcacgtggactatcccaaacttctctaggcaaaacaccaggaagcattactccgatgtatttgtcgttggaggttacaaatggcgcatattgatcttcccgaaagggaacaatgtcgaccatttgtccatgtacttggatgtttctgatgctgcgagtttgccgtacggttggagcagatatgctcagttcagtctggctgttgtcaatcaaatccacaccagatataccattagaaaagaaacgcaacatcaattcaatgcaagagaaagtgattggggatttacatcattcatgcctctcagcgaactctatgatcctagtagaggatatttagtgaatgatactgtgttcgttgaagctgaagtcgctgtacgtaaggttcttgattactggtcatacgactctaaaaaagagactggttttgttggtctcaagaaccaaggtgcaacttgttacatgaactctctcctacagacactataccacataccttacttcagaaaggctgtataccacatgccgacaactgagaatgatgcgcccacagcaagtatacctttggctctccaaagtttgttttacaagctccaatataacgacactagtgttgcgacaaaagagctgacaaagtcgtttggttgggatacatatgactctttcatgcaacatgatgtccaagaactcaatcgagttctctgcgaaaaacttgaggacaaaatgaagggaactgttgtggaaggaacgatacaacggctatttgagggtcaccatatgaactatattgagtgcataaatgttgattataaatctacacggaaagaatcattttatgaccttcagctggatgttaaaggctgcaaggatgtttatgcttcttttgacaagtatgttgaagttgaacgccttgaaggagacaacaaatatcatgcagaaggacaaggtttacaggatgcaaaaaaaggtgttcttttcatcgactttccaccggttcttcagctccagctcaagaggtttgaatatgactttatgagggacactatggtgaagataaatgatcggtatgaatttcctcttcaactggatcttgatagagagaatggaaagtacttatcccctgatgctgaccggagtgtccgcaacctttacacacttcacagtgtcttagttcatagtggaggagtacatggtgggcactattacgcttttataaggcctacgctctcagatcagtggtataaatttgatgatgaacgagtaaccaaggaagatttgaaaagggcattggaggagcaatatggtggtgaagaggagctaccacagactaatcctggtttcaataaccctcctttcaaattcacaaagtactcgaatgcgtacatgcttgtatatatccgggaaagtgacaaagataaaataatctgcaacgttgatgagaaagacattgctgaacatttaagggtgaggctgaagaaagaacaagaagaaaaggaagataaaagaagatacaaggcacaagctcacctgtttacgataattaaggttgcaagagatcaagacctcaaggaacaaattgggaaggatatatattttgatctagttgatcatgacaaagttcgtagtttccggatccagaaacagacaccatttcaacaatttaaggaggaggtggccaaagaatttggtgtacctgttcagttacagaggttctggatttgggcaaagcgacaaaaccatacttatcgtcccaatcgcccccttacgccccaggaggaattacaaccggttggacaaataagagaagcatctaacaaggcaaacactgcagaacttaagctgtttttggaagtagagcttctggatgaacgtcctattcctcctcctgaaaaatcaaaagaagatattcttcttttctttaagctttatgaccccgagaagccagagttaaggtatgttggcagactgatggtgaaaagttccagtaagcctatggatataactggaaaactgaacgaaatggctggctttgctcccgatgaagaaatagaactttttgaggaaatcaagtttgagccttgtgttatgtgcgaacacctggataagaaaacttcattcagattgtgtcaaattgaggatggagatatcatttgctttcagaaacctcttattaacaaagagaatgaatgccgctatccagctgtgccttcgtttcttgaatatgtccagaatcgacagctggtccggtttcgtgccctggaaagacctaaagaagatgaatttgttctggagttgtcaaagttgcacacttatgacgatgtcgttgaaagagtggcccaggagcgtggtcttgacgatccatccaaacttaggcttacatctcataattgctattcccagcaacccaagcctcagcctatcaaataccgtggagtagaccatttgtcagatatgttagttcactacaatcagacgtctgacattttgtattatgaagttctggacattcctcttccagaattacaaggtcttaaaaccttaaaagttgctttccatcatgccacaaaggaagaagtggttatccacaatatcagattgcctaaacaaagcacagtcggagatgttataaatgaacttaaaacaaaggtggagctttcgcacccagatgcagaattgagattacttgaggtgttttaccacaagatctacaagattttcccattaactgaaagaattgagaatataaatgaccagtactggaccttacgagctgaggagattccggaagaagagaagaatattggtccaaatgatcgtttaattcttgtgtaccactttgctaaggagactggaccaaatcagcaagtgcaaaactttggggagcctttcttcttggtaatccatgaaggtgaaactcttgaagaaataaagaaccgtatccaaaagaagcttcatgtatctgatgaggactttgccaagtggaaatttgcgtttatgtcaatggggcgtccggagtacttgcaggactcagatgttgtttataatcgcttccagagaagagagatctacggtgcttttgagcagtatctcgggttggagcacactgatactactcctaaaagggcttatgctgctaaccagaatcgacacacttatgagaagcccgtgaaaatatacaattagccaaaagaaaaaaaacacaatagtcatcaggacattgtggccgcaacagttggaccaaggcgatctaataaaggagggaaagagagccgagagtgtgaggtgtgatgatcgaccgtaggatcttgtagagaatttggtctgatagggtttttgggttgcgcattgatagtgtgtttttatttttatatttatttttatttctttctctcgtgctttcaatacttttgtgttaatatatggaatgtgtgaagactattggcacatgcaatttttattttgaaaacatcaagaaaaaaaaaacggaaagtccgtcgcttggattcgggagcgcggttggctttcagagtttatagaataccgaaacatttgtaattttagagatttggtgggtttgttaagaaagatctttttgactggcgattgtatagcttttggatttccaatcgttattattattgttgtttgctttgccgaaatcagatgaaaacgtt

SEQ ID NO: 2414 - DNA, 4302 bp, Prunus mume
cctccctgaagttgcactcagcggcttgtctcggagccagtttctttcgggagtgtcccctcctttgcaaaacgaagccccgcttctctctctctctctctctctccgcctctctatctttcactgtatccattcgtctctcagattcgtcgatcggacggctcattgttcgccatcaatgactatgatgactcctgcaccgttagatcagcaagaggacgaagagatgcttgtgccgcactcggatttggtcgaaggccctcagcctatggaagtagcccaagtggagccggctgctagtacagttgaaagtcagccagtggaggatcctccaaccatgaaattcacttggactattgagaactttgctaggttgaacaccaagaagcactactctgacatgtttattgttggcggctataaatggcggatactaatatttcccaagggaaacaatgtggactacttgtcaatgtatttggatgtggcggattccgggacattgccatatgggtggagtagatatgcgcacttcagcttggctgtagttaatcagatccataccaagtactcaataagaaaggatacacaacaccagttcaatgcaagagaaagtgactggggattcacgtcattcatgccactcggtgatctttatgatcctagtagggggtatttggtgaatgatacagtcgtcgttgaagctgaggttgctgtccgtaaggttcttgattactggtcgtatgactcaaaaaaggaaactggttatgttgggctcaagaatcagggagcaacgtgctatatgaattctctactccagactttgtaccatataccttacttcagaaaggctgtgtatcatatgccaacaactgagaatgacatgccttcaggaagcatccctttggcactacaaagtttattctataagcttcaatacaatgacagcagtgttgccacaaaagaattgaccaagtcttttggatgggatacatatgattcctttatgcaacatgatgtgcaggaacttaatagagttctttgtgaaaagcttgaagataaaatgaagggaactgttgtggagggtacaatacaacaattgtttgaaggacatcacatgaattacattgaatgcataaatgtggattacaaatctacaagaaaagaatcattttatgacctccagctcgatgtcaaaggctgtcgggatgtttatgcttcttttgacaagtatgtggaagttgagcgtcttgagggtgacaacaaataccatgctgaagaacatggtttgcaggatgctaagaagggtgtcctgtttattgacttccctcccgttcttcaacttcagttaaagcgatttgaatatgattttatgcgagatacaatggttaagataaatgatcgctatgaatttcctcttcaacttgaccttgatagggagaatggcaaatatctatcacctgactcagataagagtgtccgcaacctctacactcttcatagtgtcttggttcatagtggtggggtgcatggtggacattactatgcttttatcaggccaaccctctctgaccagtggtacaagtttgatgatgaacgtgtgacaaaagaggatgtgaagagggcattagaagagcagtacggtggtgaggaagagttgccacagaccaatcctggcttcaataacactcctttcaaatttacaaaatactcaaatgcatacatgcttgtgtatatacgggacagtgataaggacaaaataatatgtaatgttgatgagaaagacatagctgaacacttaaggataaggttgaagaaagaacaagaagaaaaagaagacaaaaggagatataaggcacaagcacacctctatacgattataaaggttgctcgagatgaggacctggcagaacaaattggaagggatatatattttgatcttgtggaccatgacaaagttcgtagtttccgtattcagaaacagacaccatttaatcttttcaaggaggaggttgcaaaagagtttggtataccagtgcaatttcagcgcttctggatttgggctaagagacaaaaccacacatatcgccccaatcgaccattgacacctcaagaagaactacaatcagtcggacacttgagagaggtatcaaataaaacacacaatgcagagctgaagctgtttttggaagtagagtttgggccggatctacgccctattcctctgcctgacaaaaccaaggaagatatcctgctgttctttaagctttatgaacctgagaaacgagaactacgttttgtcggtaggctatttgtgaagagttctagtaagccagtagatattttggcaaaattaattcaactggctggttttggccccgatgaagaaattgaactttatgaggaaataaagtttgagccttgtatcatgtgcgaacaccttgacaagaggacctcatttcgatcaagtcagattgaagatggagacatcatttgctttcagaaatctactccacttgaaagtgaagaagaatgtaaatatcctgatgttccttcatttttggaatatgtacacaatcgccagattgttcatttccgttctttggagaaaccgaaggaggaggattttagtttagaattgtcaaagctacacacttatgatgatgtggtggagaaggtggctcgccaaattggtttggaagatcctactaaaatcagactcaccgcgcataactgctattctcaacaacctaagccccaaccaatcaaatatcggggagtagagcatttaacagatatgctagtccattacaatcaaagctctgatattttgtattatgaggtcttggacatcccccttccagaattgcaaggcctgaaaaacctgaaagttgcttttcatcatgctacaaaagatgaggtggtgattcacaatattagattgccaaaacagagcactgtcggcgatgtgattaatgtacttaaaacaaaggtagagctgtctcatccaaatgcagaactcagactgcttgaggttttctatcacaagatctacaagattccagaagaagagaaaaacttggctgtccatgatcgcttgattcatgtttaccactttacaaaggacactgcacagaaccagatgcaagtacaaaattttggggaacctttcttcttggtcatccatgaaggtgaaactctagctgaagttaaagtacgtgtacaaaagaaattacaggtccccgatgatgagttttcaaagtggaagtttgcattcttgtcacttggtcgtccagagtacttgcaggattctgatattgtttccagccgatttcagagaagagatgtttatggtgcttgggagcagtaccttgggttggagcactctgataatgctcctaagagagcttatgccacgaatcaaaaccgtcacacatatgagaagccagttaaaatatacaactaataagaccgatgatcctcgagtggtgcatcagcttgtactaagcatccttccctgccacagaggcagtccagaaacaggcacgatgcgaacgagtggcacatccaaagaacgaagctcacatgtaggtgcttcgggtaggattcagttattgtattgtgagcccaattattcattcatgtgggtgggggaatggggggatcatctcctggatgtgtagtaagattattactccctgcttgagttctgctctgttctttttgtttgtttttttactctgtattgagggcacctccttgctttgagaggttggttgctttccttatacagctccactgtaatttagcagtacataaggagattttgagggcatgtatatcgggtacagtcggctgcatttaggattgttccgtaatattatttttcttcatgttcaattaattttatcgtaatttggtgcaagatgagtgagagaattaacaaaacctatggaaatgagtctctattagcaaggtttggctggcccacaattatggcttttggattttataagatatatgattggatcagtatgtctttttttgggtctgaagtatgtttgtgtttatcgggctattttccggttcatctgtgggagattttatgatttagcatttcaattctcaaataaatgtaaagaaatggtgtatcgaatttaagtaaaaatattaataagcaatgtaattgaaaactcgacttaaatttgttaccttcttaacaattggtttgaccgttccccttcctccctcgtcttcattttatctcgtgacggcttgacttgtcctcccttaccttatggc

SEQ ID NO: 2415 - DNA, 3879 bp, Gossypium hirsutum
cgtcgacggtcctcagcctttagaagtggcgaaggaagctgcaagtaaagtggatgcacaagcagtggatgatccaccgtcaggaaggttcacatggacaattgagaatttctcgaggcttaatactaagaagctctactctgacatcttctttgttggaggctacaaatggcggatacttattttccccaagggtaacaatgttgatcatttgtcaatgtatcttgatgttgcggattcagcaactttaccttatggatggagtagatatgcacagttcagcttagctgtctgcaaccaaatacataataagtatactattagaaaagacactcagcatcagttcaatgtacgtgaaagtgattggggctttacttcattcatgcctcttggtgaactatatgaccctagtagaggctttcttgtgaatgacacatgtgttgtagaagctgatgttgctgtgcgtaaggttgctgattattggtcacatgactcaaaaaaggagactggttatgtcggactcaagaatcagggagccacctgctatatgaactctctcctccaaacactctatcatattccctacttcagaaaggctgtgtatcatatgccaacaactgagaatgacatgcccacagggagcattccattggctttgcagagtctattttataagctccagtatagtgacactagtgtggcaaccgaggagttgacgaaatcttttgggtgggacacttatgattctttcatgcagcacgatgttcaggaacttaatagggttctttgtgaaaagcttgaagacaaaatgaagggaacagttgtggagggtacaatacaacagttgtttgaagggcatcatatgaattatattgaatgcatcaatgtggactataagtcaacgagaaaggaatcgttttatgatattcagcttgatgtgaaaggctgtaaggatgtttatgcatcgtttgacaaatatgttgaagtggagtgtcttgaaggtgacaataggtatcatgctgaacaatttggtttacaggatgccaggaaaggagttcttttcattgactttcctcctgtccttcaacttcagctaaaacgttttgagtatgatttcatgcgagatactatggtgaagataaatgatcgctatgaattccccttgcaacttgatctagatagggaggatggcaagtatttatcacctgcggctgacagaagtgttcgcaacctttatacacttcacagtgttttggttcacagtggcggggtgcatggtgggcattactatgcttatatcaggccaaccctctcagatcagtggttcaagtttgatgatgaacgggtaacaaaagaagatgtcaagagggcattggaggagcagtatggtggtgaagaggagttaccgcagacaaatcctgggttcaacaacactccatttaaatttactaaatattcaaatgcatatatgcttgtgtatatacgagaaagtgacaaggataaaataatctgtaatgtggatgagaaggacattgctgaacacctgagaataagattgaagaaagagcaagaagagaaggagcaaaagaggaaggaaaaagcagaggcacatctgtatactgttataaaggttgcacgtaatgaagacctagttgagcagattggaagggatatatactttgatctggtggatcatgaaaaagttcgtagctttcgaattcagaagcagatgccttttaatgttttcaaggaagaagttgctaaagagtttggtattcctgtgcaatatcaacgtttttggttgtgggcaaagcggcagaaccatacataccgtccaaatcgaccattaacttatcaggaggaagcacaatctgtaggacaacttagagaggtttcaaataaggcgaataatgcagagctgaagttgttcctggaagtggagcttggaccggatttgcagccagtacctccacctgagaagactaaagaagatattcttcttttctttaaactctatgacccagtcaaagaggagctccgttatattgggaggatgtttgtgaagggtgctggcaagccaatggaaatattggcaaggatcaacaaaatggcaggctttggtcctgatgaagagattgaactttatgaggaaataaaatttgaacccaatgtcatgtgtgaacacattgacaagaagctcacattccgtaccagtcagcttgaagatggtgatattatatgccttcaaaaatattctgaagttgcaagcgaacaatgccgttatcctgatgttccttcatttctggagtatgtacataatcgtcaggttgttcggtttagatctctagaaaagccaaaggaggatgaattttctcttgagttgtcaaagcttcacaattatgatgatgttgttgaaagggtggctcaccatcttggcttggatgatccttccaaaattaggcttacatcccataactgttattcccagcaacctaaacctcaacctatcaagtacagaggagtcgaacatttgtctgacatgcttattcactacaatcagacatctgatattctatattatgaagtgttggatatacctttgccagaactccagggcctcaaaacattgaaagttgctttccatcatgctaccaaagacgaagtagttattcatactattagattgccaaaacagagcactgtaggggatgttcttgatgacctcaagacaaaggtggagttgtctcatcctggtgctgaacttagattacttgaggttttctatcacaagatttacaagatcttccctctcagtgaaaagatagagaacataaatgatcaatattggacattacgtgcagaggagataccggaagaggagaaagaccttggtccccatgatcgcttgattcatgtttaccatttcatgaaagacacaacacaaaaccagcaggtacagaattttggggagccatttttccttgttattcatgaaactgaaacattagctgaagttaaagtgcgagttcagaaaagattacaggttccagatgaggaatttgcaaagtggaagtttgcatttttatcactgggtcgtccagagtatcttcaggactctgatgttgtgtctactcgttttcagagaagggatgtatatggtgcttgggaccagtatcttggactggaacattctgacaatgcccctaagcggtcatatgcagcaaatcagaaccggcatacatttgagaagccagtaaaaatctacaactagatcaaaaactggaagagctacaacaactgtatgaggtgaaacgtgtagccgacagtacgtccaacttttgtgtaataagcgaagaagccagaaggaggctgattgtttggtaatgcaggaacggttatcaagtaaattagatgtgattcattcagcggtatgggaagatgtcatcaacctagaaactctacatgttttcccaatagatagggacccgcctagttccgtggacaaagtggtttttaggtaagcatttggtgttaaagttcggttgtaatctacttactacacgacgagattttgtttttggcatttgttgtgggtcgaaaatttatattagcgggctggtgagtgagtgattggggattgtgtatagaaaatatagactggtagagacctaatgtttttcatttaatctcctaaattcgtgaactggtttttgcataggatgtcacttgttattggggacccccgtcccagcttttgtgtaatagaatgaatcatatcaccatcaactgcccaacaaccagcctttggcttccaacttacatacatatataaagaaacgaacgtaagctatgacatgtttatatagaaaccaaagtaaa

SEQ ID NO: 2416 - DNA, 3877 bp, Arabidopsis lyrata
gcgattgtatttctccctagagtcactttgcctcttctttgatttttctctgcatcgtcggtctctcttttgcgtttctcgatcccaccgtcaaatccttctccggccaatgactatgatgactccgcctcccgttgatcagccagaagatgaggagatgcttgtgccgaattcagatttggtcgacggtcctgctcagcccatggaagttatccaacccgagactgctgcgagtactgtggagaaccagccagctgaggatcctcctactctgaaattcacgtggactatccctaatttctctaggcaaaataccaggaagcattactccgatgtatttgtcgttggaggttacaaatggcgcatattaattttcccgaaagggaacaatgttgatcatttgtccatgtacttggatgtttctgatgctgcgagtttgccgtacggttggagcagatatgctcagttcagtctggctgtagtcaatcaaatccactccagatataccattagaaaggagacgcaacatcaattcaatgctagagaaagcgattggggatttacatcattcatgcctcttagcgaactttatgatcctagtagaggatatttagtgaatgatactgttttggttgaagctgaagtcgctgtacgtaaggttcttgattactggtcatatgactctaaaaaagagactggttttgttggactcaagaaccaaggtgcaacttgttacatgaattctctcctacagacactataccacataccttacttcagaaaggctgtataccacatgccgacaactgagaacgatttacccacagcaagtatacctttggctctccaaagtttgttttacaagctccaatataatgacactagtgttgcaacaaaggagctgacaaagtcttttggttgggatacatatgattcctttatgcaacatgatgtgcaagaactcaatcgggttctctgtgaaaagcttgaggacaaaatgaagggaactgttgtggagggaacaatacaacaactatttgagggccaccatatgaattatattgagtgcataaatgtagatttcaaatcgacacggaaagaatcattttacgaccttcagctggatgtgaaaggctgcaaggatgtttatgcttcttttgacaagtatgttgaagttgaacgtcttgaaggagataacaaatatcatgcagaaggacatggtttgcaggatgcaaaaaaaggtgttcttttcattgactttccaccggttcttcaactccagctcaagaggtttgaatatgactttatgagggacaccatggtaaagataaacgatcggtatgagtttcctcttgaactggatcttgatagagaaaatggaaagtatctgtctcctgatgctgacaggagtgtccgcaacctttatactcttcacagtgtcttagttcatagtggaggagtacatggtgggcactattacgcttttataaggcctacgctctcagatcagtggtataaatttgatgatgagcgtgtaacaaaggaagatttgaaaagggcattggaggagcaatatggtggtgaagaagagctaccacagactaatcctggtttcaataaccctcctttcaaattcacaaagtactcgaatgcttacatgcttgtatatatccgggaaagtgacaaggataaaataatctgcaacgttgatgagaaagacatagcagaacatttaagggtgaggctaaagaaagagcaagaagaaaaggaagataaaagaagatacaaggcacaagctcacctatatacaataattaaggttgcaagagatgaagatcttaaggaacaaatcgggaaggatatatattttgatcttgtggaccatgacaaagttcgcagtttccgtatccagaaacagacaccatttcaacagtttaaggaggaggtagccaaagaatttggtgtacctgttcagttacagaggttctggatttgggctaagcgacaaaaccatacctatcgtcccaatcgcccccttacgcctcaagaggaattacaacaggttggacaaataagagaagcatctaacaaggcaaacactgcagaactaaagcttttcctggaagtagagcacctggatttacgtcctattcctcctcctgaaaaatcaaaagaagatattctgcttttctttaagctttatgaccccgagaaggcagtattaagctatgcaggcaggctgatggtgaaaagttccagtaagcctatggatataactggaaaactgaatgaaatggttggctttgctcctgatgaagaaatagaactttttgaggaaatcaagtttgaaccttgtgttatgtgcgaacacttggataagaaaacttcattcagattgtgtcaaattgaagatggagatatcatttgctttcagaaacctctagttaacaaggagattgagtgccgctacccagctgtgccttcgtttcttgaatatgtccagaatagacagctggtccggtttcgtgctctggaaaaacctaaagaagatgagtttgttctggagttgtcgaagctgcacacttatgacgatgttgtggaaaaagtggctgagaagcttggtcttgacgatccatccaaacttaggcttacatctcacaattgctattcccagcaacccaagcctcagcctatcaaataccgtggagtagaccatttgtcagatatgttagttcactacaatcagacgtctgacattttgtattatgaagttctggacattcctcttccagaattgcaaggtcttaaaaccttaaaagttgctttccatcatgccacgaaggaagaagtggtaatccacaatatcagactacctaaacaaagcacggtcggagatgttattaatgaacttaaaacaaaggtggagctttcgcatccagatgcagaactgagattgctcgaggtgttttaccacaagatctacaagattttcccatcaactgaaagaattgagaatataaatgaccagtactggactttacgagctgaggagattccggaagaagagaagaatatcggtccaaatgatcgcttaattcttgtgtaccattttgctaaggagactggacaaaatcagcaagtgcaaaactttggcgagcccttcttcttggtaatccatgaaggtgaaactcttgaagaaataaagaaccgtatccaaaagaagcttcatgtatccgatgaggactttgccaagtggaagtttgcgtttatgtcaatggggcgtccagagtacttgcaggacacagatgttgtttataatcgctttcagagaagagatgtctatggtgcttttgagcagtacctcgggttggagcatgctgacactactcctaagagggcttatgctgcaaaccagaaccgccacgcttacgagaagccggtgaaaatatacaattagccccacaaaaaagaacacaatggtcagtgagacattgtggcagcaacgttggaccaaggcattgattggaccaatgcatcgaataaggagggaaagagagagtgtgagggtgtgatgatgaccgtaggatgttgtagagaatctggtctgatagggttttgggttgcgcgttgatagtggtgtgttttctattattatttttcctatccttctttctttcgtgcttcaatacttttgtgttaatatctggaatgtgtgaagaccattggcacatgcaatttttattttccaaaaaaaaatatatggaagcccttcgcttggattcggagtttatagaataccgaaacatttgtaattttagagattggggtttaagaagatttttgactgaggaaatttgtattcttttgcattttcaaa

SEQ ID NO: 2417 - DNA, 4113 bp, Brassica rapa
gaaatgacaatattaccccttaaattatcgaagcccagagaaagagtaagagcgattgtataatctctctctcgagtgactttggcgtctctttgattttttcaccgttcgtcggtctctcgatcccaccgtcaatccttctccggccaatgactataatgactccgcctcccggtgatcagcaggaggatgaggagatgcttgtgccgcattcagatttggttgacggcactactcagcccatggaagtttcggaaactgaggctgctgtgagtactgtggagaaccagcagccagctgaggatcctcccactctgaaattcacgtggactgtccctaacttctctaggcagaacaccaggaagcattactctgatgtatttgtcgttggaggttacaaatggcgcatattaattttcccgaaagggaacaatgtcgaccatttgtccatgtacttggatgttgctgatgctgcgactttgccttacggttggagccgatacgctcagttcagtctggctgtggttaatcaaatccacactagatataccattagaaaagaaacgcaacatcaattcaatgcaagagaaagcgactggggatttacatcattcatgcctctcagcgaactttatgatcctagtagaggttatttagtgaatgatactgttttcgttgaagctgaagtcgctgtacggaaggttcttgattactggtcatacgactctaagaaagagactggttttgttggtcttaagaaccaaggtgccacttgctacatgaattctctcctacagacactataccacataccttacttcagaaaggctgtataccacatgccgacaactgagaacgacgcgcccacagcaagtatacctttggctctccaaagtttgttttacaagctccaatataacgacactagtgttgcgactaaagagctgacaaagtcgtttggttgggatacatatgattctttcatgcaacatgatgttcaagaactcaatcgagttctcagcgaaaaacttgaggacaagatgaagggaactgttgtggagggaacaatacaacagctatttgagggtcaccatatgaattacattgagtgcataaatgtagattacaaatctacacggaaagaatcattttatgaccttcagctggatgttaaaggctgcaaggatgtttatgcttcttttgacaaatatgttgaagttgaacgccttgaaggagacaacaaatatcatgcagaaggacatggtttacaggatgcaaaaaaaggcgttcttttcatcgactttccaccggttcttcagcttcagctcaagaggtttgaatatgacttcatgagggacaccatggtgaagataaatgatcggtatgaattccctcttgaactggatcttgatagagagaatggaaagtatttatcccctgatgctgacaggagtgtccgcaacctttacacgcttcacagtgtgttagttcatagtggaggagtacatggtgggcactattacgcttttataaggccgacgctctctgatcaatggtataaatttgatgatgaacgagtaaccaaagaagatttgaaaagggcattggaggagcaatatggtggtgaagaagagctaccacaaactaatcctggtttcaataaccctcctttcaaactcacaaagtactcgaatgcatacatgcttgtatatatccgggaaagcgacaaagataaaattatctgcaacgttgatgagaaagacattgctgaacatttaaggataaggctgaagaaagaacaggaagaaaaggaggaaaaaagaaaatacaaggcacaagctcacctttttacgataattaaggttgcaagggatcaagacctaaaggaacaaattgggaaagatatatattttgatcttgttgatcatgacaaagttcgtagtttccggattcagaaacagacgccatttcaacaatttaaggaggaagtggccaaagaatttggtgtacctgttcagctacagaggttctggatttgggcaaagcgacaaaaccatacctatcgtcccaatcgcccccttactcctcaggaggaattgcaaccggttggacaaataagagaagcatctaacaaggcaaacactgcagaacttaagctgtttttggaagtggagttactggttgaacgtcctattcctcctcctgacaaatcgaaagaagatattcttcttttctttaagctttatgaccccgagaagcaagagttgaggtatgttggtagactgatggtgaaaagttccagtaagcctatggatataactggaaaattgaatgaaatggctggcttcgctcctgatgaagaaatagaactatttgaggaaatcaagtttgagccatgtgtaatgtgcgaacacctggataagaaaacttcgttcaaactgtgtcaaatcgaagatggagatatcatttgctttcagaaacctcttggtaacaaggagactgagtgccgttatccagctgtaccttcgttccttgaatatgtccagaatcgacagctggtccgatttcgtgctctggaaaaacctaaagaagatgaatttgttttggagttgtcaaagttgcacacttatgacgatgtcgtggaaagagtggcggagaagcttggtcttgacgatccatccaagcttaggcttacatctcacaattgctattcccagcagcccaagcctcagcctatcaaataccgtggggtagaccatctgtcagatatgttagtacactacaatcagacgtctgatatcttgtattatgaaattctggacattcctcttccagaattgcaaggtctgaaaaccttaaaagttgctttccatcatgccacgaaggaagaggtggtaatccacaatatcagactacctaaacaaagtacagtcggagatgttatcaatgaacttaaaacaaaggtggagctgtcgcatccagatgcagaactgagaatacttgaggcgctttaccacaagatctacaagattttcccattaactgaaagaattgagaatataaacgaccagtactggactttgcgagctgaggagattcctgaagaagagaaaaatattggtccaaatgatcgcttaattctagtgtaccactttgctaaggagactggacaaaatcagcaagtgcaaaacttcggggagccgttcttcttggtaatccatgaaggtgaaactcttgaagaaatcaagaaccgtatccaaaagaaactgcatgtatctgatgaggactttgccaagtggaagtttgcgtttatgtcaatggggcgtccggagtacttgcaggactcggatgttgtttacaatcgctttcagagaagggatgtctacggtgcctttgagcagtaccttgggttggagcacactgataccagtcctaagagggcttactctgcaaaccagagccgacacacttatgagaagccggtgaaaatatacaattagccggtaagactaaagaaaacacaaatgtcgtcaagacattgtggcagcaacgttggaccaagccagacatcgaataagagggaggaaagaccgagtgtgaggtgtggatgatgaccgaccgtagtaggatgttgtagagaatttggtctgaatagggtgctgggttgcgcatcgatagtgttttgtgttctttttcttctattcgtccttatttctttctttctttcctctgcttcaatactttgtgtaatgtatatggaatgtgagagagagaccattggtacctcatgcaatttttattttcgaacaaagaagaatatggaagcctgtcgcttggattcgggagtgcggtttggctttcagagtttatatagaataccgaaacatttgtaattttaaaagggatttctggtttaagatgtttttgactactgatacacaagtcaatagataaaaggtgcttcgatttgaatatttaactcctgtatgaaatatcaaactgtgttgatgatagcactatgcaactctgtaggatacaacaccctccgttgtctcaacaactaatctcttcatccgtgtcagtagcaatgtgtacgctttctccttatgccct

SEQ ID NO: 2418 - DNA, 3738 bp, Brassica napus
gtataatctctctctcgagtgtactttggcgtctctttgtattttttcaccgttcgtcgggctctcgatccccaccgtcaatccttctccggccaatgactataatgactccgcctcctggtgatcagcaggaggatgaggagatgcttgtgccgcattcagatttggttgacggcactactcagcccatggaagtttcggaaactgaggctgctgtgagtactgtggagaaccagcagccagctgaggatcctcccactctgaaattcacgtggactgtccctaacttctctaggcagaacaccaggaagcattactctgatgtatttgtcgttggaggttacaaatggcgcatattaattttcccgaaagggaacaatgtcgaccatttgtccatgtacttggatgttgctgatgctgcgactttgccttacggttggagccgatacgctcagttcagtctggctgtggttaatcaaatccacaccagatataccattagaaaagaaacgcaacatcaattcaatgcaagagaaagcgactggggatttacatcattcatgcctctcagcgaactttatgatcctagtagaggttatttagtgaatgatactgttttcgttgaagctgaagtcgctgtacggaaggttcttgattactggtcatacgactctaagaaagagactggttttgttggtcttaagaaccaaggtgccacttgttacatgaattctctcctacagacactataccacataccttacttcagaaaggctgtataccacatgccgacaactgagaacgacgcgcccacagcaagtatacctttggctctccaaagtttgttttacaagccccaatataacgacactagtgttgcgactaaagagctgacaaagtcgtttggttgggatacatatgattctttcatgcaacatgatgttcaagaactcaatcgagttctcagcgaaaaacttgaggacaagatgaagggaactgttgtggagggaacaatacaacagctatttgagggtcaccatatgaattacattgagtgcataaatgtagattacaaatctacacggaaagaatcattttatgaccttcagctggatgttaaaggctgcaaggatgtttatgcttcttttgacaaatatgttgaagttgaacgccttgaaggagacaacaaatatcatgcagaaggacatggtttacaggatgcaaaaaaaggcgttcttttcatcgactttccaccggttcttcagctccagctcaagaggtttgaatatgacttcatgagggacaccatggtgaagataaatgatcggtatgaattccctcttgaactggatcttgatagagagaatggaaagtatttatcccctgatgctgacaggagtgtccgcaacctttacacgcttcacagtgtgttagttcatagtggaggagtacatggtgggcactattacgcttttataaggccgacgctctctgatcaatggtataaatttgatgatgaacgagtaaccaaagaagatttgaaaagggcattggaggagcaatatggtggtgaagaagagctaccacaaactaatcctggtttcaataaccctcctttcaaattcacaaagtactcgaatgcatacatgcttgtatatatccgggaaagtgacaaagataaaattatctgcaacgttgatgagaaagacattgctgaacatttaaggataaggctgaagaaagaacaggaagaaaaggaagaaaaaagaaaatacaaggcacaagctcacctttttacgacaattaaggttgcaagggatcaagacctaaaggaacaaattgggaaagatatatattttgatcttgttgatcatgacaaagttcgtagtttccggattcagaaacagacaccatttcaacaatttaaggaggaagtggccaaagaatttggtgtacctgttcagctacagaggttctggatttgggcaaagcgacaaaaccatacctatcgtcccaatcgcccccttactcctcaggaggaattgcaaccggttggacaaataagagaagcatctaacaaggcaaacactgcagaacttaagctgtttttggaagtagagttactggttgaacgtcctatacctcctcctgacaaatcaaaagaagatattcttcttttctttaagctttatgaccccgagaagcaagagttaaggtatgttggtagactgatggtgaaaagttccagtaagcctatggatataactggaaaactgaatgaaatggctggctttgctcctgatgaagaaatagaactatttgaggaaatcaagtttgagccatgtgttatgtgcgaacacctcgataagaaaacttcattcaaactgtgtcaaatcgaagatggagatatcatttgctttcagaaacctcttggtaacaaggagactgagtgccgctatccagctgtaccttcgttccttgaatatgtccagaatcgacagctggtccgatttcgtgctctggaaaaacctaaagaagatgaatttgttttggagttgtcaaagttgcacacttatgacgatgtcgtggaaagagtggccgagaagcttggtcttgacgatccatccaagcttaggttgacatctcacaattgctattctcagcaacccaagcctcagcctatcaaataccgtggagtagaccatttgtcagatatgttagttcactacaatcagacgtctgatattttgtattatgaagttctggacattcctcttccagaattgcaaggtcttaaaaccttaaagttgctttccatcatgccacgaaggaagaggtggtaatccacaatatcagactacctaaacaaagtacagtcggagatgttatcaatgaacttaaaacaaaggtggagctttcgcatccagatgcagaactgagaatacttgaggtgttttaccacaagatatacaagattttcccattaactgaaagaattgagaatataaacgaccagtactggactttgcgagctgaggagattccggaagaagagaaaaatattggtccaaatgatcgcttaattctagtgtaccactttgctaaggagactggacaaaatcagcaagtgcaaaacttcggggagcccttcttcttggtaatccatgaaggtgaaactcttgaagaaattaagaaccgtatccaaaagaagctgcatgtatctgatgaggactttgccaagtggaagtttgcgtttatgtcaatggggcgtccggagtacttgcaggactcggatgttgtttacaatcgctttcagagaagggatgtctacggtgcctttgagcagtaccttgggttggagcacactgataccagtcctaagagggcttactctgcaaaccagaaccgacacacttatgagaagccggtgaaaatatacaattagccggaaagactaaagaaaacacaaatgtcgtcaagacattgtggcagcaacgttggaccaagccagacatcgaataagagggaggaaagaccgagtgtgaggtgtggatgatgatcgaccgtagtaggatgttgtagagaatttggtctgaatagggtgctgggttgcgcattgatagtgtttgtgttcttttcttctatttgtccttatttctttctttctttcctctgcttcaatactttgtgtaatgtatatggaatgtgagagagagaccattggtacctcatgcaatt

SEQ ID NO: 2419 - DNA, 3925 bp, Eucalyptus grandis
agagcttctctctttccctcttcatcatacttcggtccgtacatcatcacctctcttcgctctccagattcagcccgatcggcgattccggagacgcccgatcgccgccgctgccctccgaccgatgactctgatgactcctccgccgttagatcaggaggacgacgagatgctggtcccgaacaccgagttcaccgagggtcctcagcccatggaagttcaagcagatgctgcaggtacagtcgaaacacaaattgctgatgatcccccatcggggaggttcacttggactatagagaacttctcaaggcttaacaccaagaagctctattctgaaatcttttatgttggcggatacaagtggcgaattctgattttcccaaaagggaataatgtggaccatttgtcaatatatctggatgttgcggattcggcggccttgccatatggttggagtagatatgcacagttcagcttaactgttattaatcagattcacaacaaatactctgtgagaaaagagacacagcaccagttcaatgcacgggagagcgattggggttttacttccttcatgcatcttagtgaattgtataatcctagcagaggttatctggtgaacgacacgtgtattgttgaagctgatgtcgaagttcgtagaatagtcgattactggtcacatgactctaaaaaggagactggttatgttggtcttaagaaccaaggagctacctgttacatgaattcccttcttcagacattgtatcatataccttacttcaaaaaggcagtgtatcatatgccgacgacagagaatgatatgccttcaggaagcataccgcttgctttgcaaagtttattctataagctccagtatagtgataccagtgtagcgacaaaagagttgacgaaatcctttgggtgggacacttatgattcattcatgcagcatgatgtgcaagagcttaaccgggttctctgtgaaaagctcgaagataagatgaagggaactgttgtggagggtacaattcagcagctgtttgaaggtcaccacatgaactatattgaatgcataaatgtggactacacatcaacgaggaaggagtccttttacgatcttcagcttgatgtaaaaggctgtcgagatgtatatgcttcttttgacaagtacgtggaagtggagagacttgaaggtgataatcgatatcatgccgaacaacatggtttacaggatgcgaagaagggtgtactatttatagacttcccccctgttcttcaacttcagctaaaaaggttcgagtatgattttatgcgggatactatggttaagataaatgatcgttatgagtttcctttgcaacttgatctcgatagagagaatggaaagtatttgtcacctgaggctgatcggagtgtccgcaacctgtacacacttcacagtgttttggttcacagtggcggtgtgcatgggggacactattatgcttacattaggccaaccctctcagaccagtggttcaagtttgatgatgaacgggtgacaaaggaagatattaagagggcgttggaggaacaatacgggggagaggaagagttaccacaaacaaatcctgggttcaacagttctccattcaagttcacaaaatactcaaatgcgtatatgctagtatatatacgtgaaagtgacaaggaaaaaattgtttgtagtgtggatgagaaggacattgctgagcaccttaggataagattgaagaaagagcaagaagagaaggaaaagaagagaaaagaaaaagccgaggcacatctatataccatcataaaggttgctcgtgatggggacctacatgagcagattggcagagacatatattttgatcttgtggatcatgataaagtacgaagttttcgtattgagaagcagaagtcctttcaggtgctcaaggcggaagtttttaaagagtttggcatacctattgaatgtcaacggttctggttgtgggcaaagcggcaaaaccatacatatcgtcctaatcggccactgttacctcaggaagaaggacaatccgttgggcaattgagagaagtatccaacaagcaaagtgctgaattgaaactgtttctggaggtagaattggggcaggacttgcgccctgtgccactgctggagaagcttaaagaggaaattcttctcttcttcaagctctatgaccctttgaaagaggaacttcggtacgtgggaaggctctttgtaaaagtaaatagtaagccagctgaaatacttgcaaaactaaatgaaatggctggtttctctccggatgaagagattgacctttttgaggagatcaaatttgagcctaatgtcatgtgcgaacatgttgataagaagctcactttccgtgctagtcagcttgaagatggagatatagtttgttatcagaagtctaaagctagcagtgctgaacaatatcgctatcctgatgttccagcatttatggaatatgtgcacaatcgtcaggttgttcgtttccgatcattggagaaacccaaagaggatgagttctcgcttgagttgtcgaagcttcataactatgatgatgtcgtggaaagagtggcccaccatctcagtttaaatgatccatccaaaattaggctaacacctcataattgctactcccaacaacctaaacctcaaccaatcaagtatcgaggagcggagcacttgtgtgacatgcttgttcactataatcagacttcagatatcctttattatgaagtcttggatatccccctgcctgaactgcaaggtttgaaaactctgaaggtggcttttcatcatgcaactaaagatgaagttgttattcattccataaggttgccaaaacaatgcactgttggcgatgttataaatgaccttaagacaaaggtggatttatcccatccgagtgccgaactgaggttgcttgaagttttttatcacaagatctacaagattttcccacttaatgaaaagattgagaatataaatgaccaatactggactttgcgtgcagaggagattcccgaagaggagaagaaccttggtcctcatgatcgtcttattcacgtttatcattttatgaaggatactactcaaaaccaggttcagaattttggggaacccttttttctggttatccatgaaggcgagaccctatccgatattaaagttcgtatacagaaaaaactgcaggttccagatgaagaatttgcaaagtggaggtttgcatttctgtcactgggtcgtccggagtatcttgaagacactgatgttctttctacccgttttcagaggagggatgtctatggggcttgggagcagtatcttggactggaacatactgataatgctccaaaaaggtcatatgctgtcaatcagaatcgtcacacgtttgagaagcctgtgagaatctacaactagaagccaagcctccgctagttcattggatgtgttgagggcagtgacatctcacgtttgattgatggattgtgataatctcgatactgggccttcttttgctgacctttaggcatccctctctgagaggaggttggtggggttggtttactacattgtaatcaatgaataccaattttggggtgggtgttgtatagagggtataggtgtgtgttcttaaattttcaatttgattctttgtttgtgtctatgccccgaatgtattctagtgtatggggggttttgtaaaattgttaatgtaggatgctggttcttgtcttccaagaaaagctttacagtcggcctgcagaatttgtcccaccaccgatcctctcgacagttagcttgttgcaaaagaggtggtttggtcattcacactgcttaagaattctaatgtcatcatgccatactaagatagccacgctccagcat

SEQ ID NO: 2420 - DNA, 3341 bp, Gossypium raimondii
ggttttgatcagcagatcccaactgtccctctcattttgtatctgtttttgttttgcagcaggaggacgatgagatgttggttccccacaatgacttcgtcgacggtcctcagcctttagaagtggcgaaggaagctgcaagtaaagttgatgcacaagcagtggatgatccaccgtcaggaaggttcacatggacaattgagaatttctcgaggcttaatactaagaagctctactctgacatcttctttgttggaggctacaaatggcggatacttattttccccaagggtaacaatgttgatcatttgtcaatgtatcttgatgttgcggattcagcaactttaccttatggatggagtagatatgcacagttcagcttagctgtctgcaaccaaatacataataagtatactattagaaaagacactcagcatcagttcaatgtacgtgaaagtgattggggcttcacttcattcatgcctcttggtgaactatatgaccctagtagaggctttcttgtgaatgacacatgtgttgtagaagctgatgttgctgtgcgtaaggttgctgattattggtcacatgactcaaaaaaggagactggttatgtcggactcaagaatcagggagccacctgctatatgaactctctcctccaaacactctatcatattccctacttcagaaaggctgtgtatcatatgccaacaactgagaatgacatgcccacagggagcattccattggctttgcagagtctattttataagctccagtatagtgacactagtgtggcaaccaaggagttgacgaaatcttttgggtgggacacttatgattctttcatgcagcacgatgttcaggaacttaatagggttctttgtgaaaagcttgaagacaaaatgaagggaacagttgtggagggtacaatacaacagttgtttgaagggcatcatatgaattatattgaatgcatcaatgtggactataagtcaacgagaaaggaatcgttttatgatcttcagcttgatgtgaaaggctgtaaggatgtttatgcatcgtttgacaaatatgttgaagtggagtgtcttgaaggtgacaataggtatcatgctgaacaatttggtttacaggatgccaggaaaggagttcttttcattgactttcctcctgtccttcaacttcagctaaaacgttttgagtatgatttcatgcgagatactatggtgaagataaatgatcgctatgaattccccttgcaacttgatctagatagggaggatggcaagtatttatcacctgcggctgacagaagtgttcgcaacctttatacacttcacagtgttttggttcacagtggtggggtgcatggtgggcattactatgcttatatcaggccaaccctctcagatcagtggttcaagtttgatgatgaacgggtaacaaaagaagatgtcaagagggcattggaggagcagtatggtggtgaagaggagttaccgcagacaaatcctgggttcaacaacactccatttaaatttactaaatattcaaatgcatatatgcttgtgtatatacgagaaagtgacaaggataaaataatctgtaatgtggatgagaaggacattgctgaacacctgagaataagattgaagaaagagcaagaagagaaggagcaaaagaggaaggaaaaagcagaggcacatctgtatactgttataaaggttgcacgtaatgaagacctagttgagcagattggaagggatatatactttgatctggtggatcatgaaaaagttcgtagctttcgaattcagaagcagatgccttttaatgttttcaaggaagaagttgctaaagagtttggtattcctgtgcaatatcaacgtttttggttatgggcaaagcggcagaaccatacataccgtccaaatcgaccattaacttatcaggaggaagcacaatctgtaggacaacttagagaggtttcaaataaggcaaataatgcagagctgaagttgtttctggaagtggagcttggaccggatttgcagccagtacctccacctgagaaggctaaagaagatattcttcttttctttaaactctatgacccagtcaaagaggagctccgttatattgggaggatgtttgtgaagggtgctggcaagccaatggaaatattggcaaggatcaacaaaatggcaggctttggtcctgatgaagagattgaactttatgaggaaataaaatttgaacccaatgtcatgtgtgaacacattgacaagaagctcacattccgtaccagtcagcttgaagatggtgatattatatgccttcaaaaatattctgaagttgcaagcgaacaatgccgttatcctgatgttccttcatttctggagtatgtacataatcgtcaggttgttcggtttagatctctagaaaagccaaaggaggatgaattttctcttgagttgtcaaagcttcacaattatgatgatgttgttgaaagggtggctcaccatcttggcttggatgatccttccaaaattaggcttacatcccataactgttattcccagcaacctaaacctcaacctatcaagtacagaggagttgaacatttgtctgacatgcttattcactacaatcagacatctgatattctatattatgaagtgttggatatacctttgccagaactccaaggcctcaaaacattgaaagttgctttccatcatgctaccaaagacgaagtagttattcatactattagattgccaaaacagagcactgtaggggatgttcttgatgacctcaagacaaaggtggagttgtctcatcctggtgctgaacttagattacttgaggttttttatcacaagatttacaagatcttccctctcagtgaaaagatagagaacataaatgatcaatattggacattacgtgcagaggagataccggaagaggagaaagagcttggtccccatgatcgcttgattcatgtttaccatttcatgaaagacgcaacacaaaaccagcaggtacagaattttggggagccatttttccttgttattcatgaaactgaaacattagctgaagttaaagtgcgagttcagaaaagattacaggttccagatgaggaatttgcaaagtggaagtttgcatttttatcactgggtcgtccagagtatcttcaggactctgatgttgtgtctactcgttttcagagaagggatgtatatggtgcttgggatcagtatcttggactggaacattctgacaatgcccctaagcggtcatatgcagcaaatcaggtataatatttctcg

SEQ ID NO: 2421 - DNA, 3367 bp, Vinca minor
ccaaaaatcttcacagatcgtacggacctttcaagttccatccatgactctcatgaccactcctccaatggatccagaagaggatgagatgcttgttcctcattctgagtttccggtcgaaggtcctcaacctatggaagttgccccagcatcagcggcagcggaaactacaacagtggatgcacaggctgcagtggatgatccgccttcagcccggtttacatggacgattgagaatttcacgaggttgaatacgaagaagctgtattctgaagtattcaatgtgggaggatataaatggcgggtgcttatattccccaaaggaaacaatgtggaccacttgtccatgtatctggatgttgcagatgcttcagctttgccatatggttggagtagatatgcccagtttagcttagctgttgtcaatcaggttcataacaagtttacagtgcgaaaagatacacaacaccaatttaatgcaagagaaagcgactggggtttcacttcatttatgcctcttagtgaactctatgatcctggtagaggttatcttgtaaatgatacatgtattattgaagctgacgttgctgttcgtaaagtgattgattattggtcgcatgactcgaaaaaggagactggttatgttggattaaaaaatcagggagctacttgttacatgaactctctcctccagacattgtatcacattccttacttcagaaaggctgtgtatcacatgcccacgactgagaatgatatgccatctgggagcatccctttggccctgcagagtttgttctataagcttcagtacagtgatactagtgtagcaacgaaagaattgacaaaatcatttgggtgggatacgtatgattctttcatgcaacatgatgttcaagaacttaatagggttctctgtgagaagcttgaagacaaaatgaagggaaccgttgtggagggcactattcagaagttgtttgaagggcaccacatgaattacattgagtgtattaatgtagactacaagtcaactagaaaagaatctttttatgatcttcagcttgatgtcaaaggatgccgtgatgtttatgcttcttttgacaagtatgtggaagtggagcgtcttgagggtgacaacaaatatcatgctgaacagcatgggctccaagatgccaagaaaggagtcctgttcattgacttcccccctgttcttcaacttcaattaaaacgatttgagtatgactttgtacgagataccatggtaaagataaatgatcgatatgagttcccattgcaacttgatctggatcgagacaatggaaaatatctgtctcctgacgctgatcgaagtgttaggaacctctacactctccacagtgttttggttcatagtggtggggttcatggtgggcattattatgcttatatcaggccaacactctcagatcagtggttcaaatttgacgatgaacgtgtaacaaaagaagatatgaagagggcattggaagagcagtatggtggcgaggaagagttaccacagacaaatcctggattcaacaactcgccatttaagtttaccaagtattcgaacgcgtacatgcttgtgtatataagagagagcgacaaagagaacataatttgtaatgtagatgaaaaggatattgctgaacaccttaggatacggttgaagaaagaacaagaagaaaaggagtcaaaagagaaaggagaaagcagaggcacacctctatactattattaaggttgctcgtgatgatgatttagttgaacaaattgaaaggacatatattttgatcttgttgaccatgataaggtccgatgtttccgaattcagaaacagaccccgtttaatcttttcaaggaagaagtcgccaaggagtttggtataccagttcagtgtcagcgtttctggctatgggcaaagcgtcagaaccacacatatcgtcccaatcgtccactgaatcctcatgaagaggctcaatctgttggccaactcagagaggtatcaaataaagcaaataacgcggagttgaagttgtttctggaagtagatatgggcctggaattgcagccagttcctccccctgagaagactaaggaggagattcttctgtttttcaaacattatgatccttgcaaagaggaattacgttatgttggccggatgtttgtcaaaggtaatggcaagcccatagagatattgagtaagctaaatgaattggttgggtttgctcccgatgaagaacttgatctctttgaggaaataaaatttgaacctaatgtcatgtgcgaacatatagacaagaagctcaatttccgcagcagtcagcttgaagatggggacattatttgctttcagaagtctcttcaaggtcaaaatgttgaacagtatcgttatcctgatgttccttcatttttggaatatgtgcataatcgtcaggttgtgcgattccgcgcacttgagaaaccgaaggaagatgagttttctcttgagttgtcaaagcagaacaactatgatgaagttgtacaaagtgttgctcttcatctttccttggatgacccatctaaaatccgacttacaccacataactgttactcccagcaaccgaaaccccaacctattaagtatagaggagtagaacatctaacagacatgctaatacattacaatcagacttctgatattttgtactatgaagtgttggatatccctttgccggagctacaaggcttgaaaactctgaaagttgcctttcatcatgctacaaaagatgaagtagttattcatacaataaggctgcctaaacaaagtactgttggggatgttattaatgatctgaagacaaaggttgagttgtcccaccccaatactgaattaagagtactggaggttttttatcacaagatatacaagattttccctctccatgaaaagattgagaacatcaatgatcaatactggacgttacgtgctgaggagattcctgaggaagataaaaaccttggacctcatgatcgcttgattcatgtttaccatttcatgaaggacacatcacagaaccaagcgcaggtccagaattttggtgaaccttttttcctagcaatcatgaaggcgagacgctagctgaagttaaattacggatacagaagaagttgcaggttccagatgaggagttttcaaagtggaagtttgcatttttgtctttgggccgtccagagtatcttcaggactcggatattgtgtccactcgttttcagaggagagatgtctatggtgcttgggaacaataccttggtttagaacactccgacaatgctcccaaaagatcttatgctgcaaatcagaacc

SEQ ID NO: 2422 - DNA, 3940 bp, Brassica rapa
gagaaaagagtaagaaaaagaacgagcaaattgtattgtaatgtctctctagtcacactttgcctcttcccctcttttgattttttctccgttcttcgtcgtcgtcgtcgtcgatccccaccgtcaaccccttccccggccacaatgactatggtgactccgcctcccgtcgatcagcaagaggatgaggagatgcttgttccgcattcagatttggttgaggatcctgctcagcccatggaagtttccgaaactgagactgctgtgagtactgtggagaatcagccagcagctgaggagcctcccactctgaaattcacgtggactatcccacacttctcgaggattaacaccaggaagcagtactccgatgtgtttgttgttggaggttacaaatggcgcatattgattttcccgaaagggaacaatgttgaccatttgtccatgtacttggatgttgctgatgctgcgagtttgccttacggctggagcaggtatgctcagttcagcctggctgttgtcaatcaagtccacaccagatacaccattagaaaagaaacgcaacatcaattcaatgcgagagaaagcgattggggatttacgtcattcatgcctcttagcgaactttatgatcctagtagaggatatttggcgaatgatactgtttacattgaagctgaagttgttgtgcgtaaggttcttgattattggtcttacgattccaaaaaagagaccgggtttgttggtctcaagaaccaaggtgcaacttgttacatgaattcgcttctacagacactataccacattccttacttcagaaaggctgtataccacatgccaaccactgagaacgatgcgcccacagcaagtatacctttggctctccaaagtttgttttacaagctccaatataacgacaccagtgttgcgacaaaggagctgacgaagtcgtttggctgggacacatatgattctttcatgcaacatgatgtccaagaactaaatcgagttctctgcgagaaacttgaggataaaatgaagggaactgttgtggagggaactatacaacagctatttgagggtcaccatatgaattatatcgagtgcataaatgtagattacaaatctacacgaaaagaatcattttatgaccttcagctggatgttaaaggctgcaaggatgtttatgcttcttttgacaaatatgttgaagttgaacgccttgaaggagacaacaaatatcatgcagaaggacacggattacaggatgcaaaaaaaggtgttcttttcatagactttccaccggttcttcagctccagctcaaaaggtttgaatatgacttcatgagggattccatggtgaagataaatgatcggtatgaatttccgctggaactggaccttgatagagaggatgggaagtatttatcccctgatgctgacaggagtgtccgcaacctttatactcttcacagtgtcttagttcatagtggaggagtacatggtgggcattattacgcatttataaggcccacgctctcagatcaatggtataaatttgatgatgaacgagtaaccaaagaagatttgaaaagggcactggaggagcaatatggtggtgaagaggagctaccacagactaatcctggtttcaataaccctcctttcaaattcacaaagttctcgaatgcatatatgcttgtatatatccgagaaagtgacaaagataaaataatctgcaacgttgatgagaaagacattgctgagcacttaagggtgaggctgaagaaggaacaagaagaaaaggaagacaaaagaaaatacaaggcacaagctcacctttttacgataattaaggttgcaagagatcaagaccttaaggaacaaattgggaaggatatatattttgatcttgttgaccatgacaaagttcgtagtttccgaatccagaaacaaacaccatttcaacagtttaaggaggaggtggccaaagaatttggtatacctgttcagtgtcagaggttctggatttgggcaaagcgacaaaaccatacttatcgtcccaatcgcccccttacacctcaggaggaattacaaccggttggacaaattagagaagcatctaacaaagcaaacactgcagaacttaagctgtttttggaagtagagctgctggatgaacgtcctattcctcctcctgaaaagtcaaaagaagatattcttcttttctttaagctttatgaccccgagaagccagagttaaggtatgttggcagactgatggtgaaaagttccagtaagcctatggatataactggaaaactgaatgaaatggctggctttgctcctgatgaagaaatagaactttttgaggaaatcaagtttgagcctggtgttatgtgcgaacacctggataagaaaaattcattcagattgtgtcaaatcgaagatggagatatcatttgctttcagaaacctgttgttaacaaggagactgaatgccgctacccagctgtgcctttgtttcttgaatatgtccagaatcgacagctggtccgatttcgtgctctggaaaaacctaaagaagatgaattcgttctggagttgtcaaagttgcacacttatgacgatgtcgtggaaagagtggcggagaagcttgggcttgacgatccatccaagcttaggcttacatctcacaattgctattcccagcaacccaagcctcagcctatcaaataccgtggagtagaccgtttgtcagacatgttagttcactacaatcagacgtctgatattctgtattatgaagttcttgacattcctcttccagaattgcaaggtcttaaaaccttaaaagttgcttttcatcattccacgaaggaagaagtggtaatccacaatatcagactacctaaacaaagcacggtcggagatgttattaatgaactaaaaacaaaggtggagctctcgcatccagatgcagaactgagaatacttgaggtgttttaccacaagatctacaagatttttccattaactgaaagaattgagaatataaacgaccagtactggactttgcgagctgaggagatcccggaagaagagaaaaacattggtccaaatgatcgcttaattcttgtgtaccactttgctaaggagactggacagaatcagcaagtgcaaaactttggggagcccttcttcttggtaatccatgaaggtgaaactcttgaagaaatcaagaaccgtatccaaaagaagcttcatgtctcagatgaggactttgccaagtggaagtttgcgtttatgtcaatggggcgtccggagtacttgcaggactcagatgttgtttacaatcgctttcagaggagagatgtctatggtgcttttgagcagtacctggggttggagcacactgataccactcctaagagggcttattctgcaaaccagaaccgacacgcgtatgagaagccggtgaagatatacaattagccgagaaaagaaaaggcaaatgtcatccagacattgtggaagctacgttggaccaacagggatcgaataaaagatggaaagaccgagtgtgaggtgtgatgatgaccgaccgtataatgttgtaggagaatttggtctgaacagggttttgggttgcgcattgatggtgtgtgtttttttttatatcttctttcgtgcttcaatacgttttgtgttcatgtatatggaatgtgcgaagactatttgcacatcatgcaatttttattttcgaaacaaaagaatatggaagaagcccgtcgcttgaactcgggagtttatagaatagctaaacatttgtaactttttagagattcggggtttaagaagattttttatctgactggcgattgtaatagtttattgcatttccaaatagttatttagaaaaaagctgctaggatatgga

SEQ ID NO: 2423 - DNA, 3248 bp, Chelidonium majus
catctgacgtttatcagattcatcgatcgatcggactactctcctttctccatccatgactatgatgactcctccaccgttagatcaagaagatgatgagatgttggttccgcattcagattttgccgacggtccacaacctatggaagtagttgcccaagcggaaactgctaccactgttgagaatcagccaatcgaggatcctccaacgtcgagattcacttggacaatagagaacttttctaggttgaccaccaagaagcattactctgatgtattctttgttggtggttataaatggcgtgtactgattttcccaaaaggaaacaacgtggaccatttgtcaatgtacctagacgttgcagattcggcaaatttgccttatggatggagtagatacgcacaattcagtttggctgtggttaatcaaatccacaataagtacacagttagaaaagacacacaacaccaattcaatgctcgagagagtgattggggtttcacatcattcatgcctctcagtgaactatatgatcctggtagagggtttctggtgaatgatacgttgttagttgaagccgaggttgttgttcgtaaagttgtggactactggacttacgattcaaagaaagaaacaggatacgttgggcttaagaatcagggagcaacctgttacatgaactctctactccaaactttgtatcatattccctatttcagaaaggctgtgtaccatatgccaacaacagagaatgatatgccatctgggagcatccctctggcactgcagagcctattttacaagctccagtacagtgacaacagtgttgcaactaaagagctgacaaaatcttttggctgggacacgtacgattctttcatgcagcatgatgtccaagaacttaatagggttctttgtgagaagcttgaagataaaatgaaaggaactgtggtagaaggtacaattcagcagttatttgaaggccaccatatgaactatattgagtgtatcaatgtggaatacaaatctacaagaaaggagtcattttatgacctccaacttgatgtcaaaggttgtcgagatgtctatgcttcttttgacaagtatgttgaagttgaacgcctcgagggtgataacaagtatcatgctgaacaacatggattgcaggatgctaagaagggtgttctcttcattgactttcctccagtcctccagcttcagttgaaacggttcgagtatgatttcatgagggacactatggtaaagataaatgaccgttatgagttcccgttgcaacttgaccttgatagagagaacggcaaatatttatcgccagacgcagatagaagagttcgcaacctttacacacttcacagtgtgttggttcacagtggtggagtgcacggtggacactattatgcctttatcaggccgacactctctgatcaatggtttaaatttgatgatgagcgggtaacaaaagaggatattaagagagcattagaggaacagtatggtggcgaggaagagttaccgcagacaaatccaggcttcaataacactccattcaagtttacgaaatactcaaatgcatatatgcttgtttatatacgtgagagtgataaagataaaattatttgtaatgtggacgagaaggacattgctgaacaccttaggataaggttaaagaaagaagcaagaagaaaaggaagcacaagaaaaaggaaaaagacagaggcccacctttacaccattataaaagttgcgaggaatgaggacctcgtagaacagattggaagagatatatattttgatcttgtggatcatgacaaagttcgcagctttcgtattcagaagcagatgccttttaatattttcaaggaagaggttgccaaagaatttggtataccagtgcaatttcagcgtttttggttgtgggcaaagaggcaaaaccatacatatcgtccaaacagaccgttgacacagcaagaggaaactcaatcggttggacacttgagggaggtgtcaaataaagctcacaatgcagaattgaagttgttcttggaagtagagcttgggctggatttacgtcctatttcccctcctgagaagaccaaagaagatattctgcttttcttcaagctttatgaccctgcaaaggaagcacttaggtttgtggggaggctatttgtgaagggtagtggcaagcccttagaaatattgactaagctgaacgaattggctggctttgctgcagatgaagaaattgaactttatgaggaaataaagtttgagcccagtgtcatgtgtgaacacattgacaaaaaactcacttttcgagctagccagcttgaagatggggatataatatgttttcagaaatctcctccaattgaacgtgacgaacggtgccgttatcctgatgttcctacatttttggaatatgttcataatcgccaggttgtccatttccgatctctggagaaaccgaaggaggacgatttctgtctggagttgtcaaaaaatttcacttatgatgaagttatggaaagagttgcgcgtcaacttggtttggatgacccaaccaaaatcaggcttacatcacacaactgttattctcagcaacctaaaccccaaccgatcaagtaccgaggtgtggaccatttgtcagacatgttggttcactacaatcagacttctgatatcttgtattatgaagtactggatattcctttgccagaattgcaaggcttaaaaactctgaaggtcgcttttcatcatgccacaaaggatgaagtggtcattcacagtattagattgccaaaacaaagcactgttggggatgtcattaatgacctaaaaacgaaggttgaactgtctcaacccaatgcagaacttagattgctggaggttttctatcataagatttataagattttccctcccagtgaaaagattgagaatattaatgatcaatactggacactacgtgcagaagagataccagaagaagagaaaaaccttggtcctcgtgatcggctgattcatgtttaccatttcacaaaagatgcatctcaaaatcagatgcaggttcagaattttggtgaaccatttttcttgatcattcatgaaggagagactttagccgaggttaaagtccgtatccagaagaaattgcaagttccagatgaggagttctctaagtggaaatttgcgtttttgtcattgggacgccccgagtaccttc

SEQ ID NO: 2424 - DNA, 4941 bp, Vitis vinifera
gttacccaagcctttttctccgtttgcttttataactttatatcaaaatacctaaactaccctcctccacactaaactcccccaagcgccttcccattcacccaggttttcttttcctttttttcctcgtcccttgttgcagagcccgttgtttctctctcttctccccttcttcagattcgtcaatcggacgatccatttgcctccgccatgactctcatgactcctgcgccattggatcaagaagatgaggagatgctcgttccccattcggatttagtcgaaggtcctcagcccatggaagtggtggcgcaagcagatgctagtagtgctgtggagaatcagcccgtggaggatcctcagacatctagattcacatggacaattgagaacttttctaggttgaacaccaagaagcactattccgagatattcgtcgttggtggttttaaatggtagttagatgactctactcactaagctcctttatgcggcccaacaagatttatttcgtttgccatggttgatttttaacttgcattggtttgagcaggcgggtgcttatttttccaaaaggaaacaacgtagaccacttgtcaatgtatttagatgttgcagattctgcaaccttaccatatgggtggagtcgttacgcacaattcagcttgtctgttgttaatcagattcataacaaatactcaataagaaaggacacacagcaccaattcaatgcgagagagagtgattggggcttcacatcattcatgcccctcagcgatctttatgaccctggtagagggtaccttgtgaatgatacatgtataattgaagctgaggttgctgttcgtaagattctagattactggacttatgattcaaaaaaggagactggttttgttggactgaagaaccaaggggctacttgttacatgaattctctcttacaaactctctaccatattccttatttcagaaaggctgtgtaccatatgccaactacagagaatgatatgccttcaggaagcattccattggctctgcagagtttattttataagctccagtataatgacaacagtgttgcaactaaggaattgacgaagtcctttggatgggacacatatgattcttttatgcagcatgatgtgcaagaacttaatagagttttatgtgaaaagcttgaggataagatgaagggaactgtagtggaggggacaatacagcagttgtttgaagggcaccatatgaactacattgagtgcatcaatgtggactacaaatctacaagaaaggaatcattttatgacctacaacttgatgtaaaaggatgccgggatgtttatgcttcttttgacaagtatgtagaagttgaacgtcttgaaggtgataacagataccaagctgagaatcatggtttacaggatgctaagaagggtgtcttatttattgacttcccaccagttcttcaacttcagctaaagcggtttgagtatgacttcatgcgggacactatggtgaagataaatgaccgttatgaattccctcttcaacttgaccttgatagagagaatggaaaatatttgtcacctgacgcagataggagtgttcgcaacctttacacacttcacagtgttttggttcatagcggtggtgtgcatggtggacattattatgcttttatcaggccgaccctttctgatcagtggttcaaatttgatgatgagcgggtaaccaaagaagatactaggagggcattggaggaacagtatggtggcgaggaagagttgccacagacaaaccctggattcaacaacactccatttaaattcacgaaatactcaaatgcatacatgcttgtgtatatacgtgaaagtgacaaggagaaaatcatttgtaatgtggatgagaaggacattgctgaacaccttaggataaggttgaagaaagaacaagaagagaaggaggataagagaaaatataaagcacaagcccacctttttactattataaaggttgcacgggatgaagaccttgcagagcaaattggaaaggatatatattttgatcttgtggatcatgacaaagtccgcagttttcgcattcagaaacagtggccttttacccttttcaaggaggaagtggccaaagagtttggtattccagtccaatatcaacgattttggatttgggcgaagcggcaaaaccatacttatcgtcccaatagaccattgacaccccaagaggaagcacagtctgttgggcagttgagggaggtatcaactaaagtgaacaatgcagaactaaagttgtttttggaagttgaacttgggccggatctgcgtcctattcctccacctgaaaaaactaaagaagatattctgcttttcttcaagctttatgaccctgagaaagaagagctccgatatgttggtagactttttgtgaagagttctggtaaaccaatagagattctaacaaaactaaatgaaatggctggatttgctcctgatgaagagattgaactctatgaggaaataaaatttgagccttgtgtcatgtgtgaacacctcgctaagaggacatcatttcgatttagccagattgaagatggggacatcatttgcttccagaaatctgctcctcctgaaagtgaagaacaatgccggtattctgatgtcacttcatttttggaatatgtgcaaaatcgtcaggttgtgcattttcgagctttggagagacctaaggaggatgatttctgtctagagttgtcaaagctacacaattatgatgatgttgtggaaagagtggctcgtagacttggtttggatgatccatccaaaatcagacttacatctcacaactgctattcccagcaacctaagccccaaccaattaaatatcgaggtgtagagcatttgtcagacatgcttgtgcattacaatcagagttctgatattttatattatgaagttctagacatccctcttccagaattgcaaggtctgaaaaatctgaaagttgcttttcatcatgctacaaaggatgatgtgataattcacaatattagattgcctaaacagagtactgttggagatgtgattaatgaacttaagacaaaggttgagttgtctcatccaaatgcagaacttagactgcttgaagttttctatcacaagatttataagatctttccacccagtgaaaaaatcgagaatataaatgaccaatactggacactccgtgcagaggagattccagaagaagagaagaatcttggtccccatgatcgcttgattcatgtttaccacttcacaaaggagactgtacagaatcagatgcaagtacaaaattttggtgaaccctttttcttgatcatccatgaaggcgaaactcttgctgaagttaaagagcgcatacaaaagaaattgcaggttccggatgaggagttttcaaagtggaagtttgcttttctatcactgggtcgtccagagtacctgcaggattctgacattgtgtccagccgttttcagagaagagatgtttatggtgcttgggaacagtaccttgggctggagcactctgatactgctcctaaaagggcttatgcagcaaatcaggcagcagaaggagctccaatctgagtgtgctcgaaagcgatcattcctctccaaactctgcttttcggccgatctttgggttcaaaccttcaaggcctcttccttccaactgttgtgagacctatattggattccttttaagcatccaagcaagttcatcaacctgccctaggtgatcattttaagccatggtgggctggcagagacatttacggaatgtatttactcaaattgggaaaagagtggaacataattacaatgtatctgctaacttttcttgttcccggttggagtcatcaccgctagtaggtgagttgccttatttgcaaaggctgtggaaattaccttctgctaccatcccaaggccttattactattatttccaacagttgggaatttctagttcaaggcagctacttgcagattctgatgtaacacctgttgcttctccattgacacctgctttggcattaaatggtggaaaaactgaagaccagaaagttgtttccaagccttcaaaagttcaagcagttctaaagggcataaagcagagtccaaagaaggtcaatttagttgctgaattagttcgtggcatgcgtgttgaagatgcattattgcagttacaattgacagttaagcgagcctcaaaaactgtctatcaggttatacactcagcacgggcaaatgcaacccataatcatggcttagatccagatcgactcctagttgcggaggcatttgtagggaaggggttttttaaaaagagagtgtcataccatgctaaagggaaatgtgggataaaagtgagaccagaatgtagattgacagtggtagtaagagagatgactcctgaagaggaggctaagttagccaagctgagagtcagcaatttccgtaaactaagtaagcgggaaaggcggcttgtaccacatcagcttattgagacaacttcaatttggaaccgcaaagcaaatggtggcgtggcaagtgatatggcttcatgagcctgttttcatattttttgtagtagctgtcaaagactgcctcaaataatggatttacaagctccgttgtatccctcttaatttattctacgtagaacaaccaaaatctggctcatggaggcttctcgttaagtttggtattgggtggaactctccttctgtatagattacttatcttcgtgacgcattttccttgtgggggagaagagcaaaaagtactcctacctggtgtatactcttctctttctcattttttaagaccttaaaatttatcttaattttatttttatattaattccatcaataaatttcaaacctca

SEQ ID NO: 2425 - DNA, 3944 bp, Brassica rapa
acttcgaagccgagaaagagagtaacaaaaagaatcgagcagattgtacatctctctagtcactttgatttttctctgttcgttctctagatttcaccgtcgatcttcatccggccaatgactatgattactccggctcccgtcgatcagcaagaggatgaggtgatgctcgtgccgcattctgatgttgtcgacggtcctgctcagcccatggaagtttccgaagctgagactgctgtgagtactgtggagaatcagccagctgaggaacctcccacactgaaattcacgtggactatcccaaacttctctaggcaaaacaccaggaagctttactctgatgtatttgtcgttggagggtacaaatggcgcatattaattttcccgaaaggaaacaatgtcgaccatctgtccatgtacttggatgttgctgatgctgcgaatttgccatatggttggagccgttacgctcagttcagtctggctgtagtcaatcaaatccacaccagatataccattagaaaagagacgcaacatcaattcaatgctagagaaagcgattggggatttacatcattcatgcctctcagcgaactttatgatcctggtagaggatatttagcgaatgatactgtttacgttgaagctgaagtcattgtacgtaaggttcttgattactggtcatacgactccaaaaaagagactggttttgttggtctcaagaaccaaggtgcaacttgttacatgaattctctcctacagacgctataccacataccttacttcagaaaggctgtataccacatgccaacaactgagaacgatgcgccaacagcaagtatacctttggctctccaaagtttgttctacaagcttcagtataacgacaccagtgttgcgacaaaagagctgacaaagtcgtttggttgggatacgtatgattcgttcatgcaacatgatgtccaagaactcaatcgagttctatgtgaaaaactcgaggacaaaatgaagggaactgttgtggagggaacaatacaacagctatttgagggccaccatatgaactatattgagtgcataaatgtagattacaaatctacacggaaggaatcattttatgatcttcagttggatgttaaaggctgcaaagatgtttatgcttcttttgacaaatatgtggaagttgaacgccttgaaggagacaacaaatatcatgcagaaggacatggtttacaggatgcaaaaaaaggtgttcttttcatcgactttccaccagttcttcagctccagctcaagaggtttgaatatgactttatgagggacaccatggtgaagataaatgaccggtatgagtttcctctccaattggatcttgatagagaggatggaaagtatttatcccctgatgctgacaggagtgtccgcaacctgtacacacttcacagtgtcttagttcatagtggaggagtacatggtgggcactattacgcttttataaggcccacgctctcagatcagtggtataaatttgatgatgaacgagtaaccaaggaagatttgaaaagggcattggacgagcaatatggtggtgaagaagagctaccacagactaatcctggtttcaataacccgcctttcaaattcacaaagtactcgaatgcatacatgcttgtatctatccgggaaagtgacaaagataaaataatctgcaacgttgatgagaaagacattgctgaacatttaagggtgaggctgaagaaagaacaagaagaaaaggaagataaaagaaagtacaaggcacaagctcacctttttacgataattaaggttgcaagagatcaagacctccgggaacaaattgggaaggatatatattttgatcttgttgatcatgacaaagttagaagtttccggatccagaaacagacgccatttcaacaatttaaggaggaggtggccaaagaatttggtatacctgttcagttacagaggttctggatctgggcaaagcgacaaaatcatacttatcgtcccaatcgcccacttactcctcaggaggaattacaaccggttggacaaataagagaagcatctaacaaggcaaacactgcagaacttaagctgtttttggaagtagagctgctggatgaacgtcctattccccctccagaaaaatcgaaagaagatattcttctgttctttaagctttatgaccccgagaagccagagttaaggtatgttggcagactcatggtgaaaagttccagcaagcctatggatataactggaaaattgaatgaaatggctggttttgctcctgatgaagatttagaactttttgaggaaatcaagttcgagcctggtgttatgtgcgaacacctggataagaaaacttcattcagattgtgtcaaatcgaagatggagatatcatttgctttcagaaacaccttgttaagaaggagactgaatgccgctacccagctgtgcctttgtttcttgaatatgtccagaatcggcagctggtccggtttcgtgctttggaaaaacccaaagaagatgaatttgttctggagttgtcgaagttgcacacttatgacgatgtcgtggaaagagtggcccagaagcttggtcttgacgatccatccaaacttaggcttacatctcacaattgctattcccagcaacccaagcctcaacctatcaaataccgtggagtagaccgtctgtctgatatgttagttcactacaatcagacgtctgatattttgtattatgaagttctggacatccctcttccagaattgcaaggtcttaaaaccttgaaagttgctttccatcatgccacgaaggaagaagtggtaatccacaatatcagactacctaaacaaagcacagtcggggatgttattgatgaacttaaaacaaaggtggagctttctcatccagatgcagaattgagattacttgaggtgttttaccacaagatctacaagattttccccttaactgaaagaattgagaatataaacgatcagtactggactgtacgagctgaggagattccggaagaagagaagaatattggtccaaatgatcgcttaattctagtgtaccactttgctaaggagactggacaaaatcagcaagtgcaaaactttggggagcccttcttcttggtaatacatgaaggcgaaactcttgaagaaatcaagaaccgtatccaaaagaagcttcatgtatccgatgaggactttgccaagtggaagtttgcgtttatgtcaatggggcgtccagagtacttgcaggactcagatgttgtttacaatcgctttcagagaagagatgtgtacggtgcttttgagcagtacctggggttggagcacactgataccactcccaagagggcttattctgcaaaccagaaccggcacacttatgagaagccggttaaaatatacaactagccgaagtaaagggaaaatcaaagacattgtggcagcaacgttggccaaaggcatcgaataagaaagaggagtgaaagagcggagagtgtgatgatgatcgaccgtaggatgttgtagagaacttggtctgatagggttttgggtttgcgcattgatagtgtgtgtgtgtgtgtgttcctttatttctttctttcgtgcttcgatatactgtgttaatatatgcaatgtgtgagactttcggcacatcgtgcaatttttattttcgaagaaaagaatatgaattcgaaaagaatatgaaagccagccgcttggattcgggagcacggtttggctttcagagcttatagtataccgaaaacctttgtaatttttagagatttggggtttaagaatatatttttttctgactggcgattgcatagttgttttcatttgtaatattgttatcgtttactttgtcgaaatcagatggataggtt

SEQ ID NO: 2426 - DNA, 3873 bp, Brassica napus
gggagaaaagagtaagaaaagaacgagcgattgtattgaaatgtctctctagtcacactttgcctcttcccctcttttgattatttctccgttcttcgtcgtcgtcgtcgccgatcccgccgtgtcaaccccttccccggccacaatgactatggtgactccgcctcccgtcgatcagcaagaggatgaggagatgcttgttccgcattcagatttggttgaggatcctgctcagcccatggaagtttccgaaactgagactgctgtgagtactgtggagaatcagccagcagctgaggagcctcccactctgaaattcacgtggactatcccacacttctctaggattaacaccaggaagcagtactctgatgtgtttgttgttggaggttacaaatggcgcatattgattttcccgaaagggaacaatgttgaccatttgtccatgtacttggatgttgctgatgctgcgagtttgccttacggttggagcagatatgctcagttcagcctggctgttgtcaatcaagtccacaccagatacaccatcagaaaagaaacgcagcatcaattcaacgcgagagaaagcgactggggatttacgtcattcatgcctcttagcgaactttatgatcctagtagaggatatctggcgaatgatactgtttacattgaagctgaagtcgttgtgcgtaaggttcttgattattggtcttacgattccaaaaaagagaccgggtttgttggtctcaagaaccaaggtgcaacttgttacatgaattctcttctacagacactataccacataccttacttcagaaaggctgtataccacatgccaaccactgagaacgatgcgcccacagcaagtatacctttggctctccaaagtttgttttacaagctccaatataacgacaccagtgttgcgacaaaagagctgacaaagtcgtttggttgggacacatatgattctttcatgcaacatgatgtccaagaactcaatagagttctctgcgagaaacttgaggataaaatgaagggaactgttgtggagggaacaatacaacagctatttgaagggcaccacatgaattatatcgagtgcataaatgtagattacaaatctacacggaaagaatcattttatgaccttcagctggatgttaaaggctgcaaggatgtttatgcgtcgtttgacaaatatgttgaagttgaacgccttgaaggagacaataaatatcatgcagaaggacacggattacaggatgcaaaaaaaggtgttcttttcatagactttccaccggttcttcagctccagctcaaaaggtttgaatatgacttcatgagggattccatggtgaagataaatgatcggtatgaatttccgctggaactggaccttgatagagaggatgggaagtatttatcccctgatgctgacaggagtgtccgcaacctttatactcttcacagtgtcttagttcatagtggaggagtacatggtgggcattattacgcatttataaggcccacgctctcagatcaatggtataaatttgatgatgaacgagtaaccaaagaagatttgaaaagggcactggaggagcaatatggtggtgaagaggagctaccacaaactaatcctggttttaataaccctcctttcaaattcacaaagtactcgaatgcatatatgcttgtatatatccgggaaagtgacaaagataaaataatctgcaacgttgatgagaaagacattgctgagcacttaagggtgaggctgaagaaggaacaagaagaaaaggaagacaaaagaaaatacaaggcacaagctcacctttttacgataattaaggttgcaagagatcaagaccttaaggaacaaattgggaaggatatatattttgatcttgttgatcatgacaaagttcgtagtttccggatccagaaacagacaccatttcaacagtttaaggaggaggtggccaaggaatttggtatacctgttcagtgtcagagattctggatttgggcaaagcgacaaaaccatacctatcgtcccaatcgcccccttacacctcaggaggaattacaaccggttggacaaattagagaagcatctaacaaggcaaacactgcagaacttaagctgtttttggaagtagagctactggatgaacgtcctattcctcctcctgaaaaatcaaaagacgatattcttcttttctttaagctttatgaccccgagaagccagagttaaggtatgttggcagactgatggtgaaaagttccagtaagcctatggatataactggaaaactgaatgaaatggctggctttgctcctgatgaagaaatagaactttttgaggaaatcaagtttgagcctggtgttatgtgcgaacacctggataagaaaaattcattcagattgtgtcaaatcgaggatggagatatcatttgctttcagaagcctgttgttaacaaggagattgaatgccgctacccagctgtgcctttgtttcttgaatatgtccagaatcgacagctggtccgatttcgtgctctggaaaaacctaaagaagatgaattcgttctggagttgtcaaagttgcacacttatgacgatgtcgtggaaagagtggcggagaagcttggccttgacgatccatccaagcttaggcttacatctcacaattgctattcccagcaacccaagcctcagcctatcaaataccgtggagtagaccgtttgtcagacatgttagttcactacaatcagacgtctgatattttgtattatgaagttcttgacattcctcttccagaattgcaaggtcttaaaaccttaaaagttgcttttcatcattccacgaaggaagaagtggtaatccacaatatcagactacctaaacaaagtacagtcggagatgttattaatgaactaaaaacaaaggtggagctctcgcatccagatgcagaactgagaatacttgaggtgttttaccacaagatctacaagatttttccattaactgaaagaattgagaatataaacgaccagtactggactttgcgagctgaggagattccggaagaagagaaaaacattggtccaaatgatcgcttaattcttgtgtaccactttgctaaggagactggacagaatcagcaagtgcaaaactttggggagcccttcttcttggtaatccatgaaggtgaaactcttgaagaaatcaagaaccgtatccaaaagaagcttcatgtatcagatgaggactttgccaagtggaagtttgcgtttatgtcaatggggcgtccggagtacttgcaggactcagatgttgtttacaatcgctttcagaggagagatgtctatggtgcttttgagcagtatctggggttggagcacactgataccactcctaaaagggcttatgctgcaaaccagaaccgacacgcgtatgagaagccggtgaagatatacaattagccgagaaaagaaaaggcaaatgtcatccagacattgtggaaactacgttggaccaaaagggatcgaataagagatggaaagaccgagtgtgaggtgtgatgatgaccgactgtagaatgtgttgtaggagaatttggtctgaacagggttttgggttgcgcattgatggtgtgtgtgttttttatatctttctttcgtgcttcaatacgttttgtgttcatgtatatggaatgtgcgaagactatttgcacatcatgcaatttttattttcgaaacaaaagaatatggaagaagcccgtcgcttgaactcgggagtttatagaatagctaaacatttgtaactttttagagatttggggtttaagaagatttttttc

SEQ ID NO: 2427 - DNA, 3623 bp, Flaveria ramosissima
acaaaccaccgttgatcggaggtattcaccaccggaataatgactatggtcacccctcagccactagatcaggaagatgaggagatgcttgtgccgcatactgagctgctggatgggcctcagccggtgcaaggtcctgttgcgtttgatggtactccgccgattgaagctcctcagccgatggaagttgtgggtcaaccggaagttgctagcacagcagagaatcaagcagctgatgaacctcaggcctctaggtttacttggactattgagaatttctctcgtcagaccaacaaaaagctctactctgatgtctttatggttggtggatataaatggcgtgtgcttatatttccaaaggggaacaatgtggaccatttgtctatgtatttagatgtagctgattctgcatccttgccatatggttggagtagatatgcacaattcagcttggctgttgttaatcaaattcataacaagttcaccataaagaaagacacacaacaccagttccatgcaagggagagtgattggggattcacatcttttatgcctcttagtgatctatatgacccaagtagaggatatcttataaatgacacatgcattatcgaagctgatgtggctgtaaggaaagtgattgactattggacatatgactcaaagaaggaaactggttatgttggtcttaagaaccaaggagctacatgttacatgaactctctccttcaaaccttgtaccatatcccgtactttagaaaggctgtctaccatatgccaacaacagaaaatgatatgccttcagggagtattcctttggctcttcagagcttattttataagctccaatacaacgaaaccagtgttgccacaaaagaactgacgaaatcttttggatgggatacatatgattctttcatgcagcatgatgtccaagaacttaacagggttttgtgtgagaaacttgaagacaagatgaagggaacagttgtggaggggacaatacagaagttatttgaaggacaccatatgaactacattgaatgtgtaaacgtggacttcaaatcaacaagaaaagaatcattttatgatcttcaacttgatgtgaaaggctgtcgggacgtttatgcgtcttttgacaaatatgttgaagtggaacggcttgagggtgacaataaatatcatgctgaagcacatgggttacaggatgctaagaagggcgtgttgtttattgatttccctcctgttcttcaacttcagctaaagcgttttgaatatgatttcacaagggatacaatggtaaagataaatgatcggtatgaatttccacttgagctcgaccttgacagagagaatgggaaatatttatctcctgatgctgataagagtgtccggaatctttacacacttcacagtgtattggtacatagtggcggtgtgcatggtggacattattatgcatttatcaggccaactctttctgatcagtggttcaagtttgatgatgaaagagttacaaaagaagacatgaagagggcgttagaagagcagtatggtggtgaggaagagcttccccaaacaaatcctggctacaataatgctccatttaaatttacaaaatactcaaatgcctacatgcttgtttacatacgggaaagcgacaaagataagattatatgtgacgtagatgagaaagatattgcagaacatcttaggataaggttgaagaaagaacaagaagaaaaggaagacaagagaagatataaagcacaggctcatctctacactattattaaggttgctcgtgatgcagaccttttagaacagataggcaaggatatatattttgatcttgttgatcatgacaaagttcataactttcgtatacagaaacaaacaccatttaaccaatttaaggaggaggttgctaaacaatttggtgtgcctgttcaattccaacgtttctggatatgggcaaagaggcagaaccacacataccgtcccaatcgccctttaaccgctctagaagaaacccagtcggttggacaattgagagaagtttccaataagaataacaatgctgaacttaaattgttcttggagatagagattggaccagatttgcatcctcttccaccacctgacaaaagcaaagaagacatacttctcttctttaagctttatgaccctgagaaggaagaactccgatacgtaggtaggttttttgtgaagagttctggtaaaccaactgaaatcatagtaaaattaaatgagagagctggatttagtccagatgaagaaattgaactctatgaggaaattaaatttgagccatgtgtcatgtgtgaacgccttgacaaaagatcctcatttaggtctagccagatcgaagatggagacattatttgtttccagaaactccctaaagctgaggagaagtatcggtatgctgatgtcccttcatttctagaatacgtgaaaaatcgtcagatggttcattttcggtctcttgaaagacctaaggaagatgatttctgtcttgaactgtcaaagttgcatacatatgatgatgtggtggaacgagttgctcagaaacttaatctggacgacccatcaaaaatcaggcttactcctcacaactgttattctcaacaacccaagccccaccacattaagtatcgtgctgcagaacacctactagatatgctggttcactacaatcaggtttctgatattctgtattatgaggtgttagacattcctctgcctgaattacaatgtctgaagactttgaaagttgcttttcaccatgcaaataaagaagaacctgtaattcataatattaggttgcctaagcagagcactgttggagatgttctcaatgaaataaagtcaaaggttacactatctcatccagatgctgaacttagactgcttgaagtattctatcataagatttacaagatctttcctttaactgagaagattgagaatataaatgatcaatactggacattacgtgctgaggaaattcctgaagaagaaaagaacctgggaccccaggataggttgattcatgtttaccacttcaccaaagaggctgcacagaatcagatgcaagtgcagaactttggtgagcctttctttttgataattcatgaaaatgaaactttagcagatgttaaaatccgaattcaaaggaaattagaggttccagatgaggagttttccaagtggaagtttgcatttttatctttgggacgtcctgaatatttacaagattcggatgttgtatcaagccgttttcagagaagagatgtttatggtgcttgggagcagtacctcgggttggaacactcagacacaacacctaaaaggtcttttacagcaaatcagaaccgtcacacctttgagaagccagttaagatatacaactaggagagcagtgcgagtgtaaagttattggaatatggtgaactgaaaggaatggttttttgtttgtggaatccttccattgttggttttgtcggttggttggtgataattctttttggactgaagtcgggtaatgggaattggaatgataccaaaggatgttgttggttttgtgatgtgtaatttag

SEQ ID NO: 2428 - DNA, 3239 bp, Arnica chamissonis
ccggaagaggaagagatgctagtcccacattctgactttgctgccgctgatgggcctcaaccaatggaagttgcacctgcagaagctgctaatacagttgaagcaccaatagctgatgatccaccatcagcaaggttcacatggacaatagagaatttctcaagattgattggcaaaaagttgtactcggatgttttcattgttggaggatataaatggcgagtgctcatattcccaaaaggaaacaatgtggaccatttgtcaatgtatcttgatgttgctgattccacaacattgccatatggttggagcagatatgctcagtttagcctagctgtggtcaatcaaatgcatagcaagctcaccatacgaaaagatacacaacatcagttcaatgcacgagaaagtgattggggtttcacgtcttttatgcctcttggtgagctatatgaactcagtagaggatatcttgtgaatgatacatgcatagttgaagctgatgtggcagtccggaaggttgttgattactggtcacatgactcgaaaaaggaaactggttatgttgggcttaaaaatcaaggtgctacttgctatatgaactctttacttcagacattgtaccacatcccttatttcaggaaggctgtgtatcacatgcccacaactgagaatgatatgccatcagggagcattcctttggctttacagagtttattttataagcttcaatacagtgacacaagtgtggccacaaaagagttgaccaaatcctttggctgggatacatatgattcttttatgcagcatgatgttcaagaactcaatagggttctttgtgagaaacttgaagataaaatgaagggaactgttgtggaggggacaattcaacaattattcgaagggcatcatatgaattatatcgaatgcattaatgtagactacaaatcaacaaggaaggaatcattttatgaccttcagcttgatgtcaaaggttgtcgtgatgtctatgcttcttttgacaagtacgtggaagtggaacggcttgaaggtgataacaagtatcatgctgagcaacatgggttacaggatgcaaagaagggtgttctgttcattgatttcccccctgttcttcagctccaactaaaacgttttgaatatgatttcatgcgagatacaatggttaagataaacgatcgctatgaatttccattgcaacttgatcttgatagagaaaatgggaagtatttatcaccccaggcagacagaagtgttcgcaatctctatacccttcacagtgtattggttcacagtggtggggtccatggtggacactattacgcctatattcggccaacactctctgatcaatggctgaaatttgatgatgaacgtgtaactaaagaagacatgaagagagcaatggacgaacaatatggaggcgaggaagagttacctcaagcaaatcctgggttcaataactctccatttaagtttacaaagtattcaaatgcgtatatgcttgtgtatatacgtgaaagtgacaaggagaaaataatctgtaatgtggacgagaaagatgtagcagagcacctgaggattagattgaagaaagaacaagaagaaaaagagcaaaaaaggaaggagaaagcagaggcacatttgtatactattataaaggttgctcgtgatgagaatcttcatgaacaaatagggaaaaatatatttttgatctagtggaccatgataaagttcgtagtttccgtatccaaaagcaaatatcttttgcccttttcaaggaggaagtagctaaagaattgggtataccggtacaatgtcaacgtttctggctttgggccaagcgccaaaatcatacttaccgcccaaatcgtccattgactcctctagaagaagctcaatctgttggacatttgagggaggtatcaaataaggctaacaatgctgaacttaagttgtttctggaggtagaacttggacagaattcacagccagttcccccacctgcgaagactaaggaggagattctactattctttaagctttatgaccctttaaaagaggagcttcggtatgttgggaggctctttgtgaagggtactggaaagcctacagaaatactgacaaagctaaacgagttggctggctttgcgcctaatgaagaaatagaactctttgaggaaattaagtttgaacctaatgttatgtgtgaacatgttgataaaaagctcacatttcgggctagtcagcttgaagatggggacatcatctgctttcagaagcctcttccagttgggactgtaaaatgtcgctatcctgatgttccatcttttctggagtatgttcataatcgccaggttgtgcgatttcgttcgctcgagaaacccaaggaggatgagttctctttggaattgtcaaagctcaacaattatgatgatgttgttgaaagagttgcctcccatttaaacttggatgatccatcaaaaatcaggcttacgtctcataactgttattcccagcaacccaaacctcaaccgatcaaataccgaggagtggaacacctgtcagacatcttggcccactacaatcagacttcagatattttgtattatgaagtgctggatattcctcttcctgaactgcaaggcctgaaaaccctaaaggttgcttttcatcatgcaacaaaagatgaagtagtcatacataccattagattgccaaaacaaagcactgtgggtgatgtgatcaatgaccttaagacaaaggttgagttgtcacataaagatgcagagcttcgattgcttgaagttttttaccacaagatttacaagattttccctctgaacgaaaagatcgagaacattaatgatcaatactggacgttacgtgctgaggagatcccagaagaggaaaaggaccttggtccacaggatcgtctaattcatgtatatcattttacaaaagacacatctcagaaccagcaagtgcagaactttggggagccatttttccttgtgattcgagaggatgaaacattagctgaggttaaaatacgcatacaaaagaaactacaggttcctgatgaggagttttctaagtggaagtttgcatttctctctttgggtcgtcctacataccttcaggactctgatgttgtctccacccgctttcagagaagagatgtttatggtgcttgggaacagtacttgggattggagcactct

SEQ ID NO: 2429 - DNA, 3905 bp, Arabidopsis thaliana
gcgattgtatttctccctaagagtcactttgcctttgtctttgatttttctctgtatcgtcggtctctcttttgcgtttctcgatcccaccgtctaatccttctccggccaatgactatgatgactccgcctcccgttgatcagccagaagatgaggagatgcttgtgccgaattcagatttggtcgacggtcctgctcagcccatggaagttacccaacccgagactgctgcgagtactgtggagaaccagccagctgaggatcctcctactctgaaattcacgtggactatccctaatttctctaggcaaaacaccaggaagcattactccgatgtatttgtcgttggaggttacaaatggcgcatattaattttcccgaaagggaacaatgttgatcatttgtccatgtacttggatgtttctgatgctgcgagtttgccgtacggttggagcagatatgctcagttcagtctggctgtagtcaatcaaatccacaccagatataccgttagaaaagagacgcaacatcaattcaatgctagagaaagcgattggggatttacatcattcatgccacttagcgaactttatgatcctagtagaggatatttagtgaatgatactgttttggttgaagctgaagtcgctgtacgtaaggttcttgattactggtcatatgactctaaaaaagagactggttttgttggactcaagaaccaaggtgcaacatgctacatgaattctctcctacagacactataccacataccttacttcagaaaggctgtataccacatgccaacaactgagaatgatgcacccacagcaagtataccgttggctctccaaagtttgttttacaagctccaatacaatgacactagtgttgcaacaaaagagctgacaaagtcgtttggttgggatacatatgattccttcatgcagcatgatgtgcaagaactcaatcgggttctctgcgaaaagcttgaggacaaaatgaagggaactgttgtggagggaacaatacaacaactttttgagggccaccatatgaattacattgagtgcataaatgtagattttaaatctacacggaaagaatcattttacgaccttcagctggatgttaaaggctgcaaggatgtttatgcttcttttgacaagtatgttgaagttgaacgtcttgaaggagacaacaaatatcatgcagaaggacatggtttacaggatgcaaaaaaaggtgttcttttcattgactttccaccggttcttcaactccagctcaagaggtttgaatatgactttatgagggacaccatggtgaagataaatgatcggtatgagtttccgcttgaactggatcttgatagagaagatggaaagtatctgtcgcctgatgctgacaggagtgtccgcaacctttatactcttcacagtgttttagttcatagtggaggagtacatggtgggcactattatgcttttataaggcctacgctctcagatcagtggtataaatttgatgatgaacgagtaaccaaggaagatttgaaaagggctttggaggagcaatatggtggtgaagaagagctaccacagactaatcctggtttcaataataaccctcctttcaaattcacaaagtactcgaatgcttacatgcttgtatatatccgagaaagtgacaaagataaaataatctgcaacgttgatgagaaagacatagcagaacatttaagggtgaggctaaagaaagagcaagaagaaaaggaagataaaagaagatacaaggcacaagctcacttatataccataattaaggttgcaagagatgaagaccttaaggaacaaattgggaaggatatatattttgatcttgtggatcatgacaaagttcgcagtttccgtatccagaaacagacaccatttcaacagtttaaggaggaggtagcaaaagaatttggtgtacctgttcagttacagaggttctggatttgggcaaagagacaaaaccatacctatcgtcccaatcgcccccttacgcctcaagaggaattacaaccggttggacaaataagggaagcatctaataaggcaaacactgcagaactcaagctttttttggaagtagagcacctggatttacgtcctattcctcctcctgaaaaatcaaaagaagatattcttcttttcttcaagctttatgaccccgagaaggcagtattaagctatgctggcaggctgatggtgaaaagttccagtaagcctatggatataactggaaaactgaatgaaatggttggctttgctcctgatgaagaaatagaactttttgaggaaatcaagtttgaaccttgtgttatgtgcgaacacttggataagaaaacttcattcagattgtgtcaaattgaagatggagatatcatttgctttcagaaacctcttgttaacaaggagattgaatgcctctacccagctgtgccttcgtttcttgaatatgtccagaatagacagctggtccggtttcgtgctctggaaaaacctaaagaagatgagtttgttctggagttgtcgaagcagcacacttatgacgatgttgtggagaaagtggctgagaagcttggtcttgacgatccatccaaacttaggcttacatctcacaattgctattcccagcaacccaagcctcagcctatcaagtaccgtggagtagaccatttgtcagatatgttagttcattacaatcagacgtctgacattttgtattatgaagttctggacatccctcttccagaattacaaggtcttaaaaccttaaaagttgctttccatcatgccacgaaggaagaagtggtaatccacaatatcagactacctaaacaaagcacggtcggagatgttattaatgaacttaaaacaaaggtggagctttcgcatccagatgcagaactgagattgctcgaggtgttttaccacaagatctacaagattttcccatcaactgaaagaattgagaatataaatgaccagtactggactttacgagctgaggagattccggaagaagagaagaatattggtccaaatgatcgcttaattcttgtgtaccattttgccaaggagactggacaaaaccagcaagtgcaaaactttggcgagcccttcttcttggtaatccatgaaggtgaaactcttgaagaaatcaagaaccgtatccaaaagaagcttcatgtatctgatgaagattttgccaagtggaagtttgcgttcatgtcaatggggcgtccagagtacttgcaggacacagatgttgtttataatcgcttccagagaagagatgtctatggtgcttttgagcagtacctcgggttggagcatgctgacactactcctaagagggcttatgctgcaaaccagaaccgccatgcttacgagaagccggtaaaaatatacaattagccccaaaacatgaacacaaatgtcaggagacattgtggcagcaacgttggaccaaggcattgattggaccaatgcatcgaataagaagggaaagggcgagtgtgagggtgtgatgatgaccgtaggatgttgtagagaatctggtctgatagggttttgggttgcgcattgatagtggtgtgttttctatttttttcttttcaatctatccttattttatttcgtgcttcaatactttgtgttaatatctggaatgtgtgaagaccattgcacatgcaatttttattttccaaaaaaagaatatggaagcccttcgcttggattcgggagcgcggtttggctttcagagtttatagaataccgaaacatttgtaattttagagattgtggtttaagaagatttttgactgaggagatttgtattctttttgcattttcaaatt

SEQ ID NO: 2430 - DNA, 3864 bp, Citrus sinensis
ctcctccccccccccttctggtgatctctatagcttcagtgtaatcttcataattcgtgctttttgattcccctattcaattctcttattattcttccttttacaacaaaacgacgcgtcgtacactctcctcactcacaccatgactatcatgaccccagctccaatcgatcaacaagaggatgaggagatgctcgtcccacactctgatttggccgacaatcaccagcccatggaagttgttgctcaacctgaaactgccaatgctgtggagaataatcagccattggatgatcctccatcgtcaagatttacatggaggattgagaacttttctaggttgaatacaaagaagcactattctgagattttcattgttggtggcttcaaatggcgtgtgcttatttttccaaaaggaaacaatgtggaccatctgtcaatgtatctagatgttgctgattcatcaagtttaccatatggttggagtagatatgcacagtttagcttggcagtgattaatcaaatccattccaagtactcggtgagaaaagatacacaacaccaattcaatgcccgagaaagtgattggggttttacatcctttatgcctcttggtgaactctatgaccctaatagagggtatcttgtgaatgatacacttatagttgaagcagaggttattgtgcgtagggttgtggattactggtcatatgactcaaaaaaagagactggttatgttggacttaagaatcaaggggccacatgttacatgaactctcttctccaaactctatttcacattccttattttcggaaggctgtataccatatgcctacaacagaaaatgatatgccatctggtagcatcccattggctctgcagagtttgttttacaagctccaatacagcgacagcagtgttgcaaccaaggagttgaccaaatcttttggatgggacacatatgactccttcatgcaacatgatgtgcaagagcttaatcgagttctgtctgaaaaacttgaagataaaatgaagggaactgttgtagagggcaccatacaacagttgtttgaagggcaccacatgaactacattgagtgcatcaatgtagattacaagtcaacaagaaaagagtcattttatgaccttcagcttgacgtcaaaggctgtcgtgatgtttatgcttctttcgataaatatgtagaagttgaacgtcttgagggtgataacaagtatcatgccgagcaatatggattgcaggatgctaagaaaggtgtgttgttcattgactttccccctgtccttcaacttcagctaaaacgatttgaatatgattttatgcgggataccatggtgaagattaatgaccgttatgagttccctctgcaacttgaccttgatcgagagaatggcaagtatttgtcacctgatgctgacaggagtgttcgcaacctttacacacttcacagtgttttggttcacagtggcggggtgcatggtggtcattattatgcctttatcagaccgactctttctgatcagtggtataaatttgatgatgaaagggtaacaaaagaagatctgaaaagggcactagaagagcagtacggtggtgaagaggagttaccacagacaaatccgggatttaacaacactccttttaaatttaccaaatattcgaatgcatatatgctggtgtatatacgtgaaagtgacaaggacaagataatttgtaatgtggatgagcaggatattgcagaacaccttcgtgaaaggttgaaaaaagagcaagaagaaaaagaacacaagaagaaagagaaggcagaagcacacctttataccgttatcaaggttgcaagggatgatgaccttttggaacagattggaaaggatatctattttgatcttgtggatcatgacaaagttaggagttttcgtattcagaagcagatacctttcaaccttttcaaggttggacagttgagggaggtgtcaaataaggtccataatgcagaactgaagttattcttagaagtagaacgtggaccggatttacgccctattgctccacctgagaagacaaaggaagatattttgctcttcttcaagctttatgaccctgagaaagaagagctgcgttatgttggaaggctttttgtgaaaagtactggtaagccgatggaatatttgccaaaactaaatgaaatggctggttatgctcctgatgaagaaatcgatctatatgaggaaattaagtttgagcccagtgtaatgtgtgagcccatagaaaagagatgcacgtttcgagctagccagcttgaagatggagacattatttgctttcaaaaatctactccaattgaaggtgttggtaaatttcgctatccggaagtgccttcattcttggactatgtgcacaatcgccaagtggttcattttcggtctcttgaaaaacccaaggaagatgatttctgtctagagatgtcaaagctttatacttatgatgacgttgtagaaagagtagctcagcaactgggtttggatgatccatctaagatcaggcttacatcacacaactgttactctcagcaacctaaaccccaacccattaagtaccgtggggttgatcatttatctgacatgctgatccactacaaccagacttctgatgtattatattatgaagtattggacattccacttccagaattacaatgtctgaaaacactcaaagtcgcgtttcatcatgctaccaaggatgaagtgagtgttcatactattagactaccaaagcagagtactgtaggggatgtgattaatgatcttaaaacaaaggtggaattgtcacaacctgatgcagaacttcgattgctggaagttttctatcataagatctataagatttttccacttaatgaaaagattgagaatataaatgatcaatactggacattaagggcagaagagattccagaagaagaaaaaaatcttggtccacatgatcgtctaattcatgtttatcactttacaaaagagacagctcagaaccagatgcaaattcagaacttcggtgaaccgtttttcttagttatacatgaaggtgagactctgcaagaaataaaagtgcgaatacagaggaaactgcaagttccagatgaagagtttgctaagtggaagtttgcattcctttctcttggtcgcccagaataccttcaggacacggacattgtttccagtcgttttcagagaagagatgtttatggtgcttgggagcaatatcttggattggaacactcagacagtgctcctaaaagggcatatgctgctaaccagaatcggcacacgtatgagaagccagttaaaatctacaattaggaaacatttgaagatgcatgaatttcattcatggctgtggattcagttggtaagcctcaacaccaattgatctgtaaaaatgggcaaaaatgaaaagggatcgaggctataaaggtgaaaagggaaagcatatggttgttgactttattggggtattgtaattcttcttcagctagcttggattgggaggacatttcccctttagcaaatgtgtatctatctgcaagtgttgtcacagatatatttatagggtatagtgggtgatccttgttttctttttttcccctttttaattaatccttgtttctttattttcctttttcatcatgtttgctttcctgatttttgttttcatgtagatggctgatcagccactgttgtgagcctgtttccacacagagagatatatatacatatttttttgtatacggaagtttacaggccctgcattttcaattgtcattagataatattagttgccttctatt

SEQ ID NO: 2431 - DNA, 3872 bp, Cucumis sativus
atctgatttgcgtgttttgttccacagcaagaagacgaggagatgcttgtgccacattcggatgtagtggaaggtcctcagccgatggaagctcaagtggagccttctggcaccgtggagaaccagcaagtggaggatcctccacctataaaattcacatggagaatcgagaacttctctaggttaaacatgaaaaagtattattctgactcgttttctgttggtggatataaatggcggatattagtttttccaaaaggaaacaacgtggaccacctgtcaatgtatttggatgttgcagactctggaacgttgccatacgggtggagtagatatgcccagttcagcttggctgtggttaatcaggtccataagaagtattcgatacgaaaagacacaaaacaccaattcaatgctagagaaagtgattggggttttacatcattcatgcctctcagtgatctttatgatcctagtcgagggtaccttgtaaatgacacatgtattgttgaagctgaggttctggttcgtaaggtgcttgattactggtcatatgattcaaagaaagaaactggatatgtgggtcttaagaatcaaggagcaacttgttacatgaattctcttcttcagacactttatcatataccttacttcagaaaggctgtttaccatatgccgacaaccgagaatgacatgccttcaggaagcatccctttggctcttcaaagtttgttctataaacttcaatttaatgccagcagtgttgcaactaaagagcttactaagtcctttggatgggatacttatgattcttttatgcaacatgatgtgcaagaactcaatagagttttgtgtgaaaagcttgaagataaaatgaagggaactgttgtagaggggacaatacagcagttatttgagggtcatcacatgaattacatagaatgcattaatgttgactacaaatctacaagaaaggagtcattttatgatctccagcttgatgtgaagggttgtaatgatgtgtatgcatcttttgataagtatgtggaagttgaacgtcttgagggtgataataagtatcatgcagaagagcatggcttgcaggaagctaagaagggcgtcttgtttattgacttccctccagtcctccaacttcagttgaagaggtttgagtacgattttatgcgggatacaatggtgaagataaatgatcgctatgagtttcctcttcaactagaccttgatagagagaacggcaagtatctatcgccagaagcagataggagcgttcggaacctgtacacacttcatagtgtgctggtacatagtggtggtgtccatggtgggcattattatgcttttatcagaccaaccttatccgatcagtggtacaaatttgatgacgagcgtgtaacaaaagaagatacgaagagagcattagaagagcaatatggtggtgaggaagagttgccgcagaccaaccctggtttcaacaatactcccttcaagttcaccaaatattctaatgcatatatgcttgtgtacatccgtgaaagtgacaaggacaaaataatttgcaatgtggatgagaaagacatagctgaacaccttaggataaggttaaagaaagagcaggaggagaaggaagacaagagaaaatataaagctcaggcccatctctatgcaattatcaaggttgcacgagatgtggaccttcaagaacaaatagggaaggatatatacttcgatcttgttgatcatgacaaagttcgcagtttccgtattcagaaacaagtaccttttaatcttttcaaggaggaggttgccaaggagtatggcataccagtgcaatttcagcggttttggatttgggcaaagaggcaaaatcacacgtatcgccctaatcggccattgactccacaagaagaagcacaatctgttgggcagctgagagaagcatccaacaaggcaaataatgcggaactgaagttgtttttggaagtagagcttggattggatctacatcctattgttccacctgagaaaaataaagatgatatccttcttttcttcaagctttatgaccctgagaaaggagagctgagatacgtaggtaggctttttgtgaagagttcaacaaagcctattgagattttggaaaaattgaataaaatggcaggctttgatcctgatcaagagattgaactttttgaggaaataaagtttgagccttgtgtcatgtgtgaacatctagataaaaggacttcatttcgactaagtcagattgaggacggggacattatttgctttcagaaatcccccattgatagtgaagaatgcagataccccgatgttccatcttttttggagtatgtacataatcgtcaggttgttcattttcgaactcttgaaaaacccaaggaggatgacttttgcttagagctgtcgaaagttcatgtcgaaagttcatacttatgatgatgttgttgaaaaggtggcacaacgaattggactggacgatccatccaaaatcagattgactgctcagcaacctaagccacagcctattaaatatcgaggggtagatcatttgtcagatatgttggtgcattataaccagatgtctgatgtctgatatattgtattatgaagtcttggacattcccctcccggaattgcaaggtctcaaaaatctgaaggttgcttttcatcatgccacaaaagatgaggtggttattcacaatattagattacctaaacagagtaccgttggcgatgttattaatttacttaaaacaaaggttgagttgtctcatccagatgcggaacttagattgcttgaagttttctatcataagatttacaagatctttccacaaaatgaaagaattgagaatataaatgaccaatactggacactgcgtgtggaggaggcaagtatccctgaagaagagaaaaaccttggtcctcaggaccgtttgattcatgtataccacttcagcaaagaaacggcacaaaaccaaatgcaagtacaaaactttggagaaccgtttttcttggttattcatgaaggtgagaccttggctgatgtaaaagttcgcattcagaagaaacttcaagttccagatgaagagttctcaaagtggaagtttgcatttttctccctggggcggccagaatatctgcaggattctgacatcgtctccaatcgttttcagaggagagacatttatggtgcttgggaacagtaccttgggttggagcattcagacaccactcccaagaggtcttatgctgtcaatcataaccgtgccacatatgagaaacctgttaaaatatacaactgaacatatagccatcttctaccaatacttgagccatatgaagtccccacttcgtcgaatatggaagaaatgtagaatatgcaaatgagaggtgcgtacgaagaaacaaagctcctattgaagttactctctagtgtgtagttataggaattcagtgatatagtttttgttttccttttccctttttcgtttaaaatcgagcgggggaggttagtttttcctcgggcattttactgttcaattcttccatctggggctctgccattgtgttttttttttctaatgaactcattaaagcttcagcttttctataagtttggtgggttatgaaggtcttagtgtaatttaccaggtacataagcaacttccctttcttcctttttcttttctttcctttttccatctgaggggatgtatattgagtttatagttggcagtgtttttgtctcattcattatttttaccttattaccctattttggtggtggtggtggtggcttccttaggtgatgagatgagtttgggaaa

SEQ ID NO: 2432 - DNA, 4024 bp, Prunus persica
gcaaaacgaagccccgcttctctctctctctctctctctgcctctctttctttcactgtttccatttatctctcagatttgtcgatcggacggctcattgctcgccatcaatgactatgatgactcctgcaccgttagatgtaccagcaagaggacgaagagatgcttgtgccgcactcggatttggtcgaaggccctcagcccatggaagtagcccaagtggagcccgctgctagtacagttgaaagtcagccagtggaggatcctccaaccatgaaattcacttggactattgagaactttgctaggttgaacaccaagaagcactactctgacatgtttattgttggcggctataaatggcggatactaatatttcccaagggaaacaatgtggactacttgtcaatgtatttggatgtggcggattctgggacattgccatatgggtggagtagatatgcgcacttcagcttggctgtagttaatcagatccagaccaagtactcaataagaaaggatacacaacatcagttcaatgcaagagaaagtgactggggattcacatcattcatgccgctcggtgatctttatgaccctagtagggggtatctggtgaatgatacagtcgtcgttgaagctgaggttgctgtccgtaaggttcttgattactggtcgtatgactcaaaaaaggaaactggttatgttgggctcaagaatcagggagcaacatgctatatgaattctctactccagactttgtaccatataccttacttcagaaaggctgtgtatcatatgccaacaactgagaatgacatgccttcaggaagcatccctttggcactacaaagtttattctataagcttcaatacaatgacagcagtgttgcaacaaaagaattgaccaagtcttttggatgggatacatatgattcctttatgcaacatgatgtgcaggagcttaatagagttctttgtgaaaagcttgaagataaaatgaagggaactgttgtggagggtacaatacagcagttatttgaaggacatcacatgaattacattgaatgcataaatgtggattacaaatctacaagaaaagaatcattttatgacctccagcttgatgtcaaaggctgtcgggatgtttatgcttcttttgacaagtatgtggaagttgagcgtcttgagggtgacaataaataccatgctgaagaacatggtttgcaggatgctaagaagggtgtcctgtttattgacttccctcccgttcttcaacttcagttaaagcgatttgaatatgattttatgcgagatacaatggttaagataaatgatcgctatgaatttcctcttcaacttgaccttgatagggagaatggcaaatatctatcacctgactcagataagagtgtccgcaacctctacactcttcatagtgtcttggttcatagtggtggggtgcacggcggacattactatgcttttatcaggccaaccctctctgaccagtggtacaagtttgatgatgaacgtgtgacaaaagaggatgtgaagagggcattagaagagcaatatggtggtgaggaagagttgccacagaccaatcctggctttaataatactcctttcaaatttacaaaatactcgaatgcatacatgcttgtgtatatacgggacagtgataaggacaaaataatatgtaacgttgatgagaaagacatagctgaacacttacggataaggttgaagaaagaacaagaagaaaaagaagacaaaaggagatataaggcacaagcacacctctatacgattattaaggttgctcgagatgaggacctggcagaacaaattggaagggatatatattttgatcttgtggaccatgacaaagttcgtagtttccgtattcagaaacagacaccatttaatcttttcaaggaggaggttgcaaaagagtttggtataccagtgcaatttcagcgcttctggatttgggctaagagacaaaaccacacatatcgccccaatcgaccattgacacctcaagaagaactacaatcagtcggacacttgagagaggtatcaaataaaacacacaatgcagagctgaagctgtttttggaagtagagtttgggccggatctacgccctattcctctgcccgacaaaaccaaggaagatatcctgctgttctttaagctttatgaacctcagaaacgagaactacgttttgtcggtaggctatttgtgaagagttctagtaagccagtagatattttggcaaaattaaatcaattggctggttttggccccgatgaagaaattgaactttatgaggaaataaagtttgagccttgtatcatgtgcgaacaccttgacaagaggacctcatttcgattaagtcagattgaagatggagacatcatttgctttcagaaatctactccacttgaaagtgaagaagaatgtaaatatcctgatgttccttcatttttggaatatgtacacaatcgccagattgttcatttccgttctttggagaaaccgaaggaggaggattttagtttagaattgtcaaagctacacacttatgatgatgtggtggagaaggtggctcgccaaattggtttggaagatcctactaaaatcagactcaccgctcataactgctattctcaacaacctaagccccaaccaatcaaatatcggggagtagagcatttaacagatatgctagtccattacaatcaaagctctgatattttgtattatgaggtcttggacatccctcttccagaattgcaaggcctaaaaaacctgaaagttgcttttcatcatgctacaaaagatgaggtggtgattcacaatattagattgccaaaacagagcactgttggcgatgtgattaatgtacttaaaacaaaggtagagctgtctcatccaaatgcagaactcagactgctcgaggttttctatcacaagatctacaagatcttcccacacactgaaaagattgagaacataaatgaccagtactggactttgcgtgctgaggaggcaagttcctttcccccctttttctttatttagactggactggattggttcatgtcactgttattttttaagctgactggtttttatttctgtttatcagattccagaagaagagaaaaacttggctgtccatgatcgcttgattcatgtttaccactttacaaaggacactgcacagaaccagatgcaagtacaaaatttcggggaacctttcttcttggtcatccatgaaggtgaaactttagctgaagttaaagtacgcgtacaaaagaaattacaggtccccgatgatgagttttcaaagtggaagtttgcattcttgtcactcggtcgtccagagtacttacaggattctgatattgtttccagccgatttcagagaagagatgtttatggtgcttgggagcagtaccttgggttggagcactcggataatgctcctaagagagcttatgccgcaaatcaaaaccgtcacgcatatgagaagccagttaaaatatacaactaataagaccgatgatcctcgagtggagcatcagcttgtactaagcatccttccctgccacagaggcagtccagaaataggcacgatgcgaacgagtggcacatccaaagaacgaagctcgcatgtaggtgcttcgggtaggattcagttattgtattgtgagctcaattattcattcatgtgggtgggggaatgggaggatcatctcctggatgtgtagtaagattattactccctgcttgagttctgttctgttctttttgtttgttttttactccgtattgaaggcacctccttgctttgagaggttggttgctttccttatacagctccattgtaatttagcagtacataaggagattttgagggcatgtatatcgggtacagtcggctgcatttaggattgttccgtaatattatttttcttcatgttcaattaattttatcgtaatttggtgc

SEQ ID NO: 2433 - DNA, 3725 bp, Amorphophallus konjac
ggcgggtgctgatcttcccaaagggaaataacgtagaccacttgtctatgtacctggatgttgccgactcagcgagtctgccctatggttggagcagatatgctcagttcagtttggctgtgatcaatcagatgcacaacaaatacacgataagaaaggagacacaacaccaatttaatgctcgtgaaagtgattggggcttcacatccttcatgccactaagtgaactttatgacccaagcagaggttatcttgtcaatgatacatgtatagttgaagctgaggttgctgttcgtagagtggttgactactggacatatgattcaaaaaaggaacaggctatgttggtcttaagaatcaaggagctacttgttacatgaactctcttcttcaaactttgtaccatataccatattttagaaaggctgtgtaccatatgcccactacagagaatgatatgccatctggaagtattcctctagccttgcagagcttgttctacaagcttcaatatagtgacaatagtgttgctacaaaggagcttacaaaatcttttggatgggacacatatgattcattcatgcagcatgatgtgcaagagcttaatagggttctttgtgagaagttggaagataaaatgaagggaactgttgttgaggggaccattcagcacttgtttgaaggacatcatatgaactacattgagtgcatcaacgtggattacaagtctactagaaaagagtcattttatgatctccaacttgacgtgaaaggctgcagggatgtctatgcttcttttgacaaatatgttgaagttgaacgtcttgaaggtgataacaagtatcatgcagaacaatatggcttgcaggatgctaagaaaggggttttattcattgactttcctcccgtcttgcaacttcaactaaaacgctttgaatatgatttcatgcgggatacaatggttaagataaacgatcgttatgaattccccttgcaattagaccttgacagggacaatggaaagtatctttcccctgaagcagacagaagtgtccgcaacctttacaccctccatagtgttcttgtccacagcggcggggtgcatggaggtcactattatgcttttattcgaccaacactctctgaccagtggttcaagtttgatgatgaacgggtaacaaaagaagacacaaagagggcattagaggagcagtacggtggtgaagaggagttgcctcaaacaaatcctggtttcaataatactcctttcaaattcacaaagtattcaaatgcatatatgctcgtgtatattcgtgaaagtgacaaggaaaagataatatgcaatgtggatgagaaagacatagctgaacatctcagggtgaggttgaagaaagaacaagaagaaaaggaacataaaaagaaagagaaagctgaagctcacctttacactgtcataaaggtagctcgcgatgaggatttggctgagcagataggaagagagatatactttgacctagtagatcatgataaagtccgtagttttcgtatacagaagcagatgcctttcaatctttttaaggaagaggtggcaaaagaatttggcatcccagtacagttccagcgtttctggctgtgggctaagcgtcagaaccatacataccgtccaaataggcctttgactccacaagaagaagcacaatcagttgggctcttgagggaagtgtcaaataaggctcataatgctgagcttaaattgttcttagaagtggagattggaccggatttgcgtccgctttctccacctgagaagaccaaagaagatatactgcttttcttcaagctttatgacccagaaaaagaagagcttaggtatgtagggaggctttttgtgaagactacaggaaagccagtagaaattctgaagaagctcaatgaaatggctggtttcgattcgaatgaagaaattgaactttatgaggaaataaaattcgaacctagtgtgatgtgtgaacacatagacaagaaactcactttccgatccagccagcttgaagatggcgacatcatttgctatcagaaagctcctccactagagaatgatgaaatgtgtcgttatccagatgttccctcctttctggaatatgtgcataatcggcaggttgttcattttcggtcactggagaagccaaaggaagatgatttctgtttagagctgtcaaagctctatacgtatgatgatgtggtggaaagagttgctcatcacattggtttggacgatcccacaaagatcaggcttacttcccataactgttactctcagcaacccaagcctcagccaattaaataccggggggtagaacatttgtcagatatgcttgttcattataaccagacttctgacatattgtattatgaagtattggacattccactgccagagttgcaaggtttgaaaactctgaaagttgcgttccatcatgccaccaaggatgaggtggtgattcacagtattagattaccaaaaaacagcactgtgggtgacgtaattaatgatttgaaaacaaaggtcgaactgtctcatcctaatgcagaactccgacttcttgaggtgttctaccacaaaatatataagatcttccctgcaaatgagaagattgaaaatataaatgatcagtactggacattgcgtgcagaggagataccggaggaagagaaaaacataggtcctcatgatcggttgattcatgtgtaccatttcatgaaagatcctcaaaatcagatgcaggttcagaattttggggaaccatttttcctggttattcatgaaggtgaagctctagcagatgtcaaagagcgtattcagaagaagttgcaggtttcagatgaggaatttgcgaagtggaagtttgcattcctgtcccttggtcgaccagaatatcttaaagacacagatatagtgtctcatcgttttcagaggcgagatgtttatggagcttgggagcagtacctcggactggagcactcagacactgctccaaaacgcgcttacaccacaaatcaaaaccgtcacacttttgagaaaccagtgagaatttacaactgaaaaaaaaaatactaaagccaccaccaggatattgttgctgaaatgcaacacagtcaaccccccagctgcgtgctgatgctgtgggaatgaagatgagtaaaagaaacaatttgtggggttgatggttgccttgtttgttgattttgctggtgtggtgctttacagtctccgtcggactcagataaattaattctccttttttcgatggcagcacccctgcttcattgagcttcaaagctgttcttttttaaatgaaggctcccctaagggagaggtcatctcctttttcgttcccactgtaatttagtacataagcagattttggattagagaatgtatacaagtagtcgagcttctttgacgtttgttcttttgtttttcccccttgctttttgtttgtcttccttttcctgttcaagttatttttagagggtgggggttgtataatgatcagtgcaacttagttccgagcttaggaatttgtatacgctactacagccgtgaggcctctctatccattttcccatgtatgagcaaatttgttgtctacccacatgttctccccgatggacttaaaaacattggaaccgcgaagggaggttgatacatgggccagtatttg

SEQ ID NO: 2434 - DNA, 3454 bp, Pennisetum glaucum
tggttgattattggacttacgattcgaaaaaagaaacaggttatgtaggtctcaaaaatcaaggtgctacctgttatatgaactctctcctacaaacattgtatcatataccatactttagaaaggctgtatatcatatgccaacaactgagaatgacatgccatctgggagtatacctctagcccttcagagccttttttacaagctccagtatagcgacaacagtgtggctacgaaagagttgacgaaatcctttggatgggatacttacgattctttcatgcagcatgatgtgcaagagctcaacagagttctttgtgagaagcttgaagataaaatgaagggaactgttgtggaaggaacaattgaacaattatttgaaggacaccacattaattatattgagtgcatcaatgtggactataaatctagcagaaaagaatcattttatgatctgcaacttgatgtgaaaggttgtcgtgatgtttatgcatcatttgataaatatgtggaagtggagcgtttagagggtgacaataaatatcatgcggagcaatatggcttacaggatgcaaagaaaggtgtactcttccttgacttccctcctgttttgcaacttcaactgaagcgttttgaatatgattacatgcgagatacaatggttaagattaatgaccgttatgagttcccactacaacttgatcttgatagagatgatggaaaatatctttctccagatgcagatcgaagtattagaaacctttatacgcttcacagtgttcttgttcatagtggaggagtacatggtggtcactactatgctttcattcggccgacactctcagatcagtggtacaaatttgatgatgagcgggttacgaaagaagatatgaaaaaagcacttgaagagcagtatgggggtgaggaagagttgcctcaaataaaccctggtttcaataacacgccgttcaagttcacaaagtattcaaatgcctacatgcttgtctacattcgagagagtgacaaggagaaaataatgtgtaatgttgatgagaaggacattgcagagcatttgcggataaggttgaagaaagaacaagaagagaaagaacacaagaaaaaggaaaaggctgaagcacatctctacactatcataaagattgctcgagatgaagatctaaaggatcagattggtaagaacatatattttgacctggtggaccacgaaaaagttcgcagcttccgcattcagaagcagttgcctttcacttcattcaaggaggaagttgcaaaggaatatggcatacctgtacagtttcagcgcttctggttgtgggctaagaggcagaaccatacataccggccgaatcgcccgttgaccccccatgaagaagcacaatcggtcgggcagcttagggaagtctcaaataaggcacacaatgcggagctgaagctgttcctggaagttgaacttggaccggagttatgcccaattcgtccaccagagaagagcaaagaagacatactacttttctttaagctttatgatgctgagaaggaagacctcaggtttgtcggtagactttttgtgaaggctttgggaaagccatctgaaatattgacaaagctaaatgaaatggcagggttttctccaaatgaagaaattgagctatatgaggaaattaagtttgagccaaatgtgatgtgtgaacatattgacaagaaactaactttccgttctagtcagcttgaagatggagacatcatctgtttccaaaaggctcctgttcctgatggtgatacacaagtgcgctatccagatgttccttcattcttggagtatgttcacaataggcaggttgtgcactttcggtctctggacaaacctaaggatgatgatttttcgttggagttgtcaaagcttcatacttatgatgatgttgttgagaaagttgctcatcaacttggtttggatgatccatcaaagattcggcttacatctcacaattgttattctcagcaacctaaaccccaacctatcagatatcggggagtagaacatctactggacatgcttgtccattataatcagacttctgatatcttgtattatgaggttctggacattccattgccagaattacagtgcttgaaaacacttaaagttgcattccaccatgcaacaaaagatgaggttgtagttcatagcataagacttccaaagaatagcaccatcagcgacgtgattactgacttgaaaactaaggttgaactatctaatcctgatgctgagctccgcttgcttgaagtattttaccacaagatttataagatctttccacctcatgaaaagatagagaacataaatgatcagtactggacactacgggctgaggagatcccggaggaagagaagaatcttggcccacacgatcgattgattcatgtttaccatttcatgaaagatccaaatcagaatcagcagattcagaattttggagatccctttttgatggtcatccgtgaaggtgagactgctgctgaggtaatggagcgcatccaaagaaaacttagagtccctgatgaggaattctccaagtggaagcttgcattcatatccatgaaccggcccgagtacctccaggatactgatgttgtatctgcacgttttcagaggagagacgtatacggtgcttgggaacaataccttggcttggagcacactgatacaacatcaaaaaggtcttacacagccaatcagaatcgtcacacctatgagaagcctgtgaaaatttataattgagaaaccatcatatggacttaactccgacaaaggccttgtttgggtcggtctgccaaaggtgataagggacgtccctaagaaaaatggcggagggatctagtactgcctgtgtgccaaggccttcatgactcagcaacggctccaaccatcggcattactcctgttgattggcgaaagggtattcttttagaggcattcccatcttgcttccgagcaaccaagcatgtgtgttggttttttcatttgtgtaagagtatgatggcccctgctaggagataggtgtttgcttaatttgtagagcaaaagctagtacataagaaagaagattttggtagggggcatgtatacaggattatagccgagactgattgctgaactggcgcctctcttgtagcttggggaacaatgggagagattgtataatgggtttggtattggttccaattttcggtgttgagaaatgtaagaggataactgcgcagatagtacagttttgagttccagcgtaggctgctgttttgttggtaaacttggcatacctgtttgggaaaattttgcttcaacatgccgtacaagggtccagtaattctgcatgcccaattgcaactgataactagaaaattcgccatagtagactggaactggaaggc

SEQ ID NO: 2435 - DNA, 4024 bp, Solanum phureja
gttttcttctcaaaattacagctaattaactcaaaattctcttcaatttcttcatcgaatgaccataatgactcctgctcctaccgatgaagaggaggagatgcttgttccgcgttcagatttggtatttgaaggacctcagcctatggaagcacaagcagaaaccggcaatgatgtggaaaagcagccaccagaggatcctcaaacttcaaggtttacttggaagatagaaaacttctctaggttgaatgtaaagaaactatactctgacccttttgttgtcggtggctataaatggcggattttaatttttcccaaggggaacaatgttgattacctgtccatgtatctggatgttgctgagtcagctaatttaccttacgggtggagtagatatgccctgttcaacttgtcaattgttaaccaaattcataacaagtactccatcagaaaagagacgcaacaccaattcaatgcaagagaaagtgattggggtttcacatcctttatgccacttggtgaactatatgatccaaacaaaggttatcttgttgatgatacatgtgttgttgatgctgaggtagctgtccgaaaaattgttgactattggtcgtatgactcaaaaaaagaaactggctttgttggactgaagaaccaaggagctacctgttatatgaactcacttctccaaactctctaccatattccttacttcaggaaggctgtataccacatgcctacaactgaaaatgatatgccctccgctagtatccctctagcgttgcaaagcttattctataagctccagtacagtgacaacagtatagcaacaaaggagttgacaaaatcatttggatgggatacatatgattctttcttgcagcatgatgtgcaagaactcaatcgtgttctctgtgaaaagcttgaagaaaaaatgaagggtactgttgtggaaggcactatacagcagttatttgaagggcaccatatgaactatattgagtgcatcaatgtggactacaaatctacaagaaaggagtcattttatgatcttcagcttgatgtcaaaggctgtgctgatgtttatgcttcttttgataaatatgttgaagttgaacgtctcgagggcgataacaagtaccatgcggaacaatatggtttgcaggatgctaagaagggtgtcttatttatggatttcccccctgtcctgcagcttcagttaaagcgctttgaatatgatttttcgcgggacactatggtaaagataaatgacaggtatgagttccctctgcaactcgatctagatagagagaatggtaaatacttgtcacctgaggcagatggaagtgtcagaaacctttacacacttcacagcgtattagtccacagtggtggtgtgcatggtgggcactattatgctttcataaggccaactctttcagatcaatggtataaatttgacgatgaacgtgtgactaaagaagatgtgaaaagagctctagaagagcagtatggaggagaagaagagttgccacaaacaaatcctggattcaataatactcccttcaaatttacaaagtactcaaatgcttacatgctggtctatattcgggaaagtgacaaagagaaaataatgtgtaatgttgatgagaaggacattgctgagcatgtcagggcaaggttaaagagagaacaagaagagaaagagcagaagaagaaggagaaagcagaggcacacctttacacaattataaaggtttctcgtgatgaagacctcagacagcagattgggaaggacatacattttgatttagtggattatgacaaagttaggagttttcgcattcagaagcagacactttttagcatttttaaggaggaggttgccaaagaatttggtgtaccggtgcaatctcaacgtttttggctatgggcaaagcgccagaatcatacatatcgtccaaatcggccattaacacatctcgaagaagctcaaactgttgggcagttgagggaagtgtcaaataaggttcaaaatgcagagctaaaattgttcttggaagtggagcttggactggacttgagacacatcactccacctgacaagactaaagatgatattatgctattcttcaagatttatgatcctgagaaagaagagctgaggtatgctggaagactctttgtgaagggaacgagtaatccaactgaaatcttgaacaaactaaatgaaatggctggctatgcccctgatcaagagattgaactatatgaggaaataaaatttgaaccgattgtcttgtgtgaacccatcgacaagaaatttgctttccgaacgaaccagcttgaggatggtgatatagtatgctatcagaaatccctttcttctgaaagtcgccagaagttacggtatccagatgttccttctttcctggagtatgttcaaaatcgccaggttgttcacttccgatccttagaaaagttgaaggaggatgatttctgtttagagctgtcaaagattaatacatatgatgaagttgtggaaagagtagctcagcgacttggcttggatgatccatctaaaataaggctcacaccccataattgttactctcagcaacctaaaccccagccaattaagtacagaggtgtagacacccttggagatatgctggtccactacaatcagacatctgatattttgtactatgaagtactggacattcctttgccagaattgcaaggtttaaaaaccttaaaagtagcttttcatcatgctaccaaagatgaagtggtcacttacactatcagactaccaaaacaatctactgttggtgatgtaattaatgatctaaagacaaaggttgagttttcaaagccagatgcagaattacgattgctagaggtcttctaccacaaaatttataagatatttccaacaagtgagaagatagagaacataaatgaccagtactggacattgcgggccgaagagattcctgaagaagagaaaaatctaggcccgaatgaccgtttgattcatgtgtatcacttcactaaagagactgcacaaaaccaaatgcaaattcagaattttggggaacctttcctcttggttatctatgagggtgagactttagctcaagtgaaggtgcgaatacagaagaaattgcaggtcccagatgaagagtttgctaagtggaaatttgcattcctctcacttggccgtcctgagtaccttgaggactcagatatattgtccaaccgtttccagcgaaaggatgtttatggtgcttgggagcagtatctcggcttggaacatcctgacaatgcccctaaaaggattcatgcagcatatcagaatcgcccgacgtacgagaagcctgttaaaatttacaactaacactgctgaaaatgaagattgtgagatggttcaatgctacgattgaccattgcatttgtcgctgaagttagaagccaattcgagtctgtacagggtcttatgatttttgttactgaagcatcttgtattctgatatggatgtgaagtttgatcctaatgcagcatccatatctcagtacttgaactcaagtgatgcataaatgacctatcgataactctctctctctctgttcaagtgtaagtgtaagtgagccatacattggcaaagaattttgaacaaatgaatgaatacatgatatattgtgcttgattcagttctgacttttatctgaggagaagagtactaagttttctgccatttttgggctctatagatgtgattttttctggtagagattttgaggtttttgcctctgaaattgtgtaacctgaagtaagtttggtaatttcttgctattgtaattaaccagcaatgaagagtgacaaattgtttgtcacaagtacctgttgaatttttattttttttgttttcatgtgcccattgataaggcaattgtgcagcaataaagctggtttctggagctgtagttgaaaggaaatgatggttaaaatacaactttg

SEQ ID NO: 2436 - DNA, 4109 bp, Malus domestica
ctcaaaacgaagcccccgctttctctctctctctctctctctctctctctctctctctctactgttatcgttcgtctctctgattcgtcgatcggacggttcattgcgcggcagcaatgactatgatgacccctgcaccattagatgtgacagcaagaggacgaagagatgcttgtgccgcactcggatgtggtcgaaggccctcagcctatggaagtagctcaagtggagccagctagtacagttgatagtcagccagtggaggatcctccaacgatgaaattcacttggacaattgagaattttactaggttgaacaccaagaagcactactctgacacgttcgttgttggcggctataaatggcggatattgatatttcccaagggaaacaatgtggactacttgtcaatgtatttggatgtggcagattctgggacattgccatatggatggagtagatatgcgcacttcagcttggctgtagttaatcagatccataccaagtactcaataagaaaggacacacaacaccagttcaacgcaagagaaagtgactggggattcacttccttcatgcttcttggtgatctctatgacctgagtaggggatatctggtgaacgatacagttgtggttgaagctgaggttgctgtccgtaaggttcttgattactggtcatatgactcgaaaaaggaaactggttatgttgggctcaagaatcagggagcaacttgttatatgaattctcttctccagactttgtaccatataccgtacttcagaaaggccgtgtatcatatgccaacaactgagaatgacatgccttcaggaagcattcctttggcactacaaagtttgttctataagcttcaatacaatgacagcagtgttgcaaccaaagaattgaccaagtcctttggatgggatacatatgattcttttatgcaacatgatgtgcaggaacttaatagagttctttgtgaaaagcttgaagataaaatgaagggaactgttgtggagggtacaatacagcagttgtttgaaggacatcacatgaattacattgaatgcatcaatgtggactacaaatctacaagaaaagaatcattttatgacctccagcttgatgtgaaaggctgccgggatgtttatgcttcatttgacaagtatgtggaagttgaacgtctagagggtgacaataaataccacgccgaagaacatggtttgcaggatgctaagaagggtgtcctatttattgacttccctcccgttcttcaacttcagttaaagcgatttgagtatgattttatgcgggacacaatggttaagataaatgatcgctatgaatttcctctccaacttgaccttgatagggagaatggaaaatatctatcacctgactcagataagagtgttcgcaacctctacacccttcatagtgtcttggttcatagtggtggggtgcatggtggacattactacgctttcatcagaccaaccctttctgaccagtggtacaaatttgatgatgaacgtgtgacaaaagaggatgtgaagagggctttagaagagcagtatggtggtgaggaagagttgccacagaccaatcctggcttcaataatactcctttcaaatttacaaagtactcaaatgcatacatgcttgtgtatatacgggatagtgataaggacaaaataatatgtaacgtggatgagaaagacatagccgaacatctaaggataaggttgaagaaagaacaagaagagaaagaggacaaaaggagatataaggcacaagcacacctctatacaattattaaggttgctcgagatgaggatctgacagaacaaattggaagggatatttattttgaccttgtggaccatgacaaagttcatagtttccgtattcagaaacaaatgccctttaatcttttcaaggaggaggttgcaaaagcgtttggcataccagtgcagtttcagcgtttctggatttgggccaagagacaaaaccacacatatcgccccaatcgaccattgacacctcaggaagaaacacaatcggttggacaattgagagaggtatcaaataaaacaaacaatgcagagctaaagctgtttttggaagtagcatttgggctggatctacgtcctattcctccgcttgacaaaaccaaggaagatattcttcttttctttaagctttatgagcctgagaaacgagaactacgttttgttggtaggtttttcgtgaagagttctagtaagccagcagagattttaggaaaattaaatcaactggctggttttgcccctgaggaagaaattgaactttatgaggaaattaagtttgagccttgtatcatgtgcgaacaccttgacaagaagacctcatttcgattaagtcagattgaagatggggatattatttgctttcagaagtctactcctcttaaaagtgaagaagaatgtaaatatcctgatgttccttcgtttttggaatatgtacacaatcgccaggttgttcatttccgttctttggagaaacctaaggaggaggatttcagtttagaattgtcaaagcaacacacttacgatgatgtggtggagaagttggctcgccaaattggtttggatgatcccaccaaaatcagactcactgcacataactgctattctcagcaacctaagccccaaccaattaaatttcggggagtagagcatttaactgatatgttagttcattacaatcaaagctctgatattttgtattatgaagtcttggacatccccctgccagaattgcaaggcctaaaaaatctaaaagttgcttttcatcatgctacaaaagatgaggtggtgattcacaatattagattgcccaaacagagcactgtaggggatgtgattaatgtacttaaaacgaaggtagaactgtctcatccaaacgcagaactccgactgcttgaggttttctatcacaagatctacaagatcttcccacatggtgagaaaattgagaatataaatgaccagtactggactttgcgtgcagaggaggcaagttcctttcgcccccttttctttatttagactgaattggattgatatttttgtaccagtgctctttatgcagctgactttttgtttttctttgtttcttgtgcatcagattccagaagaagagaaaaacttgggtctccatgatcgcttgattcatgtttaccactttacaaaggacactgcacagaaccagatgcaagtacaaaattttggggaacctttcttcttggtcatccatgaaggtgaaactttagctgaagttaaagaacggatacaaaagaaattgcaggtccccgatgaggagttcaccaagtggaagtttgcattcttgtcacttggtcgtccagagtacttgcaggattctgatgttgtttccagccgttttcagagaagagatgtttatggtgcatgggagcagtaccttgggttggagcactctgataatgctcctaagagagcttatgcagcaaatcagaaccgtcacacatatgagaagccggttaaaatatacaactaataagagctgatggtcctcgactggtgcatcagcttgtacttagcatccctcagtgccacggaggcagtcggaaaatagccaggatgcaaacgagatgtagctcatataggggtgatttggtcagcaatcgattgttgtcgtttgggatcaaatattcattcacgtggttggggaaggggaagatcatctccccctgctagagatgtgctctgtttctgttgtttgttttctttacctccttattgaaggcaccgccttgctttcggaggttggttgctttccttatacagctccgttgtagttttagcagagtacataaggagattttgagggcatgtatatcgggtacagttggctgcatttgcatgtaggattgttccgtaatattatttttcatgttcaattaattttctctcattttcgtgaaggccttgggaaacaaaaaactgcgaaacgggtttgtattagcatggttggcatgttcagaattctggctctcagattgtataagatttacgatttcaca

SEQ ID NO: 2437 - DNA, 4556 bp, Distylium racemosum
tgattggaggatccagcgtaggttttttggctttttccctctggtaacgaaagtagtttttattgttaatgtggatcggagctgccagatctgaaccggtaaagtatatatgagcgacgggctttctcttactgttgtaatggcgtgttaggtccctggggtttacgaggtagggtttgggaaggggctgtaatgcatttatgtcgcgacagccaaaagacgaagagatgttggtgccccatcccgaatttaacaacagcaataacaacaacgacgccattgcacccatggaagcaacagtagggcggccggagacggtgacggtaagtaccgcagagaaccggccgattatcgaggatcctccaacatcaaaatttacttggactattgaacacttttcgaggttgaatgtgaggaagcattactctgaatattttatagtcggaggctacaagtggcgaattctagtgttcccaaagggaaacaatgtagaccaggtgtcgatgtacttggatgtggcagattccagcattttaccttatggatggagcagatatgctcatttcagttggcaattgtcaatcagattcatccgaagtatactatcagaaaagaaacccaacatcaatttaatgctcgagagagtgattggggtttcacatcatttatgccgcttttggacttttacgattcgtaaaggttatttggtaaatgacactttggtagtagaagcagaagttactgtacagagagtcttagattattggacttacgactctaaaaaagagactggatttgttggactgaagaatcaaggagcaacatgttatatgaattcccttctgcaaaccttgtatcatatgccttacttcagaaaggcagtgtatcatatgccgacaactgaaaatgatgcgccatcaagtagcatccctttggctctacagagcctgttctacaaacttcaatacagtgacactagtgtgtcaacaaaagatttgacaaaatcttttggatgggatacatatgattctttcatgcagcatgatgttcaggagctgaaccgtgtgttatgtgagaaattagaggacaaaatgaagggaacagctgtggagggtacaattcaacagctatttgagggtcatcacatgaattacattgaatgtattaatgttgattacaaatctacacgtaaagagtcgttctatgatctacaacttgatgtcaaaggctgtcgcgatgtctatgcatcatttgacaagtatgtagaagttgaaaaactggaaggcgataataagtatcatgcagagaattatggcttgcaggaggcacaaaaaggtgttcttttcattgattttcctccagtattacagcttcaactaaaacgatttgaatatgatttcatgcgtgatatgatggtcaagataaatgaccgttatgagtttccactgcaactcgatttggatagggaaaatggaagatatctctctccagatgcagatagaagtgtgcgaaatttgtacactctacacagcgttttggtccatagtggaggtgtacatggaggtcattattatgcttttatcagaccaactctctcagaccagtggtacaagtttgatgatgagcgtgtcacaaaggaagagaccaagagggccctcgaagagcagtatggtggtgaagaggaactgccacagacaaatcctggttcaacaacacaccttttaagttcacaaagtattcaaatgcttacatgctcgtttatgttagagagagtgataaggacaaaattatttgcaatgttgatgagaaggatattgcagagcatttaagagtaagattaaagaaagaacaagaagaaaaggaacagaaacggaaagaaaaggcagaagcccacctttatacaattataaaggttgcccgtgatgaagatcttactaatcagattggcaaggacatatattttgatcttgtagatcatgaaaaggtccgaacatttcgaattcagaagcaaattccttttacatcattcaaggaagatgttgcaaaagagtttggtattcctgttcaatttcagcggttttggctgtgggcaaagcgtcaaaaccatacgtatcgacctaacaggcctttgacaaccctggaggagtcccaatctgttggctatttaagggagtcttctaacaaagctcatgtggcagaattgaaattatttttggaagtagaaaatggaccggatcttcgttggcttccacctcctgaaaaacaaagaagatatactccttttttttaaacttatgatccagagaaagaagagctcaggtatgttgggaggtcttttgtgagggccagcggtaaaccttcagagattattgcaaagcttaataccatggctggtttccttccgaatgaggaaattgatctttttgaggaaattaaatttgaaccaaatgtcatgtgtgagctcattgaaaagaggatttcttttcgagctagtcagcttgaagacggagatataatttgttttcaaaaagctcttacaagtgatgaggagatgtatcgttatccagacgttccttcatttttggagtatgtgcataaccgccagattgtacatttccgccgcctggataagcccaaggaagatgatttttgtttggaactatcaaagctttatacttacgatgatgttgtagagagagttgcacaacaactgggcttgacagatccttcaaaaatcagacttacatcacataattgctattcacagcaacccaagcctcaacctatcaaatacagatcagtagatcacttgagtgatatgctacttcattataatcagacatctgatatcttatactatgaggtcctcgacatcccactcccagaactggaggggctgaaaacattaaaggttgcttttcatcatgcaacaaaagatgaggtgtctgttcacagtataagactgcccaaacagagcactgtgggtgatgttatcaatgaactaaagggaaaggtggagctatccaatccaaatgcagatcttagattgcttgaggttttctaccacaaaatttacaagatttttccattgaatgaaaaaatagagaacataaatgatcaatattggactttgcgagcagaagagatcccagaggaggagaaaaacttgggtcctcaggatcggttgatacatgtttatcactttaccagagatgcatctcaaaaccaaatggtgcaaaactttggagagcctttctttttggttattcatgatggtgagacattagctgaagtgaaagaacgaattaagaagaagctgcaggttcctgatgaagaattttccaagtggaattttgctttcctttctttgggccgcccagattatcttcaagactcagatattgtgtctattcgttttcagaagcgggatgtttatggagcttgggagcagtatcttgggttagagcattctgatagtgcgccaaagaaaccacatcaaggtaatcagaaccgccatacatttgagaaacctgtgaagatatacaattgagtactgaaatagtattcttacttgagactgaaggattgcacctcaaggagcctttgttttgatgaatggaatttgaggagattttcataattgcggtcttcaatctgccttgagaatttagccattcttgtccccaagtggcactcagtttgtttatatctttattttggcctttctcatgtatgttatcattgcttatagaagtctctttatactgattagtgttactgatgtttgtccctcgttagccactttcacttcatgttagcggtggttattggagtgttctatttgccaacagaatctttttttttcttactggaagattttagaatctggggtcttgctgccttgcaatatgtcaaggttttagataatatatcaatacaaaagttgtcatgccattggcattagatgtcacagtaatcagctgcattaattgaattgctcacagatttcttggaagagattttaattgtatgtaatagattctttttaagctgcaatccccattgtaatctatcacttgtgtggcctttggagacaaatggtctttgcattcacggatgaggataataacagcagctaaatttgtactgtattttccagacgcatggcacatttatttggataacgtgagatttcatatttcatgaaatatatgccatataggtagaatgatgttctactggtgctcagaagctaagatttgggttttaagcctttcttctgagtaattgtaatgtactctttgtgagatgctttgcttagtgattggttttctttttgaaaatcatgtatcatatatatcatcctagagcgaaaatgttacataggaacagcaacttgtaagccagccgccgcaaacaaaatgcgagggacatgctcatactggcactagctgatgaaacatatatgtcatagctatacgctaagaaaacaaagtgaatgttgtgttggacaatagttgtacttttatattagccagattgggccactggtactg

SEQ ID NO: 2438 - DNA, 4032 bp, Mimulus guttatus
attctctctccgtctctctttctctctcatctctctctctctctcctatctttctcccccctctctcaaattgcattgatttctctgtgatttgtcaatcaggcggctgtaaatcttcagccatgacgatgatgactcctcagccgttggatcaacaggaagatgaagagatgctggtgccgcactctgatttagtcgaaggtcctcaaccgttggtccaagggcctcagccaatggaagtggcgccatcggacaatgctggaacaacagaaaaccaggcgaatgacgagccacaagcatcacgcttcacgtggacgattgatgccttttccagagtgaataataagaagctttattctgatgccttcgctgttgggggctataaatggcgcgtgcttatttttccaaagggaaataatgtggactacttatcgatgtatctagacgtggctgattcagctaatttgccgtatgggtggaacagatacgcgcagtttagcttggctgtagttaatcaaatgcatagcaagttaacaattaaaaaagatacacaacaccagttcaatcaaagggagagtgattggggtttcacatctttcatgcctcttagtgagctttacgaccccaacaagggatacctggtgaatgatactgttgttattgaagccgatgtagctgtacgtaaagttgttgattactggacatatgattcaaagaaggagacaggctatgttggacttaagaaccagggtgcaacttgttacatgaattctctgctccaaactctgtaccatattccttacttcagaaaggctgtatatcacatgccaacaacagagaatgataaccccactggaagcatccctttggcgttgcagagtttattttataagctccagtataatgacaccagtgttgcaacaaaagagttgactaaatcatttggatgggacacatatgattcctttatgcaacatgacgtgcaagaacttaacagagttttatgtgaaaagcttgaagacaagatgaagggaactgttgttgaagggacaatacagaaattatttgaagggcaccatatgaattacatagaatgcatcaatgtggacttcaaatctacaagaaaagagtccttttatgatcttcaattggatgtaaaaggttgcaaggatgtctatgcttcatttgacaagtatgtggaagttgaacgccttgaaggagataacaaataccaggctgaaggacatggtttgcaggacgcaaaaaagggtgtcttgttcatggacttcccaccagttctccagctgcagttgaagcgttttgagtacgactttatgagggatacaatggttaagataaatgaccgttatgaatttccattggaacttgatctagacagagacaatggcaagtatttgacaccagaagcagatagaggcatacgaaacctttacacgcttcacagtgttttggttcatagtggtggggtgcatggtggtcattattatgcttttatcaggccgacgctttctgatcaatggtacaaatttgatgatgagagggttactaaagaagatatgaagagagcattagaggagcagtatggtggtgaggaagagctaccacagacaaatcctggctacaacaacaccccgttcaaatttacaaaatactcaaatgcatacatgcttgtgtatatacgagtgagtgacaaggataagattatatgtgatatggatgagaaggatattgcggaacatcttcggataagactgaaaaaagaacaagaagaaaaggaagacaagaaaagatacaaagcccaagcacacctttatactattatcaaggttgctcgagatgaggatttgagggaacagattggaaaagatatatattttgatcttgtagatcatgataaagtatgtaacttccgaatccagaaacaaatgcctttcaatcagttcaaggaagaagtagccaaagaacttggtataccagtacaatttcaacgcttttggatatgggcaaaaagacagaaccatacttaccgtccgaaccggccattgacggcccaggaagaagcgcaaactgttggagcactgagagaagtttccagtaaagctcacaatgcagaattgaagttgttcttggaagtacatcatggactggatttacagccggttcctccaccagaaaaaaataaggaagacatacttttgttttttaaactctatgatcccgagaaagaagagcttcgatacatagggaggtttttcgtaaagaacaccggaaagcccattgagatcctagcaagaataaatgaaatggctggatttgctcctgatgaagagattgatctatttgaggaaataaaatttgagccaactgttatgtgtgaacgccttgataaaaaagcttcatttcgatttagtcagatcgaagatggggacattatttgcttccagaaacggcctttgcctgaacatgaagagaaaatccgtttccctgatgttccttcatttttggagtacgtaaaaaatcgccagattgtgcattttcgagctttggagaaacccaaggaagatgaattttgcctagaattagcaaagaatcacacatatgatgatgttgtggaaaaagttgcccagcgccttggcctagacgatccatcaaaaattcgtcttactcctcacaattgctattctcagcaaccgaagcccaatcccattaaatatagatcggttgatcatttgctagacatgcttgtccactataatcagatttctgatatactgtactacgaagtgctagacattcctcttccagaattgcagtgcttaaagacactgaaggtcgccttccatcacgccacgaaggaggaggctgtaattctcaatattagattgcctaaacaaagcaccgttggagatgttctcaatgagatcaaaacaaaggtggagttgtctcatccaaattctgagcttaggttgcttgaggttttctatcacaagatttacaagattttcccactccatgagaaaattgagaacataaatgaccagtactggactctgcgtgccgaggagattccagaagaagaaaagaatcttgggcccaatgatcgtttgattcatgtttaccatttcaacaaagagattgcccagaatcaactgcaggtccagaatttcggggaaccattcttcttggtcattcatgaaggcgacacattagcagatgttaaagtacgcattcaaaagaaattgctggtctcagatgaggagttctctaagtggaagtttgcatttttgtcattgggacggccagagtatctcgaggactcggacattgtctccagtcgtttccagagaagagatgtttacggtgcttgggagcagtacctggggttagagcattccgatactactcctaaaagagcatatgctgcaaaccagaaccgtcacacatttgagaagccagtgaagatatacaattgaagttgatcgctttttacgaaaatgcccactttgatgttggttggaaatgagaattaaggcaaaaaaaaaggaaaaaaagattgacattccctgttgttcttttacgaggctgtggtggttagtattatttatcctttcgactagtgttggaagggcagctcctctcttagacgtttgttgtttcccattgtcgatagctctttcgttcttctcattctcactttgctttgtagtgggcgtgcaaactattacgttgtcactttgtaatttatcacgcgtaacagattttggctgataggtttgtaaagtgggtatagtttaggtctctctaccataatgatttatgtcttcttccattttcttttcctttttgagtttcctaccccttgttttttttcgtttgtatttcgtgtattgcataaataggggacgtaactcgtgattgtaaaataatacgattatgttgttttttggatatcatatttataagctaccattattcagagcattaaattatgttattacgagtgcccaaatt

SEQ ID NO: 2439 - DNA, 3840 bp, Gossypium raimondii
aatttagttgcccaagttgagccagctagtacggttgagaatcagcaagtggaggagcctccatcaatgaaattcacttggacaattgagaatttttctaggctcaacaccaagaagcattattcagatatatttgttgttggtggttacaaatggaggatactaatttttccaaagggaaacaatgtggatcacttgtctatgtacctggatgttgcggattcttctgcattgccatatggttggagtagatatgctcagtttagcttggcagtagttaatcaaatccatcacaaatattcaataagaaaggatactcaacaccagttcaatgcaagagagagcgattggggtttcacatcatttatgcctctcagtgatctttatgaccctagtagaggatatcttgtgaatgatactgttgttgttgaagctgaggttgctgttcgtaagatactggattattggtcatatgactcaaagaaagaaactggttatgttggacttaagaaccaaggggctacttgttacatgaactcactcctgcagactctataccatataccatactttagaaaggctgtgtaccacatgccaacaactgaaaatgatatgcctataggaagtattcctttggctctgcagagtttattttataagcttcaatataatgacactagtgtcgcgacaaaggagttgaccaaatcttttggatgggatacatatgattctttcatgcagcatgacgtgcaagaactcaacagagtgctgtgtgaaaagcttgaggacaaaatgaagggaactgttgtggaggggacaatacagcagttatttgagggtcatcatatgaactatattgaatgcatcaatgtggattacaagtctacaagaagggaatcattttatgaccttcagcttgatgtcaaaggttgtcgggatgtttatgcttcctttgataaatatgtggaagttgagcgccttgagggtgacaacaaatatcatgctgaagagcatggcttacaggatgcaaagaaaggtgtcttatttattgacttccctcctgttcttcaacttcagctaaagcgatttgaatatgattttatgcgggatacgatggtgaagataaatgaccgctatgaatttcctcttcaacttgaccttgatagagaagatgggaagtatttatcacctgatgcagataggagcgttcgcaacctttacatgcttcacagtgtcttagttcatagtggaggagtacatggtggacactactatgcttttattaggccaaccctttctgaccagtggtataaatttgatgatgaacgggtgacaaaagaagatatgaagagggtattagaagagcagtatggtggtgaggaagagttgccacagacaaaccctggcttcaataacacgcctttcaagtttacaaaatactcaaatgcgtacatgcttgtctacatacgagaaagtgataaggacaaaataatttgcaatgttgatgagaaggacattgctgaacacttgaggatgaggttaaagaaggagcaggaagagaaggaagacagaaggagatataaagcacaggcccacctttatactattataaaagttgctagagatgaagatcttctagaacaaatcggaaaggacatatattttgatctcgtggatcatgacaaagttaggagtttccgcatccagaagcagacatccttccttgcttttaaggaggaagttgcgaaagagtttggcataccattacagtatcaacgtttttggatttgggcaaagcgtcagaaccatacgtatcggccaaatcgaccattaacccctcaggaggaggctcaatctgttggacaattgagggaggtttcaagtaaagcccacaatgcagaactaaaactgttcttggaagttgagcgtggccaggatttacatcctattcctccacctgataagacaagggatgatattctacttttcttcaagctctatgacccagagaaaggagaattgcgttatgttggtagactattagtaaaactttctggtaagccaatagactatatagcgaagctaaaccaaatggctggtttttctcctgatgaagaaatagaactttatgaggaaataaagtttgagccttgtgtgatgtgtgaacaccttgataagagatgctcattccggttaagtcagattgaagatggggatatcatatgctttcagaagtcttctccaattcaaagtgaagaagcatgccggtgtccagatgtgccatcatttctggaatatgtgcacaaccgccagattgttcgttttcgatcattggaaagaccaaaagaagatgatttttgtctagagctgtcaaagatacatacatatgatgatgttgtggaaagagtggcttacaaaattggtctggatgatccatccaaaatcaggctcacatctcacaactgctactctcaacaacctaagcctcaacctattaaataccgaggagtagagcatctttcagaaatgttggtccactataaccagacttctgacattttgtattatgaagttttggatatccctttgccagaattgcaagggctgaaaaacctgaaagttgctttccatcatgctacgaaggaggaagtggtaattcacaatattagattgcctaaacagagcactgtaggagacgtgattgatgaacttaagacaaaagtggaattgtcacatccaaatgcagagcttagactgcttgaagttttctatcacaagatctataagatctttccacccagtgaaaagattgagaacataaatgaccagtattggacattgcgtgcggaagagatcccagaagaagagaagaaccttggtcccaacggtcgtttgattcatgtataccactttacgaaagaaactgcccagaatcagatgcaaatacagaattttggtgagcccttttttttagtcattcatgaaggtgaaactctggctgaagttaaagtgcggatacaaaagaaattgcaggttccagatgaagagttctccaagtggaagtttgcattcatgtcattgagtcgaccagagtatctacaggagtcggacattgtgttcaatcgttttcagagaagagatgtttatggtgcttgggagcaataccttgggttagagcatagtgataacactcctaagagggcttatgtaaatcagaaccgtcacacatacgagaaagcagttaaaatatacaactaggagaaagctaatttgatagagagattagcaggtaagttagttgatgtggagatagccttttccttacaaatgatggcattgtagatatcatcattattatgattatggaggaaaccgttgttgcttagagagaatttatccagtagggtttgattattgtttttttgtaggataaaataatataattatcaatatatgatatagttttgttttctttctttatgtaatttagcagaacataggaagattttgacgggatgaatatcataccggcctcatcacattcttttcctttgttattattaatactaggagaattagtgcttaaggatttaaagtgtgcgtggaatgtgtacagctccccgtttctatgcttagtttatgatatcctacacttacatgtcatcatttcatctgttaaagtttacctctagttcttgtgtcatatcataaaattcattttagtagttcatgtacatttgaaaacctgacattttaatccctacatgagtgcacaaatggatttgacagtaaattaaatataaaaggtaaaaacatttttgaagaatgagaagagataag

SEQ ID NO: 2440 - DNA, 4002 bp, Mimulus guttatus
ttctctctccgtctctctttctctctcatctctctctctctctcctatctttctcccccctctctcaaattgcattgatttctctgtgatttgtcaatcaggcggctgtaaatcttcagccatgacgatgatgactcctcagccgttggatcaacaggaagatgaagagatgctggtgccgcactctgatttagtcgaaggtcctcaaccgttggtccaagggcctcagccaatggaagtggcgccatcggacaatgctggaacaacagaaaaccaggcgaatgacgagccacaagcatcacgcttcacgtggacgattgatgccttttccagagtgaataataagaagctttattctgatgccttcgctgttgggggctataaatggcgcgtgcttatttttccaaagggaaataatgtggactacttatcgatgtatctagacgtggctgattcagctaatttgccgtatgggtggaacagatacgcgcagtttagcttggctgtagttaatcaaatgcatagcaagttaacaattaaaaaagatacacaacaccagttcaatcaaagggagagtgattggggtttcacatctttcatgcctcttagtgagctttacgaccccaacaagggatacctggtgaatgatactgttgttattgaagccgatgtagctgtacgtaaagttgttgattactggacatatgattcaaagaaggagacaggctatgttggacttaagaaccagggtgcaacttgttacatgaattctctgctccaaactctgtaccatattccttacttcagaaaggctgtatatcacatgccaacaacagagaatgataaccccactggaagcatccctttggcgttgcagagtttattttataagctccagtataatgacaccagtgttgcaacaaaagagttgactaaatcatttggatgggacacatatgattcctttatgcaacatgacgtgcaagaacttaacagagttttatgtgaaaagcttgaagacaagatgaagggaactgttgttgaagggacaatacagaaattatttgaagggcaccatatgaattacatagaatgcatcaatgtggacttcaaatctacaagaaaagagtccttttatgatcttcaattggatgtaaaaggttgcaaggatgtctatgcttcatttgacaagtatgtggaagttgaacgccttgaaggagataacaaataccaggctgaaggacatggtttgcaggacgcaaaaaagggtgtcttgttcatggacttcccaccagttctccagctgcagttgaagcgttttgagtacgactttatgagggatacaatggttaagataaatgaccgttatgaatttccattggaacttgatctagacagagacaatggcaagtatttgacaccagaagcagatagaggcatacgaaacctttacacgcttcacagtgttttggttcatagtggtggggtgcatggtggtcattattatgcttttatcaggccgacgctttctgatcaatggtacaaatttgatgatgagagggttactaaagaagatatgaagagagcattagaggagcagtatggtggtgaggaagagctaccacagacaaatcctggctacaacaacaccccgttcaaatttacaaaatactcaaatgcatacatgcttgtgtatatacgagtgagtgacaaggataagattatatgtgatatggatgagaaggatattgcggaacatcttcggataagactgaaaaaagaacaagaagaaaaggaagacaagaaaagatacaaagcccaagcacacctttatactattatcaaggttgctcgagatgaggatttgagggaacagattggaaaagatatatattttgatcttgtagatcatgataaagtatgtaacttccgaatccagaaacaaatgcctttcaatcagttcaaggaagaagtagccaaagaacttggtataccagtacaatttcaacgcttttggatatgggcaaaaagacagaaccatacttaccgtccgaaccggccattgacggcccaggaagaagcgcaaactgttggagcactgagagaagtttccagtaaagctcacaatgcagaattgaagttgttcttggaagtacatcatggactggatttacagccggttcctccaccagaaaaaaataaggaagacatacttttgttttttaaactctatgatcccgagaaagaagagcttcgatacatagggaggtttttcgtaaagaacaccggaaagcccattgagatcctagcaagaataaatgaaatggctggatttgctcctgatgaagagattgatctatttgaggaaataaaatttgagccaactgttatgtgtgaacgccttgataaaaaagcttcatttcgatttagtcagatcgaagatggggacattatttgcttccagaaacggcctttgcctgaacatgaagagaaaatccgtttccctgatgttccttcatttttggagtacgtaaaaaatcgccagattgtgcattttcgagctttggagaaacccaaggaagatgaattttgcctagaattagcaaagaatcacacatatgatgatgttgtggaaaaagttgcccagcgccttggcctagacgatccatcaaaaattcgtcttactcctcacaattgctattctcagcaaccgaagcccaatcccattaaatatagatcggttgatcatttgctagacatgcttgtccactataatcagatttctgatatactgtactacgaagtgctagacattcctcttccagaattgcagtgcttaaagacactgaaggtcgccttccatcacgccacgaaggaggaggctgtaattctcaatattagattgcctaaacaaagcaccgttggagatgttctcaatgagatcaaaacaaaggtggagttgtctcatccaaattctgagcttaggttgcttgaggttttctatcacaagatttacaagattttcccactccatgagaaaattgagaacataaatgaccagtactggactctgcgtgccgaggagattccagaagaagaaaagaatcttgggcccaatgatcgtttgattcatgtttaccatttcaacaaagagattgcccagaatcaactgcaggtccagaatttcggggaaccattcttcttggtcattcatgaaggcgacacattagcagatgttaaagtacgcattcaaaagaaattgctggtctcagatgaggagttctctaagtggaagtttgcatttttgtcattgggacggccagagtatctcgaggactcggacattgtctccagtcgtttccagagaagagatgtttacggtgcttgggagcagtacctggggttagagcattccgatactactcctaaaagagcatatgctgcaaaccagaaccgtcacacatttgagaagccagtgaagatatacaattgaagttgatcgctttttacgaaaatgcccactttgatgttggttggaaatgagaattaaggcaaaaaaaaaggaaaaaaagattgacattccctgttgttcttttacgaggctgtggtggttagtattatttatcctttcgactagtgttggaagggcagctcctctcttagacgtttgttgtttcccattgtcgatagctctttcgttcttctcattctcactttgctttgtagtgggcgtgcaaactattacgttgtcactttgtaatttatcacgcgtaacagattttggctgataggtttgtaaagtgggtatagtttaggtctctctaccataatgatttatgtcttcttccattttcttttcctttttgagtttcctaccccttgttttttttcgtttgtatttcgtgtattgcataaataggggacgtaactcgtgattgtaaaataatacgattatgttgttttttggatatcatatttataagctaccattattcagagcat

SEQ ID NO: 2441 - DNA, 3804 bp, Silene vulgaris
tgataatcagcctatggaagtggttgcttcagcggaacctgctaatactttggagactccacctgcggaggatcctccaacggcaaggtttacttggaaaattgagaatttcactcggttgaataccaagaagcattattccgcagttttcctcggtggtgaacataaatggcggatacttattttccctaaagggaacaatgtggactacttgtcaatgtatcttgatgttgcggattctgctagtttgccttacgggtggagtcggtatgcacagtttagcctggctgtagttaatcaagttcataacaagtattctgtgagaaaagatacccaacatcagttcaatgctagggaaagtgattggggctttacttcgttcatggctttaagtgagctgtatgaccccagtcgagggtatcttgtcaacgatactgttattattgaggccgaggttgttgttcgaaagattgtagactattggtcctatgactcaaagaaggaaactggatttgttggacttaagaatcaaggagcaacgtgctacatgaactctcttcttcaaacactttttcacattccctattttcgaaaggctgtataccatatgcctacaactgagattgatatgccatcagctagcattcctttggctcttcagagtttgttctacaagctgcaatatagtgacggcagtgttgcgacaaaagagttgaccaaatcttttggctgggatacttatgattctttcatgcagcatgatgtgcaggagctgaatagggttctttgtgaaaagcttgaagataaaatgaagggtaccgttgttgagggtaccatccaaaaactgtttgaaggtcatcacatgaactacatcgaatgtgtaaatgtagattacaaatctactaggaaggagtccttctatgatctacagctcgacgttaaaggatgccgtgacgtttatgcttcttttgataagtatgtggaagttgagaaactggacggtgataacaagtatcatgctgagcaatatggtttgcaggacgctaggaagggtgtcttgttcattgatttccccccggtgcttcaactgcagctcaaaagatttgaatatgattttatgcgtgacactatggtgaagatcaatgatcgctatgagtttcctctcgaacttgatcttgatcgtgaaaatggcaaatatttatctcctgatgctgatagaagtgtacgcaacttgtatactctccacagtgttttggtccatagtggtggggtgcatggtggacactattatgcttatatacggccaacactttcagaacagtggtataaatttgatgatgagcgagttacaaaagaagatatgaaaagagctttggatgaacagtttggtggtgaagaggagttaccacagacaaatcctggtttcaataacgctcccttcaaattcacaaaatattcaaatgcctatatgcttgtgtatatacgtgaaagtgacaaggacaagattctgtgtaatgtggacgagaaggacattgctgaacatcttagggagcgtttgaatagagaacaagatgaaaaggagtttaagaagaaagagaaggcagaggcacacctgtacactatcataaaggttgcacgtgatgacgatctcagtgagcagattggaaaggatatttatttcgaccttgttgatcatgataaagttaaatcttttcgtgtacagaagcagatgccatttaaccttttcaaggaagaggttgctaaagaatttggtatcccagtacaattacaaagattttggctgtgggcaaagcgccaaaatcacacttatcgaccgaatagacccttgactgcattggaggaagctcagactgttggacagctgagggaagtgtctaataaggctcagaatgcggaactaaagttactgttggaagtagagcttgactatgatttacggcccatcgcacctccagaaaagacaaaggatgaaattttactgttttttaagcattatgatcctgcgaaagaagagctacgttatgtgggaagactttttgtcaaggctaatggtaaaccaggagaaattttggggaaattgaaggaaatggctggctacgctgctgaggaggagattgagttatttgaggaaattaagtttgagccaactgtgatgtgtgaacatattgatctgaagcttacgtttcggggtagtcagcttgaagacggagatatagtttgtttccagaaaactctaccagctgaaactgcaggaagataccgctaccctggtgtcccctcatttttagattatgtgcagaatcgccaagtggttcacttcagatcactggagcgacccaaggaagatgacttttgcctggagttatcaagacatcatacatacgatgatgtagtggaaagagtgtctcgccaacttggcttggatgatccgtcgaaaattaggcttacttctcacaactgctactctcagcagccaaagccgcagcctattaaatataggggtgtggatcacttgacagacatgctggtccactacaatcagacttccgacatactctactatgaagttttggacataccattgcctgaattacaaggcttgaagacactcaaagttgcttttcatcatgcttcaaaagatgaagttgttattcatactagactaccaaaacacagtacagtaggagatgttcttaatgacctgaaaacaaaggttgaattatcacatcctgatgctgagctgagattgcttgaagtattctatcataagatctacaagatctttccaccaaatgaaaagattgagaatataaatgatcaatactggacattgcgagcagaagagattcccgaagaagagaagaacttgggccctcaagatcggctaattcatgtgtaccactttactaaggagaccgctcagaaccaaacgcaaatccaaaacttcggcgaaccctttttcttggtgattcatgaaggggaaaccttggctgatgttaagggtaggattcaaaagaaattgcaggtcccagatgaagaattttctaagtggaagtttgcatttttgtccttaggtcgtccagagtatctccaagacactgacatcgtgtccagtcgttttcagagaagagatgtatatggtgcatgggaacagtatcttggattggagcatccagatactaccccaaaaagaataaacacggcgaatcagaatcgccataactttgagaaacctgtaaaaatctacaactagcatgatttgggaaccggatttgtatgcttggaccttctctggttccctcgacggtggttttgacattcaatgttgattgcaacccccgtcaagttttcagatttccgttttctctaacggaatttcttcctatggctctacgcttgtatgtgtgttgccctttgaaactcacccagttgtaacttgtaagttaagaaaacacgagtacataaaatgagattttggttagggatgtatacagtatagtcggacctattctctttctttaggcatgtctagtctttagattatgagggttgtgcgagggtcttcccgtcgcttctgtgataatgtcggatgtcccctctttttttcgctttattattatttctcttgtgaaagaagcttgtcaggattgtagcttttatgagtaaacattttactatttacctgtgtaagagacgagtatgttgtaaacttgtaatgttctcttctttgaatattgtaaacgagtcattagtgatttcgaacaatgattcctatgttcaaat

SEQ ID NO: 2442 - DNA, 3978 bp, Solanum lycopersicum
acaattgatctctcaatttcactttcagttttcttctcaaatttacagcaaaattagctcaaaattctcttcaatttcttcatcgaatgaccataatgactcctgctcctaccgatgaagaggaggagatgcttgttccgcgttcagatttggtatttgaaggacctcagcctatggaagcacaagcagaaaccggcaatgatgtggaaaagcagccaccagaggatcctcaaacttcaaggtttacttggaagatagataacttctctaggttgaatgtaaagaaactatactctgacccttttgttgtcggtggctataaatggcggattttaatttttcccaaggggaacaatgttgattacctatccatgtatctggatgttgctgattcagctaatttaccttacgggtggagtagatatgcccagttcaacttgtcaattgttaaccaaattcataacaagtactccatcagaaaagagacacaacaccaattcaatgccagagaaagtgattggggtttcacatcctttatgccacttggtgaactatatgatccaaacaaaggttatcttgttgatgatacatgtgttgttgatgctgaggtagctgtgcgaaaaattgttgactattggtcgtatgactcaaaaatggaaactggctttgttggactgaagaaccaaggagctacctgttatatgaactcacttcttcaaactctctaccatattccttacttcaggaaggctgtataccacatgcctacaactgaaaatgatatgccctctgctagtatccctctagcgttgcaaagcttattctataagctccagtacagtgacaacagtgtagcaacaaaggagttgacaaaatcattcggatgggacacatatgattctttcttgcagcatgatgtgcaagaactcaatcgtgttctctgtgaaaagcttgaagaaaaaatgaagggtactgttgtggaaggcactatacagcagttattcgaagggcaccatatgaactatattgagtgcatcaatgtggactacaaatctacgagaaaggagtcattttatgatcttcagcttgatgtcaaagggtgtgctgatgtttatgcttcgtttgataaatatgttgaagttgaacgtcttgagggcgataacaagtaccatgccgaacaatatggtttgcaggatgctaagaagggtgtcttattcatggatttcccccctgtcctgcagcttcagttaaagcgctttgaatatgatttttcacgggacactatggtaaagataaatgacaggtatgagttccctctgcaactcgatctagatagagagaatggtaaatacttgtcgcctgaggcagatggaagtgtcagaaacctttacacacttcacagtgtattagtccacagtggtggtgtgcatggtgggcactattatgctttcataaggccaactctttcagatcaatggtataaatttgatgatgaacgtgtgactaaagaagatgtgaaaagagctctagaagagcagtatggaggagaagaagagttgccacaaacaaatcctggatttaataatactcccttcaaatttactaagtactcaaatgcttacatgctggtctatattcgggaatgtgacaaagagaaaataatgtgtaatgttgacgagaaggacattgctgagcaccttagggcaaggttaaagagagaacaagaagagaaagagcagaagaagaaggagaaagcagaggcacacctttacacaattataaaggtttctcgtgatgaagacctcagacagcagattgggaaggacatacattttgatttagtggattatgacaaagttaggagttttcgcattcagaagcagacactttttagcatttttaaggaggaagttgccaaagaatttggtgtaccagtgcaatctcaacgtttttggttatgggcaaagcgccagaatcatacatatcgtccaaatcggccattaacacatctcgaagaagctcaaactgttggacagttgagggaagcgtcaagtaaggttcagaatgcagagctaaaattgttcttggaagtggagcttggactggacttgagacacatccctccacctgacaagactaaagatgatattatgctattcttcaagatttatgatcctgagaaagaagagctgaggtatgctggaagactctttgtaaagggaacgagtaatccaactgaaatcttgaacaaactaaatgaaatggctggctatgcccctgatcaagagattgaactatatgaggaaataaaatttgaaccgattgtcttgtgtgaacccattaacaagaaatttgctttccgaacgaaccagcttgaggatggtgatatagtatgctatcagaaatccctttctcctgaaagtcgccagaagttacggtatccagatgttccttctttcctggagtatgttcaaaatcgccaggtggttcacttccgatacttagaaaagttgaaggaggatgatttctgtttagagctgtcaaagattaatacatatgatgaagttgtggaaagagtagctcagcgacttggcttggatgatccatccaaaataaggctcacaccccataattgttactctcagcaacctaaaccccagccgatcaagtacagaggtgttgacacccttggagatatgctggtccactacaatcagacatctgatattttgtactatgaagtactggacattcctttgccagaattgcaaggtttaaaaaccttaaaagtagcttttcatcatgctaccaaagatgaagtggtcacttacactatcagactaccaaaacaatctactgttggtgatgtaattaatgatttaaagacgaaggtagagttgtcaaatccagatgcagaattaagattgctagaggtcttctaccacaaaatttataagatatttccaacaagtgagaagatagagaacataaatgaccagtactggacattgagggccgaagagattcctgaagaagagaagaatctaggcccgaatgctcgtttgattcatgtgtatcacttcagtaaagaaactgcacaaaaccaaatgcaaattcagaattttggggaacctttcctcttggttatccatgagggtgagactttagttcaagtgaaggtgcgaatacagaagaaattgcaggtcccagatgaagagtttgctaagtggaaatttgcattcctctcacttggtcgtcctgagtaccttgaggactcggatatattgttcaaccgtttccagcgaaaggatgtttatggtgcttgggagcagtatcttggcttggaacattctgacaatgcccctaaaaggattaatgcagcatatcagaatcgcccgacgtacgagaagcctgttaaaatttacaactagtaacgccgctgaaaatgaagattgtgagatggttcaaatctatgattgaccattgcatttgtccctgaagttaagaagccagttcgagtctgtacagggttttatgatttttgttactgaagcatcttgtattctgatatggatgtgaagtttgatcctaatgcagcatccatatctcagtacttgaactcaagtgatgcgtaaatggcccatcgataactctctctctgttctagtgtaagttaagcgagccatacattggcaaagaattttgaacaaatgaatgaatacataatatattgtgcttgattcagttctgacttttatctgaggagaagagtactactcagttttctgccattttttgggctctatagatgtgattatttctggtagagattttgaggtttttccctctgaaattgtgtaaccttaagtttggtaatttcttgctattgtaattaaccagtaattaagaatgacaaattgtttgtcacaagtatctgttgagttttttgtttttgtttgtatctagagctgtatttga

SEQ ID NO: 2443 - DNA, 3743 bp, Silene vulgaris
ggaggatgaggagatgcttgttcctcattccgatgtcgttgtcgaaggacctcagccgatggaagtggcacaagcagatgctaacaatggtactgagaaccaggcgatagaggagccccctacgtcaaagttcacatggacgattgagcactttactcggataaacacgaagaagcactattcagaggctttcgttgtcggtggttacaaatggcggatattgatttttccgaagggaaataatgtagactacctatcaatgtaccttgatgttgcggattctcaagcactgccatatggctggagtagatatgctggctttagcctaacagtggtcaatcaacttcatcagaagtactcaataagaaaagagacacaacatcaattcaattcccgagagaatgattgggggtttacatcatttatgcctctaagtgagctgtatgatccgtctagaggttatttggctaatgacactgtagtgattgaagccgaggttgccgttcgtcgtgctatggattattggtcatacgactcgaagaaggagacaggttgtgtcggacttaagaatcaaggagcaacatgctacatgaattcacttctgcaaactctttaccatattccttactttagaaaggctgtgtatcatatgccaacaactgagaatgataaccccgctaacagcatcccattggccttgcaaagtttattctacaagctgcaatataatgatactagtgtctcaaccaaagggttgacgaaatcgtttggttgggactcatacgattccttcatgcaacatgacgtgcaagaactaaatagagttctctgtgagaagcttgaagacaaaatgaagggtactgttgtggagggaacaatacaaatgttgttcgaaggacatcacatgaactatattgaatgtgtcaatgtggactacaagtcaactaggaaggaatcctattatgatcttcagctagatgtcaaaggctgtaaggatgtgtacgcttcttttgacaagtatgtggaagttgaacgtcttgaaggtgataataaataccatgctgaggaacatggtttacaggacgctaagaaaggtgttctattccttgacttccctccagtccttcaacttcagctaaagaggtttgagtatgatttcatgcgcgacactatggtaaaggtcaatgatcgctatgagtttcctctccagctagatcttgatagagacgatggcaaatatttagcccctggtgcagataggagtgtccgaaacctttatacacttcacagtgtattggtgcatagtggaggcgttcacggtgggcattattatgcatatattaggccaaccctctcagaccagtggtttaagtttgatgatgagcgggtcacaaaagaggatattaaaagggcattagaagaacaatatggtggtgaggaagagcttccgcaaacaaacccggcgttcaataatactgctttcaagtttactaaatattcaaatgcttacatgcttgtgtacatacgagaaagcgacaaggacaaagtagtttgtgatgtcgatgagaaagacattgctgaacaccttaggacaagattgaaaaaggagcaagaagaaaaggaagaaaagaggaagtacaaagcacaggcgcacctttataccatcatcaaggttgcacgagatgatgatcttgcggaacagataggccgcgacatttattttgatcttgtggatcatgaaaaagtgcgaagtttccgcattcagaagcagatgccttttaatcttttcaaggaggaagtcgccaaagaatttggcatacccgttgaatttcaacgctattggatttgggctaaaaggcagaatcacacatatcgtccaaatcggcctctaagacccgctgaagaagctcaacctgttggccaattgagagaggcatccaaggccgggaacattgttcccgaattgaagttgtttttggatgtggagattggactggatcttcgcccacttcctccaccagataaaacaaaagatgatatcttgctctttttcaagctctatgatcctgagaaggaagagctccgatatgtgggaaggctgtttgttaaaagtgctggtaaaccagttgaaattttggctaagctgaatgaaatggcaggttttgctcccgaggaagaaattgatgtgtttgaggagataaagtttgaaccttgtgtcatgtgtgaacaccttgataagagacaatcattcaggcagtcccagctagaagatggtgacatcatctgtttccagaaagcgcttcctattgaccatgaggaacgataccggtatcctgatgtaccgtcattcttagagtatgtacacaatcgtcaggttgtgcacttccgatccctggagaaacctaaagaagacgatttctgcttagaattgtcaaaaataaacacttacgatgaagttgttgaaagagttgcgaagcaacttggtctggacgatccttcaaagattaggctcacttctcacaactgttactcccagcagccgaaaccgcagcctatcaaatatagaggagttgaccatttaactgacatgttggctcattaccagcagagctctgatatcttgtattatgaagttctagacattccgttgccagaactgcaagggctgaaaaacctgaaagtggcttttcatcatgcgacaaaagaggaggttgtaattcataatgttagattgccgaagcaaagtactgtaggagatgttattaatgagcttaagacaaaggtggaactgtcccgtcctgatgcggaactcagattacttgaagttttctatcataagatttacaagatattcccaccaaacgaaaagatagaaaatataaatgaccagtactggaccttgcgtgctgaagagatcccagaagaagagaagaatcttgaacctcatgatcgcttaattcatgtttaccattttaccaaagatgctgctcagaaccagatgcaagtgcaaaatttttggagatccctttttcttggtaattcatgaaggtgaaacactagctgaaatcaaagtaagaatacagaaaaagttgcgtgttcctgatgaagaattctccaagtggaaatgtgcatttttgtcattgggcaggcctgaatatttacaggatacagacattgtatccagccgtttccagaggagagatgtttatggtgcctgggaacagtaccttgggttggagcatactgacactactccaaaaagggcttatacggcaaatcagaaccggcacacatatgagaagccagtgaaaatttataactgatccattggattaccatctaagttggcataacattcagtgcctgttgattcatatgaatttcaaaaggagaaagtggtattggtgcttgaggagtaaaatgttggctaccatttggattacttatccgtttgtggaggactggatatcgggtactcttattattgcaaatagcaaatagacggtgttggagtttttcttttgatttctctgctggatgaagttaggtcttttctcgaagaggctgctgctattttaccattttgaatcccttgtaatgtagacgtatataagattttggataagggcttgtaaattgggtatagttcattgtttttcctttctattcacctatcggttggtcgttactatatctattggaacagtgagatggttgccttttatcctttattacattaattc

SEQ ID NO: 2444 - DNA, 3884 bp, Papaver somniferum
tccaacttcgagatttacatggacaattgagagtttttctaggttgaatgtaaagaaacactactctgatgtatttgttgtgggtggttttaaatggcgggtactgatttttcccaagggaaacaatgtcgaccaattgtcaatgtacctagatgttgcagattcacagaacttgccttatggatggagtagatatgctcaattcagtttggctgtggtgaatcaatcacagaataagtttactgttagaaaagacacgcaacatcagttcaatgcacgagagagtgattggggcttcacgtcctttatgcctttaagtgacctctacgatcctagcagaggatttcttgccaatgatacagtaatcattgaagccgaggttattgttcgtaaggttgtggattattggagttatgattcaaagaaagaaacaggctttgttggtcttaagaatcagggtgcaacatgttacatgaactctctactgcaaactctttatcatatcccttacttcagaaaggccgtataccatatgccaacaactgagaatgatatgccatctggaagcattcctctggctctgcagagcctattttacaagcttcaatacagtgacaacagtgttgcaactaaagagctgacaaaatcttttggatgggacacgtatgattctttcatgcagcatgatgtgcaagaactcaatagggttctttctgaaaagctcgaggataaaatgaaagggactgttgtagagggcactatccagcaattgtttgaaggacaccatatgaactatattgagtgcatcaatgtggactacaaatctacgagaaaggagtcattttatgaccttcagctcgatgttaaaggatgtcgagatgtctatgcttcttttgacaaatatgtggaagtggaacgtcttgaaggtgataacaagtatcatgctgagcaacatggattgcaggatgctaagaaaggtgtcctctttattgactttcctcctgttctccagcttcagctgaagcggtttgaatatgatttcatgagggacactatggtaaagattaatgaccgttatgagtttccattgcaacttgaccttgatagagagaatggcaagtatttatcgccagatgcagatagaggagttcgcaacctttacacacttcacagtgtcttggttcatagtggcggagtgcatggtggacattactacgcttttattcggccaaccctctctgatcagtggtttaaatttgatgatgagcgggttacgaaagaagatatgaagagagcacttgaagaacagtatggtggggaggaagagttgccaaatgcaggcttcaataacaccccgtttaagttcacaaaatattcaaatgcatacatgcttgtgtatatacgtgatagtgataaggataagattatttgcaatgtggatgagaaggacattgctgaacaccttagggtaagattaaagaaagaacaggaagaaaaggagcacaagaaaaaggaaaaagcagaggctcacctttatactattataaaggttgcgaggaatgaggatctcaaggaacagattggcagggatatttattttgatcttgtggatcatgataaagttcgcagctttcgcattcaaaagcagatgtcttttaatgttttcaaggaagaggtggccaaagagtttggtataccagtagaatgccagcgcttttggctgtgggcaaagcggcagaaccatacatatcgtccaaatcgaccactgacacatcaagaggaaactcagtcggttggacacctgagggaggtttcaaataaagctcacaacgcagagttgaagttattcttggaagtggaggttggactggatctacgtcctattcctccacctgagaaaacgaaagacgatattttgattttcttcaagctttatgactcagagaaagaagcactcaggtttgtagggaggttatttgtgaaaggcagtggcaagcccttggagatactgtctaagctaaatgaaatggctgggtttgctccaagtgaagaaattgaactttacgaggaaataaagttcgatcctagtgttatgtgtgaacatattgacaagaaactcactttccgaactagccagctcgaagatggtgatattatatgttttcagaaatctccttctactgaacctgaacaacggcatcgttatcctgatgtaccttcatttttggagtatgttcacaatcggcaggttgttcatttccgttcgttggagaaacctaaggaggatgatttctgtcttgagctgtcaaaaatattctcctatgatgaagtcgttgaaaaagttgcacaacaacttggtttggaggatccatccaaaatcaggctcacatcacacaactgttactctcagcaacctaaaccccaacctatcaagtataggggagttgaccgtttgtcagatatgttggttcactacaatcagacttccgatatattgtattatgaagtattggacattcctttaccagaattgcaaggcttaaaaactttgaaggttgcttttcatcatgcaacaaaggaagaagcagtaattcactgtattagattgccgaagcaaagcactgttggagatgtcattaatgacctgaaaacaaaggtcgaattgtcccatcccggtgcagagctcaggttgcttgaagtattctatcataagatctacaagattttcccacttaatgaaaagatcgaaaatattaatgatcaatactggacattacgtgcggaggagattccagaggaagagaaaaaccttgggcctaatgatcgcctgattcatgtttaccattttacgaaagatacaactcaaatgcaggtccaaaattttggcgaaccatttttcttgctcatccatgaaggagagactttagctgatgttaaaggtcgcatacaaaagaaactgcaggtgccagacgaggagttcgccaagtggagatttgcgtttttgtcgttgggaaggcctgactacctcgaggacagtgatgttgtatccagtcgttttcagaaaagggatatttatggagcttgggagcaatatttagggttagaacactcggatagtgctccaaaaagggcctatgcagccaaccagaaccgccatacatacgagaagcctgtaaaaatttacaattagagaaagagccgaggaacccccaccataatagcatctcctgagatactcggtagcatgagatttgtttgatgcgggtactgaaggaaagatataagtgaataccaacaacctcctaaaggggaaaaaaaggatggttaaagctagcagtatgatgatagtataggtcatttgttattggcgcttgttatgtcttccaatgagacggtgttgggggttgtggtatttgtcgattgtgttgggctttattataactcttctttgtcgatgcagttgtggttggtggagtttgaggactcggtacaggcattgtgtttcgtctatccatgatgacaacaaccccatcctgatcttgttttcttctctttttctcatgaaaaatcccgttgtcgtaggaacatgtagttgctccattttcttataaagcacccattcaaggctgattttcccaatggggttaaattcattaagtgtaatcttttctaagtgtgaaccatccttgctgggaaggaagaaaaacaagtgaaaaggcaagaaaatcagcctctgtcgacctctgttagttccatagatgagggtgtacatagggattaatataaaaaaaagaaagttcaaataccataacagttgcgggatgtaaattaaaattttcctattaatgcaacattgttgagtttccggaaaaaaaaaaaaaaaa

SEQ ID NO: 2445 - DNA, 3834 bp, Arabidopsis lyrata
caagttctctatttcttccctcacttgttcttcttcttcttcttctccctttccattgttctctgttcggcgctctcttctgcttctctcgatccgaccgtcaatcgctctcggagcaatgactatgatgactccgccgccgcttgatcagcaggaagacgaggagatgcttgttccgaatccggatttggtcgagggacctcagcctatggaagttgcccaaactgagcctgctgcttccgccgtggagaatccgccacccgaggatcctccaactctgaaattcacctggaccatcccaattttcactaggctcaataccaggaagcattactctgatgtatttgttgttggcggttataaatggcgtatattgatttttcccaaaggaaacaatgtcgaccatttgtcaatgtacttggatgttgctgacgccgcgaatttgccgtatgggtggagcagatattcacagttcagtctggctgtagtgaatcaagtcaacaaccgatattccatcagaaaggagacgcaacatcaattcaatgcaagagaaagcgattggggctttacatcattcatgcctctcagcgagctctatgatcccactcgaggatatttagtgaatgacactgttctgattgaagctgaagttgctgtgcgtaaagttcttgattactggtcatatgactcaaaaaaagagactggttttgttggactaaaaaaccaaggtgctacctgttacatgaattctctcctgcagactttataccacataccttacttcagaaaggctgtgtaccacatgccaacgactgaaaatgatgcacctactgctagtatcccattggcgctccagagtttgttttacaagcttcagtataatgataccagtgtagcgacaaaggagctgacaaagtcgtttggttgggatacatatgattctttcatgcaacatgatgtccaagaactcaaccgagttctttgtgaaaagcttgaggacaagatgaagggaactgttgtggagggaacaatacaaaagctatttgagggtcaccacatgaattacattgagtgcattaatgtagattacaaatctacacgaaaagaatcattctatgacctccagcttgatgtcaaaggctgcaaagatgtatatgcttcttttgacaagtatgttgaagttgaacgccttgaaggagacaacaaataccatgcagaaggacatgatttgcaggatgcaaaaaaaggtgttctattcatagactttccaccagttcttcaacttcagctcaagaggtttgaatacgattttatgagggacacaatggtgaagatcaatgatcggtatgagtttcctcttcaactggatctcgacagagagaatggaaaatatttatcccctgatgcagacaagagtgttcgcaatctctacaccctccacagtgtcttggttcacagtggaggagtgcatggagggcattattatgcttttattaggccaacactttcagatcagtggtataaatttgatgatgaacgggtaacgaaggaagatgtgaaaagggcactggaagagcaatatggtggtgaagaagagttaccgcagaataatcctggtttcaataatccacctttcaaattcacaaaatactcgaatgcatacatgcttgtttatattcgggaaagtgacaaggacaagataatctgcaacgttgatgagaaagacattgcggaacatttgcgggtgaggctgaaaaaagaacaagaagaaaaggaagataaaagaaaatacaaggctcaagctcaccttttcacgacaatcaaggtcgcaagagatgatgacatcactgagcaaattggaaagaatatatattttgatcttgttgatcatgaaaaagttcggagttttcgaatccagaaacagaccccctttcaacaatttaaggaagaggtagccaaagagtttggtgtcccggttcaactacagcggttctggatctgggcaaagcgtcaaaaccatacttatcgccccaatcgtcccctattacctaatgaagaattacagacggttggacaaataagagaggcatctaacaaggcaaacaatgctgaactaaagctgtttttggaaatagagcgtggaccggatgatcttcctattcctcccccagaaaaatcttctgaagatatccttcttttctttaaactctatgaccctgagaacgcagtactaagatatgttggcaggctaatggtgaaaagttccagtaagcccatggatatagtagggcaactgaataaaatggctggttttgctcctgatgaggaaatagacctttttgaggaaattaagtttgaaccttgtgtaatgtgtgaacaactggataagaagacttctttcaggctgtgtcaaattgaagatggagatatcatttgttatcagaaacctctatctatccaggagagtgaatgtcgctacccagatgtgccatcatttttggagtatgtacagaatcgagagctggtgcgttttcgtacactggaaaaaccaaaagaagacgaatttactatggagctgtcaaagcagcatacttatgatgatgttgtggaaagagtggctgagaagcttggccttgatgatccatcgaaacttagacttacatctcacaattgctactcccagcaacccaagcctcagccaatcaaataccgtggagtagatcatctttcagatatgttagttcactacaatcagacgtctgacattttgtattatgaagttctggatattcctcttccagaattgcaaggtcttaagactctaaaagtggctttccatagtgccacaaaggatgaagtgataatccacaatatcagactacctaagcagagtactgttggagatgttattaacgaactgaaaacaaaggtggagctttcgcatcaagatgcagaactgaggttacttgaggtctttttccataagatctacaagatctttccatctactgaaagaattgaaaacatcaatgaccagtactggactttacgagcagaagagatacctgacgaagagaagaatattggtcccaatgatcggttaattcacgtatatcattttactaaagaggccggacaaaatcagcaagtacaaaattttggggaacctttctttttggtaatccacgaaggtgaaactttagaagaaatcaagacccgtatccaaaagaaactccatgtccctgatgaggactttgccaagtggaagtttgcatctttttcattgggacgtcctgattacttgcaggacacagatgttgtttataatcgctttcagagaagagatgtatacggtgcgtgggagcagtatcttgggttggaacacattgacaatgctcctaaaagggcttatgctgcgaatcagaaccgacacgcatacgagaagccggtgaaaatatacaattaggagagagacattgctatgcatggaggaatcttaagggtggttttggtgcgagggtaggatgtagagagactcaatttagatttgataaccaaaatgaatatatatcttccagggaagggttttgattttggccctgacagtagtaagtgtggctggtctcttttgcttccaaaaactagtcctttggtgttaatatggtattgtctgagactctctctctctccccctttttctctgcaaaattcccattttgaagacaaaagccccgtttcttggatttgagagggcgttggcttttttggttctcaattaggattgtatttcgtcgaggtatagtttttatgttcaaaatattaaaagattctcta

SEQ ID NO: 2446 - DNA, 3992 bp, Solanum phureja
atactaaaattttcttttgttcgtcgccttgcccaaggactcgaactgaagagaaagtccttggatcgattcgatcgtttctacgttgcattcttcatcgccgatttgttgagtttccggtctaccgttttccggcaatgactctcatgactcctcctccagttgaacctgaagacgaggagatgcttgttcctaattcggattttcctgtggaaggtccgcagcctatggaagttgcgactgcggatacagctagtacagtggagggtccacaagtggatgatccgccatctggtaggtttgcgtggacgatagagaacttttcgaggttgaatgtgaagaagctatactcggaagttttcaatgtgggaggatataaatggaggatattgatattccctaaagggaacaatgcggaccaattgtcattgtatttggatgttgccgattcaccgtcattgccttatggatggagtagatatgctcattttagcttaggtgtgctcaaccaagctcataccaagtttacagtgagaaaagatactcagcaccagtttaatgcaagagagagtgactggggtttcacatccttcatgcctcttagtgaattatatgatcctagcagaggttttattatggatgatacagtcgtagttgaagctgatgtttctgttcgtaaggttgctgattactggtcccatgactctaagaaggagactggttgtgttggccttaagaatcagggagccacttgttatatgaactctctcctccaaacattgtatcatatttcttactttagaaaggctgtgtatcatatgccaacaactgagaatgacaatccatctgggagcatccctttggctttgcagagtctgttctataagctacagtacagtgacactagtgtagcaacaaaagagttgacgaagtcctttggatgggactcaaatgattctttcatgcagcatgatgtacaagaacttaacagggttctttgtgaaaaacttgaagataaaatgaagggaaccgttgtagagggaacaatacaacaactgttcgaggggcatcatatgaattatattgaatgtatcaatgtggattacagatcaacaagaaaagaatctttttatgacttgcagcttgacgtcaaagggtgtcgtgatgtctatgcttcttttgacaagtatgttgaagtagaacgccttgagggtgacaataaataccatgcagaaaaatatggtttacaggatgctcggaaaggtgtcctttttgttgacttcccccctgttcttcagcttcagttaaaacgttttgaatatgattttgcacgggatactatggtcaagataaatgacagatatgagtttcctttacaactcgaccttgatagagagaatggaaaatatttatctccagatgccgatcgaagcgttcggaatctctatactcttcatagtgttttggttcacagtggcggggtccatgggggacactattatgcttatatcagaccaacactctctgatcaatggtttaaatttgatgatgagcgtgtgacaaaagaagatccaaagagggctctggaagagcagtatggtggtgaggaggagttgcctcatgcaaaccctgcgttcaacaattcaccattcaaattcacaaaatattcaaatgcatatatgcttgtttatattcgtgaaagtgacaaagaaaagattatctgcaatgtggacgaaaaggacattgcggagcatctcagggtaaggctaaagaaagagcaagatgaaaaggagcaaaagagaaaggaaaaagcagaggctcacctttatactatcatcaaggttgctcgtgatgaggaccttggtgaacaaattgggaaggagatttattttgatcttttggatcatgacaaagtccgtagtttccgtatccaaaaacagatggtatttacgcaattcaaggaggaggttgctaaggtattgggtatacccgtgcaatttcagcggtattggctatgggcaaaacgacaaaatcacacatatcggcctaatcggccattgacacctcaagaggaagttcagtcggttggacaattgagagaggtctctaataaaacaactaacgcggagctaaaactttatttggaagttgaaattggcctggatttgcaaccttgtcctccacctgagaagaccaaagaagatattcttctatttttcaaactgtatgaccctctaaaagaggagataaggtatgttgggcggctctttgtaaaaggcagtggtaagccactggacataatgaccaagctaaatgagttggctggaatttcacctgatgaagagattgaactctttgaggaaataaaatttgaacccaatgtgatgtgtgaacctattgattgcaatctaacattttgtagcagtcagcttgaagatggggacattatttgctttcagaaacccgttcgaagtcaaactagtgaacaatatcgatttcctgatgttccttcatttttagagtatgtgcacaatcgccaggttgttcacttccgctcattggacaaacccaaggaggaggattttagtcttgagttgtcaaagctgaacaactatgatgaagtagtagagagtttggctcgccatctccgcttggatgacccatcaaaaataaggcttacatcacataactgctactcacagcagccaaaacctcagccaataaagtatcgaggagtggaccgtcttacagaaatgctggttcactataatcagacttcagacattttgtattatgaagtcctcgatattccattaccagagctacagtgcttaaaaactctcaaagtcgccttttataatgctgcaaaatatgaagtgacaatccatactattagattgccaaaacaaagtactgtagatgatgtccttaatcatcttaagacaaaggttgagttgtcacgtccagatgctgaactgaggttgctggaagttttctatcacaagatatataagatttttccacctactgaaaggattgagaacataaatgatcagtactggaccttgcgtgcagaagagatccctgaagaggagaaaaacctgggtcctcttgatcgcttgattcatgtttaccattttacaaaggacacaactcaaaatcaagcacatgtacaaaactttggcgagccattttttctggttattcatgagggtgagacactggctgaagttaaagcgcgcattcagagaaaattgcaggttccagatgaggagttttcaaagtggatgtttgcgtttgtgtccatgggccgtcctgactacctccgggattcagatattgtatccattcgttttcagaggagagatgtttatggtgcttgggagcagtatctgggattagagcatgctgacaatggtcctaaaaggtcatatgcttccaaccagaatcgacccgcttttgacaagcctgttcggatctacaactagtcttctaaatgactgatcaatacctttgatggagcatgtaaaatcccgcgaagaagcagcactaggatcatcagaagatggcagctaacagttaatgcagtgatgtctcggtggtaatttaacttttgtcctccaaacgtgggcaagcaacaccatattttatttaagcagttttaggtggctgaaaacgttgattccattgtaattttaggcaacgcacatgattttgggtggacgtatatagagggtatagatgtttattttgacatttcctgttcctcacttttggcattctcagttctctcataattatattgtctggaaaactaatgatgtagaagaacagaaggctgggatttcccatagtgacattgttgtagaacagttgaaagggatatatcacagttttttagtgtctttgtttgcaaaatgtcccgactcgtaataattgaatttatctttttctatttaaatttgaatgaaatagagttagcggtttttttt

SEQ ID NO: 2447 - DNA, 4062 bp, Eutrema halophilum
atggagatcatgataataattaaaaaacaagcttattacactttgaagcagagtagaagcccaaaaggttcaccaaaggcctcccataccgtcacggtcgcggtgacggttaagccacgtggagagtattcatttgcgagaaagagtaagaaaatagcgattgatctcctctgcaagttctctctatttcttccctcacttcttcttcacccttcgatttttttttttcctctgttcggctctctctttcacttctcgatccgaccgtcaatcgctatcagagaaatgactatgatgactccgccgccgctggaccagcaagaggacgaggagatgctcgttccgcattctgatttggtcgagggacctcagcccatggaagttgcccaagccgagcctgctgctacttctgtggagaatccaccagccgaggagcctcccactctgaaattcacgtggactatcccaggcttcaccaggctgaacaccaggaagcattactctgatatctttgttgttggaggttataaatggcgaatattgatttttcccaaaggtaacaatgtcgaccatttgtctatgtacttggatgttgctgacgctgcgaatttgccatacgggtggagcagatattcacaattcagcctggctgtagtgaatcaaatcaacagcagatattccatcagaaaagagacccaacatcaattcaatgcaagagaaagtgattggggatttacatcattcatgccccttagtgagctctatgatcctactcgtggatatttagtgaatgatactgttctgattgaagctgaagttgctgtgcggaaggttcttgattactggtcatatgactcaaaaaaagagactggttttgttggacttaagaaccaaggtgctacctgctatatgaattctctcctgcagacgttataccacataccttacttcagaaaggctgtttaccacatgccaacgactgagaatgatgcacctacggctagtatcccactggcgctccagagtttgttttacaagcttcagtataatgacaccagtgtagcgacaaaggagctgacaaagtcgtttggttgggatacatatgattcgttcatgcaacatgatgttcaagaactcaaccgagttctctgtgaaaagcttgaggataaaatgaagggaactgttgttgagggaacaatacagaagctatttgagggccaccacatgaattacattgagtgcattaatgtagattacaaatctacacggaaagaatcgttctatgatctccagcttgatgtgaaaggctgcaaagatgtatatgcttcttttgacaagtatgttgaagttgaacgccttgaaggagacaacaaataccatgcagaaggacatgatttgcaggatgcgaaaaaaggtgttctatttatagactttccacccgtacttcaacttcagctcaagaggtttgaatatgattttatgcgagacacaatggtgaagataaatgatcgatatgagtttcctcttcaactggatctcgacagagagaatggaaaatatttatcccctgatgctgacaagagtgtccgtaatctctacacactccacagtgtcttagttcacagtggaggagtgcatgggggccactattatgcttttattaggccaacactttcagaccagtggtataaatttgatgatgaacgcgtaacgaaggaagatgtgaaaagggcattggaagagcagtatggtggtgaagaagagttaccgcagaataatcctggtttcaataatccacctttcaaattcacaaaatactcgaacgcatacatgcttgtttatatccgggaaagcgacaaggataaaataatctgcaacgttgatgaaaaagatattgcagaacatctaagggtgaggctaaaaaaagaacaagaagaaaaggaagataaaagaaaatataaggctcaagctcaccttttcacaacaatcaaggttgcaagagatgaagacatcagtgagcaaattggaaagaatatatattttgatcttgttgatcatgaaaaagttcggagctttcgaatccagaaacagaccccctttcaacaatttaaggaagaggtggccaaagaatttggtgttccggttcaactacagcggttctggatttgggcaaagcggcaaaaccatacttatcgtcccaaccgccccttattacctcatgaagaactacagacggttggacaaataagggaggcatctaacaaggcaaacaatgctgaactaaagctgtttttggaaatagagcgtggaccggatgagcgtcctattccttccccagaaaaatcgtctgaagatattctccttttctttaagctctatgaccctgagaatgcagtaataagatatgttggcagactcatggtgaaaagttccagtaagcccatggatatagtaggccaactgaatcaaatggctggcttcgctcctgatgaggaaatcgaactttttgaggaaataaagtttgaaccttgtgtgatgtgcgaacatctggataagaacactactttcagacaatgtcaaattgaagatggagatatcatttgctatcagaaacctcttcctaaccaggagagtgaatgtccatacccggatgtgccatcatttttggagtatgtacagaatcgagaggtggtgcgttttcgtactctggaaagaccaaaagatgatgagtttacaatggagttgtcaaagctgcacacttatgatgatgttgtggaaagattggctgagaagcttcgccttgatgatccatcgaaaattagactcacttctcacaattgctattcccagcaacccaaacctcagcctatcaaataccgtggagtagaccgtctttcagatatgttagctcactataatcagacgtctgacattttgtattatgaagttctggacattccgcttccagaattgcaaggtcttaaaactcttaaagtagctttccatcatgccacaaaggatgaagtggtaatccacaatatccgactgcctaagcagagtactgtcggagatgttattaacgaacttaaaacaaaggttgagctttcgcatcaagacgcagaactgaggttgcttgaggtgtttttccacaagatctacaagatctttccatctactgaaagaattgagaatatcaatgaccagtactggactttacgtgcagaagaggtacctgaggaagagaagaatattggtcccaatgatcggttgatccacgtgtaccattttactaaagagtccggacaaaatcagcaagtacaaaatttcggcgagcccttctttttggtaatccacgaaggtgaaactttagaagaaatcaagacccgtatccaaaagaaactccatgtccctgatgaagactttgccaagtggaagtttgcttctttttcaatggggcgacccgactacttgcaggacacagatgtcgtttataatcgctttcagagaagagatgtatatggtgcgtgggagcagtatcttgggttggagcacattgataatgctcctaaaagggcttatgctgcaaatcagaaccgacacacatttgagaagccggtgaaaatatacaactaggagagtgaaagagagagagaaagagagagagacgtggctatccatggaggagtctaaggatggttttggtgtgagggtaggatgtagagagtctcaatcttagatttgatggtaaccaaaatggaaaaatatcttccagggaaagggttttgattttggccctgacggtagtaagtgtggtcacttttgcttccaaactactcttcttttggtgttaatatgggtattgtctgagactctcttctctctctgcaaaattctcattttgaagacaaagtcccggtcttggattttggagggcgttggcttttttggttcctcatttaggattgtattttcaggtacagtttttcatgttcaaaaattttagttttatactattgactctattacttcttctcttgcataatgaaattatttttccaagcc

SEQ ID NO: 2448 - DNA, 4176 bp, Populus trichocarpa
agtgcttttgcgagtgtctcttctggctacacagaaaaatcccgctttcgcttctcttctcttattctcagtccctgctctcgttttcattcttgtccctctgattcgctcgatcgaacggtccatatccacccatgactatgatgactccttcaccgttagaccaagaagacgaggagatgctcgtaccgcattcagatttagttgaaggtcctcagccaatggaagtggcacaagtggagcaaactagtaccgtggagaatcagcctgtggaggatcctccatcgatgaaatttacttggactattgagaattttactaggttgaacacgaagaagcattattctgatatatttattgttggcagttacaaatggagagtactgatattccctaaaggaaacaacgtggaccacctgtcgatgtatttggatgttgcagattcgacagctttgccatatggatggagtagatatgcgcaattcagtttggctgtggtcaatcaaattcataacaaatactcgattagaaaggacacacaacatcagttcaatgcaagagagagtgactggggctttacatctttcatgcctctgagtgaactttatgatcctagcagaggatacttagtgaatgatacagttgttattgaagctgaagttgctgtttgcaaggttttagattattggtcctatgactcaaagaaggagacgggctatgtaggactgaaaaaccaaggagcaacatgttacatgaactctctcctacagactctataccatatttcctacttccgaaaggcggtgtaccacatgccaacaactgagaatgacatgcctacaggaagcattccattggccctgcagagtttattctttaagcttcaatataatgataccagtgttgcaacaaaggaactgaccaaatcttttggctgggatacgtatgattccttcatgcaacatgacgtgcaagagcttaacagggtcctgtgtgagaagctagaggataaaatgaaggggactgttgtggagggcactatacagcagttgtttgagggtcaccatatgaactacattgagtgcatcaatgtggaatacaaatctacaagaaaggagtcattttatgatcttcagcttgatgtgaaaggttgtcgagatgtttatgcttcttttgacaaatatgtggaagttgaacgacttgagggtgataacaaatatcatgccgaagaacatggtttgcaggatgcaaagaagggtgtcttatttatcgacttcccgcctgttcttcaactccaattaaagcggtttgaatatgattttatgcgcgatactatggtgaagattaatgatcgctatgaatttcctcttcaacttgacctggacagggagaatgggaaatatttatcacctgaatctgacaggagtgtgcgaaatctatacacacttcacagtgttttggttcacagtggaggtgtgcatggtggacattattatgcttttatcaggcctaccctctctgatcaatggttcaaatttgatgatgaacgcgtgacaaaggaagatgtgaagagggccttagaagaacagtatggtggtgaggaagagctacctcagaccaatcctggctttaacaatactccatttaaattcacaaaatactcaaatgcatacatgcttgtgtatatacgggaaagtgacaaggacaagataatttgtaatgttgatgagaaagacattgctgaacacttgaggataaggctgaagaaagaacaagaagaaaaggaagacaagagaagatataaagcacaagctcacctttacacaattataaaggttgcgcgagatgaggaccttaaagagcaaattggaaaggatatttattttgaccttgtggatcatgacaaagtccgtaacttccgtattcagaaacagacgcagtttagtctgtttaaggaggaggttgctaaagagcttggtataccagtacaatttcagagattttggatatgggcaaagcgccaaaaccacacatatagacccaatcggccattgactccccaggaggaagcacaatcagttggacaactgagagaggtgtcaaataagacacataatgctgaattaaagttgttcttggaagttgagcttgggctggatttacgtcccattgctccacctgaaaaaactaaagaagatattctgcttttcgtcaagctttatgaccctgaaaaacaagaattacgatatgttggtaggctttttgtgaagaattctagtaaaccgatagaaattctagcaaagcttaatcaaatggctggctttgcatctgaggaagagattgaactttatgaggaaatcaagtttgagccttgtgtcatgtgtgaacaccttgataagagagcctcatttcgaacaagtcagattgaagatggggacataatatgctttcagaaatctcctcctgaaaatgaagaagactgtcgaaatccagatgtgccttcatatttggaatatgtgcacaatcggcagatagttcatttccgatctctagagaaggcaaaagaggatgatttttgtctagagttgtcaaaattacacacttatgatgatgttgtcgaaagagtagctcgccagattggtttggacgatccatccaaaatcaggttaacatcccacaactgctactctcagcagcctaagccacagccaattaaatatcgaggagtggagcatctatcagatatgttagttcactacaatcagacttccgatatcttgtattatgaagttctagatattcctcttccagagttgcaaggtctaaaaaatttgaaagttgctttccatcacgctaccaaagatgaagtggtaattcataacattagattgcctaaacaaagcaccgtgggggatgtaattaatgaacttaaaactaaggtagaattgtctcacccaaatgctgaacttcgactgcttgaagtattttatcacaagatttataagatctttccacccaatgaaaaaattgagaatataaatgaccagtattggacgctgcgggcagaggaggcaagccaacaaacagaaagtttactttcagttgattaacaatcctggacactccttcagaaatgagataatgttttgacaccccattctcgctctctcactctctctctccctcgctctcaaattctgcagattcccgaggaagaaaaaaatcttggtccccaagatcgcctgattcacgtttatcacttcacgaaagagtctggacagaatcaaatgcaagtacagaattttggtgaaccctttttcttggccatccatgaaggtgaaaccttagccgaagttaaaatgcgtatacaaaagaagctgcaggttcctgatgaggagtttgctaagtggaaatttgcatttctgtcactgggtcgtccagagtacttgcaggattctgatgttgtgttcacccgctttcagagaagagatgtatatggtgcttgggagcagtaccttgggttggagcactccgataatactcctaaaaggtcttatgcagtaaatcagaaccgtcacacatttgagaagcctgttaaaatatacaattagggaagagcagattacactccaccggcacgtaaagctgagtcggacatctttcatgctacaatgtaggggatgagaatggatggtacatctgaaggaagaagacaatgaagcgcgaattaaagtgatttctgtaggatttgataattggttttgtaggccatatttgtttctctgatgtgatgggggggaggtggaaggaggccccccatatgtagtgtgttattatggttgagacacaccctgcttgagctcctggtcctttcttgcctttctcctaatgcagacacctccttgtttcaagaggttggtgtgatattcccacgatatacagctccagggtaatttagcagcagtacataagaagattttgactaggggattgtataccggggtataggtggctgcgtttgacattgattctttgtttttccctgtcttgggggatgggcttgtaaaatgattggcttacggttccgagcttagatagtgtagtggtggttcagggtggttttatagcaccaccttcatcacctaatatagtggtggtggttctcatttgtttcca

SEQ ID NO: 2449 - DNA, 3893 bp, Arabidopsis thaliana
tatcctatcgaaaagtgagaaagagtaagcagagaaataagcgattgatctctccttctgcaagttctctatttcttccctcacttcttcttcttcttctcccctttcattgttctctctgttcggcgctctcttctacttctctcgatccgaccgtgaatcactatcggagcaatgactatgatgactccgccgccgctagatcagcaggaagacgaggagatgcttgttccgaatccggatttggtcgagggacctcagcctatggaagttgcccaaactgatcctgctgctaccgctgtggagaatccaccacccgaggatcctccaagtctgaaattcacgtggaccatcccaatgttcactaggctcaataccaggaagcattactctgacgtatttgttgtaggcggttataagtggcgtatattgatttttcccaaaggaaacaatgtcgaccatttgtcaatgtacttggatgttgctgatgctgcgaatttgccgtacgggtggagcagatattcacagttcagtctggctgtagtgaatcaagtcaacaaccgatattccatcagaaaggagacgcaacatcaattcaatgcaagagaaagcgactgggggtttacatcattcatgcctctcagcgagctctatgaacccactcgaggatatttagtgaatgacactgttctgattgaagctgaagttgctgtgcgtaaagttcttgattattggtcatatgactcaaaaaaagagacaggttttgttggactaaaaaaccaaggtgctacctgttacatgaattctctcctgcagactttataccacataccttactttagaaaggctgtttaccacatgccaacgactgaaaatgatgcacctaccgctagtatcccattggcgctccagagtttattttacaagcttcagtataatgataccagtgtagcgacaaaggagctgacaaagtcgtttggttgggatacatatgattcttttatgcaacatgatgtacaagaactcaacagagttctctgtgaaaagcttgaggacaagatgaagggaactgttgtggagggaacaatacaaaagctatttgaaggtcaccacatgaattacattgagtgcattaatgtagattacaaatctacacggaaagagtcattttatgacctccagcttgatgttaaaggctgcaaagatgtatatgcttcttttgacaagtatgttgaagttgaacgccttgaaggagacaacaaataccatgcagaaggacatgatttgcaggatgcaaaaaaaggtgttctattcatagactttccaccagttcttcaacttcagctcaagaggtttgaatacgattttatgagggacacaatggtgaagattaatgatcggtatgagtttcctctccaactggatctcgacagagaagatggaagatatttatcccctgatgcagacaagagtgtccgcaatctctacaccctccacagtgtcttggttcacagtggaggagtgcatggagggcattattatgcttttattaggccaacactttcagatcagtggtataaatttgacgatgaacgggtcacgaaagaagatgtcaaaagagcactggaagagcaatatggtggtgaagaagagttaccgcagaataatcctggtttcaataatccacctttcaaattcacaaaatactcgaatgcatacatgcttgtttatattcgggaaagtgacaaggataagataatctgcaacgttgatgagaaagacattgcggaacatttgcgggtgaggctgaaaaaagaacaagaagaaaaggaagataaaagaaaatacaaggctcaagctcaccttttcacgacaatcaaggtcgcaagagatgatgacatcactgagcaaattggaaagaatatatattttgatcttgttgatcatgaaaaagtgaggagttttcgaatccagaaacagaccccctttcaacaatttaaggaagaggtagccaaagagtttggtgtcccggttcaactacagcggttctggatctgggcaaagcgtcaaaaccatacttaccgccccaatcgtcccctatcacctaatgaagaattacagacggttggacaaatacgagaggcatctaacaaggcaaacaatgctgagctaaagctgtttttggaaatagagcgtggaccggatgaccttcctattcctcccccagaaaaaacttctgaggatatccttcttttctttaaactctatgaccctgagaacgcagtactaagatatgttggcaggctaatggtgaaaagttccagtaagcccatggatatagtagggcaattgaataaaatggctggttttgctcctgatgaggaaatagaactttttgaggaaataaagtttgaaccttgcgtaatgtgtgaacagattgataagaagacttctttcaggctgtgtcaaattgaagatggagatatcatttgttatcagaaacctctttctatcgaggagagtgaatttcgatacccagatgtgccatcatttttggagtatgtacagaatcgagagctggtgcgttttcgcacactggaaaaaccaaaagaggatgagtttactatggagctgtcaaagctgcacacttatgatgatgtagtggaaagggtggctgagaagcttggccttgacgatccatcaaaacttaggcttacatctcacaattgctactctcagcaacccaagcctcagccaatcaaataccgtggagtagatcatctttcagatatgttagttcactataatcagacgtctgacatattgtattatgaagttttggatattcctcttccagaattgcaaggtcttaagactctaaaagtagctttccatagtgccacaaaggatgaagtgataatccacaatatcagactacctaagcagagtactgttggagatgttattaacgaactgaaaacaaaggtggagctttcgcatcaagatgcagaactgaggttacttgaggtctttttccacaagatctacaagatctttccatctactgaacgaattgaaaacatcaatgaccagtactggactttacgagcagaggagatacctgaagaagagaagaatattggtcccaatgataggttaattcacgtatatcattttactaaagaggccggacaaaatcagcaagttcaaaattttggggaacccttctttttggtaatccacgaaggtgaaactttagaagaaatcaagacccgtatccaaaagaaactccatgtccctgatgaggactttgccaagtggaagtttgcatcgttttcaatgggacgtcctgattacttgctggacacagatgttgtttataatcgctttcagagaagagatgtatacggtgcgtgggagcagtatcttgggttggagcacattgataatgctcctaaaagggcttatgctgcaaatcagaaccgacacgcatacgagaagccggtgaaaatatacaattaggagagagacatggctatgcatgtaggaatcaagggtggtggttttggtgcgagggtaggatgtagagagactcaattttagatttgataactaaaatggatatatatcttttccaggtaagggttttgattttggccctgacagtagtaagtgtggttggtctcttttgcttccaaaaactcgttctttggtgttaatatggtattgtctgagactctctccctctccccctttttctctgcaaacttttcattttgaagacaaaagccccgttcttggatttgagaggtcgttggcttttttggttctcaattaggattgtatttcgtcgaggtatagtttttatgttcaatatattaaaatattctcta

SEQ ID NO: 2450 - DNA, 3786 bp, Ambrosia trifida
ataataatcatccctctccataccaccgttgatcgtacggccatcatcaccgttaccatgactctcgtcactcctcaaccgttagatcaagaagaagacgaggagatgcttgtgccgcactcggaggtactcgaagggcctcgaccggtgcaaggtcctgttgctttcgatggtactccgcctgttgaagcgcctcagccgatggaagttgtgggtcaaccagaaggtgctagcacagtagataatcaagcgattgaggaacctcaggtgtctaggtttacgtgggctattgagaatttctctcgtctgactaacaaaaagctctattctgacgtctttgtagttggtggatataaatggcgggtgcttatatttccaaagggaaacaatgtggaccatttgtccatgtatttagatgtagctgattcctcatcattgccatatggttggagtagatatgcacaattcagcttggctattgttaatcaaattcacagcaagttcactgtaaagaaagacacacagcaccagtttcatgcaagggagagtgactgggggttcacatctttcatgcctctaagtgaactatatgacccaggtagagggtatcttctaaatgatacttgcattattgaagctgacgtggctgtgagaaaagtgatcgactattggacatatgactcaaagaaggaaaccggttatgttggtcttaagaaccaaggagcaacatgttacatgaactctctccttcaaaccttgtaccatatcccttactttagaaaggctgtctaccatatgccaacaacagaaaatgatatgccctcagggagcattcctctggctcttcagagcttattctataagctccaatacaatgaaaccagtgttgccacaaaagaactgacaaaatcttttggatgggacacatatgactctttcttgcagcatgatgtgcaagagcttaatagggtcttgtgtgagaagcttgaagacaagatgaagggaacagttgtggaagggacaatacagaagttatttgaaggacatcatatgaactacattgagtgtgtcaatgtggacttcaaatccacgagaaaagaatcattttatgatcttcaacttgatgtgaaaggatgtcgggatgtttatgcttcttttgacaaatatgttgaagtggaacggcttgagggtgacaataagtaccatgctgaagcacatgggttacaggatgctaagaagggtgtgttgtttattgatttccctcctgttcttcaacttcagctaaagcgtttcgaatacgatttcacgagggatatgatggtaaagataaatgatcggtatgaatttccactagagcttgaccttgacagggagaacggcaaatatttatctcctgatgcggataagagtgtccggaatctttatacacttcacagtgtattggttcatagtggcggtgtgcatggtggacattattatgcatttatcaggccaactctgtcagacaactggttcaagtttgatgatgaaagagttactaaagaagatattaagagagcgttagaagagcagtatggtggtgaggaagagctaccccaaacaaatcctggctacaataacgctccgtttaaatttacaaaatactcaaatgcgtacatgcttgtttacatacgggaaagcgataaagataagattatttgtgacgtcgatgagaaggacattgcagaacatcttaggataaggttgaagaaagaacaagaggagaaggaaaacaagagaaaatataaagcacaggctcatctctatactattatcaaggttgctcgtgatacagaccttttagaacagattgggaaggatacattttttgatcttgttgatcacgacaaagttcatagctttcgtatacagaaacaaacgccgttcaaccaattcaaggatgaggttgctaaagaattcggtgtgcctgttcaatttcaacggttctggatatgggcaaagaggcagaaccacacataccgtcccaatcggcctttaacagctttggaggaaactcaatcggttgggcaattgagggaagtttccagtaagaatcagaatgctgaacttaaattgttcttagagatcgagattggaccggacttgcatcctattccaccacctgacaaaagcaaagaagatatacttctcttcttcaagctttatgatcctgagaaggaagaactacgatacgttggtagattttttgtcaagagttctggtaaaccaactgagattatcacaaaattaaatgagagagctggatttagtctagatgaagaaattgaactctatgaggaaataaaatttgagccatgtgtcatgtgtgaacgccttgacaaaagaacctcatttagatctagccagatcgaagacggagacattatatgctttcagaaactccctaaagctgaggataaataccgatatcctgacgtcccgtcatttctagaatatgtgaaaatcgtcagatagttcattttcggtctcttgatagacctaaggaagatgatttctgtcttgaactgtcaaaattgcatacctatgatgatgtggtggagagagttgctcagaaacttaatctggatgacccggcaaaattagacttactcctcacaactgttattctcaacaacccaaaccccagcccatcaagtaccgtgttgcagaacacctgctagatatgctggttcactacaatcaggtttccgatattctatattatgaagtgttagacatccctctgcctaaattacagtgtctgaaaactttgaaagttgctttccaccatgtaaacaaggaagagcccgaaatacacaatattaggttgcctaaacagagcactgttggagatgttcttaatgaaataaagtcaaaggttacattatctcatccagatgctgaacttagacttcttgaagtattttatcacaagatttacaagatctttcctcttaatgagaagattgagaatataaatgatcaatactggacattacgcgccgaggaaattccagaagaagagaagaacctcgggccccaggatcgcttgattcatgtttaccatttcacaaaagaggctgcacagaaccagatgcaagttcagaactttggggagccgttctttctgataattcatgaaaatgaaactttagcagatgttaaagtccgaattcaaaagaaattacaagttccagatgaggagttttctaagtggaagtttgcctttttatctttggggcggcccgagtatctacaagattcagatgttgtatccaaccgttttcagagaagagatgtgtatggtgcttgggagcaataccttgggttggagcattcagacaccacccctaaaagatcatttacagctaatcagaaccgtcacgcgtatgagaagccagtgaaaatatacaactagaacaaaagtgagtgtaaagtatttaataactacgcggcaatgtttttcgtttgtccaaagaacattttatgttgaccgaagtggggggtttagtgttgatagaaaaatgttgttatctaatgtgtaatttagcagtaaaggtacatagtaaggaggaagattttgttaaaaagtgtacaagcagcagcaactattgttataaggtgtgtgtctaaattagtcattcgttttctttgggatgtgcaaaatggttggagatattagttgtgtaaaaagttgcattcttagtgctctcttgacaaggtatagttcatcttttcaaaaaagaa

SEQ ID NO: 2451 - DNA, 4119 bp, Solanum lycopersicum
cacccccccatctgaactcatttcttcatataccccccacccccacccaccccaccctaccccctactcacctcgcccacatcgccggtgattagttgatcggacggtgactctttatcctcaaacatgaccatgctgaatcctcaaccgctggatcagcaggaagacgaggagatgcttgtgccacattctgaattagttgaaggtcctcagcctttagttgaagggcctcagccaatggaagtggcagcttctgagaatgctactactggggagaaccaagccgtggacgagcctcaggcttcccggtttacatggacaattgatgaattctctcggttatctgtgaagaagctatattctgagccttttgttgttggtagttataaatggagagtgcttatatttccaaaaggaaacaacgtggagtgtttgtcaatgtatttagatgtggcagattcagctacattgccatatgggtggaacagatatgcacagttcagcttaacagttgtaaatcagataaaccccaaatattcagtgaaaaaagagacgcagcaccagtttaaccaaagagagagtgattggggcttcacatcattcatgcttctaagtgatctttatgatcccaataagggatatcttgtaaatgataaagttgttattgaagctgatgttgctgtaaggaaggtcattgattactggacatatgactcgaagaaagagacgggatatgttgggcttaagaatcagggagctacttgttacatgaactctctccttcaaaccttgtaccatatcccctactttagaaaggctgtgtatcatatgccaaccacagagaatgacatgccatcagggagcattccattggctctgcaaagtttattttataagctccaatatagtgataccagtgtggcgactaaagaattgacaaaatctttcggatgggacacttatgattcattcatgcagcatgacgtgcaggaactaaacagagtgttgtgtgaaaagcttgaagacaagatgaagggtacggttgtggaagggacaattcagaagttatttgaggggcaccatatgaattacatagaatgtattaatgtggacttcaaatcaacgagaaaagagtcattttatgatcttcagctcgatgttaaaggctgccgcgatgtttatgcttcttttgacaaatatgttgaagtcgaacgtctagaaggcgataataagtaccatgctgaagcacatggtttgcaggatgcaaaaaagggtgtactatttattgacttccctccagttcttcagcttcagttaaagaggttcgaatatgatttcatgcgtgatactatggtaaagataaatgaccgttatgaatttcctctagagcttgaccttgatagggagaacggaaaatatttgtctcctgatgcagataggagtgtacggaatctctatacacttcatagtgtgttggttcatagcggcggtgtgcatggtggacattattatgctttcatcaggccaacactgtcagatcaatggtataagtttgatgatgaacgggtgacaaaagaagacaataagagggctctagaggaacaatatggtggagaagaggagttgccacagacaaatcccggcttcaataacactcccttcaagtttactaaatattccaatgcttacatgcttgtttatatacgtgagagtgacaaggataaaataatctgtgatgttggtgagaaggacatcgcggaacacttaaggataaggttgaagaaagaacaagaagaaaaggaggacaagagacgatacaaagcacaggcccacctgtatacaatcatcaaggttgcacgggatgaggatcttagagaacagattggtaaggagatatattttgatcttgttgatcatgacaaagttcgtagctttcgaatccagaaacagctgccatttaaccttttcaaggaggaggttgcaaaagaattgggtataccagttcaattccagcgtttctggatttgggcaaagcggcaaaatcacacttaccggcccaatcgcccattaactccgcatgaggaactacaaacagtttgtcagttaagggaagtttctaacaagaacaacaacgctgagttaaaattatttttggaagtggactatggcctggatttcattcctggtcctccacctgacaaaagcaaggatgatatactccttttctttaagctttatgatcctgagaaagaagagctccgttatgttggtaggcttttcgtgaagagtactagtaagccagttgagatacttccaaaacttaatgaattggctggatttgctcctgaccaagaaattgaactttttgaggaaataaagtttgaaccttctgtcatgtgtgaaagactagacagaaaggcttcatttcgatttagccagattgaagatggggatattatatgctttcagaagaaaacttctcctgaagttgaagaacaagtccgatttccagatgttccttcatatatggagtatgtcaaaaatcgccagcttgtccacttcagagcactggaaaaaccgaaggaggatgatttttgtctggagttagcaaaaagtgatacatatgatgaagtagtggatagagtggctcagaggcttggtgtggatgattcctccaaaattaggcttactcctcacaactgctactcacagcaacccaagcccaaccccatcaaatatcggtctgtggatcatttggtagacatgcttatccattacaatcagatctccgatattctgtattatgaagttctggacatacctctgccagaattacaatgtctgaagacgctcaaagttgccttccatcattctacgaaggatgagattgaaattctgaatgtaagattgcctaagcagagtacagtgggggatgtacttgaggaaatcaaatcaaaggtagagttgtcccatccaaatgcagagctcagattactcgaggtcttctatcacaagatttataagatctttccgctcagtgaaaagattgagaatataaatgaccaatattggacattgcgggcagaggaaataccagaagaggagaaaaaccttggtccccacgatcgtctaattcatgtttaccatttcacaaaagagactccacaaaatcaaatgcaagtgcagaattttggagaacctttctttctggtcatccatgaaggtgaaactttagcggaaattaaagtgcggattcaaaagaaattgcaggtctcggatgaggagttctctaagtggaaatttgcatttttatcattggggcgcccagaataccttcaggactcagatattgtatccaaccgttttcagaggagagatgtttatggtgcttgggagcagtaccttggattggagcatgcagataatacatctaagaggccatatattaatcagaaccgtcacacattcgaaaagccagtcaagatatacaactgaaagaggtttgtgatattccagctgggctttggttgtagcgttcactcctcacgagcttagaagggagaaatgtaaaagagtttgtagctatgacatgatgataagtagaaggcagagaggggattggcatgaaaaccgttttcatataggggatttcaccacctttgtttcctcctgatgatttggtcagattttgcaggctttatgttttcccttcgatttcgtttggggagggagatttgtttctctttagtttagttaggatgtgcgctgcagtttctgccctcgccttcagctattacaccgctgagggttggttcttttgatgttgtcttctgcataataagattttggttgaagggaatgtatagttgatatagtcgtcgggtgccttctgggcatgtactatctatctgttacttctgtatgaatttccccattcctctttttgttgtatttaatgtcataggagtggggaatggatctgtataagttttctctatagcattggtatatgttttctatgcttcatttctgtctttgttgttgttactgttggtttagtttggcaggaaatgacaaaaacctccttcaattgagcatatgaatgatttattttttttg

SEQ ID NO: 2452 - DNA, 3981 bp, Solanum lycopersicum
atactaaaaaattttcttttgttcgtcgcctagcccaaggactcgaactgaagagaaagtccttggatcgattcgatcgtttctacgttgcattcttcatcgccgatttgctgattttccggtcaaccgttttccggcaatgactctcatgactcctcctccagttgaacagcctgaagacgaggagatgcttgttcctaattcagattttcctgtagaaggtccgcagcctatggaagttgctactgcggatacggctagtacggtggagggtccacaagtggatgatccgccatctggtaggtttgcgtggacgatagagaaattttcgaggttgaatgtaaagaagctatactcggaagttttcaatgtgggaggatataaatggaggatcttgatattccctaaaggtaacaatgcggaccaattgtcattgtatttggatgttgccgattcaccgtcattgccttatggttggagtagatatgctcattttagcttaggtgtgctcaaccaagctcataccaagtttacagtgaggaaagacactcagcaccagtttaatgcaagggagagtgactggggtttcacatctttcatgcctttaagtgaattatatgatcccagcagaggttttattatggatgatactgttattgttgaagctgatgtttctgttcgtaaggttgctgattactggtcccatgactctaagaaggagactggttgtgttggccttaagaatcagggagccacttgttatatgaactctctcctccaaacattgtatcatatttcttactttagaaaggctgtgtatcatatgccaacaactgagaatgacaatccatctgggagcatccctttggctttgcagagtctgttctataagctacagtacagtgacactagtgtagcaacaaaagagttgacgaagtcctttggatgggactcaaatgattctttcacgcagcatgatgtacaagaacttaacagggttctttgtgaaaaacttgaagataaaatgaagggaaccgttgtagagggaacaatacaacaactgttcgaggggcatcatatgaattatattgaatgtatcaatgtggattacagatcaacaagaaaagaatctttttatgacttgcagcttgacgtcaaagggtgtcgtgatatctacgcttcttttgacaagtatgttgaagtagaacgtcttgagggtgacaataaataccatgcagaaaaatatggtttacaggatgctcggaaaggtgtcctttttgttgacttcccccctgttcttcagcttcagttaaaacgttttgaatatgattttgcacgggatactatggtcaagataaatgacagatatgagtttcctttacaactcgaccttgatagagagaatggaaaatatttatctccagatgctgatcgaagtgttcggaatctctatactcttcatagtgttttggttcacagtggtggggtccatgggggacactattatgcttatatcagaccaacgctctctgatcaatggtttaaatttgatgatgagcgtgtgacaaaagaagatccaaagagggctctggaagagcagtatggtggtgaggaggagttgcctcatacaaaccctgcgttcaacaattcaccattcaaattcacaaaatattcaaatgcatatatgcttgtttatattcgtgaaagtgacaaagaaaagattatctgcaatgtggatgaaaaggacattgcggagcatctcagggtaaggctaaagaaagagcaagatgaaaaggagcaaaagagaaaggaaaaagcagaggctcacctttatactatcatcaaggttgctcgtgatgaagaccttggtgaacaaattgggaaggagatttattttgatcttttggatcatgacaaagtccgtagtttccgtatccagaaacagatggtatttacgcaattcaaggaggaggttgctaaggtattgggtatacccgttcaattccagcggtattggctatgggcaaaacgacaaaatcacacatatcggcctaatcggccattgacacctcaagaggaagttcagtcggttggacaattgagagaggtctctaataaaacaagtaacgcggagctaaagctttatttggaagttgaagttggcctggatttgcaaccttgtcctccacctgagaagaccaaagaagatattcttctatttttcaaactgtatgaccctctaaaagaggagataaggtatgttgggcggctctttgtaaaaggaagtggcaagccactggacatattgtccaagctaaatgagttggctggattttcacctgatgaagagattgaactctttgaggaaataaaatttgaacccaatgtgatgtgtgaacctattgattgcaatctaacattttgtagcagtcagcttgaagatggggacattatttgcttccagaaacccgttcagagtcaaactagtgaacaatgtcgattttctgatgttccttcatttttagagtatgtgcacaatcgccaggttgttcacttccgctcattggaaaaacccaaggaggaggattttagtctcgagttgtcaaagctgaacacctatgatgaagtagtagagagtttggctcgccatctccgcttggatgacccatctaaaataaggcttacatcacataactgctactcacagcagccaaaacctcagccaataaagtatcgaggagtggaccgtcttacagaaatgctggttcactataatcagacttcagacattttgtattatgaagtcctcgatattccattaccagagctacagtgcttaaaaactctcaaagtcgccttttataatgctgcaaaatatgaagtgacaatccatactattagattgccaaaacaaagtactgtggatgatgtccttaatcatcttaagacaaaggttgagttgtcacgtccagatgctgaactaaggttgctggaagttttctatcacaagatatataagatttttccacctactgaaaggattgagaacataaatgatcagtactggaccttgcgtgcagaagagatccctgaagaggagaaaaacctgggtcctcttgatcgtttgattcatgtttaccattttacgaaggacacaactcaaaaccaagcacatgtacaaaactttggcgaaccattttttttggttattcatgagggtgagacactggctgaagttaaagtgcgcattcagagaaaattgcaggttccacatgaggagttttcaaagtgggcgtttgcgtttgtgtccatgggccgtcctgactacctccgggattcagatattgtatctattcgttttcagaggagagatgtttatggtgcttgggagcagtatctgggattagagcatgctgacaatggtcctaaaaggtcatatgcttccaaccagaatcgacccacttttgacaagcctgttcggatctacaactagtcttctaaatgactgatcataccatggatggagcatgtaaaatcccgcgaagaagcaggcactaggatcatcagaagatggcagctaacagttaatgcagtgatgtctcggtggtaatatatcttttgccctccaaacgcggcaagcaacaccatattttatttaagcaaggtttaggtggctgaaaacgttgattccattgtaattttaggtaacacaaatgattttgggtggacgtatatagagggtatagatgtttattttgacatttcctattcctcccttttggcattctcagttgtctcataattatattttctggaaaactaatgatgtagaagaacacaaggctgggatatcccatagtgacattgttgtagaacagttgaaagggatatctcacagtttttagtgtctttgtttgcaaaatgtccgtctcgtaataattggattcatcattttctatttaaatttgaatgaaatagagt

SEQ ID NO: 2453 - DNA, 3854 bp, Valeriana officinalis
ttgtttgcagacttcatttctgtaaacaacaccacccaggtgccccgccctaacactttctcgtctccatcgatccaagcttccccaatttctgttcatgactctcatgactcaaccctcaatagaccaagaggaggatgaaatactcgttccgcatccagatattctccccgaaggtcctcaaccaatggaagttgcaccagcagaaactcctaatacaactgatgctcagtcagttgatcgaccccccttcagcaagatttacatggtcagtggagtaatttttctaggttgaacactaagaagctctactctgattgttttagcgtcggaggatacaaatggcgggtacttatattcccaaaagggaacaatgtggaccatctttcaatgtatctagatgttgctgatgctccaactcagccttatggatggagtagatacgcccaattcagcttaggggtggtcaatcaaattcacaccaagtttacagtgagaaaagatacacaacaccagttcaatgctcgagaaagtgattggggtttcacttcgttcatgccacttggtgaactttatgacctaagtcgagggtatattgtgaacgatacatgcataattgaagccgatgttgccgtgcgcaaggttgttgattattggtcgcatgactcgaagaaggagactggttatgtggggctcaagaatcaaggagctacatgctacatgaactctctcctccaaacactttaccatattccctactttaggaaggctgtgtatcatatgccgacgacggaaaatgatatgccatcaggaagcattcctctggccttgcagagtttattctataaactacagtatagtgacagtagtgtagcgacaaaagagttgaccaagtcttttggatgggactcgtatgaatctttcatgcagcatgatgtccaggaacttaatagggttctgtgcgaaaagcttgaagacaaaatgaagggaactgttgtggagggtacaatacaacagttatttgaaggccaccatatgaattatattgaatgcatcaacgtggactacaagtcaaccagaaaagaatcttattacgatcttcagcttgatgtcaaaggctgccgtgatgtgtatgcttcgtttgataagtatgtagaagtggaacgtcttgagggcgacaatagatatcatgctgaacaacatggtctgcaggatgctaggaagggggtcttgtttatcgactttccccctgttctccagcttcagttaaaacggttcgagtatgatttcatgcgtgataccatggttaagataaatgaccgatatgagttccccttggagcttgatctcgatagagagaatggcaaatatttatcccctgatgcagataggagggttcgcaacttgtacactcttcacagtgttttggtacatagcggtggagtacacggtggacattattatgcttatatccggccaactctctctgaaaagtggtttaagtttgacgacgagcgcgttacaaaggaagacatgaagagggcgatggaggagcagtacggtggtgaagaagagctaccccaggcaaatcctgggttcactaactctccgtttaagtttacaaagtattcaaatgcgtacatgcttgtgtatatacgtgaaactgacaaggataaaataatctgtaatgttgacgaaaaggatatagcagaacatctaaggataaggttgaagaaagaacaagaagaaaaggagcaaaagagaaaggaaaaggcagaggctcatctttataccatcataaaggttgctcgcgacgaggaccttttcgaacaaattggaagggaactatactttgatcttattgatcatgacaaagtacgaagcttccgtattcagaagcaaacaccatttaacgttttcaaggaggaagttgcaaaagcgttggggatagcagtggaacatcaacgcttttggctgtgggcaaaacggcaaaaccacacgtatcgaccaaatcgccccttgacacctcaggaggaagcccaatctgttgggcaactgagggaagtgtccaataaggctagcaatgcggagctcaaactgtttttggaagtagaagttggagtgaatctgcagccgattcttccgcctgaaaagaccaaggatgatattctactattcttcaaaatttatgaccctttgaaagaggagctacggtatgttgggagggtgtttgtgaaagccagtagcaagccagtggaaaaccttgctaagctgaatgagttagctggctttgatccggatgaagaaatcgatctctacgaggaaataaaatttgaacctaacatcatgtgtgaacgagtggacaagaatattcctttccgaagtaaccagctagaagacggtgacatcatttgcttgcagaaaactgtctctgctgaaactagtgaagagtttcgttatccagatgttccttcttttcttgagtatgttcataatcgtcaggtcgttcgatttcgctcgctggagaaacccaaggaggatgagttctctcttgagttgtcaaagcttcacagttatgatgatgttgtggagagagtagcacaacatcttaatttagatgatccatccaaactaagacttacatctcataattgctattcccagcaacccaaaccccaaccaatcaagtatcgtggagtcgaacatctttctgccatgttggttcactacaatcagacttccgatatactgtattatgagatattggatattcctctgccagaactccaaggcctcaagacacttaaagttgcattccatcatgcgactaaggacgaagttgtcatacatactataaggttgccaaagcaaagcacagtcggggatgttattaatgaccttaagacaaaggttgagttgtctcatccaagtgcagaactgagattgcttgaggttttcatcacaaaatctacaagattttccccctcaatgaaaagattgagaacattaatgatcagtactggacactacgcgcagaagagattccggaagaggagaagagcattggtcctcaggataggttgatccatgttaatcattttatgaaagagacttctcagaaccaagtgcaagtgacaaattttggggaaccatttttcctgctgatccatgaaggggagacactgggtgatgtgaaagcgcgcattcaaaagaaattgcaggttcctgatgaagacttctccaagtggaagtttgcatttttgtctttggggcgtcccgagtatcttcaagattccgacatcgtgtccacacgttttcagagaagagatgtttacggggcttgggagcagtaccttgggttggagcatcccgacaatactccaaaaaggtcatacgcagtgaaccagacccggcacacatatgagaagccggtaaaaatatacaattagaggaaaagagttagctgcagcggtggcaaagtggaattttttttgtttggtgttttgattataggggagaaggctatggttactctttattttaaagtagtcagtaaagattttgagggtgttggtgtatagaagaatgaagaagaagaaaaggatagtagtaggtgtgcctattttctttgattttgtccgacttcattttgggcactgcttttccttttgatatactccactaatatttgtatatttttgtctaatgtggtaaatcattctgggcatatgcaacccactttgctatgcttttctacctctcctcttttaccccttggaaataaaataataatactacttgcgtactgtattatacagtagtacataatagttttagaccagctcattcaatcc

SEQ ID NO: 2454 - DNA, 3774 bp, Olea europaea
tgtgtttaatcgttcggatcggacggctgtaatttctccaatcatgacgatgatggctcctcaatcgttagatcaacaggaggacgaagagatgctggtgccgcactcaaatttagtcgaaggtcctcagcctttagtcgaaagtccgcagcctatggaagtggcatcaacaaacaatgctggggcaacggagaaccaggcaagcgacgagccacaagcatcacgattcacgtggacaattgagaacttttctcgcttgaatgtgaagaagctctattctgaggtctttgttgttggaggttataaatggcgggtgcttatttttccaaaaggaaacaatgtggagtacttgtcaatgtatttagatgtggccaattcagcaaacttgccatatggttggactagatatgcacagtttagcttggctgtagtcaatcaaatccatagcaagtatacagtaaaaaaggacacacaacaccagtttagtcaaagggagagtgattggggtttcacttctttcatgcctcttagtgagctttatgaccctagtaagggttatattgtgaatgatacatgtgttgtggaagctgatgttgctgtccggaaggtcattgattacttgacatatgactcgaagaaggagacaggttttgttggacttaagaatcagggagcaacttgttacatgaactctctccttcaaactttgtaccatattccttatttcagaaaggctgtgtatcatatgcccacgacagagaatgatatgccctcagggagcattcctttggccctacagagtttattttataagctccaatataatgacaccagtgtggctacaaaagaattgactaaatcatttggatgggacacgtatgattcctttatgcagcatgatgtgcaagaactcaatagagttttgtgtgaaaagcttgaagacaagatgaagggaactgttgttgaagggacaatacaaaaattgttcgaagggcatcacatgaactacatcgaatgtattaatgtagacttcaaatcgacaagaaaagagtcattttatgaccttcaactggatgttaaaggctgcaaggatgtttatgcttcctttgacaagtacgtggaagttgaacgtcttgaaggagataataaatatcattctgaagaacatggtttgcaggattccaagaagggggtcttgttcatcgacttccctccagttcttcagcttcagctaaagcgctttgaatatgattttatgagagacataatggttaagataaatgacaggtatgaatttcctttggaacttgaccttgatagagacaatggtaaatatttgtcgcctgatgcagataggagcgttcgtaacctttacatgctccatagtgttctggttcatagcggcggggtgcatggtggacattattatgcttttatcaggccaactctttccgagcagtggtacaaatttgatgatgagagggtcactaaagaagatacaaagagagcattagaggagcagtatggcggtgaggaagagttgccgcagacaaatcctggtttctataacactccatttaaatttacgaaatactcaaatgcctacatgcttgtgtatatacgtgtgagcgacaaggataagataatctgtgatgtggatgagaaggacattgcggaacatcttaggataagactgaaaaaagaacaagaacagaaggaagacaagagaagatataaagctcaggcccacctttatactaatatcaaggttgctcgagacgtggatttaagggaacagattgggaaggatatattttttgatctcgttgatcatgataaagtccatagttttcgaattcagaaacagataccttttaatcttttcaaggaggaggtcgccaaagaatttggtataccagtccaatttcagcgtttttggatttgggcaaagagacagaaccatacttatcgtccaaaccgtccattgaacccacaggaggaagcacagactgtcggagcattgagagaagtttctaataaggcccacaatgcagatctgaagttgtttttggaaatagaatttggacaggatctacatccaattccaccacctgacaaaagtaaagaagatattcttctgttctttaagctttatgatccggagaaagaagagctccggtatgttggtaggctttttgtcaaaggctctagtaagccaattgagattctgacaaaacttaatgaattggctggatttgcttctgatgaagagattgaacttttcgaggaaataaaatttgagccttctgtcatgtgtgaacgccttgacataagagcttcatttcggtttagccagattgaagacggtgacatcatttgcttccagaaaaggcctgtccctgaaggtgaagaaaaatttcgatttccagacgttgcttcttttttggaatatgtgaaaaatcgccagattgtccattttcgagctttggaaagacccaaggaagatgaattctgcctagagttggcaaagaaccacacttatgatgatgttgtggaaaggctggctcaacgtctcggcttggatgatccgtctaaaattcggcttactcctcataattgctattctcagcaaccaaagcctacttccatcaaatatagatcagttgatcagttggtagacatgcttgtgcactacaatcagatctctgatattctttattatgaagtactggacattcctcttccacaattgcaatgcctgaaaactctgaaagttgcttttcacaatgccacaaaggacgaggctgtggtgctcaatattaggttgccgaaacaaggtactgttggcgatgtgcttaatgtgatcaaagaaaaggtagagttgtcacatccaaatgctgaacttaggttgcttgaagttttccatcacaaaatttataagatctttcctctctatgagaagattgagaatataaatgaccaatactggacattgcgggcggaagagattccagaagaagagaagaaccttggtccaaatgaccgtttgattcatgtttaccattttacgaaagagaatgctcagaatcaagtgcaaatccaaaatttcggggaacctttcttcttggttattcatgaaggtgaaactctatctcatgtgaaattgcgcgttcaaaagaaattactggttcccgacgaggaattttctaagtggaagtttgccgcattgtcactgggtcgtccggagtatcttgaagactctgacattgtgtccagtcgttttcagagaagagatgtttacggtgcttgggagcagtaccttgggttagagcactctgatactactccaaaaagggcttatacagcaaaccagaatcgtcacacgtttgagaagcctgttaaaatatacaattaagaagaaatgctgtttggatgtgtttgctcttgatgcaatggtgaaaatgtaaaaaatttgaagtctgctatactgaaaggagaatgaaaggtagaaaagggaatagcgtgatagttttctttctcccctagtttttccggtgacagtttcttagactataattattgatttagcatggggaaatgggggccttgactcccaaatgtatcttgcttcttgtggttggtacaatatacgcaataaacttcctgtttttaccagtattttcaaggtgcttcctgctttgaagaatccgggaattttgtacggtacatgacaacattttggttgtaaagtggctatagttaggcctttaataa

SEQ ID NO: 2455 - DNA, 3640 bp, Eutrema parvulum
gaaaatagcgattgatctcctctctgcaagttctctatttcttccctcacttcttcttctccctttgattttttctctgctcggtgctctctttcacttctcgatccgaccgtcaatcctcccagagggatgactatgatgactccgccgccgctggatcagcaagaggacgaggaaatgctcgttccgcattctgatttggtcgagggacctcagcccatggaagttgcccaacctgaggctgctgctaccactgtggagaatccgccagccgaggagccccccactctgaaattcacgtggcctatcccatgttttactaggctgaacaccaggaagcattactctgatatatttgttgttggaggttataaatggcgaatattgatttttcccaaaggaaacaatgtcgaccatttgtccatgtacttagatgttgctgacgctgcaaatttaccctacggatggagcagatattcacagttcagcctggctgtagcgaatcaaatcagcagtagatattccgtcagaaaagagacccaacatcaattcaatgcaagagaaagcgattgggggtttacatcattcatgcctctgagcgagctctatgaccccactcgtggatatttagtgaatgatactgttctgattgaagctgaagttgctgtgcggaaggttcttgattactggtcatatgactcaaaaaaagagactggttttgttggacttaaaaaccaaggtgctacctgttacatgaattctctcctgcagacgttataccacataccttacttcagaaaggctgtttaccacatgccaacaactgagaatgatgcacctacggcaagtatcccgttggcgctacagagtttgttttacaagcttcagtataatgataccagtgtagcgacaaaagagctgacaaagtcgtttggttgggatacatatgattcgttcatgcaacatgatgttcaagaactcaaccgagttctctgtgaaaagcttgaggacaaaatgaagggaactgttgtggagggaacaatacagaagctatttgagggtcaccacatgaattacatcgagtgcattaatgtagattacaaatctacacggaaagaatcattctatgatctgcagcttgatgttaaaggctgcaaagatgtatacgcttcttttgacaagtatgttgaagttgaacgccttgaaggagacaacaaataccatgcagaaggacatgacttgcaggatgcgaaaaaaggtgttctgttcatagactttccacccgtacttcaacttcagctcaagaggtttgagtatgattttatgcgagacacaatggtgaagataaacgatcggtatgagtttcctcttcaactggatctcgacagagagaatggaagatatttatctcctgatgctgacaagagtgtccgtaatctctatacactccacagtgtcttagttcatagtggcggagtgcatggagggcattactatgcttttattagaccaacgctctcagaccagtggtataaatttgatgatgaacgggtgacgaaggaagatgtgaaaagggcactggaagagcaatatggtggtgaagaagagttaccgcaaaataatcctggtttcaataatccaccttttaaattcacaaaatactcgaacgcatacatgcttgtttatatccgggaaagcgacaaggataaaataatctgcaacgttgatgaaaaagacattgcagaacatttacgggtgaggctaaaaaaagaacaagaagaaaaggaagataaaagaaaatacaaggctcaagctcaccttttcacgactattaaggtcgcaagggatgaagacatcactgagcaaattggaaagaatatatattttgatcttgttgatcatgaaaaagttcggagttttcgaatccagaaacagaccccctttctacaatttaaggaagaggtggccaaagaatttggtgtgccggttcagctacagcggttctggatttgggcaaagcggcaaaaccatacttatcgtcccaaccgccccctattacctcatgaagaattacagacggttggacaaataagagaggcatctaacaaggcaagcaatgctgaactgaagctgtttttagaaacagagcgcggatcggatgagcgtcctattccacctccagacaagtcttctgaagatattctccttttctttaagctctatgaccctgagaatgcaatactaagatacgttggcaggctcatggtgaaaagttccagtaagcccatggatatagtagggcaactgaatcaaatggctggctttgctcctgatgaagaaatagaactttttgaggaaataaagtttgaaccttgcgtaatgtgtgaacatctggataagaattcttctttcagactatgtcaaattgaagatggagatatcatttgctatcagaaacctctttctatccaggagaatgaatgtccatacccagatgttccatcgtttttggagtatgtacagaatcgagaggttgtgcgttttcgtactctggaaaaaccaaaagaagatgagttcactatggagttgtcaaagctgcacacttatgatgatgttgtggaaagattggctgagaagcttggccttgatgatccatcgaaaattaggcttacttctcacaattgctactcccagcaacccaagcctcagcctatcaaataccgtggagtagaccatctttcagatatgttagctcactataatcagacgtctgacattttgtattatgaagttctggacattcctcttccagaactgcaaggccttaagactctaaaagtagctttccatcatgccacgaaggacgaagtggtaatccacaatatcagactgcctaagcagagtactgttggagatgttattaacgaacttaaaacaaaggtggagctttcgcatcaagatgcagaactgaggttgcttgaggtgttcttccacaagatctacaagatctttccatctaccgaaagaattgagaacatcaatgaccagtactggactttacgagcagaggagatacctgaggaagagaagaatattggtgccagtgatcggttaatccacgtgtatcattttactaaagaggctggacaaaatcagcaagtacaaaatttcggcgagcccttctttttggtaatccacgaaggtgaaactttagaagagatcaagacccgtatccaaaagaagctccatgtccctgatgaggactttgcgaagtggaagtttgcttctttttcaatgggacgtcccgactacttgcaggacacagatgtagtttataataggtttcagagaagagatgtatatggtgcgtgggagcagtatcttgggttggagcacgttgataatgctcctaaaagggcgtatgctgcaaatcagaaccgtcacgcatatgagaagccggtgaaaatatacaattaggagcaagagagaagacgtggctatccatggaggaatatatatcttaagggtggttttggtgcaaggaatttaggatgtagagtctcaatttagattttcatgtcataaccaaaaatgaaatatatctttccaggaaaaagggttttgatgttaatatggtatt

SEQ ID NO: 2456 - DNA, 3334 bp, Nicotiana benthamiana
tcgaatattaaactttagttgtgttttttggcagccagaagaggacgagatgctcgttcctaattcagattttcctgttgaaggtcctcagtcaatggaagttgcgactgcggatacagctagtacggtggatggaccgccagtggatgatccaccatctgctcggttcacatggacagtagaaaacttttcaaggttgaatacaaagaagctatactcggatgttttccatgtgggaggatataaatggaggatattggtattccctaaagggaacaatgtggaccatttgtcaatgtatttagatgttgcggattcgccggcattgccttacgggtggagtagacatgcgcagtttagcttagctgttctcaaccgagtccataacaagtttacagtgaggaaagatactcaacaccagtttaatgcaagagagagtgactggggtttcacatccttcatgcctcttagtgaattatatgatcctgtcagaggttatcttgtggacgatacagtaatagttgaagctgatgttgctgtgcgtagggtcattgattactggtctcatgactcgaagaaggaaactggttgtgttggccttaagaatcagggagctacttgttatatgaactctctcctccaaacattgtaccatattccttactttagaaaggctgtgtatcatatgccaacaactgagaatgacaatccatccgggagcatccctttggctttacagagtttgttttataagctacaatacagtgacactagtgtagcaacaaaagagttgacaaagtcctttggatgggatacatatgattctttcatgcagcatgatgtacaagaactcaacagggttctttgtgaaaaactagaagataagatgaagggaaccgttgtagagggcacaatacaacaattattcgaggggcatcatatgaattatattgaatgtatcaatgtggactataaatcaacaagaaaagaatctttttatgatttgcagcttgatgtcaaagggtgtcgtgatgtctatgcttcttttgataagtatgttgaagtagaacgccttgagggtgataataagtaccatgcagaaaaatatggtttacaggatgctcgaaaaggtgtacttttcattgatttccctcctgttcttcagcttcagttaaaacgatttgaatatgattttgtgcgggatactatggtcaagataaatgacagatatgagtttcctttagaactcgatcttgatagagagaatggcaaatacttatctcctgatgcagatcgaagtgttcgcaatctctatacgcttcacagtgttctggttcacagtggtggggtccacgggggacactattatgcttatatcaggccaacactctctgatcaatggtttaaatttgatgatgagcgtgtgacaaaagaagattcaaagagggctttggaagaacaatatggtggcgaggaagagttacctcatgcaaaccctgggttcaacaattcaccattcaagtttacaaaatattcaaatgcatatatgcttgtttatatacgtgaaagtgacaaagaaaagattatctgcaatgtggacgaaaaggacatagcagagcatctcagggtaaggctgaagaaagagcaagatgaaaaggagcaaaagagaaaggaaaaagcagaggcccacctttatacaataatcaaggttgctcgtgatgaagacctcggtgaacaaattggaaaagagatttattttgatcttgtggatcatgacaaagtccgtagtttccgtatccagaaacagatggcatttacacaattcaaggaggaagttgctaaggaattgggtataccggtgcaatttcagcgttattggctatgggcaaaacgacaaaaccacacttatcggcctaatcggccattgacacctcaagaggaagctcaatccgttggacaactgagagaggtctctaataaagcaaataatgctgagctaaaactgtttttggaagttgaatttggcctggatttgcgaccttgtcctccacctgagaagaccaaagaagatattcttctatttttcaaactgtatgaccctctgaaagaggagatgaggtatgctgggcggctctttgtaaaaggtagtggcaagccattggagatattgcccaagctaaatgagctgtctggcttttcgcctgacgaagacattgaactctttgaggaaataaaatttgatcccaacgtgatgtgtgaacccattgattggaagctaacatttcgtggcagtcagcttgaagatggggacattatctgttttcagaaacccctgcgaagtcaaactagtgaacaatatcgatttcctgacgttccttcatttctagagtacgtgcacaatcgccaggttgttcgcttccgctcattggagaaatccaaggaggatgatttcagtcttgaattgtcgaagcagaacaactatgatgaagtagttgaaagattggctcgccatcttggcttggatgatccatcaaaaataaggcttacatcacataactgctactcacagcaaccaaaacctcagccaataaagtatcaaggagtggaccatcttacagaaatgcttgttcactataatcagacttcagacattttgtattatgaagtcctcgatattccgttaccagagctgcagtgcttaaaaactctcaaagtcgccttctacaattctgcaaaagatgaagtgacaatccatactattagattgccgaaacaaagtactgtagatgatgtccttaatcatctcaagacaaaggttgagttgtcacatccagatgctgagctgagattgctggaagttttctaccacaaaatatataagatttttccacctactgaaaggattgagaacataaatgatcaatactggaccttgcgtgcagaggagatccccgaagaggagaaaaacctgggtcctcatgatcgcttgattcatgtttaccattttatgaaggacacgactcaaaatcaatcacacgtacaaaactttggggagccctttttcctggttattcatgagggcgagacactgactgaagttaaagcccgcattcagaaaaaattgcaggttccagatgaggagttttctaagtggaagtttgcgtttttgtccatgggccgtcctgactatctccaggattcagatgttgtgtccaatcgctttcagaggagagatgtttatggtgcttgggagcagtatcttggattagagcatgctgacaatgctcctaaaaggtcatatgctagcaaccaggtatgctaacagctaaaattt

SEQ ID NO: 2457 - DNA, 4562 bp, Eucalyptus grandis
atgacgctcctgccctctgccctgccgcgaaatctcccccgtgccatcccatcgcgaaaccccccacgactctcgaagccacacttctaccgagacactccttcccccctccttcctttccatctcctctctctctctctctctctgcaaatcgcttcgccgccggtcgccgccggtcgatcgcgagctcgccggaacgtggccgttcatgactatgatgactcctccgccgttggatcaagaggaggaagaaatgctggtcccgcactccgatttggtcgtcgaggggcctcagcccatggaaggcgtggcgcaggtggatcctgctggcgcggtggagactcagcaactggaggagcctccttcgatgaagttcacttggagaatcgacaacttccctaggttgaatgtgaggaagcattattccgaggtttttgttgtggggggttacaaatggaggatacttattttcccaaaaggaaacaatgtggaacacttatctatgtatttagatgtagcagattcaccagcacttccgtatggatggagcagatatgcccagttcagtttggctgtggtgaatcagagcaataacaagtatacaataagaaaggatacacaacatcagttcaatgtgagagagagtgactggggttttacatccttcatgcctcttggcgagctatatgatcctgttagaggatatatggtaaatgatacagttttcgtggaagctgaggttgttgtgcgcaagattctggattactggtcatacgactcaaaaaaggagactggttatgtgggacttaagaaccaaggagccacctgttatatgaactctttattgcagactttgtaccatattccgtactttagaaaggctgtataccatatgccaacaactgagaatgacatgccttctggaagcattcctttggctcttcagagtttgttctataagctgcaatatcatgatagcagtgtcacgacaaaagaactgacaagatcatttggatgggatacttatgattcatttatgcaacatgatgttcaagaactgaatagagtcttgtctgaaaagcttgaggataaaatgaagggaactgtggtagagggcacgatacagcaattatttgagggtcatcatatgaattatattgagtgcatcgatgtagactataaatcaaccagaaaggaatcgttttacgatctacagcttgatgttaaagggtgtcgtgatgtttatgcttcgtttgacaaatatgttgaagttgaacgtcttgaaggtgacaacaaataccaagctgaggaacatggtttgcaggatgcaaagaagggcgtcctgtttattgacttccccccagttctgcaacttcaccttaagcggtttgaatatgattttatccgagacactatggttaagataaatgatcgctatgagttccctcttcagctggacttagacagagacaatggaaaatatttgtcaccagatgcagataggagtgtacgcaacctttattctcttcacagtgtcttggttcatagtggtggtgttcatggtggccattattatgcctttatcaggcccacactctctgatctatggtttaaatttgatgatgaacgggtgacaaaagaagatataaagagggctttggaagaacagtatgggggagaggaggagttgccgcagaccaatcctggttttaacaacactccctttaaatttacaaaatactcaaatgcatacatgctcgtgtatatacgtgacagtgacaaggataaaataatttgtcacgtcgatgagaaggacattgcagaacatttgagggtgaggttgaagaaggaacaagaagagaaggaggaaaagagaaagcacaaggcacaagcccatctttatactataataaaggtagcacgagaagaggatcttgttgagcagattggaaaagatatatacttcgatcttgtggaccatgacaaagtccgaagttttcgcattcagaagcaaattaagtttaaagattttaaggaggaagttgccagagactttggtgtgcctgtgcaatgtcagcgtttctggttatgggcaaagaggcaaaaccatacttaccgtccaaatcggcctctggcacccccagaggaagaacaaccagttggacagttaagggagatgatgaacaagaccaacaatgcagaattaaagctgttcttggaagttgagcttgggctggataaggttcctgtttcaccacccgaaaaatctaaagatgatatcttgctattcttcaaactttacaaccctgagaaaggagaactgcgatatgtaggtaggctctttgtgaagttttatggtagaccaattgaaattttgccaagattgattgagatggccggcttcaatcaagatgaggaattagaactatttgaggagataaagtttgtgcctggtgtcatgtgtgagcatcttgacaagaagatatcatttcgagcgagtcagcttgaagatggggacatcatttgctttcaaaaagctcgaatggacaatgaagatgaatttcgttatcctgatgttccttcttacttggagtatgtgcataaccgccagattgttcattttcgatcattggaaagaccaaaggaggatgatttcgtcctagagttgtcaaaagtacataattatgatgaagtggtcgaaagagtggctcaacaagttgggctggatgatccatcaaaaattaggcttacatctcacaattgctactcgcaacagcctaagcctcaaccaatgaagtttcaaggggtagagcatctttcagatatgctagtccattataaccagacctctgatatattgtactacgaagtactggacatccctctcccagagttgcaaggtctaaagaacttgaaagttgcgtttcatcatgcctcaaaggatgaggttgtaattcatcatattagacttccaaagcagagcacagttggtgatgttattaatgaacttaagacaaaggtagatttgtctcgtccagatgcagaacttagacttcttgaagtcttctatcataagatctataagatctttccttccagtgagaaaattgagaatataaatgaccaatactggacattgcgcgctgaggagattcctgaagaagagaaggaccttgggccacatgatcgcttgattcatgtttaccacttcatgaaggaaactgctcaaagtcagctgcaagtgcagaactttggggaaccctttttgctgctcatccatgaaggtgaaactttagctgaagtgaaaatgcgcatacaaaagaaactgcaagttccagatgatgcattctccaagtggaagtttgcatttctttcgttgggtcgcccagagtatcttgaggattctgaaattttatcaaaccgttttcagagaagagatgtttatggggaacagtatcttggattggagcactctgatgctcccaagaggtcttatgtggtgaatcagaaccgtcacactcatgagaagcctgttaaaatatacaactaagaagagctgaggatttaacaggaccttccgtttaagggattacttgatgataatgatgtggaggttgagaacgcttgttgcatctaagtgatgatggcctgggtgaccattgtacatgtaggctaaattattctttagcgcgggtgaggaaggtgggtgtccgctcgtttatggaatctcttcttcatatgccctgcttgagctcttcctctttccaagggattttcttgtttcccagtctgttgtcctacgtctgtaatttagtagtgcataagaagattttggatgagggtgtttatagcgggaatcgttccattttactattttttccccttatttgatcttttttgtagtttgggtttttaagtttagcaggggacgacctcaaaatttcaagtggctggttgtacccgatgtagggtgttgtagaaagagctgtactgcatgagcagtcctgattgctctgttcttccacgtcatgattatagtgatcgtttgtttcgtttaaggatgtcttatacaggttttataaaagtgtgcttttcggagctatctgtttccttctgtttaggtcggattctttttttcttttagggctccttggcttctggattttcaccagtacaataggatttgctgtttcaacccacagtaaaaagacgtcaggagcgggtgaaaatcgcgttatgttgttgctgtcatcatgggccatgaaagtatatgtagctgtaaaagataaaaggaggagtgtcacctgtaattcgtacctctaccaatgtaaagtacctttggttcattgatgcttctgatctttcatgtttatcgtttctttcttttttttctctttttcctagatgtctgatctgatacttgtctgaaaactagccccccatcaaaccgaatggcttaggtgacattttttgttcgaggcttttcgttcggacagcatggcctttttccatctggctttcgccactgtgaaaatgttggaaagtcttcgggtcaataaaaa

SEQ ID NO: 2458 - DNA, 3815 bp, Eutrema parvulum
ctagtcactttgccttctcttttttcccctctctttgatttttctctgttcgtcggtctctcgatcccaccgtcaatccttctccggccaatgactatgatgaccccgcctccggttgatcagcaagaggatgaggagatgctcgttccgcattcagatttggtcgacggtcctactcagcccatggaagtttcccaaactgagactgctgcgagtactgtggagaaccagccagctgaggatcctcctactctgaaattcacgtggactatccaaaacttctctaggcaaaacaccaggaagcattactccgatgtatttgtcgttggaggttacaaatggcgcatattaattttcccgaaagggaacaatgtcgatcatttgtccatgtacttggatgtttctgatgctgcaagtttgccgtacggttggagcagatatgctcagttcagtctggctgtagtcaatcaaatccacaccagatataccattagaaaagaaacgcaacatcagttcaatgcaagagaaagcgattggggatttacatcgttcatgcctctcagcgaactttatgatcctagtagaggatatttagtgaatgatactgtttacattgaggctgaagtcgctgtacgtaaggttcttgattactggtcatacgactctaaaaaagagactggttttgttggtctcaagaaccaaggtgcaacttgttacatgaattctctcctacagacgctataccacataccttacttcagaaaggctgtataccacatgcccacaactgaaaacgatgcgcccacagcaagtatacctttggctctccaaagtttgttttacaagctccagtataacgacactagtgttgcgacaaaagagctgacaaagtcgtttggttgggatacatatgattctttcatgcaacatgatgtccaagaactcaatcgagttctctgtgaaaaactcgaggacaaaatgaagggaactgttgtggagggaacaatacaacagctatttgagggtcaccatatgaattatattgagtgcataaatgtagattacaaatctacacgcaaagaatcattttatgaccttcagctggatgttaaaggctgcaaggatgtttatgcttcttttgacaaatatgttgaagttgaacgccttgaaggagacaacaaatatcatgcagaaggacatggtttacaggatgcaaaaaaaggtgttcttttcattgactttccaccagttcttcagctccagctcaagaggtttgaatatgactttatgagggacaccatggtgaagataaatgatcgctatgaatttcctctacaactggatcttgatcgcgagaatggaaagtatctatcccctgatgctgacaggagtgtccgcaacctttacacacttcacagtgtattagttcacagtggaggagtacgagtaacgaaggaagatttgaaaagggcattggaggagcaatatggtggtgaagaagagctaccgcagactaatcctggtttcaataaccctcctttcaaattcacaaagtactcgaatgcatacatgcttgtatatatccgagaaagtgacaaagataaaataatctgcaatgttgatgagaaagacattgccgaacatttaagggtgaggttgaagaaagaacaagaagaaaaggaagataaaagaagatataaggcacaagctcacctttttaccataattaaggttgcaagagatcaagaccttaaagaacaaattgggaaggatatatattttgatcttgttgatcatgacaaagtccgtagtttcaggatccagaaacagacaccatttcaacaatttaaggaggaggtggccaaagaatttggtgtacctgttcagttacagaggttctggatttgggcaaagcgacaaaaccacacctatcgtcccaatcgcccccttacgcctcaggaggaattacaaccggttggacaaataagagaagcatctaacaaggcaaacactgcagaacttaagctgtttttggaagtagagctgctggatgagcgtcctattcctcctcctgaaaaatcaaaagaagatattcttctattcttcaagctttatgaccccgagaagccagagctaaggtatgttggcaggctgatggtgaaaagttccagtaagcctatggatataactggaaaactgaatgaaatggctggctttgctcctgatgaagaaatagaactttttgaggaaatcaagttcgacccttgtgttatgtgcgaacacctggataagaaaacgtcattcagattgtgtcaaatcgaagatggagacatcatttgctttcagaaacctcttggtaacaaggaggttgaatgccgctacccagccgtgccttcgtttcttgaatatgtccagaatcgacagctggttcgatttcgtgctctggaaagacctaaagaagatgaatttgttctggagttgtcaaagttgcacacttatgacgatgttgtggaaagagtggcccagaagcttggtcttgacgatccatccaaacttaggcttacatctcacaattgctattcccagcaacccaagcctcagcctatcaaataccgtggagttgaccatttgtcagatatgttagttcactacaatcagacgtctgatattttgtattatgaagttctggacattcctcttccagaattgcaaggtcttaaaaccttaaaagttgctttccatcatgccacgaaggaagaagtggtaatccacaatatcaggctacctaaacaaagtacagttggggatgttattaatgaacttaaaacaaaggtggagctttcgcatccagatgcagagctgagattacttgaggtgttttaccacaagatctacaagattttcccatcaactgaaagaattgagaatataaatgaccagtactggactttgcgagctgaggagattccagaagaagagaagaatattggtccaaatgatcgcttaattcttgtgtaccactttgctaaggagactggacaaaatcagcaagtgcaaaactttggggagcctttcttcttggtaatccatgaaggtgaaactcttgaagaaatcaagaaccgtatccaaaagaagcttcatgtatctgatgaggactttgccaagtggaagtttgcatttatgtcaatggggcgtccggagtacttgcaggactcggatgttgtttacaatcgctttcagagaagagatgtctacggtgcttttgagcagtacctcgggttggagcacactgatactagtcctaagagggcttatgctgcaaaccagaaccgacacacgtatgagaagcccgtaaaaatatacaattagcccccaaaaaaacacaaatgtctccaagacattattgcagcaacgttggaccaaggcatcgaataagaggaggaaagaccgagtgtgaggtgtgatgatgaccgaccgtaggatgttgtagagaatttggtcttgatagggttttgggttgcgcattgatatttgatagtgtgtttttatttttctttattttctttctttcgtgcttcaatactttgtgttaatatatggaatgtgtgagactattggcacatcatgcaatttttattttcgaaaaaaaagaatatggaagcccgtcgcttggattcgggagcgcggttggctttcagagtttatagaataccgaaacatttgtaattttagagatttggggtttaagaagattttttttggctggcgattgtatagtttctgcatttgcaattattattagtttttgctttgtc

SEQ ID NO: 2459 - DNA, 3753 bp, Papaver somniferum
aacattactctgatgtcttcactgttggtgcttataaatggcgggtgctgatttttcccaagggaaacaatgtagatcacttatctatgtaccttgatgttgcggactcagctaatttgccgtatgggtggagtaggtatgcacagttcagtttggcaatcgtcaatcaaatccataacaagtacacagtgagaaaagatacacaacaccaatttactgcacgagaaagtgattggggttttacatcattcatgcctcttagtgaactttacgaccccggaagagggtatctcgtaaatgatacatgtatagttgaagcggaggttgctgtccgtaaaatcacggattactggacatatgactccagaaaggagacaggttatgttggtcttaagaatcagggagcaacatgttatatgaactctcttctccagactctgtatcatattccttattttagaaaggcggtgtaccatatgccaacaactgagaatgatttgccatcaggaagcatccctttggctctacagagtttgttttataagcttcagtacagtgacaatagcgtcgcaacaaaggagctgactaaatcttttggatgggatacatatgattctttcatgcaacatgatgtgcaggaacttaatagggttctttgtgaaaagcttgaagataagatgaagggaactgttgtggagggtacgatacaacagttgttcgaaggtcaccatatgaactacattgaatgcattaatgtggactacaaatctactagaaaggagtcattttatgaccttcaacttgatgtaaaaggctgtcgggatgtttatgcttctttcgacaagtatgtggaagtggagcgtcttgaaggtgataacaagtatcatgctgaacaacatggtttacaggatgcaaagaagggtgtccttttcattgacttcccacctgttctccaactccagctaaaacggtttgaatatgattttatgcgggatactatggtaaagataaatgatcggtatgaattccccctgcaacttgatcttgacagggaggacggcaaatacttatcaccagatgctgatagaagagtccgcaatctttacacacttcatggtgttttggttcacagtggtggggtacatggtggacactactatgcttttataagaccaacactgtcagagcaatggttcaaattcgatgatgagcgggtaacaaaagaagatatcaagcgggcattagaagagcagtatggtggggaggaggagttgcctcagacaaatccagggttcaataatacgccgttcaaatttacaaaatattcaaatgcatatatgcttgtgtatatacgtgaaagcgataaagataaaattatttgtaacgtggatgagaaggacatcgctgaacacctgaggattaggttgaagaaagaacaagaagaaaaggagcataaaaagaaagaaaaagcagaggctcatctgtataccattataaaggttgctcgaaatgaggacctttttgaacagattgggagggatatctattttgatcttgttgatcacgacaaagttcgcagttttcgtatccagaaacagatgccttttaacctcttcaaggaggaggttgctaaagagtttggtgtacctgtgcaatttcaacggttttggttatgggcaaagcgtcaaaatcatacttatcgtccaaaccgaccgttaacgcctcaagaggagacacaatctgttggacagttgagagaagtttcaaataaggctcacaatgcggaactaaagttattcttggaaatagagcttgggccggaatcacatcccattcctcctcctgatagaacaaaagaagatattcttctttttttcaagctttatgatgctgaaaaagaagaacttcggtatgtggggagactctttgtgaagggtagtggtaagcccttggaaattcttaaaaagcttaatgagatggctgggttctctccagatgaagaaatagaactttatgaggaaataaagtttgagcccacagttatgtgtgagcacatagacaagaagctcacattccgtgctagccagcttgaagatggagacattatttgcttccagaaacccacttcagctgatagtatgacactatgccgctatcctgatgttcctacttttcttgaatatgttcataaccgtcaggttgtgcatttccgatctttggagaagccgaaggaagatgatttttgtttagagctgtcaaaggtcttaacatatgatgatgtcacggaaagagttgctcgccatcttggtttggatgacccaaccaagatcagacttacccctcataactgttactctcagcaacccaaaccccaagctattaagtaccaaggtgttgaccacttgtctgagatgttggttcactacaatcagacatctgatattttgtattacgaagtcttggacatccctctaccagagttgcaaggtttgaaaactctaaaggttgcattccatcatgcaacaaaagaagataccgttgttcatagtattagacttccaaaacaaagtacagtaggtgacgtgataaatgatctgaagacaaaggttgagctgtctcatcccgatgcggaacttagattgttggaagttttctaccacaagatttataagattttcccgcttagtgagaagattgagaacattaatgatcagtactggactcttcgtgcagaggagattccagaggaggagaagaacttgggtcctcaggatcgcttgattcatgtttatcacttcacaaaggatgcatctcaaacccaaatgcaggttcagaattttggggaaccatttttcttaattatccatgaaggagagactttaggtgcagtcaaattgcgcatacagaaaaaattgcagattcctgacgaggaattcgctaagtggaagttcgcatttttgtcactgggccgtcctgagtaccttcaggactcagatgtagtgtccagccgttttcagagacgagatgtttatggagcttgggaacagtaccttggcctggagcattctgatagctcccccaaaagagcatatgcagccaatcagaatcgccatacatttgaaaagccagtaaaaatctacaactagggttaagctgataaagcctccgtgactacctactggaccctctaatccttcagcgacgtgtgcataaacgtgataagacaacaagatgggaattaatctttcatccgcttggagaatgaagctagcaatgaaatgaggtgtctgcagtgtttgcatattgattttgttgaattgtgtattctttctatacagcgcgttgattaaggctttttgctatatgttagtttttcctttccgctggttttccaactgtagctccttgaacgtctcttgttcttgggtaaagaaaaacaaacaaaaggacgaatatgaaggcccttgttgtagtagggtgtgaggtttgcagttgtcctctaaatcttattttccagtgtaatagtaggtatataagaagattttggactctttgtatatggtgtgtagctgttctgaggtgtcttgacattgcttttcttgtttttattcggtattaaagaattgggtttagttcagttcagacgcgttggtggatttgtacaagggttcatggtcttcttttcgtatatgtaaggtttgtgtaaaagaactttggcaatgctgttttcagccaagtcatacaaggatttat

SEQ ID NO: 2460 - DNA, 3798 bp, Ambrosia trifida
atgctcaggacaacacgcgagtgtctgtcttcgtttttccgcacacatttttttagggcatactctctctcatcatttacataaccttattatttctctctctagaatccaccgttgatcggccggtattcaccgcctgaataataataataataatgactattgtcactccccagccactagatcaagaagacgaggagatgcttgtgccgcatactgagatgctggacgggcctcaaccggtgcaaggtccggttgctttcgatggtactccgccgattgaagtccctcagccaatggaagttgtggggcaaccagaagtgaatcaagcagttgaggaacctcaggtctctaggtttacttggactattgagaatttctctcgcctgaccacaaaaagctctattctgatgtctttgtggtcggtggacataaatggcgtgtgcttatatttccaaagggaaacaacgtggaccatttatccatgtacttagatgtagctgattcctcatcattgccatatggttggagtagatatgcacagttcaacttggctgttattaatcaaattgacagcaagttcaccgtaaagaaagacacacaacaccagttccatgcaagggagagtgattggggattcacatctttcatgcctcttagtgatctttatgacccaagcagagggtttcttataaatgatacatgcattattgaagctgatgtggctgtaaggaaagtgattgactattggacatatgactcaaagaaggaaactggttatgttggtcttaagaaccaaggagcaacatgttacatgaactctctccttcaaaccttgtaccatatcccctacttcagaaaggctgtctaccatatgccaacaacagaaaatgatatccctacagggagtattcctctggctcttcagagcttattttataagctccaatacaatgaaaccagtgttgccacaaaagaactgacaaaatcttttggatgggacacatatgattctttcatgcagcatgatgttcaagagcttaatagggttttgtgtgagaaacttgaagacaagatgaagggaacagttgtggaaggcacaatacagaagttatttgaaggacaccatatgaactacattgaatgcgtcaatgtggacttcaaatcgacaagaaaagaatcattttatgatcttcaactggatgtgaaaggctgtcgggacgtttatgcttcttttgacaaatatgttgaagtggaacggcttgagggtgacaataaataccatgctgaagcacatgggttacaggatgctaagaagggtgtgttgtttattgattttccacctgttcttcaacttcagctaaagcgctttgagtatgatttcacaagggatacaatggttaagataaatgatcggtacgaatttccccttgagctcgaccttgacagggagaatggcaaatatttatctcctgatgctgataagagcgtccggaatctttatacacttcacagcgtattggttcatagtggcggtgtgcatggtggacactattatgcatttatcagacctactctgtcagaccagtggttcaagtttgatgatgaaagagttactaaagaagatatgaagagggcattagaagagcagtatggtggtgaggaagagctaccccaaacaaatcctggctacaataatgcaccctttaaatttacaaaatactcaaatgcctacatgcttgtttacatacgggaaaacgacaaagataagattatctgtgacgtagatgagaaagatattgcggaacatcttaggataaggttgaagaaagaacaagaagaaaaagaagacaagagaagatataaagcacaggctcatctctacactattattaaggtcgctcgtgatgcagacctgttagaacagataggcaaggatatatattttgatcttgttgatcatgacaaagttcataactttcgtatacagaaacaaacgccatttaaccaattcaaggaggaagttgctaaacagtttggcgtgcctgttcagtttcaacggttctggatatgggctaagaggcaaaaccacacataccgtcccaaccgccctttaactgctctggaggaaacccaatcggttggccaattgagggaagtttccaataagaataacaatgctgaactaaaattgttcttagagatagagattggaccggatttgcatcctcttccaccacctgacaaaagcaaggaagatatacttctcttttttaagctttatgatcctgagaaggaagaacttcgatacgttggtaggttttttgtgaagagttccagtaaaccaactgaaattatattaaaattaaatgagagagctggatttagtccagatgaagaaattgaactctatgaggaaataaaatttgagccatgtgtcatgtgtgaacgtcttgacaaaagatcctcgtttagatctagccagatcgaagacggagacattatttgttttcagaaactccctaaagctgaggggaaatgccgatatcctgacgtcccttcatttctagaatatgtgaaaaatcgtcagatcgttcattttcgatctctggataggcctaaagaagatgatttttgtcttgaactgtcaaaattgcatacatatgatgatgtggtggaacgagttgctcagaaacttaatctggatgacccatcaaaaattaggcttacccctcacaactgttattctcaacaacccaaaccccaccccataaagtatcgtgttgcagaacacctactagatatgctggttcactacaatcaggtttctgatattctttattatgaagtgttagacatccctctccctcaattacaatgtctgaaaactttgaaagttgcttttcaccattcaaataaagaagagcctgtaattcacaatattaggttgcctaagcaaagcactgttggagatgttctcaatgaattaaagtcaaaggttacattatctcatcaaaatgctgaacttagattgcttgaagtattctatcacaagatttacaagatctttcctctgactgagaagattgagaatataaatgatcaatactggacattacgtgctgaggaaattccagaagaagagaagaacctgggaccccaggatcggttaattcatgtttaccatttcaccaaagaggctgcccagaaccagatgcaagtgcagaactttggcgagcctttctttttgataattcacgaaaatgaaactttagcagatgttaaagtccgaattcaaaggaaattagaagttccagatgaggagttttctaagtggaagtttgcatttttatctttgggacgtcccgagtatctacaagattcagatgttgtatctagccgttttcagagaagggatgtttatggtgcctgggagcagtaccttgggttggaacattcggacaccacccctaaaaggtcctttacagcaaatcagaaccgtcactcgtttgagaagccagttaagatatataactaggagagtgctttgaagtaaatgaaaatttggtgaagtgactgcaatggttttgtttgtccaaagaacattcttatttggattctttccattgtttgtttgttggtgataattctttttcggaccgaggtgggggaatgagaatgataccaccaaaggtcgttctgatcttggcggtttatgtaggttttgtcatgtgtaatttaacagtaaacggtacataggaggaaattttgtttcaggagtgtacaaacagcagcagc

SEQ ID NO: 2461 - DNA, 3236 bp, Theobroma cacao
aatgatttattttaattttagttgctcaagttgagccggctagtacggttgagaatcagcaagtggaggatcctccatcaatgaagttcacttggacaattgagaatttttcaaggctcaataccaagaagcactattcagatatatttgttgttggtggttataaatggcggatactaatttttccaaagggaaacaatgtggatcacttgtcaatgtatcttgatgttgctgattcttctacattgccatatggttggagtagatatgctcagtttagcttggcggttgttaatcagatccatcacaagtattctataagaaaggacacccaacaccagtttaatgcaagagagagtgattggggtttcacctcatttatgcctcttagcgatctttatgaccctagcagaggatatcttgtgaatgatactgttgttgttgaagctgaggttgctgttcgtaagatactggattattggtcatatgactcaaagaaagagactggttatgtaggacttaagaaccaaggagcaacttgttacatgaactcgctcctgcagactctataccatataccatacttcagaaaggcagtgtaccacatgccaacaactgaaaacgacatgcctataggaagtattcctttggctctgcagagtttattttataagcttcaatataatgacactagtgttgcgacaaaggaattaaccaaatcttttggatgggatacgtatgattctttcatgcaacatgatgtacaagaactcaatcgagtcctatgtgaaaagcttgaagataaaatgaagggtactgttgtagaggggacaatacagcagttgtttgagggtcatcatatgaattatattgaatgcatcaatgtggattacaagtctacaagaaaggaatcattttatgaccttcagcttgatgtcaaaggttgtcgtgatgtttatgcttcttttgataagtatgtggaagttgagcgccttgagggtgacaacaaatatcatgctgaagagcatggcttacaggatgcaaagaaaggtgtcttatttatcgactttccccctgtacttcaacttcagctaaagcggtttgaatatgattttatgcgggatacgatggtgaagataaatgaccgctatgagtttcctcttcaacttgaccttgatagagaaaatgggaagtatttatcacctgaagcagataggagtgttcgcaacctttacacacttcacagtgtcttagttcatagcggaggggtgcatggtggacattactatgcttttatcaggccaaccctttctgaccagtggtataaatttgatgatgaacgggtaacaaaagaagatatgaagagggcattggaggagcagtatggtggtgaggaagagttgccacagaccaatcctggctttaataatacccctttcaaatttacaaaatactcaaatgcatacatgcttgtctatatacgcgaaagtgataaggacaaaataatatgcaatgttgatgagaaggacattgctgaacacttgaggataaggttaaagaaagaacaagaagagaaggaagacaaaaggagatataaagcagaggcccacctttatactattatcaaggttgcaagagatgaagatcttgcagaacagattggaagggacatatattttgatcttgtggatcatgacaaagttaggagtttccgcattcagaagcagatacccttccatgtttttaaggaggaagttgccaaagagtttggcataccggtgcaatatcagcgattttggatttgggcaaagcggcagaaccatacatatcgtcccaatcgaccattgacctctcaggaggaggcacaatctgttggacagttgagggaggtgtcaaataaggcacacaatgcagaactaaagctattcctagaagttgagcatggacaggatttacgcactattcccccacctgataaaacaagggaagatattttgcttttcttcaagctttatgatccggagaaaggagaattacgttatgttgggaggctcttggtaaaactttctggtaagccaatagaatatatagcgaagctaaatcaaatggctggctttgctcctgatgaagaaatagaactgtatgaggaaataaagtttgagccgtgtgtgatgtgtgagcaccttgataagagatgctcattccggttaagtcagatagaagatggggatatcatatgctttcagaagtctcctccgactgaaagtgaagaagcatgccgatatccagatgtgccttcattcctggaatatgtgcacaatcgccagattgttcgttttcgatctctggagagaccaaaggaagatgatttttgtctagagttgtcaaagatacatacttatgatgatgttgtggaaagagtggctcgcaaaattggtctggatgatccatccaaaatcaggctcacatctcacaactgctattctcaacaacctaagcctcaacctattaaatatcgaggagtagagcatctttcagaaatgttggtccactataaccagacttctgacattttgtattatgaagttttggatatccctttgccagaattgcaaggtctgaaaaacctgaaagttgctttccatcatgctactaaggatgaagtggttattcacaatattagattgcctaaacagagcactgttggaaatgtaattgatgaacttaagacaaaggtggagttgtcacatccaaatgcagagcttagattgcttgaagtcttctatcacaagatatataaggtagaaattgtctttccacccagtgaaaagattgagaacataaatgaccagtattggacattgcgtgcagaagaggcaagtatcccagaagaagagaagaatcttggtcctcatgatcgattgattcatgtctaccactttaccaaagagacttcccagaatcagatgcaagtacaaaattttggtgagccctttttcttggtcattcatgaaggtgaaactctggctgaagttaaagtgcggatacaaaagaaattgcaggttcatgatgaagagttcaccaagtggaagtttgcatttttgtcattgggtcgaccagagtatctacaagactctgacattgtgttcaatcgttttcagagaagagatgtttatggtgcttgggagcaataccttggtctagagcatcctgataacactcctaagagggcttat

SEQ ID NO: 2462 - DNA, 4614 bp, Cicer arietinum
tattgatgaactttagttgttactcaacctgaaactgccaacaccgtggatagtcagcctgtcgaggatccttcaccatcaagattcacttggagaattgacaacttttctaggatgaatacgaaaaagctctattcagaagtatttgttgttgggagttacaaatggcgtgtacttattttcccaaaaggaaacaatgtggactatttgtctatgtatttggacgttgcagattcaactagtttgccgtatggttggagtagatatgcacagtttagcttggcagtagttaatcaaatccataataagtactctgtgagaaaagatacgcagcatcagttcaatgcacgagaaagtgattggggtttcacgtccttcatgcctcttggtgaattgtatgatcctagtagagggtatcttatgaatgacactcttataattgaggccgaggtccttgtccgtaggattgttgattactggacttacgattcaaaaaaggagactggctatgttgggcttaagaaccagggagctacatgttatatgaattctctgctccaaactctgtaccatattccttatttccgaaaggctgtataccatatgcctacaacagagaatgacattccctctggaagcatccccttggctttgcaaagtttgttctacaagcttcagtatagtgacaccagtgtcgcaacaaaagagctgacaaaatcttttggatgggatacatatgattcattcttgcagcatgatgttcaagaactaaatagagtcctttgtgaaaaacttgaagacaaaatgaaggaaactgttgttgagggaactatacagaaactatttgaagggcaccatatgaactatatcgagtgcatcaatgtggactataaatcaactcgaaaggagtcattttatgatcttcaacttgatgtcaaaggctgtcctgatgtttatgcttcttttgacaagtatgttgaagttgagcgtcttgagggtgacaacaaatatcatgctgaacagtatggtttgcaggatgctaagaagggtgtcttgttcattgattttccccctgttttgcaacttcagctgaaaagattcgaatatgactttatgcgtgatactatggtaaagattaatgaccgttatgagtttccattgcaacttgatcttgatcgctacaatggaaaatatttatcacctgatgctgacaggaatgtgcgcaatctttacacacttcatagcgttctggttcacagtggtggtgtgcatggtggacattactatgcttttatcaggccgactctctctgatcagtggtacaaatttgatgatgagagggtgacaaaagaagaccctaaacgggcattagaggagcaatatggtggtgaggaagagttaccgcagacaaatcctggattcaataacactccttttaaattcaccaaatattcaaatgcttatatgctggtgtatatacgtgacactgacaaggaaaaaataatatgcaatgtggatgagaaagacattgcagagcatttaagggagaggttgaagaaagaacaggaagaaaaagagcacaaaaagaaagaaaaggcagaggctcacctctacactattataaaggtggcacgagatgaagaccttgaagaacagattggaaaggatatatattttgatcttgtagaccatgacaaagtgcggagtttccgtgtccaaaagcagacgccatttaacgttttcaaggaagaggttgctaaagagtttggtgtaccggttcaattccagcgcttttggctatgggcaaagcgtcaaaaccatacatatcgtcctaatcggccattgacacaaattgaggaagcacaatctgttggacaattgagagagatatcgaacaaggttcacaatgcagaattaaaattgtttttggaagtggagcgtgggccggatatatttcccattgcaccacctgagaagacaaaggatgatatattactttttttcaagttatacgatcctgaaaaagaggagctacgttatgttggaaggctctttgtgagcagtactggtaagccatcagaaatcatagcaaggttaaataaaatggctcgttatgatcctgatgaagagattggactttatgaggaaattaagtttgaaccaaatgtaatgtgtgagcctattgacaagaaattaacatttcgaggaagccagcttgaagatggagatattatatgctttcagaaagctcctgctatggacattgaggaacatatccgctatcctgatgtgccttcttacttggaatatgtgcacaatcgccaggttgttcactttcgatctctagataaaccaaaggaagatgacttttgcttggagatgtcaaggctttttacatatgatgatgttgtggagagagtagctcaaaaacttggtttggacgacccatccaaaatcaggctcaccccacacaactgctactctcaacaaccgaaacctcagcctattaagtaccgagggctggaacatttatctgatatgctggttcactacaatcagacatcggatatattgtactacgaagtacttgacatccctctgccagaattacaaggtttgaaaactctgaaagttgcatttcatcatgctacgaaggatgaagtagttatccataccatcagactcccaaagcagagcactgtgggagatgtacttgatgatcttaaaacaaaggttgagttgtctcgtcctgatgctgagcttaggttgcttgaagtcttctatcacaagatatacaaggttttccctcccaatgagaagattgaaaacataaatgatcaatactggacattacgagcagaggagattccagaagaagagaaaaatctcggtcctcatgatcgtttaatccacgtgtatcattttactaaagacacaactcagaaccaaatgcaaattcagaactttggggaacccttcttcttggtcatacatgaatgtgagtgtttggatgaaattaaagtgcgcatacagaagaaacttcaagttcctgatgacgagtttcccaagtggaagtttgcctttttttcattagggcgtcctgagtacctcgaggactcagacattgtatctagtcgttttcagagaagagaagtatatggtgcttgggagcagtatcttggcttggagcatactgataatgctcctaaaagatcatatgctgctaatcagaatcgtcacacatttgagaagccagttaagatttataattaggaagtcggtatggatgagttatcgtcttgcatgggatgactttagcgttcttctacatctatgggcttgtaaaaacagggaaagtagtgaaaggctaactctgcataggccaacttatgagatcagtgatcgaggtggtgtctgcaggttttttatattagaattgtgatatgtaattcttttttgatggagtgacattgctctccacattatgtatctgccgtccacagccccttgagcttttgactgcttccattggtgtatggaagttgttcttcatgttgaagtccttgatcatcatcactgcactgtatcagtacataagattttttggattagcgatagcgagtgtatacagggtatagttggttgtctttttttctcatcgtgattgcatccagattttgttcagttagcagtgttaattcaagtgagggctgcaaaatggtgtagcaaagttcatgtagtgtttgtaaaggagactttgcagcctccatatacttgttagcataaaatattccgcagcaccatttggttaatctcttctgtggctgctttactatcttctttctatcaccttaggattggaaggtatattagtcaataaaacagtctctaattaatctgaaaaagaaagaaacacacttcctgcccatataaagatgaaagggtcttaagttttgctaaccaatgcaaagagaaccacagagcacagacgaagaaaataatttaagcatgatcacagttaaaatccatttcctgcgtgtgttaaagctaaaataataataatagtccacctatatatgagactggttgtgtaacccgcttttagtgttattaaatgtcattgtttgaatccttattttattgtggaatgatttggctcgagtcagttgggtcacttgcccagaccaggttatacttatcccaagattatttgacagctagtatttatctgttttttgggtgaattgcaagagaaagggaaggatcaagctcatatttgagctggagaggttctaaaccaatagggggagagggtaaagtcgagttaatatccaatttgacatggagttatggaaccatagcaatatatatataggaagatccagctatctgaatctattgtcccgcattctctttttcttttttcattttaattgatgggtaattttgtgatgctgcacatgattgttgaattgcaggggcgtaaacataggtgaaatgtcagtagtttataatgacgcctttaccactcaatagtttattataaaaaaaactgctaaacaagataatgatgacaatatgtagtaatattatgtcatttctttaattatttgc

SEQ ID NO: 2463 - DNA, 4000 bp, Nicotiana benthamiana
tcgaattaattgcttctttggtttatctttggcagccagaagagcacgaaatgcttgttcccagttctgactttcctactgacggacctcagcctatggaagttgcaccagcggacacagcaagtacggtggatgcacaggctgtggatgatccggcgtcagcccggttcacatggactatcgataatttttcaaggttgaatgtgaagaagttgtactctgatgtttttaatgtaggaggatataaatggaggatattgatattcccaaaagggaacaatgtggacaatttatcaatgtatttagatgtggcagattctgcaacattgccgtacgggtggagtagacatgcacagtttagcttagctattctcaaccgaattcataacaagttcactgtgagaaaagatactcagcaccagtttaatccaagagagagtgactggggtttcacgtcattcatgcctcttagtgagctatatgatcctggaagaggttatcttgtggatgatactgtcatagttgaagctgatgttgccgtgcgtaaagtcattgattactggtcccatgactctaagaaggagactggctgtgttggccttaagaatcagggagccacttgttatatgaattctctcctccaaacactataccatattccctattttagaaaggctgtgtatcatatgccaacaactgagaatgacaatccttccagcagcatccctttggccttacagagcttgttttataagctccagtatagtgacactagtgtatcaacaaaagagttgacaaagtcctttgggtgggatacctatgattctttcatgcagcatgatgtacaagaacttaacagggttctttgtgaaaagctcgaagataagatgaagggaactgttgtggagggcacaatacaacaattacttgaggggcatcatatgaattatatcgaatgcatcaatgtggactacaaatcaacaagaaaagaatctttttatgatcttcagcttgatgtcaaaggattttgtgatgtgtatgcttcttttgacaagtatgttgaagtagaacgccttgagggtgacaacaaatatcatgcagaacaacatggcttacaggatgctcggaaaggtgtccttttcatcgacttccctcctgttcttcaacttcagttaaaacgcttcgaatatgattttgcacgggatgctatgatcaagataaatgaccgatatgagttccctttgcaactcgaccttgatagagagaatggaaaatatttatctccagatgcagatcgaagtgtccgcaatctctatactctgcacagtgttttagttcacagcggcggggtgcatggggggcactattatgcttatatcaggccaacactctctgatcaatggtataaatttgatgatgagcgtgtgacaaaagaagatacaaagagagctctggaagaacaatatggtggtgaggaagagttacggcacacaaaccctgggttcaacaattcaccattcaaatttacaaaatattcgaacgcgtatatgcttgtttatatacgtgaaagtgacaaggataagattatatgcaatgtggatgagaaggacatagctgagcatctcaggatacgattaaagaaagagcaagaagaaaaggaacaaaagagaaaggagaaagcagaggctcacctgtatacaatcatcaaggtagctcgtgatgaagaccttggtgaacaaatcggaaaggagatttattttgatcttctggatcatgataaagtgcgcagtttccgtattcagaaacagatgccatttactcaattcaaggaggaagttgcaaaagaattaggtatcccagtgcaatttcaacgttactggctatgggcaaaacgccagaaccatacatatcggcctaatcgtccattgacagctcaagaggaagttcaatccgttggccaactgagggaggtttcaaataaagcgaataatgctgagcttaaactgtttctggaagtagaatttggcctggatttgcaaccttttcctccaccagagaagaccaaggaagatatccttctatttttcaaactttatgaccctctgaaagaggagataaggtacgttggaaggctttttgtaaaaggaagtggcaagcctcttgagatattaacaaagctaaacgagttggctggctttttgcctgatgaagaaattgaactttttgaggaaataaaatttgagcccaatgtgatgtgtgaacacatagactggaagttgagtttttgcggcagtcagctagaagatggggatattatttgctttcagaaatcccttcgaaatcaagacagagaacaatatcgctttcctgaggttcctttgtttttggagtatgtgcacaatcgccaggttgttcgttttcgttcattggagaaacccaaggaggacgagttcagtcttgagttgtcaaagaagaacaactatgatgaagttgtggaacacttagctcgccatcttggcctggatgatgcatcaaaagtaaggcttacatcacataactgctactcacagcaaccaaaaccgcagccaataaggtatcgtggagttgatcgtctcacagaaatgctcagtcactataatcagacttcagatatcctgtattatgaagtcctggatattcctttaccagagctgcagggcttaaaagctctcaaagttactttccatcttgctgccaaagatgaagtcactatccatactatcagattgccaaaacaaagtaccataggggatgtccttaacgacctgaaaacaaaggttgagttaacaagaccggatgctgaactaagattactggaagttttttaccacaagatatataagatctttccccttaatgaaaggattgagaacataaatgatcaatactggacgctacgtgcagaggagattcctgaagaggagaaaaacctgggtcctcatagtcgattaattcatgtttatcattttatgaaggacacatctcaaaatcaagcacaaatacataactttggtgatccctttttcctggttattcatgagggtgacacgttgactgaagtcaaagctcgtattcagaaaaaattgcaggttccagatgaggagttttcaaagtggaaatttgcatttttatccatgggccgtccagagtacctcgaggactcggatgtcgtgtccaatcgttttcagaaaagagatgtgtatggtgcttgggaacagtaccttggattagagcacattgacaatgctccaaaaagatcacatgctgccaaccagaaccgacacacttttgagaaacctgttcggatctacaactagataatcttccaatttacttctacattagccggatgaccatcttcgaaggcaagcgtactattctgcaaagaaggtgctctaggttctgcaaaagatagcagcacggcagttaatgtggggatgtcactttcctccgaggaagttaaggtatatgctgagattttattgagcaagcacccgtttttggctaagggagttcgcttgcaaaattggtcacttcagttgtaatgtagggaatgcatacgattttgggttggtttgtatagaatatagctgttgctttcgacttttcctactttagaggagaacacatgttccttacatttctctttcgaagatatttgaccttctcagttatttctccccctgaatgtttggttctaggattggctgagataggaaatctgtaaaatgttagatttacttggtttttctgggttttccaggtttcatgcaacaaagagcttgatcatgatgctgctagtttttactctggcctcgtttaggattacctgaacacacttatttcaatacataaatttcaagtatagtatcatgttgaaacgaaattataatggactatttgaacgaacaattggttatagtttccagtttatggctatttctgtatatttttactgctc

SEQ ID NO: 2464 - DNA, 4074 bp, Picea glauca
ctttattatcttccatggcgttgtagggctaaattgaataaggggaatgtatgccgccgattcacaataagagttgcaatcggatttcggattggatagggcgggcgttagggcgtggaatgcatgcagcagcaacagcacaaggacggcgaaatgtggtgccccatccggattcaacaacgacacaattgaacccatggaagcaacagtagggcaagccgatacagtgagtacggctgagaaccagcctattgttgaggatcctccgacgtcaaaattcagctggacaattgaacatttatcaaagctaaatatgaaaaagcattattctgaaacttttgtagtaggaggatataaatggcgaattctaatatttccaagggggaacaatgtagatcacttgtcaatgtacttggatgtggcggattctagcactttaccatacggctggagcagatatgctcatttcagcctggctgttgtcaatcagattcattcaaagtacagtgttagaaaggacacacaacatcaattcaatacccgggagagtgattggggtttcacatcattcatgccacttttggatctttatgattcgggaaaaggttatttggtaaatgatactttggtaatagaagcagaagttactgttcaaagagggatggattacttgcaatatgattcaaaaaaggagacaggctttgttgggctgaaaaatcaaggagcaacatgttacatgaattcccttcttcagacattgtatcatataccttactttagaaaggcggtgtatcatatgcccacaactgaaaatgatgtaccatcaaatagcattcctttggctctacagagcttgttctacaaagttcaatacaacgataccagtgtgtcaacaaaagatttgacaaaatcttttggatgggatacatatgattcattcatgcagcatgatgtacaggagttgaaccgtgtattgtctgagaaattagaagacaaaatgaaggggactgctgtggagggtacaatacaacagctatttgaggggcatcatatgaattacatcgaatgtataaatgtagattataaatctacacgaaaagagtcattctatgatctacaacttgatgtcaaaggctgtcgagatgtctatgcatcatttgacaagtatgtggaggttgaaaaacttgaaggtgataataaataccatgcagagaactatggtttgcaggaagcaagaaaaggtgttctcttcattgatttccctccagtgctacaacttcagttaaagcgattcgagtatgatttcatgcgtgacacaatggtcaagataaatgatcgttatgagtttccgctgcagcttgatttggatagggagaatggaaaatatctttctccagatgcagacaggagtgtgcgtaatttgtacactctacacagtgttttggtccatagcgggggtgttcatggaggccattattatgcatttattaggccaactctctcagatcagtggtacaagtttgatgacgaacgcgttacaaaggaagatgttaagagggccctggaagaacagtatggtggtgaagaggagctgccacagacaaatcctgggttgaacaatactccatttaaatttacaaaatattcaaatgcttacatgcttgtctatgttagagagagcgataaggacaagattatctgcaatgttgatgagaaggatattgcagagcacctaagggtgagactaaagaaagaacaagaggaaaaagaactgaagcggaaagaaaaggcagaggcacatctttatacaattataaaggttgcccgtgataaagatctttctaatcagattggtaaggacatatattttgatcttgttgaccatgataaggtccggacgtttcggattcagaagcaagttccttttgtttctttcaaggaagaagttgcaaaagagtttggcattccagtgcaatttcaacggttttggctgtgggctaagcgtcaaaaccatacataccgtcctaacaggcccttgacacaaccggaggagtcacaatctgttggctacttgagggagacttcaaacaaggcgcacactgcagaattgagattgtttttggaagctgaatatagtcctgatcttcaattgctcccgcctcctgagaaaacaaaagatgatatacttctgtttttcaaactatatgatccagagaaagaagagctgaggtttgttgggaggctttttgtcaaggctgggggcaggccaatagaatatattacaaagttgaatgcaatggctggttttccagcagatgaggaaatcgatctttttgaggaaatcaaatttgaaccaaatgtcatgtgtgaactcattgaaaagagaagtccttttcgaactagccagcttgaagatggggacatcatttgttttcagagatcccttacctctgaagatgatttacatcgatatccggatgttccttcatttttggattatgttcataatcggcagattgtacattttcggcgcttggataagccgaaggaagatgatttttgtttggaactctcaaaactcttcacttatgacgatgttgtggagagagttgcacagcaacttgacttggatgatccctcaaaaatccgactcacagcgcataattgctattcacagcaaccaaagcctcaacccatcagatacagaggagtagaccacttaagtgatatgctagtacattataatcagatttcagacatcttgtattatgaaattctcgatatcccacttccagaactgcaagggctaaaaactttgaaggttgctttccatcattcaacaaaagatgaggtatctgtgcacagtattagactgcccaaacagagtagtgttggtgatgtcatcaatgagctaaagacaaaggttgagctttcaaatccaaatgcagatattagattgcttgaggtcttctaccacaaaatttacaagattttccccttgaatgaaaagattgagaacataaatgatcagtattggactttgcgagcagaggaggtcccagaagaggagaaaaatttaggtccccaggaccggctaattcatgtgtatcatttcacgaaggatgcttctcagaaccatatggtgcaaaactttggggagcctttcttttggctatccatgaaggcgaaacattagcagaagtaaaagaacgaataaaaaagaaattgcatgttcccgatgaagagttttgcaagtggaatttcgcattcatttctttgggtcgtcctgaatatcttcaagacccagacattgtgtctactcgttttcagaggcgagatgtgtatggagcttgggagcagtaccttggtttggagcattctgatagtgcccctaagaaatctcaccaagctaatcataatcgccacagctttgagaaacctgtaaagatatacaattaaatgcagaatggcactccctcaatatagactgaaggcctggacctttgggagtatttactttaatgaatggaattcaaggagtcatataattgtggtccttggtttggatgaacatgtgtcatccattttttggagtggcaactacgttttatttcatttcgttatacatgttctcactgcatacaattagtgttttactggtcacatattgttgagtatctgctaagttataaaatggaatattgtagtgtttttgtttgctatcagatagtaaaacagatggaatatgggaagatttgagaatcttggctttgatgccttgcaatgtgtcaaacttcttggtagtagtcatactgcgttagcgttgcatgccataatgagcggctgtttaaacgagttgctcatttgtttcttggaagagattctagttgtatttaggagattcttttgaagctgtataacatacccattttgtaatctattgcccctctgatattggagacatttggttttatacccacagatgacgataataacgacaacttacatttgtattggttctgacagatgttcaattaattggtgaatgtgacataattcttttgggttcatgta

SEQ ID NO: 2465 - DNA, 3721 bp, Taxus baccata
cgagactgtcagtaccgtggaaaatcaaccccccgaagatcctccttcatctagatttacctgggcaattgaaaacttttcaaggtttaaatgtgaagaaacattattctgatgtttttacagttggaggatttaaatggcgggtgctaatttttcctaaaggaaacaatgtagaccagctatctatgtatttggatgtggctgatgctgccacattaccttatggttggagcagacaagcacaatttagcctggctgttgtcaatcagattagctcaaaatattcaatacgaaaagatacacagcatcagttcaatgctcgagagagtgattggggtttcacgtcttttatgcctctaggagaaatttatgatccttcgaaaggttatctggtgaacgattcacttgttgtagaagcagatgttgtcgtccgaaaagttgatagttgttggcaatatgactcgaagaaagaaacagggtttgtgggactcaagaatcaaggagctacttgctacatgaactcactgcttcaaacactatatcatgttccttacttcagaaaggctgtgtatcacatgcctacaactgaaaatgacatgccatctggtagcattccattggccttacagagtttgttctataagcttcagtacagtgacagcagtgttgcaacaaaagagctgacaaaatctttcggctgggatacatatgattccttcatgcaacatgatgttcaggagttaaatagagtgctgtcggagaaactagaagacaagatgaaggggacagttgttgagggtacaatacagcaactctttgagggccatcacatgaattacattgagtgcataaatgtagattacaagtcaacaaggaaagagtcattctatgatctgcagcttgatgtcaaaggatgccgagacgtctatgcatcatttgataaatatgttgaagttgaacgccttgaaggagataataagtaccatgctgaacaacatggtttacaggatgcaaagaagggtgttctgttcattgattttccccctgtgctacaacttcagttaaagcgctttgaatacgatttcatgcgcgatacgatggttaagataaatgatcgttacgagtttcctttgcaacttgatcttgatagagaaagtgggaagtatctttctccagatgcagatagaagcgtacgcaatctgtacactctccatagtgttttagtgcatagtggaggcgtgcatggcggccattactatgcatatatcagacctactctctcagaccagtggtttaagtttgatgatgaacgcgtaacaaaggaggacatgaaaaaagcacttgaggagcaatatggaggggaggaggagctgcctcagacaaatccagggttcaacaacacaccatttaagtttacaaaatattcaaatgcgtacatgcttgtctatattagagagagtgacagagacaagattatctgtaatgtcgatgagaaggatatagcggagcatctaagggttagattaaagaaagagcaagaggaaaaggaacaaaaagaaaagagaaggccgaggcacacctttatacgattataaaggttgcccgcgacgtagatctttctgagcagattgggaaggatatattttttgatcttgtagatcatgacaaggttcgaagctttcgcattcagaagcaaacaccatttgcggttttcaaggaagaggtggcaaaagagttcgcaatccctgtacagtttctgcgattctggttttgggcaaaacgacagaaccatacctaccgtcccaacaggcctttgtcaccagcagaggagtcccagattgtttgtcacttgagagaggcttctaacaaggtgaacaatgcagagttaaaactatttcttgaaatagaactaagcccagatcttcatccacttcccctacctgaaaagacaaatgcggatatattactcttcttcaaactttatgatcccgagaaagaagagctaaggtatgttggcaggtcatttgtgaaggctttaggcaagcctactgaaattttaacaaagttgattgagttggccgggtttgcaccaaatgatgaaattgagctttttgaggaaatcaagtttgagccaaatgttatgtgtgagcatattgacaaaaggcttactttccgtggatgccaacttgaagatggggacattatttgttaccaaagggtcatttcaaaggaagatgaagagcaatatcggtttccagacgttccatcttttttggaatatgtgcacaaccgacagattgtccattttcggtgcctggagaagcccaaggaagatgacttttgtcttgagctatcaaaactctacacttatgacgatgttgtagatagagttgcaactaaacttggtctagacgatccttccaaaatcagacttacttcacacaattgttactctcagcaaccaaagccccagcctattaaatatcgtggcgtggatcacttatccgatatgctgattcattacaatcagacttctgatatcttgtactatgaagttctggacattccactcccagagttgcaagggctaaagactttgaaagtagcttttcatcattcaacaaaagatgaagtatctgttcacactataagattgccaaaacaaagcactgttggcgatgtcattaatgacctcaagacaaaggtggaattatccaaccctgatgccgaaattcgattgctcgaggttttctaccacaaaatttacaagatttttccacatcatgaaaagatcgagaatatcaacgatcagtattggactttacgagcagaggagattccagaagaggagaagaatctaggccctcatgaccgcttaatccatgtttaccattttaccaaagatgcatcccagaatcacatggttcaaaattttggagagcctttctttctgcttatccacgaaggtgagactctggcagaggttaaacaacgaatccagaagaagctgcaggtttctgacgatgaatttgccaagtggaagtttgcatttctctccttgggtcggcctgattatcttcaagacacagagattgtttcaagccgctttcagaggagagatgtttatggagcttgggagcaatatcttgggttggagcattctgacaatgccccaaaaagatcttaccaaactaatcagaaccgtcatacatttgaaaagcctgtgaagatatacaactgaaaccgaagctgaaaatgtgatacctttgtactgatagccacctacatttcaatgtaactatgattaattggagacaaattcgggtcccactattttttgaagcagtatatctggtttgtcgaaagcatagagaacattttctcacgtttgtctctactgaaagaacttacttagagagaagtttcttgccagctcatttctgtccatgtatttcatgtcggttcttgtatctggtagtcttctcttattatttaaatgagaagttaaaattgtgctttgtcttgatcttggaatgtgtcatgtacaagcctaagtttcttattgattctgtgccagaagtaactctggaagctgagaatcatgcaacatattttggaaaaaaagtactgcaagttggttcattatgtagaatcatgtgaggcctcatcaattttgttgtaatttagaattataatactggaatcgtctctgttgtataac

SEQ ID NO: 2466 - DNA, 3479 bp, Cannabis sativa
ctgagagagaataagagagaaagagtcgtcttggtcaggggtctttgcaatctctccttttctcgtcttctcctccatccattctcaaaattactattctgccctttctcgaactaaacccagcaacccccttctttccttctacgtcctcagttgcagactctctctctctctctctccctctccctccttccctctttctatttctctctcctagattcgacgatcgaacggcacccaatctccacccatgactctgatgactcctccaccgctcgatcaacaggaggacgacgagatgctggtcccacacaccgacttcgcccacggtcctcagccaatggaagtagctcaaccggaaaatacaaacgcagtggaggctcagccagtggatgatccaccatcagcgaggtttacgtggacaattgataactttacgaggcttaataccaagaaactatattctgacgtattttttgttggcggccacaaatggaggatactaatattccccaaaggaaacaatgtagatcacttgtcaatgtatttagatgttgctgattcgacagctctaccttatgggtggagtagatatgcccagttcagcttaagtgttgtcaatcaacttcagagtaaatattcagtaagaaaagaaacacaacatcagttcaatgcacgcgagagtgattggggtttcacttcattcatgcctctgggtgaattatatgatcctggtcgaggttatcttgtgaatgacacctgcatagttgaagctgatgttgctgtacgtagagttgttgattattggtcacatgactcgaaaaaagaaactggttatgttgggcttaagaaccaaggagctacatgttatatgaattctctcctccaaactctgtaccatatcccttactttagaaaggctgtgtatcacatgccaacaactgagaatgataatccatcaggaagtattcctctggctttgcagagtttattttacaagcttcagtatagtgacactagtgtagcaacaaaagagcttaccaagtcttttggatgggatacatatgattcatttatgcaacatgatgtccaagaactaaatagggttctctgcgaaaagcttgaggacaagatgaagggaactgttgtggagggtaccatacaacagttatttgaagggcatcatatgaactatatagaatgcatcaacgtggactacaaatcaacaagaaaagaatcattttatgatcttcagcttgatgttaagggctgtagggatgtttatgcttcttttgacaaatacgtggaagttgagcgtcttgaaggtgacaacaagtatcacgctgaacaatatggtttacaggatgctaagaaaggtgttctattcattgattttcctccagtccttcagcttcagctaaagcggtttgagtatgattttatacgagataccatggtgaagataaatgaccgctatgagttccctttgcaacttgatcttgatagggaggatgggaaatatctatcacctgatgctgacagaagcatccgcaatctttacactcttcatggtgtcttggtgcacagtggtggggtgcatggtggacactactatgcttatataaggccaactctatctgatcagtggtttaaatttgatgatgaacgggtgaccaaggaagatgttaaacgggcgttagaggagcagtatggtggtgaggaggagttaccgcaagcgaatcctggcttcaacaatgctccatttaaatttacaaaatattcaaatgcttatatgcttgtttatatacgtgaaagtgacaaggagaaaataatttgtaatgttgatgagaaagacattgccgaacacctgaggataaggttgaagaaggaacaagaagaaaaggaactaaagagaaaggaaaaagctgaagcacacctttatactatcataaaggttgcacgaaacgaggatctacttgaacagataggaaaagatatatactttgacctcgtggatcatgacaaagttcgaagttttcgtattcagaaacagatgccctttaatctgttcaaggaagaggttgccaaagaatttggcgtaccagtacaatttcaacgatactggctgtgggcaaagcgccaaaaccatacatatcggccaaatcgaccactgacacatatggaggaagcacaatctgttggacagctaagagaagtttcaaataaggcaaataatgcagagctaaagctgtttctggaagtagaggttggtctggatcagcgacctgttgctcctccagaaaagactaaagaggaaattctcatcttctttaagctttatgaccctttgaaagaagaaatgcggtacctagggaggctttttgtaaaggcaagcggaaagcctgctgagatattgaccaagttaaacgaaatggctggctttggtgctgatgaagaaattgaacttttcgaggaaataaagtttgagcctaatgttatgtgtgaacacattgacaagaaggccacttttcgtgctagtcagctcgaagatggagacatcatttgcttccagaaggctgctccagtgagtgaacagtgtcgctatcctgatgttccttcattcttagagtatgtggttcgctttcgctctctggagaaaccaaaagaggatgagttctgtctcgagctgtcaaagctctatacctatgatgacgtcgttgagaaagttgctcaccacctagggttgaacgatccctcaaaaatcaggctcacgtcgcataactgttactcccaacaacctaaaccccaacctatcaagtacagaggagtagaccatttgtctgacatgctgctgcattacaatcagacttccgatattctctattatgaaatactggatatccctctaccggaattgcaaggtctcaaaacgttgaaggttgctttccatcattcgaccaaggatgaagttgtcattcatactgttagattgccaaagcagagcactgtaggggatgtaattaatgatcttaaaacaaaggtagaattgtctcatcccgccgcagagattagattgcttgaggttttctatcacaagatttataagatttttccgcttaatgaaaaaattgagaatattaatgatcagtactggacattacgtgctgaagagatccccgaagaagagaagaactttggtcctcatgaccgcataatccatgtctatcattttatgaaggacacagctcagaaccagcaagttcaaaattttggggaaccttttttcttggtaattagagaggatgagactttagctgaggttaaagtgagaatacagaagaagttgcaagtccctgatgaggagttcgcaaagtggaagtttgcatttttgtcacttggtcgccccgagtaccttcaagacagtgatgttgtggccagtcggtttcaggtgctgagtttctttctctctctctctctct

SEQ ID NO: 2467 - DNA, 3861 bp, Valeriana officinalis
ttttctagtttttctccgttaaggccattgctgcctcctccttcgccgtcgccgttatcattcatcattcctggattcgctgatcggagtcctcacttttgctccgccatgaccatggtcactcaaccgttagatcaagaggatgaggagatgctagtgccacagccagagcaagttgaaggtcctcaactagttgaaggtcctcagcctatggaagttgctcaacctgaagcagttgccacagtagagaaccaagcagttgaggagcctcagacaactagacacacatggaaaattgaaaatttttctagacagacaacgaagaagctttactctgacgtttttactgttggaacatttaagtggcgtgttcttatttttcctaagggaaacaatgttgatcacttatctatgtatttagatgtggcagattcatcgacattgccgtatgggtggagtagatatgctcagttcagtttggctgttgttaatcaaattcattccaagtataccgtaaaaaaagatacgcaacatcagttccatggaagagagagtgattggggtttcacgtctttcatggctttaagtgagctatatgatcctggtaaaggatttcttgtgaatgatacatgtattattgaagctgatgttgccgtacgtaaagttgttgactattggacatacgattctaagaaggaaactggttatgttggtctcaaaaaccaaggagctacttgctatatgaattctcttcttcaaacactgtatcatatcccctactttcgaaaggctgtgtatcatatgccgactacagagaatgatatacctaccggaagcattcccttggctcttcaaagtttattctacaaactgcaatataacgatatgagtgttgctactaaagagttgaccaagtcttttggatgggacacttatgattcgttcatgcaacatgacgttcaagaactcaacagagtgttgagtgaaaagcttgaagataagatgaaggggactgttgttgagggtacaatacagaagttatttgaagggcacaatatgaattacattgaatgcatcaatgtagacttcaaatcaacaagaaaagagtcattttacgaccttcagcttgatgtgaaaggatgtcgagatgtgtatgcttctttcgataagtatgtggaggttgaacgccttgagggtgataacaaatatcatgctgaagaacacggtttacaggatgcaaagaagggtgtcttgttttcagacttccctcctgttcttcagcttcagttaaagcggtttgagtacgattttatgcgagataccatggtcaagattaatgatcgctatgaattccctctagaacttgatcttgatagggaagatggcaaatacctatcacctgatgcagaccgtagtgttcgcaatctttacactcttcacagtgttttggttcacagtggtggtgtgcacggcggccactattatgcttttatcaggccaactctttcagaacaatggttcaaatttgatgatgaaagagtaacgaaagaagacatgaagagagcgttagaggagcaatacggtggcgaggaagagctgcctcaaacaaatcctggattcaataacgccccatttaaatttacaaaatactcgaatgcttacatgcttgtttatatacgcgagagtgacaaggagaagattatctgtgatgtggatgagaaagaaattgctgaacacttgagaataaggttgaagaaagaacaagaagaaaaggaagataagagaaggtacaaagcgcaggctcatctttacactatcatcaaggttgcgcgtgatgaggatctagtagaacagataggcaaagatatttatttcgatcttgtggatcatgacaaagtgcgtagtttccgtattcagaagcagatgccatttaatcttttcaaggaggaagttgcaaaggagtttggtataccagttccgtgtatgcggttctggatctgggcaaagaggcaaaaccatacttaccgtcctaatcgacccttgacagctcaagaagactcccaatcggttgggcaattgagggaggtttctaataaaacacacaatgcagaactgaaattgtttctggaagtagaaactggactggacttgcggccaattcctttaccagagaaaactaaagaagatgtgctactcttcttcaagctttatgatcctgagaaagaagagcttcgatatgttggtaggctttatgtgagaagctctagcaagccacttgaaatcatggccagattgaatgaactagctggatttcaacctgacacggatcttgatctttttgaggaagtcaaattcgagcctggtgttatgtgtgaacggcttgataaaaagatttctttccgatttagtcagatcgaagacggagacattctttgcttccagaaacacttagaacctcaaaatgaagagcagtacagatatcctatagtttcatcgttcttggaatacgtgaaaaatcgccagattgtacattttcggcacttggagagacccaaggaggatgacttctgtctagagttgtcaaagcaacacacttatgacgatgttgttgaaagagtggccaagaaattgggcctggatgatccgtctaaaattcggcttactcctcacaattgttattctcagcaacctaaacctcatccaattaagtacagagttgcagagtgtcttctagatatgctcattcactacaatcagatttctgatattttatactatgaagtgctggatattcctcttccagaattacaatgtctgaaaaccttaaaagttgcttttcatcaagcagccaaggacgaggttgtaatttacaacatcagattgcctaaacagagcactgttggagacgtgttaaatgaaattaagacaaaagtggagctgtcgcatcctgatgcagaactcaggctgcttgaagttttttatcacaagatttataagatctttccgttaacagagaaaattgagaatattaatgatcagtactggactctgcgagcagaagagattcccgaagaagagaaaaatcttggtctccatgatcgcttgatccatgtctaccattttacaaaagagaccgcacagaatcaaatgcaggtccagaattttggtagaaccctttttcttgatcatacacgaaggtgaaacattagcagaagtcaaacttcgtattcagaagaaattgcaggttctggatgaagagttctctaagtggaaattcgctttcttatcactgggacgtcctgattatctccaagacaccgatgttgtttcaagccgtttccagagaagagatgtttatggagcttgggagcagtatcttggattagagcactctgatactactcctaagagagcttttgcggcaaatcagaaccggcacacatacgagaaaccagtaaaaatatacaactagaatgaggagttgtcggcagatctgaatatttaatgctcaatctcaatgtgtaaagacaagaaaaatcgaactgatggatgatgatacaggaaaaataacggacgagttctcagaggggatctaaaaatatatattatatatattattatatacatatattatataacatgggatttcatggtcgttttttcgggttttaggcgaaattattcttttctttgcacagacttattgctctttgttcttcagtttcttcgttttagcgtgtaattttaggagtacataagcaaacattacagaaaatttggaaaaagattttgattggcgattgtaaactgatcttttgatgtgttatattatagtgcgaatttttctttctccgtaaaaaa

SEQ ID NO: 2468 - DNA, 3709 bp, Brassica napus
ggatcctgctcagcccatggaagtttccgaaactgagactgctgtgagtactgtggagaatcagccagcagctgaggagcctcccactctgaaattcacgtggactatcccacacttctcgaggattaacaccaggaagcagtactccgatgtgtttgttgttggaggttacaaatggcgcatattgattttcccgaaagggaacaatgttgaccatttgtccatgtacttggatgttgctgatgctgcgagtttgccttacggctggagcaggtatgctcagttcagcctggctgttgtcaatcaagtccacaccagatacaccattagaaaagaaacgcaacatcaattcaatgcgagagaaagcgattggggatttacgtcattcatgcctcttagcgaactttatgatcctagtagaggatatttggcgaatgatactgtttacattgaagctgaagttgttgtgcgtaaggttcttgattattggtcttacgattccaaaaaagagaccgggtttgttggtctcaagaaccaaggtgcaacttgttacatgaattcgcttctacagacactataccacattccttacttcagaaaggctgtataccacatgccaaccactgagaacgatgcgcccacagcaagtatacctttggctctccaaagtttgttttacaagctccaatataacgacaccagtgttgcgacaaaggagctgacgaagtcgtttggttgggacacatatgattctttcatgcaacatgatgtccaagaactcaatcgagttctctgcgagaaacttgaggataaaatgaagggaactgttgtggagggaactatacaacagctatttgagggtcaccatatgaattatatcgagtgcataaatgtagattacaaatctacacggaaagaatcattttatgaccttcagctggatgttaaaggctgcaaggatgtttatgcttcttttgacaaatatgttgaagttgaacgccttgaaggagacaacaaatatcatgcagaaggacacggattacaggatgcaaaaaaaggtgttcttttcatagactttccaccggttcttcagctccagctcaaaaggtttgaatatgacttcatgagggattccatggtgaagataaatgatcgctatgaatttccgctggaacttgatcttgatagagaggatgggaagtatttatcccctgatgctgacaggagtgtccgcaacctttatacacttcacagtgtcttagttcatagtggaggagtacatggtgggcattattacgcatttataaggcccacgctctcagatcaatggtataaatttgatgatgaacgagtaaccaaagaagatttgaaaagggcactggaggagcaatatggtggtgaagaggagctaccacagactaatcctggtttcaataaccctcctttcaaattcacaaagtactcgaatgcatatatgcttgtatatatccgggaaagtgacaaagataaaataatctgcaacgttgatgagaaagacattgctgagcacttaagggtgaggctgaagaaggaacaagaagaaaaggaagacaaaagaaaatacaaggcacaagctcacctttttacgataattaaggttgcaagagatcaagaccttaaggaacaaattgggaaggatatatattttgatcttgttgatcatgacaaagttcgtagtttccggatccagaaacagacaccatttcaacagtttaaggaggaggtggccaaggaatttggtatacctgttcagtgtcagaggttctggatttgggcaaagcgacaaaaccatacctatcgtcccaatcgcccccttacacctcaggaggaattacaaccggttggacaaattagagaagcatctaacaaggcaaacactgcagaacttaagctgtttttggaagtagagctgctggatgaacgtcctattcctcctcctgaaaaatcaaaagaagatattcttcttttctttaagctttatgaccccgagaagcctgagttaaggtatgttggcagactgatggtgaaaagttccagtaagcctatggatataactggaaaactgaatgaaatggctggctttgctcctgatgaagaaatagaactttttgaggaaatcaagtttgagcctggtgttatgtgcgaacacctggataagaaaaattcattcagattgtgccaaatcgaagatggagatatcatttgctttcagaaacctgttgttaacaaggagattgaatgccgctacccagctgtgcctttgtttcttgaatatgtccagaatcgacagctggtccggtttcgtgctctggaaaaacctaaagaagatgagttcgttctggagttgtcaaagttgcacacttatgacgatgtcgtggaaagagtggcggagaagcttggtcttgacgatccatccaagcttaggcttacatctcacaattgctattcccagcaacccaagcctcagcctatcaaataccgtggagtagaccgtttgtcagacatgttagttcactacaatcagacgtctgatattctgtattatgaagttcttgacattcctcttccagaattgcaaggtcttaaaaccttaaaagttgcttttcatcattccacgaaggaagaagtggtaatccacaatatcagactacctaaacaaagcacggtcggagatgttataaatgaactaaaaacaaaggtggagctctcgcatccagatgcagaactgagaatacttgaggtgttttaccacaagatctacaagatttttccattaactgaaagaattgagaatataaacgaccagtactggactttgcgagctgaggagattccggaagaagagaaaaacattggtccaaatgatcgcttaattctcgtgtaccactttgctaaggaaactggacagaatcagcaagtgcaaaactttggggagcccttcttcttggtaatccatgaaggtgaaactcttcaagaaatcaagaaccgtatccaaaagaagcttcatgtatcagatgaagactttgccaagtggaagtttgcgttcatgtcaatgggacgtccggagtacttgcaggactcagatgttgtttacaatcgctttcagaggagagatgtctatggtgcttttgagcagtatctggggttggagcacactgataccactcctaagagggcttatgctgcaaaccagaaccgacacgcgtatgagaagccggtgaagatatacaattagccgagaaaaagaaaaggcaaatgtcatcaagacattgtggaagctacgttggaccaaaagggatcgaataagagatggaaagaccgagtgtgaggtgtgatgatgaccgaccgtataatgttgtaggagaatttggtctgaacagggttttgggttgcgcattgatggtgtgtttttatatatttctttcgtgcttcaatacgtttttgtgttcatgtatatggaatgtgcgaagactatttgcacatcatgcaatttttattttcgaaacaaaagaatatggaagaagcccgtcacttgaactcgggagttaatagaatagccaaacatttgtaactttttagagattcgggtttaagaagattttttctgactggcgattgtaatagtttattgcatttccaataattatttagaaaaaggctgctaggaaat

SEQ ID NO: 2469 - DNA, 4116 bp, Oryza sativa
caaaaacctcctcccccccttctcattctctctcttctctctcctccacctccccacctcctcgcgatctccacccccacaccccacccccaaccccgcgacccactcccaggtgggccccacatcgccgccggcgaccgcgactcatctcctcggctcccgcgccgccgcgtccgcgcggccatgacgacctctcccccgccaccgccgcccgccgagcagcagcagcaacaggaggaagaggaggtgctcgtgccgcgccaggagttgcccaacggaacgcagccaatggaagttgtgccttctgagccagccgccactgtggaaaaccagcagattgaagatccaccaatctctagatttacttggaccattgagaacctatcaagagtgagcacaaagaaactctactctgaaatttttgttgttgggggctacaagtggcggattttgattttcccaaggggaaataatgttgaatatctgtctatgtatttggatgtggctgattcagcagtcctgccttatgggtggactagatatgcgcagttcagcctctctgtggtcaatcaaatgcacaacaagtttacaataagaaaagaaacacaacatcaattctctgctcgagaaagtgattggggttttacttcctttatgcctttgggtgatctctacaaccccagtagaggctatcttgtaaatgatacttgtatagtggaggccgaagttgctgtatgtaaggtggttgattattggagctatgactctaaaaaggaaactggttatgttggtctgaaaaatcaaggtgctacttgctatatgaattctcttcttcagactctgtaccatattccatatttcagaaaggctgtttatcatatgcccacaactgagaatgacatgccttcgggaagcattccattagctctgcaaagtctcttttataagctgcagtataatgacagcagtgtctctacaaaggaactcacaaaatcttttgggtgggacatgcacgattcattcatgcaacatgatgtgcaagaactaaatagagttctttctgagaagttggaagataagatgaagggaactgttgtggagggcacaatacaacaattatttgaagggcatcacatgaattatatcgagtgtatcaatgtggatatgaaatcaactagaaaggaatccttctatgatcttcagcttgatgtcaaaggttgtcaggatgtctatgcttcttttgataagtatgtagaggtggagcgcctggaaggagataacaagtatcacgcagaacaatatggactgcaggatgcaaagaaaggtgttcttttcatcgacttccctcctgttttgcaacttcagctaaaacgctttgaatatgatttcatgcgtgatacaatggtaaagataaatgaccgctatgagttcccgattcagttggatcttgatagagatgatggaaagtacctctctccagatgcagataggaatgtgcggaatctttacactcttcacagtgttctcgtccatagtgggggtgttcatggtgggcattactatgctttcatacggcctactctttctgatcagtggtttaagtttgatgatgagcgtgtaacaaaagaggatgcaaagagggcattggaagagcaatatggtggtgaggaggagctacctcagactaatcctggtctaaacaatactcctttcaagttcactaaatattcaaacgcatacatgcttgtgtacattcgcgaaagtgacaaggacaaaataatttgtaacgtggatgagaaggacatagcagagcaccttcgaattagattagaaaaggatcgtgaggaaaaggagcgtcgaaagaaggagaaagctgaggcccacctatatactatcattaaggttgcaagggatgatgacttgaccactcaaatagggaaggacatatattttgatcttgttgatcatgataaggtcccaagtttccgcatccagaagcagatgcctttcactcaattcaaggaggaggttgcaaaagagtttggtattcctacccaatttcaaagattttggctgtgggccaagcgacaaaaccatacataccggcctaaccgtccactgactcctcaagaagagacgcacacagttggacagctaaaagaagcagcaaataaggctcataacgcagaactaaaattgttcttggaggttgaacttggactggaccttaaacctcttcctctgcctgacaagaccagagaagatatattgcttttcttcaaactctatgatcctgaaaaggaacaactgcggtatgttggtaggctctttgttaaggcttcgggaaaacctcaggacattctgccaaaactgaggaaaatggctggtttttcacaggatgaggaaattgaactttatgaggaaatcaagtttgagcccaatgtaatgtgtgaatatattgacaataggcttctatttcgagcttgccagcttgaagatggtgacatcgtttgttttcaaaaatctccaaagccagatactgctgaccaatatagataccctgatgtcccatcctttctggtgtatatacggaaccggcaggtagtccattttcgttcattggagaagcccaaagaggatgatttttgtttagagatgtcgaaggctttcacgtatgatgaagtagtggaaaaggtggctcaaaaacttggtgttgatgacccaactaaaattcggcttacatcgcataactgttattctcaacaacctaaacctcaacctattaaatacagaggtgttgagcgtttgctggacatgctgattcactataaccagacttctgatattctttactatgaagtattggatataccactcccagaattacaagctctgaagacattaaaagttacatatcatcatggcacaaaagatgaggtgtcagttcacagtattaggttgccaaagaacagcactgtcggtgatgtgctaaatgatataaaatcaaaggttgagctgtctcatcctaatgctgagcttagactacttgaggttttctatcacaagatatacaagatttttgcaccgaatgaaaagatagaaaacatcaatgatcagtactggaccctgcgtgcagaggaggttccggaggaagagaaaaatcttggtccttttgatcgcttgattcatgtataccattttaccaaagacactcaaaatcagacgcaagttcagaactttggagaacctttctttatggttattcgtgaggatgaaaccctttcttctattaaagaacggatacagaaaaaactaaaagttccagatgaggatttctcaaagtggaaatttgcctacatatcacttggtcgcccagattattttgaggattcagacactgtagcttcaagatttcagcgaaacatgtatggagcttgggagcaatatcttggactggagcatccagacacggctcctagaaagacacacaacgctaatcagaaccgccattcatttgagagacctgtaaagatctataactagacttgagaaatttgagtgacgtgccgccatccaacaccaagcaagggcctgaaaagtgctggcttgaataaattgtgtaccataattgatggtaggacgggttgctcaggtttttcgatggagctagaaagcatgcatggtgtttcctgaggagacgttttttagtatctgaggcagtttctcatcttccgcaacttgccccagatatataaagttgtgcagagatgacccatcgtctttcatcagtagataaggcggtattttccagtagtcatacagttaaaatagctcaagttttcttcgttgatcacatggttctgcagttgtactaggactccgagctgtttatacctgttgccctgtaaattatccatgtacaagggtttttcttgctctgacggcagtcaacacggtattgtaattccagctataaatatattgttgcctcttatatacttttatctgattggcagttcgctatctcctgagatcatttggagtacatgagagctttcaggaatcaggactggctattctgtgaacgaccgctttttaattaaacaaacatattcc

SEQ ID NO: 2470 - DNA, 3335 bp, Nicotiana benthamiana
tcaaattaattgcttctttggtttatctttggcagccagaagagcacgaaatgcttgttcccagttcagactttcctactgaggggcctcagcctatggaagttgcaccagcgaacacagcaagtacagtggatgcacaggctgtggatgatccggcatcagcccggttcacatggactatcgataatttttcaaggttgaatgtgaagaagttgtactctgatgtttttaatgtaggaggatataaatggaggatattgatatttccaaaagggaacaatgtggacaatttatcaatgtatttagatgtggcagattctgcaacattgccttacggatggagtagacatgcacagtttagcttagctattctcaaccgaattcataacaagttcactgtgagaaaagatactcagcaccagtttaatgcaagagagagtgactggggtttcacgtctttcatgcctcttagtgagctttatgatcctggaagaggttttcttgtggacgatgctgtcatagttgaagctgatgttgccgtgcgtaaagtcattgattactggtcccatgactctaagaaggagagtggctgtgttggcctcaagaatcagggagccacttgttatatgaattcgctcctccaaacactataccatattccctattttagaaaggctgtgtatcatatgccaacaactgagaatgacaacccttccagcagcatccctttggccttacagagcttgttttataagctccagtatagtgacactagtgtatcaacaaaagagttgacaaagtcctttgggtgggatacctatgattctttcatgcagcatgatgtacaagaacttaacagggttctttgtgaaaagctcgaagataagatgaagggaactgttgtggagggcacaatacaacaattacttgaggggcatcatatgaattatattgaatgtatcaatgtggactacaaatcaacaagaaaagaatctttttatgatcttcagcttgatgtcaaaggatgtcgtgatgtttatgcttcttttgacaagtatgttgaagtagaacgccttgagggtgacaacaaatatcatgcagaacaacatggtttacaggatgctcggaaaggtgtccttttcatcgacttccctcctgttcttcaacttcagttaaaacgcttcgaatatgattttgcacgggatgctatgatcaagataaatgaccgatatgagttccctttgcaactcgaccttgatagagagaatggaaaatatttatctccagatgcagatcgaagtgtccgcaatctctatactctgcacagtgttttagttcacagcggcggggtgcatggggggcactattatgcttatatcaggccaacactctctgatcaatggtataaatttgatgatgagcgtgtgacaaaagaagatacaaagagagctctggaagaacagtatggtggtgaggaagagttaccgcacacaaaccctgggttcaacaattcaccattcaaatttacaaaatattcgaatgcgtatatgcttgtttatatacgtgaaagtgacaaggaaaagattatatgcaatgtggatgagaaggacatagctgagcatctcaggataagactaaagaaagagcaagaagaaaaggaacaaaagagaaaggagaaggcggaggctcacctatatacaatcatcaaggtagctcgtgatgaagaccttggtgaacaaatcggaaaggagatttattttgatcttgtggatcatgataaagtgcgcagtttccgtattcagaaacagatgccatttactcaattcaaggaggaagttgcaaaagaattaggtataccagtgcaatttcaacgttactggctatgggcaaaacgccagaatcatacatatcggcctaatcgtccattgacagctcaagaggaagttcaatccgttggccaactgagggaggtttcaaataaagcgaataatgcggagctgaaactgtttctggaagtagaatttggcctggatttgcaaccttttcccccaccagagaagaccaaggaagatatccttctatttttcaaactttatgaccctctgaaagaggagataaggtacgttggacggctttttgtaaaaggaagtggcaagcctcttgagatattaacaaagctaaacgagttggctggcttttttcctgatgaagaaattgaactttttgaggaaataaaatttgagcccaatgtgatgtgtgaacacatagacgggaagttgagttttcgcggcagtcagctagaagatggggatattatttgctttcagaaatcccttcgaaatcaagacagagaacaatatcgttttccggaggttcctttgtttttggagtatgtgcacaatcgccaggttgttcgttttcgttcattggagaaacccaaggaggacgagttcagtcttgagttgtcaaagaagaacaactatgatgaagttgttgaacacctagctcgccatcttggcttggatgatgcatcaaaagtaaggcttacatcacataactgctactcacagcaaccaaaaccacagccaataaggtatcgtggagttgatcgtctgacagaaatgctcagtcactataatcagacttcagatattctgtattatgaagtcctggatattcctttaccagagctgcagggcttaaaagctctcaaagttactttccatcatgctgccaaagatgaagtcactatccatattatcagattgccaaaacaaagtaccataggagatgtccttaacgacctgaaaacaaaggttgagttatcaagaccggatgctgaactaagattactggaagttttttatcacaagatatataagatttttccccttaatgaaaggattgagaacataaatgatcaatactggacactacgtgcagaggagattcctgaagaggagaaaaacctgggtcctcatagtcgattaattcatgtttatcattttatgaaggacacatctcaaaatcaagcacaaatacataactttggtgatccatttttcctggttattcatgagggtgacacgttgactgaagtcaaagctcgtattcagaaaaaattgcaggttccagatgaggagttttcaaagtggaaatttgcatttttatccatgggccgtccagagtacctcgaggactcggatgtcgtgtccaatcgttttcagaaaagagatgtgtatggtgcttgggaacaataccttggattagagcacattgacaatgctccaaaaagatcacatgctgccaaccaggtatgcacttgtgctctatgt

SEQ ID NO: 2471 - DNA, 3327 bp, Nicotiana benthamiana
atgaccatgctgaatcctcaaccgttggatcagcaggaagaagaggagatgcttgtgccacattctgacttagttgaaggtcctcagcccttagttgatgggcctcagcccatggaagtggcacctgctgagaatgctagtacgggggagaaccaagccgtggacgagccacaggcatcccggtttacgtggacaattgacaatttctctcggttatctgtgaagaagctatattctgaggcttttgttgttggtagttataaatggcgagtgcttatatttccaaaaggaaacaacgtggactgtttgtcaatgtatttagatgtggcagattcatctacattgccatatgggtggagcagatatgcccagttcagcttagctgttgtaaatcaaataaaccccaaatattcagtgaaaaaagagacgcagcaccagtttaaccaaagagagagtgactggggcttcacatctttcatgcttctaagtgatctttatgaccccaataagggatatcttgtaaatgataaagttgttattgaagccgatgttgcagtacgaaaggtcattgattactggacatatgactcaaagaaggagacaggatatgttgggcttaagaatcaaggagctacttgttacatgaactctctcctacaaaccttgtaccatatcccctactttagaaaggctgtgtatcacatgccaactacagaaaatgacatgccatcagggagcatcccattggctctgcaaagtttgttttataagctccagtatagtgataccagtgtggcgacgaaagaattgacaaaatcttttggatgggacacttatgattcattcatgcagcatgatgtgcaagaactaaacagagttttgtgtgaaaagcttgaagacaagatgaagggtacggttgtggaagggacaattcaaaagttatttgaggggcaccatatgaattacatagaatgtatcaatgtggacttcaaatcaacaagaaaagagtcattttatgatcttcaactcgatgtcaaaggctgtcgcgatgtttatgcctcttttgacaaatatgttgaagttgaacgtttagaaggcgataataagtaccatgctgaagaacatggtttgcaggatgcaaaaaaaggtgtactatttattgacttccctccagttctccagcttcagttaaaaagatttgaatatgatttcatgcgagatacaatggttaagataaatgaccgttatgaatttcctctggaacttgaccttgatagggagaatggcaaatatttgtctcctgatgcagataggagcgtccggaatctctacacacttcatagtgtgttggttcatagcggtggtgtgcatggtggacactattatgctttcatcaggccaacactatcagatcaatggtataagtttgatgatgaacgggtgacaaaagaagacttgaagagggctctagaggaacaatatggtggagaggaggagttgccacagacaaatcctggcttcaataacactccctttaagtttacaaaatactccaatgcgtacatgcttgtttatatacgtgagagtgacaaggataaaataatttgtgatgtcggggagaaagacattgcggaacacctaaggataaggttgaagaaagaacaagaagagaaggaggacaaaagaagatacaaagcgcaggcccatctttatacaattatcaaggtggcacgtgatgaggatcttagggagcagataggaaaggagatatattttgatcttgttgatcatgacaaagttcgtagctttcggattcagaaacagatgccttttaaccttttcaaggaggaagttgcaaaagaattgggtatcccagttcagttccagcgtttctggatttgggcaaagcggcaaaatcacacttatcggcccaatcgcccattaactccgcaggaggaactacaaaccgttgggcagttaagggaagtttctaacaagaccaacaatgccgagttaaaattatttttggaagtggaccctggcctggatctcgttcctagtcctccacctgacaaaagtaaagatgatatactccttttctttaagctttatgatcctgagaaagaagagcttcaatatgttggtaggctttttgtgaagagtactagtaagccaagtgaaatacttccaaaactgaatgaactggctggatttgctcctgaccaagaaattgacctttttgaggaaataaaatttgaaccttctgtcatgtgtgaaagactagacaaaaaggcttcatttcgatttagccagattgaagatggtgacattatatgctttcaaaagaaagcttctcctgaagttgaagaacaagtccgatttccggatgttcctgcatatctggaatatgtaaaaaatcgccagattgtccactttcgagcactggagaaaccgaaggaggatgatttctgtctggagttagcaaaaagtgatacatatgatgatgtagtggagagattggcacagcggcttggcgtggatgatccctccaaaattaggcttactccacacaactgctactctcagcaacccaagcctaaccccatcaaatatcggtccgtggatcatttggtagacatgctaatccattacaatcagatttctgatattctttattacgaagttctggacattcctctgccagaattacaatgtttgaagacgctcaaagttgcttttcatcatcctacgaaggatgaggttgaaattttgaatgtaagattgcctaagcagagtaccgtgggggatgttcttaatgaaatcaaatcaaaggtagagttgtcccatccaaatgcagaccttagattactcgaagtcttctatcacaagatttataagatctttccgctcgctgaaaagattgagaatataaatgaccagtattggacattgcgggcagaggagataccagaggaggagaaaaatcttggtccccatgatcgtctaattcatgtttaccatttcacgaaagcgactccacaaaatcaaatgcaagtgcagaattttggagaacctttctttctggtcatccatgaatgtgaaactttagcggagattaaagtgcgcattcagaagaaattgcaggttccagatgaggagttttctaagtggaaatttgcatttttatcattggggcgcccagaataccttcaggattcggacgttgtatccagccgctttcagaggagagatgtttacggtgcttgggagcagtaccttggattggagcatgcagattatacatctaagaggccatatgttagtcag

SEQ ID NO: 2472 - DNA, 3819 bp, Olea europaea
cagcaggaagaagaagagatgctggtgccgcactcagatttagtagagggtcctcagcctttagtagaaggccctcagcctatggaagtaggaccagcagagaatcctgggacagtggaaaaccaggcaagtgatgagccacaggcatcacggttcacgtggatgatcgagaacttctctcgcttgaatgtaaagaagctgtattctgaagtctttattgttggaggttataaatggagggttcttatttttccgaaaggaaacaatgtggactacctatcaatgtatttagatgtggcagatgcagctaccttaccatatgcgtggagtagatatgcacaatttagcttggctgtagtcaatcaaatgcatagcaagtacacagtaaagaaggatacacatcaccagttcaatcagagggagagtgattggggtttcacttctttcatgcctctcagtgagctgtatgatcccagtaaggggtatcttgtcaatgatacatgtgttattgaagccgatgttgctgtgcgtaaggccattgattactggacttatgactcaaagaaggagacaggttatgttggactcaagaaccagggagcaacttgttacatgaactctctccttcaaactttgtaccatattccttacttcagaaaggctgtgtatcatatgccaacaacagagaatgatatgccctcagggagcattcctttggctttgcagagtttattttataagctccaatataatgacaccagtgtggctacaaaagaattgactaaatcttttggatgggacacttatgattcctttctgcagcatgatgtgcaagaacttaatagagttttgtctgagaagctcgaagacaagatgaagggaactgtagttgaagggaccatacagaaattatttgaagggcaccatatgaattacattgaatgtataaatgtggacttcaaatctacaagaaaagaatctttttatgatttacaacttgatgtcaaaggctgtaaggatgtttatgattcctttgataagtatgtggaagttgagcgccttgaaggtgataacaagtatcatgctgaagaacacggcttgcaggatgccaggaagggtgtcttgttcattgacttccctccagttcttcagcttcagctaaaacgttttgagtatgattttatgagagatacaatggttaagataaatgaccgctatgaatttcctctggaacttgaccttgatagagacaatggaaaatatttgtcgcctgaagcagataggagtgtccgcaacctttacatgctccatagtgttttggttcatagtggcggtgtgcacggtggacattattatgctttcataaggccaacgctctctgaccagtggtacaaatttgatgatgagagggtcactaaagaagatatgaagagagctttagaggaacagtatggtggtgaggaagagttgccgcaaacaaatcctggctacaacaacaccccatttaaatttacaaaatactcgaatgcctacatgctggtgtatatacgtgtgggtgataaggataagataatatgtgatgttgatgagaaggacatcgctgaacatcttaggatgagactgaaaaaagaacaagaagtgaaggaggacaagaggagatataaggcgcaggcccatctttataccatcatcaaggttgcccgagatgaggatttgaaggaacagattggaaaggatatatattttgatcttgttgatcatgataaagtccgcagctttagaattcagaaacagacgccttttaaccttttcaaggaggaggttgctagagaatttggtataccagttcaattccagcgcttttggatttgggcaaagaggcagaatcacacatatcgtccgaaccgtccattgacaccacaggaggaagcacaaactgttggtgcattgagggaagtctccaataaagctcataatgctgagctgaagttgtttttggaagtcaaacatggccaggagctacatccctttcctcctcctgacaaaactaaggaagacatacttctgttctttaagctttatgatcctgagaaagaagaactcaggtatgttggtaggttttttgtgaaaagctctggcaagccgatggagatcttgacaaaactaaatgaattggctggatttgctcctgatgaagagattgaactctttgaggagataaaatttgagcctactgtcatgtgtgaacgcctcgacagaagagcttcatttaggtttagccagattgaggatggggacattatctgtttccaaaagaagcttctcccagaaggtgaagaaaaattccgatatcctggagttccttcatttttggaatatgtgaaaaatcggcagactgtccattttcgtgctctggagagacccaaggaagatgaattctgcctagagttagcaaagaaccacacttatgatgatgttgtggaaagggtagctcagcaccttgggttggatgatccatctaaaattaggcttactcctcataattgctattctcagcaaccaaagcccaatcccatcaagtatagatcggttgatcgcctattagacatgcttgttcactacaatcagatctcagatattctttattatgaagtactggacattcctctaccagaattgcaatgtctgaagactctgaaagttgcctttcatcatgcgacaaaggatgaggcagtagtactcaatattagattgccgagacaaagcacggttggagatgtgcttaacgagatcaaaacaaaggtagagttgtctcatccaaatgcagaacttaggttgctggaagttttctatcacaagatttacaagatctttccgctcaatgagaagattgagaatataaatgatcaatactggacattgcgtgctgaagagattccagaagaagagaagaaccctggtcccaatagccgattgattcatgtttaccattttaagaaggagaatgctcagaatcaagtgcaagtacagaattttggggaacccttctttttggtcattcatgatgctgaaattctagcggatgttaaaatgcggattcaaaagaaattgcaggtacctgacgaggaattctctaagtggaagtttgcttttctctcactgggacgtccagaatatcttgaggactctgacattgtctccagccgttttcagagaagagatgtttatggtgcttgggagcagtaccttgggttagagcattctgacactacacctaaaagggcttatgctgcaagccagaaccgccacacattcgagaaagctgtgaaaatatacaactaaatggaattgcttcttaatattcttgctctgaggcaacacataaatgtgacgaaggtgaaatctgtgattcgtataggagagtgttaacgcagaaaaaaggttagctgatggaagttttttctcccctccgcgtttctgtacatttggtggtttgttaaactagaattaatttttgacttggaatggaaaaagaggagctttcgcttccaaatttaatttgcttttagtggttggtattatatatttgctctcttcaggaattatttatggttcctgtgaaatttaatcctacataccaagattttggttactagggttagcccttactatttcagcccgactcgtttttcttttccctgtattttcgtacccccttaatttgttgtatttcaaattatatgtacaggggatagggttgtaaaggaaactattatgctcctttttagaggagatctatattaattatctgagctttta

SEQ ID NO: 2473 - DNA, 3969 bp, Panicum virgatum
ctcctccacctccccacccctcgcgatctccacctccccccgtaacccacttcaggctggggtcccacatcgccgccggcgacccagcgcctccccgtcccctctctccctgcgcgccaccccgcgacgcgcgcgtcctaccggctatgacgacctcgccgccgccccctccgcccgccgagtcgcagcagcaacaacaggaggaagacgaggtgctcgtgccgcaccaggagctgcccaatggaacgcagccaatggaagttgtgcctgctgagccagctgctactgtggaaaaccaacagatagaggatccaccaatctcgagatttacttggactattgagaatctatcaagagttagcacaaagaagctctactctgaagtttttattgtcggaggctacaagtggcggattttgattttcccacgaggaaataatgttgaattcttgtctatgtatttggatgtggccgattctggagtcttgccatatggatggactagatatgcacagttcagcctctctgtggtcaatcaaattcacaacaagtttacaataagaaaagaaacacaacatcagttctctgctcgagaaagtgattggggtttcacttcatttatgccgttgggtgaactctacaatcccagtagaggttatcttgtaaatgatacttgtatagttgaagctgaggttgctgtgtgtaaagttgttgattattggagttatgactctaaaaaggaaactggttatgttggtctcaaaaatcaaggtgctacttgctacatgaattctcttctacagacactgtaccacatcccgtatttcagaaaggctgtttatcacatgcccaccactgaaaatgatatgccctcgggaagcattccattagctctacagtcactgttttataagttgcagtataacgacagcagtgtctctacgaaggagctcacaaaatcattcgggtgggacatgcatgattcatttatgcaacatgatgttcaagagttaaatagagttctttctgagaagttggaagataagatgaagggaactgttgtggagggcacaatacaacaattgtttgaagggcaccatatgaattacatcgagtgtatcaatgtggatttcaaatcaacaagaaaagaatccttctatgatctccagcttgatgtcaaaggttgtcaggatgtctatgcgtcatttgataagtacgttgaggtggagcgtctggaaggtgacaacaagtatcatgccgaacagcatggccttcaggatgcaaagaaaggagttcttttcattgacttccctcctgttttgcaacttcagctaaaacgttttgaatatgatttcatgcgtgatacaatggtgaagatcaatgaccggtatgagttcccacttcagttggatcttgatagagataatggaaaatatttatcacctgatgctgacaggaatgtgcggaatctttacacccttcacagtgttcttgtccatagcggtggtgttcatggtggacattattatgctttcatacgacctactctttctgatcaatggttcaagtttgaagatgagcgtgtaacaaaggaagatgcaaagaaggcactggaagaacaatatggcggtgaggaggagctacctcagacaaatcctggcttaaacaacactcctttcaagtttaccaaatattcaaatgcatatatgcttgtgtacattcgtgaaagtgacaaggacaaaattatttgtaatgtggatgagaaagacatagcggagcatcttcgtattagattggaaaaagaccgtgaagagaaggagcgcaggaaaaaagagaaagctgaggcacacctctataccatcatcaaggttgcgagggatgatgacttaaaagctcagataggaaaagacatatattttgatcttgttgatcatgataaagttccaagcttccgtatccaaaagcagatgacctttactcaattcaaggaggaggtagcgaaggagtttggtattcctacacagtttcaacgattttggctgtgggccaagcggcaaaaccatacttaccggcccaaccgaccattatctcctcaagacgaagcacacagtgttgggcagttaaaggaactggtgaacaaggcccacaacgctgaactgaaattgttcttagaagttgaacttggactggaccttaagccgcttcctcttccagagaagacaagagatgatatatttcttttcttcaaactctatgaccctgaaaaggaagagctgcggtatgttggtaggctctttgtaaaggcttcaggaagaccacaggacattctgccaaagttaaggatgttagcggggttctcacaagacgatgatattgaactttttgaggaaattaagtttgagcccaatgtgatgtgtgaatacattgataacaggcttctgtttcgatcttgtcagcttgaagatggggacataatttgttttcaaaaatctccaaagccagatagtgctgaccgatatagattccctgatgtcccgtcctttttggtgtatatacgtaaccgacaggtggtccacttccgttcactggagaagcctaaggaggatgatttttgtctagagatgtcaaagattttcacgtatgatgaagttgtggaaaaagtggctcaaaaactaggagtggatgacccatcgaaaattcgtcttacatcacataattgttattcgcaacaacctaagcctcaaccaataaagtacagaggcgttgaacgtctactggacatgttgattcactataaccagacttctgatattttgtactatgaggtattggacataccacttccagaattacaagcgctgaagacattgaaagttacttatcatcatgccacaaaagatgaggtgtcagttcacagtataagattgccaaagaacagcactgttggcgatgtgctaaacgatatcaaatcaaaggttgagttgtctcatcccaatgctgagctaaggttacttgaggtcttctatcacaagatatataaggtttttgcgccaagtgaaaagatagaaaacattaatgatcagtactggacattgcgtgcagaggaggttccagaggaggagaaaaaccttggtccctttgaccgcttgattcatgtataccattttacaaaagatactcaaaaccaaacgcaagttcagaacttcggagagccattttttatggttattcgtgaggacgaaaccctatcttctatcaaggaacgtatacagaaaaagcttaaggttccagatgaggatttctcaaagtggaaatttgcatacatttcacttggccgtccagactattttgaagattcagatattgtggctacaaaatttcagagaaacatgtatggagcttgggagcagtatcttggactggaacatccagacacagctcctaggaaggcacacacggttaatcagaaccggcattcatttgagagacctgtaaaaatttataactaggcaagttaggaatttgaacgatgagccaccacccaatgggtaagggctgaaattgctggcttgaaataaagtgtgccatagtcggggcgtgttgcttaggttttcaacgaagctgatgagctagtttcagaggaggctttttcagtctttccccgttttgccctggatatataaagttgtgcagagatgaccccaccgaaccattatctttcagtagataagctggtatttcgtgttaggtgactttatacagtcgaatagccgacgctttcagttgttgacactttgttcaacagttgttggtactaggaggcctggagctgttaagggtactagtcctgtatattattgacgcggagtgtaaaagcctcagtcgttgacaatcacacgatgtttgtaattctcaatgatatatttctgtctttttgcatgtttgtatttgtatttgattgttgaagat

SEQ ID NO: 2474 - DNA, 3342 bp, Nicotiana benthamiana
aatctctgaaatcactctttctttgggaataattcagcagcaggaagaagaggagatgcttgtgccacattctgacttagttgaaggtcctcagcccttagtcgaagggcctcagcccatggaagtggcacctgctgagaatgctagtacgggggagagccaagccgtggatgagccacaggtatcccggtttacctggacaattgacaatttctctcggttatctgtgaagaagctgtattctgaggcttttgttgttggtagtcataaatggcgagtgcttatatttcctaaaggaaacaacgtggattgtttatcaatgtatttagatgtggcagattcatccacattgccatatgggtggaacagatatgcccagttcagcttagctgttgtaaatcaaataaaccccaaatattcagtgaaaaaagagacacagcaccagtttaaccaaagagagagtgactggggcttcacatctttcatgcttctaagtgatctttatgaccccaataagggatatcttgtaaatgataaagttgttattgaagccgatgttgctgtacgaaaggtcattgattactggacatatgactcaaagaaggagacaggatatgttgggcttaagaatcagggagctacttgttacatgaactctctccttcaaaccttgtaccatatcccctactttagaaaggctgtgtatcacatgccaactacagagaatgacatgccatcggggagcatcccattggctctgcaaagtttgttttataagctccaatatagtgataccagtgtggcaacgaaagaattgacaaaatcttttggatgggacacttatgattcattcatgcaacatgatgtgcaagaactaaacagagtgttgtgtgaaaagcttgaagataagatgaagggtacggttgtggaaggcacaattcaaaagttatttgaggggcaccatatgaattacatagaatgtatcaacgtggacttcaaatcaacgagaaaagagtcattttatgatcttcaactcgacgttaaaggctgtcgggatgtttatgcctcttttgacaaatatgttgaagttgaacgtctagaaggcgataataagtaccatgctgaagaacatggtttgcaggatgcaaaaaaaggtgtactatttattgacttccctccagttctccagcttcagttaaaaagatttgaatatgatttcatgcgagatacaatggttaagataaatgaccgttatgagtttcctctagaacttgaccttgatagggagaatggcaaatatttgtctcctgatgcagataggagcgtccggaatctttacacacttcatagtgtgttggttcatagtggtggtgtgcacgggggacactattatgctttcatcaggccaacactgtcagatcaatggtataagtttgatgatgaacgggtgacaaaagaagacttgaagagggctctagaggaacaatatgggggagaggaggagttgccacagacaaatcctggcttcaataacactccttttaagtttacaaaatactccaacgcatacatgcttgtttatatacgtgagagtgacaaggataaaataatttgtgatgtcggtgagaaagacattgcggatcacctaaggataaggttgaagaaagaacaagaagagaaggaggacaagagaagatacaaagcgcaggcccacctttatacaattatcaaggttgcacgtgatgaggatcttagggagcagataggaaaggagatatattttgatcttgttgatcatgacaaagttcgtagctttcgaattcagaaacagatgccttttaaccttttcaaggaggaagttgcaaaagaattgggtatcccagttcaattccagcgtttctggatttgggcaaagcggcaaaatcacacttatcggcccaatcgcccattaactccacaggaggaactacaaaccgttggtcagttaagggaagtttccaacaagaccaacaatgcagagttaaaattatttttggaagtggaccttggcccggatctcgttcctagtcctccacctgacaaaagtaaagatgatatactccttttctttaagctttatgatcctgagaaagaagagcttcaatatgttggtaggctttttgtgaagagtactagtaagccaattgaaatacttccgaaactgaatgaattggctggatttgctcctgaccaagaaattgacctttttgaggaaataaaatttgaaccttctgtcatgtgtgaaagattagacaaaaaggcgtcatttcgatttagccagattgaagatggtgacattatatgctttcaaaagaaagcttctcctgaagttgaagaacaagtccgatttccggatgttccttcatatctggaatatgtaaaaaatcgccagattgtccactttcgagcactggagaaaccgaaggaggatgatttctgtctggagttagcaaaaagtgatacatatgatgatgtagtggagagagtagcgcaacggcttggtgtggatgatccctccaaaattaggcttactccacacaactgctactctcagcaacccaagcctaaccctatcaaatatcggtccgtggatcatttggtagacatgctaatccattacaatcagatttctgatattctttattacgaagttctggacattcctctgccagaattgcaatgtctgaagacgctcaaagttgcttttcatcattctacgaaggatgaggttgaaattttgaatgtaagattgcctaagcagagcaccgtgggggatgttcttaatgaaatcaaatcaaaggtagagttgtcccatccaactgcagagcttagattactcgaagtcttctatcacaagatttataagatcttaccgctcactgaaaagtttgagaatataaatgaccagtattggacattgcgggcagaggagataccagaggaggagaaaaatcttggtccccatgatcgtctaattcatgtttaccatttcacgaaagagactccacaaaatcaaatgcaagtgcagaattttggagaacctttctttctggtcatccgtgaaggtgaaactttagcggagattaaagtgcgcattcaaaagaaattgcaggttccagatgaggagttttctaagtggaaatttgcatttttatcattggggcgcccggaataccttcaggattcggacattgtatccagccgctttcagaggagagatgtttatggcgcttgggagcagtaccttggattggagcatgcagataatacatctaagaggccatatgttagtcaggtaaattc

SEQ ID NO: 2475 - DNA, 4221 bp, Brachypodium distachyon
cacccaaaacctccccccgctttctctctcctccacctccccccgcacacaccccacctcgcgatctccacgccccccccgcaacccactactcccggggcgggtcccacatcgccgccggcgaccccatcctccccttccgcccgcccgcgacatgacgatctcgcaaccgcccccggcgcctaccgagccgcagccacagcaggaggaagaggaggtgctcgtgccacaccaggagctgcccaatggagcgcagccaatggaagttgtgcctgctgagccagctgctacagtagaaaaccagcagatagaggatccaccgatctcgagatttacttggacaattgataacctatcaagagtgaacacaaagaagctctactctgaaacttttgttgtcggaggctacaagtggcgtgttttgattttcccaaggggaaataatgttgaattcttgtctatgtatttggacgttgccgattcagcagtcttgccctatggatggagtagatatgcacagttcagtctctcagtggttaatcaaatccacaacaagtttacaataagaaaagaaacccaacaccaattctctgcgcgagaaagcgactggggtttcacctcatttatgcctttgggtgaactctacaaccctagtagaggttatcttgtaaatgatacttgtatagtggaagcagaggttgctgtctgtaaggttgttgattattggagttatgactccaaaaaggaaactggctatgtgggtcttaaaaatcaaggtgccacttgctatatgaattctctccttcagactctctatcacattccttatttcagaaaggctgtatatcatatgcccactaccgagaatgatatgccctcagggagcattccattagctcttcaaagtctcttttataagttgcagtataatgacagcagtgtctcgacaaaggagctcacaaaatcatttgggtgggacatgcatgattcatttatgcaacatgatgtgcaagaactaaatagagttctttctgagaagttggaagataagatgaagggtactgttgtggagggcacaatacagcaattatttgaagggcatcacatgaactatatcgagtgtataaatgtggattttaaatcaacaaggaaggaatccttctatgatttgcagcttgatgtcaaaggttgtcaggatgtatatgcttcatttgataagtacgtggaggtagagcgtctggaaggtgacaataagtaccatgcagaacagcatggtttgcaggatgcaaagaaaggtgttcttttcattgacttccctcctgttctgcaacttcagcttaaacgttttgaatatgatttcatgcgggacacaatggtgaagataaatgatcgttatgagttcccacttcagttggatctcgacagagatgatgggaagtatttatctcctgatgcagataggaatgtgagaaatctttacactcttcacagtgttcttgtccacagcggtggcgttcatggtggacattactatgctttcatacgacctactctttctgatcagtggttcaagtttgatgatgaacgtgtaacaaaagaagacccaaaaagggcattagaggagcaatatggtggtgaggaggagctgccacagactaatcctgggttaaacaacactccttttaagttcactaaatattcgaacgcatacatgttggtatacattcgtgaaagcgacaaggacaagataatttgtaatgtggatgagaaagacatagctgagcaccttcgaattagactggagaaggaccgtgaagaaaaggagcgccggaaaaaggagaaagctgaggcccacctatataccatcattaaggttgctagggatgatgacttgactgctcagataggaaaagacatatattttgatcttgttgatcatgataaagtcccgagcttccgtattcagaagcagatgccttttacccaattcaaggaggaggtagcaaaagacttaggtattcctacgcagtttcaacgattttggttgtgggccaagcggcaaaaccatacttaccgacccaaccgaccattaactcctcaagaagaagcactcactgttgggctgttaaaggaagcagcaaacaaggcccacaatgcagaactgaaattgttcctggaagttgaacttggactggatttaaaaactatcgctctgccagacaagaccagggaggacatattgcttttcttcaaactttatgatcctgaaaaggaacagctccggtatgttggtaggttcttcgtgaaggcttctggaaggccactggatattctgccaaaattgagaaaaatggctggtttttctcaagatgatgatattgaactttatgaggaaattaagtttgagcccaatgtgatgtgtgaatacattgataatagggttatatttcgatcttgccagcttgaagacggcgatattgtctgctttcaaaaatccccaaagccagataatgctgaccaatacagataccctgatgtcccatcctttctggtgtatatacgtaacagacaggtagtccacttccggtctttggagaagcccaaggacgatgatttttgcctagagatgtcaaagattttcacatacgacgaagttgtagagaaagtcgctcaaaaacttggtgttgatgacccatcaaaaattcgtcttacatcacataattgttattctcaacagcctaagcctcaaccaattaagtacagaggcgttgaacgcttgctagatatgctgattcactataaccagacttctgatattctatactacgaagtattggatataccccttcctgaattacaagcgttgaagacattgaaagttacatatcatcatgccaccaaggatgaggtgtcagttcacagtatcagattgccgaaaaatagcactgttggtgatgtcctaaatgatatcaaatcaaaggttgatctgtctcatcctgatgctgaacttaggttactcgaagttttctaccacaagatatacaagattttcgcacccagtgaaaagatagaaaacatcaatgatcagtactggacactgcgtgcagaggaggttccggaggaggagaaaaaccttggtccttttgaccgcttgattcatgtataccattttaccaaagacactcagaatcaaacgcaagttcagaattttggagaacctttctttatggttattcgtgaggatgagacgttatcttctattaaagaacgtctacagaaaaagcttaaggtgtcggatgaggatttctccaagtggaaatttgcatacatatcacttggtcgcccagactattttgaagattcggatactgtagccacaagatttcagagaaacatgtatggagcttgggagcagtatcttggactggagcacgcggacacagctccaagaaaggcacacactgctaatcagaaccgccattcatttgagagacctgtaaagatctataactaggctgttatcagaaatacaagtgacgtcctgccatgcaatacctagcaagtggctgaaactgaaaatgctggcttgaataaattgtgtaccataatttggtggcaaagactggttgctcaggttcatgacggagccggtcagctagtttcagaaatcggaggagaccttttcagtaccatctgggctccccctcatctttcccccactctgccctggatatatgaagtttgtgcagagatgacccaacgaacaatcacctttcagtagataaggctgtcttttttctattaggtgctctatacagtcgaatagccgaagttttagtgtatgactttgttctgcagttggtgctaggtgtcagagatacatttcctgtatattattgatgtgaagtgtacaagtctttatcttgtttgatggtcacatggtatttgtaactccagtgatgatatagtggtgcgttcttttgacagatttgtattgtactatctgagtacccctctgctattttctaagacgtaggatgtttgattttattttattttgagatttgatttttgccaaaggtctcccgcggtttgtccatttccgaccactgatctttcagctcgaaccttttttttacaagtatatactccttccgtcccatattaagtgattcaaatttgttaaaaatgtatgtatctatgcttaaaatgtgtatagat

SEQ ID NO: 2476 - DNA, 3956 bp, Secale cereale
tcgcgatctccacgcctctcgcaacccactcccggggcgggccccacatcgccgccggccacccctggtcccctctcccgtcgctatgacgatctccacaccgcccccggcgcccgcagagccgcagccgcagcaggaggaagaggaggtgctcgtgccgcaccaggagctacccaacgggacgcagccaatggaagttgtgcctgctgagccagctgctaccgtcgaaaaccagccaacagaggatgcaccaatctcgagatttacttggaccattgataacctatcaagagtgaatacgaagaagctctactctgaaacttttgttgttggtggctacaagtggcgagttttaattttcccaaggggaaataatgttgaattcttgtctatgtatttggatgttgccgattcagcagtgttgccctatggatggactagatatgcacagttcagcctctcagtggttaaccaaattcacaacaagtttacaataagaaaagaaacacaacatcagttttctgctcgagaaagcgattggggtttcacttcatttatgcctttgagtgaactctacaatcccagtagaggttatcttgtaaatgatacttgtgtaatagaagcagaggttgctgtgtgtaaggttgttgattattggagttatgactctaaaaaggagactggctatgttggcctcaaaaaccaaggtgccacttgctatatgaactctctccttcagactctctatcatattccatatttcagaaaggcggtttatcatatgcccactactgagaatgatatgccctcaggaagcattccattagctcttcaaagtctcttttataagttgcagtataatgacagcagtgtttccacaaaggagctaacaaaatcttttgggtgggacatgcatgattcatttatgcaacatgatgtgcaagaactaaatagagttctttctgagaagttggaagataagatgaagggaaccgttgtggagggcacaatacaacaattatttgaagggcatcacatgaactatatcgagtgtatcaatgtggactttaaatcaacaaggaaggaatccttctatgacctacagcttgatgtcaaaggttgtcaggacgtctatgcttcattcgacaagtatgtggaggtggagcgcctggaaggtgataacaagtatcatgcggaacagcatggattgcaggatgcaaagaaaggtgttctctttatcgacttccctcctgttctacaacttcagctaaaacgttttgaatatgatttcatgcgtgacacaatggtgaagataaatgaccgttatgagttcccacttcagttggatcttgatagagatgatgggaagtatttatctcccgatgcagacaggaatgtgcgaaatctttacactttgcacagtgttcttgtccatagtggcggtgttcatggtgggcattactatgctttcataagacctacgctctctgatcagtggttcaagttcgatgatgagcgtgtaacaaaagaagatgcaaagagggcattggaagagcaatatggtggtgaggaggagctaccccagactaatcctggcttaaacaacactccgttcaagtttaccaaatattcaaacgcatacatgcttgtatacattcgtgaaagcgacaaggacaaaataatttgtaatgtggatgagaaggacatcgctgagcaccttcgaattagactggaaaaggaccgtgaagagaaggagcgccggaaaaaggagaaagctgaggcccacctatataccatcattaaggttgctagggatgacgacttgactgctcagatagggaaagacatatattttgatcttgttgatcatgataaagtcccgagctttcgtattcaaaagcagatgccttttactcaattcaaggaggaggtagcaaaagaattgggtatccctacacagtttcaacgattttggttgtgggccaagcggcaaaaccatacctaccgacccaatcgaccgctgactcctcaagaagaagcactaactgttggacaattaaaggaagcagcaaacaaggcccacaacgcagaactgaagttgttcttggaagttgaacttggactggacctaaaacctcttgcgctaccagagaagaccagggaggatattttgcttttcttcaaactctatgatcctgaaaaggaacagctgcggtatgttggtaggctctttgtgaaggcttcaggaagaccacaggatattctgccaaaattgagaaaaatggctggttttttgcaagatgatgatgttgaactttacgaggaaattaagttcgagccaaatgtgatgtgtgaatacattgataataggattatatttcgctcttgccagctggaagatggtgatattgtttgttttcaaaaatccccaaagccggatactgctgaccagtttagataccctgatgtcccatcatttctggtgtatatacgtaacagacaggttgtccacttccgatcgttggagaaggccaaggaggatgatttttgcctagagatgtcaaagattttcacgtacgatgaagttgtagaaaaagtcgctcaacagcttggtgttgatgacccatcaaaaattcgtcttacatcacacaattgttactctcaacagcctaagcctcaacccattaagtacagaggcgttgaacgtttgctagacatgctgattcactacaatcagacttctgatattctgtactatgaagtattggatatacccctgccagaactacaagcattgaagacactgaaagttacatatcatcatgccaccaaggatgaggtgtctgttcacagtataagattgccaaaaaatagcatggttggtgatgttctaagtgatatcaaatcaaaggttgacctgtctcatcctgatgctgaacttcgattacttgaagttttctaccacaagatatacaagatttttgcacccagtgaaaagatagaaaacatcaacgatcagtactggacactgcgtgctgaggaggtaccggaggaggagaaaaaccttggtccttttgatcgcttgattcatgtataccattttaccaaagacactcaaaaccaaacgcaagttcagaattttggtgaacctttctttatggttattcgtgaggatgagcccttatcttctattaaagaacgtttacagaaaaagcttaaggtctcagatgaggatttctccaagtggaaatttgcgtacatatcccttggtcgcccagactattttgaagattctgacactgttgctacgagatttcagagaaacatgtatggagcttgggagcagtatcttggactggagcaccccgacacagcgccaagaaaggcacatagtgctaaccagaaccgccattcatttgagaggcctgtaaagatctacaactagacagttgtgagaagcaggagcgacaccctgccatgcaataccaccaagcaaatggctgaaactgaaattgctggcttgaataaatcgtgtaccatatgatggcagggctggttgctcaagttaatgacggagcctgtaagctagcgtttccgcgcactctgccccggatatataaagtttgtgcagagatgacccaacgaacatcaccttttagtagatataagaggctgtttttcttttcttgcactaggtgctctatacagtcaaatagctagtggattgcttggttctgcagttgttgctagatgcagagttgttgatgatgctttttctgtatattattgttgtgagctgtactagtccagtccttgttgacggtcacacggtatctgtaactccagtgatggtatagtgctctgcgtcttttcataaatttgtattatctgactctcctaagctgtcctacagggctgttaccgcacctgactcaagtttgagcttgcaccatttg

SEQ ID NO: 2477 - DNA, 3219 bp, Amorphophallus konjac
ccaaagggaaacaatgtagatcacttgtctatgtacctggatgttgctgactcgccaagcctgccctatgggtggagcagatatgctcagttcagtttgggtgtgatgaatcaaatccaccacaaatacaccataaggaaagatacgcagcaccaatttaatgctcgcgaaagtgattggggtttcacatcattcatgccgctatgtgagatctatgatccaagtagaggatatctcgtcaatgacacattgatggttgaagctgaagttgcggtacgtagggtggttgactactgggcatatgattcaaaaaggaaacaggttatgttggtcttaagaatcaaggtgctacctgttacatgaactcgcttcttcagactctgtaccatatcccatactttagaaaggctgtgtaccatatgccgacaactgagaatgacctgccatctggaagtattcctctagcgttgcagtctttgttctacaagcttcaatatagtgacaatagtgtcgctacaaaggagctaacaaaatcttttggatgggacacatatgattcatttatgcaacatgatgtccaagagcttaacagggttctttgtgagaagttagaagacaaaatgaagggaacggttgttgagggtaccattcaacacttatttgaaggacaccacatgaattacattgagtgcatcaatgtggactacaaatctaccagaaaagaatcgttttatgaccttcagcttgatgtcaaaggttgtcgggatgtatatgcttcttttgacaaatatgttgaagttgaacgccttgaaggagataacaagtatcatgcagaacaatatggcttgcaggatgcaaagaaaggtgtattgttcattgactttcctcctgtcttgcaacttcagcttaaacggtttgagtatgatttcatgcgtgatacgatggtaaagataaatgaccgttatgaattcctttgcaacttgaccttgatagggacaatggcaagtatctgtccccagaggctgacaaaagtgtccgcaatctttatacgcttcatagtgttcttgtccatagtggtggtgtgcatggaggccattactatgctttcattcggccgacactgtctgaccagtggtataaatttgatgatgaacgagttacaaaagaagacacaaaaagggcattggaggagcagtatggtggtgaggaagagttgcctcagacaaatcctgggtttaataatactcctttcaaatttacaaaatattcaaatgcatatatgcttgtgtatatccgtgaaagtgacaaagaaaagataatctgcaacgtggatgagaaagacatagctgaacaccttagggtgaggttgaagaaagaacaagaggaaaaagagcacaagaagaaagagaaagctgaagctcatctttacaccattataaaggttgctcgaaatgaggatttgtctgagcaaataggaagggatgtatattttgacctagtggatcatgacaaagtgcggagttttcgcatacagaagcagatgccttttaatcttttcaaggaagaggtggctaaagaatttggcatcccattacagtttcagcgtttttggctgtgggctaggcgccagaaccatacctaccgtccaaataggcctttgactccacaagaagaaacacaatctgttgggcaattgagggaagtatcaaacaaagctcataatgctgaacttaaactgtttctagaagcggagtttggaccggatttgtgccctcttcctccacctgagaagactaaagaagatatactgctcttttttaagctttatgacccagagaaggaagagctcaggtatgtggggagactttttgtgaagtctatgggaaagccaatggaaattctgaagaagctcaatgaaatggctggatttgatccaaacgaagagattgaactttatgaggaataaagtttgaaccaagtgtgatgtgtgaacacatcgacaagagactcacttttcgatctagccagcttgaagatggtgacatcatatgttatcaaaaatctcctccactggagaatgatgaaatgtgtcgttatccagacgtaccctcctttttggagtatgtgcataaccggcaggttgtccatttccgatctttggagagaccaaaggaggaggatttctgtttagagctgtcaaaactatatacatatgacgatgtcgtggaaagggttgctcatcacattggtttggatgatccaacaaagattaggcttacatctcataattgctattcgcagcagcctaaacctcaaccaattaaatatcgaggtgtagagcatctatcggacatgcttgcccattataaccagacttctgacatattgtactatgaagtattggacatacctttgccagagttacaagggctgaaaactctgaaagttgctttccatcatgccacaaaggatgaggtggtgattcacagcattagactacccaaaaacagcactgtaggtgatgtccttaatgatttaagggcaaaggttgaattatctcatcctaatgcagaacttcgattgcttgaggtcttctaccataaaatatacaagattttcccggtcaatgagaaaattgagaacataaatgatcagtactggacattacgtgcagaggagattccagaggaagagaaaaatcttggaccccatgatcgcttgattcatgtgtaccatttcacaaaggatgctgcacaaaatcacatgcaggttcaaaacttcggggaaccttttttcttggttattcatgaaggtgagactttggctgatgccaaagtccgtattcagaagaagttgcaggttccagatgaggaattctccaagtggaagtttgcatttctatcactgggtcgtccagaatatcttcaagactcagacattgtgtcacagcgctttcagagacgagatatttatggagcttgggagcaatatctaggattggagcattcagacactgctcctaaaagggcttacactacaaatcagagccgtcatactttcgagaagccagttaaaatctataactgaaattttggaaaaccagccctcagtgtgttgctgaactccatcatgttcaaccccctggttgtgctgatataatgtaggaatggagtacgaaatgtggcaagttagagttggcagggttgattggtcttctgt

SEQ ID NO: 2478 - DNA, 4158 bp, Pinus taeda
ggtagtaataataataatgcaaaggtatatctggcattggaggatgccggagggtctttttccatgtctatgattgcagttattattattaccagtgtcgacagaagctagatctggacactgtccattagaatcgttattagtttccatggctttgtagggctaaattgaataaggggaatgtatgccgccgtataacaataaacatagcaatcggatttgggattggataggcgggcgttagggcgtggaatgcatgcaggagcaacagaacaaggacggcgaaatgttggtgccccatccagatttcaacaacgacacaattgaacccatggaaggaacagtagggcaagccgatacagtgagcacggctgagaaccagcctattattgaggatcctccgacgtcaaaattcacctggacaattgaacactttacaaagctaaatgtgaaaaaacattattctgaaacttttatagtcggaggatataaatggcgaattctaatatttccaagggggaacaatgtggatcacttgtcaatgtacttggatgtggcggattctaccaccttaccatacggctggagcagatatgctcatttcagcctggctgttgctaatcagattcattcaaaatacagtgtcagaaaggacacacaacatcagttcaatgctcgggagagtgattggggtttcacatcattcatgccacttttggatctttatgattcaggaaaaggttatttggtaaatgacactttggtaatagaagcagaagttactgtacaaagagggatggattacttgcaatatgattcaaaaaaagagacaggctttgttggactgaaaaatcaaggagcaacatgttacatgaattcccttcttcagacattgtatcatatgccttactttagaaaggcggtgtatcatatgcccacaactgaaaatgatgtaccatcaaatagcattcctttggctctacagagcttgttctacaaagttcaatacaatgataccagcgtgtcaacgaaagatttgacgaaatcttttggatgggatacatatgattcattcatgcagcatgatgtacaggagttgaaccgtgtattgtctgagaaattagaagacaaaatgaagggtactgccgtggagggtacaatacaacagctatttgaggggcatcatatgaattacatcgaatgtataaatgttgattataaatctacacgaaaagaatcattctatgatctacaacttgatgttaaaggctgtcgagacatctatgcatcatttgacaagtatgtggaggtcgaaaaacttgaaggtgataataaataccatgcagagaactatggcttgcaggaagcaagaaaaggcgttcttttcattgatttccctccagtgctacaacttcagttaaagcgattcgagtatgatttcatgcgtgacacaatggtgaagataaatgatcggtatgagtttccactgcagcttgatttggatagggagaatggaaaatatctttctccagacgcagacaggagtgtgcgtaatttgtacactctacacagtgttctggtccatagtgggggtgttcatggtggccattattatgcatttattaggccgactctctcagaacagtggtacaagtttgatgatgaacgcgttacaaaggaagatgttaagagagccctggaagaacaatatggtggtgaagaggagcttccacagacaaatcctgggttgaacaatactccatttaagtttacaaaatattcaaatgcttacatgcttgtctatgttagagaaagtgacaaggacaagattatctgcaatgtcgatttgaaggatattgccgagcacctaagggtgagactaaagaaagaacaagaggaaaaagaactgaagcggaaagaaaaggcagaggcacatctttatacaattataaaggttgcccgcgatcaagatctttctaatcagattggtaaggacatttattttgatcttgtcgatcatgataaggttcggacgtttcggattcagaagcaagttccttttatctctttcaaggaagaagttgcaaaagaatttggtattccagtgcaatttcagaggtattggctgtgggctaagcgtcaaaaccatacataccgtcctaacaagcccttaacacaaccggaggagtcccaatctgtcggcatcttgagggagacttcaaacaaggcacacatcgcagaattgagattgtttttggaagctgaatatggtccggatcatcgactgctcccacctcctgataaaacaaaagatgatatacttttgtttttcaaactgtatgatccagagagagaagagctcaggtatgttgggaggctttttgtcaaggctctgggcaagccaatagaaattattacaaagctgaatgccatggctggttttccaccagatgaggaaattgatctttacgaggaaatcaaatttgaaccaaatgtcatgtgtgaacccattgaaaagagaattacttttcgatctagccagcttgaagatggggacatcatttgttttcagagatctctagctacatctgaagaggatatacatcgatttccagatgttccttcattcctggattatgttcataatcggcagattgtacattttcggcgcctggataggtccaaggaagatgatttttgtttggaactctcaaaactctctacttacgacgatgttgtggagagagttgcacaacaacttgatttggacgatccctcaaaaatccgtctcacagcacataattgctactcacagcaaccaaagcctcaacccatcagattcagaggtgtagatcacttaagtgatatgttaatacattataatcagacttctgacatcttgtattatgaaattctcgatatccctcttccagagctgcaagggctaaaaactttgaaggttgctttccatcattcaacaaaagatgaggtatctgtgcacagcatcagattgcccaaacagagtactgttggtgatgttatcaatgaacttaagacaaaggttgagctttcaaatccaaatgcggatattagattgcttgaggtcttctaccacaaaatttacaagattttccccccgaatgaaaagattgagaacataaatgatcaatattggactttgcgagcagaggaggttccagaagaggagaaaaatataggccctcaggaccggctaattcatgtgtatcatttcacaaaggatgcatctcagaaccatgtggtgcaaaacttcggggagcccttctttttggctatccatgaaggcgaaacattagcagaagtaaaagaaagaataaagatgaaattgcacgttcccgatgaagaattttgcaagtggaatttcgcattcatttctttgggtcgtcctgaatatcttcaagatgcagacatcgtgtctactcgttttcagaagcgagatgtgtatggagcttgggagcagtaccttggtttggagcattctgatagtgctccaaagaaatcccaccaagctaatcataaccgccacacttttgaaaagcctgtaaagatatacaattaaatgcggaaatgtattccctaaaatagaccgaaggattggaccattgggggcgtttgcttaaatgaatgaaattcgaggagtcgtacaattgtggtccttggtttggatactagcctgccatccatttttgagtggcaactacattttatttcattttgttatacatgctttcgctgcatatatttgtgtttcactgcaagcattttgcctagtatatcttccaaattataaattggaatattgtagtgtttttgtttgctatcagatagtcaaacagatggaatatgggaaaatttgagtcatggctttgatgccttgcaatgtgttaaacttctaggtagtagtcatacagcagttgctccgtgatagcattgcatgccataatgagcagctgtttaagggagttgctcatttgtttcttggaagagattctagttgtatttaggatattcttttgaaactgtataacattcccattttgtaatctattgcccctctgatattggatacatttggttttatacccacagacgatgataataacgactacttacatttgt

SEQ ID NO: 2479 - DNA, 4040 bp, Pseudotsuga menziesii
gctaaattgaacaaggggcaaatgtctgcaggcgattacgaataagaactgcaatcggaattcggattggatagggcgagcgttagggtgtggaatgcatgcagcagccacaacacaaggacggcgaaatgttggtaccccatccagatttcaacaacgacacaattgaacccatggaagtagggcaagtcgatacagtgagtacaacagcaacagtagggggcgatacagtgagttcggctgagaaccagcctattattgaggatcctccgacatcaaaattcacttggacaattgaacacttatcaaagataaatttgaaaaaacattattctgaaacttttatagttggtggacataaatggcgaattttaatatttccaagggggaacaatgtagatcacttgtcaatgtacttggatgtggcggattctaacactctaccatacggctggagcagatatgctcatttcagcctggctgttgctaatcagattcattcaaagtacactattagaaaggacacacaacatcaattcaatgcccgagagagtgattggggtttcacatcatttatgccacttttggatctttatgattcgggaaaaggttacttggtaaatgacactttggtaatagaagcagaagttactgtacaaagaggaatggattacttgcaatatgattcaaaaaaggagacaggctttgttggattgaaaaatcaaggagcaacatgttatatgaattcccttcttcagacattgtatcatatgccttactttagaaaggcggtgtatcatatgcccacaactgaaaatgatgtaccatcaaatagcattcctttggctttacagagtttgttctacaaggttcaatacaacgataccagtgtgtcaacaaaagatttgacgaaatcttttggatgggatacatatgattcattcatgcagcatgatgtacaggagttgaaccgtgtattgtctgagaaattagaagacaaaatgaaggggactgccgtggagggcacaatacaacagctatttgagggtcatcatatgaattacatcgaatgcataaatgtagattataaatctacacggaaagagtcattctatgatctacaacttgatgtcaaaggctgtcgagatgtctatgcatcatttgacaagtatgtggaggttgaaaaacttgaaggtgataataaataccatgcagaacactatggtttgcaggaagcaagaaaaggtgttcttttcattgatttcccaccagtgttacaacttcagttaaagcgattcgagtatgatttcatgcgtgacacaatggtcaagataaatgatcgttatgagtttccgctgcagcttgatttggatagggagaatggaaaatatctttctccagatgcagataagagtgtgcgcaatttgtacactctacacagtgttttggtccatagcgggggtgttcatggaggccattattatgcatttattaggccaactctctccgatcaatggtacaagtttgatgatgaacgtgttacaaaggaagatattaagagggccctggaagaacaatatggcggtgaagaagagctaccgcagacaaatcctgggttgaacaatgctccatttaaatttacaaaatattcaaatgcttacatgcttgtctatgttagagagagtgacaaggacaagattatctgcaatgtggatgaaaaggatattgcagagcacctaagggtgagactaaagaaagaacaagaggaaaaggaattgaaacggaaagaaaaggctgaggcacatctttatacaattataaaggttgcccgtgataaggatctttctaatcagattggtaaggacatattttttgatcttgtcgatcatgacaaggtccggacatttcggattcagaagcaagttccttttatttctttcaaggaagaagttgcaaaagaatttggcattccagtgcaatttcagcggttttggctgtgggctaagcgtcaaaaccatacataccgtcctaacaggcccttgacacaagcagaggaagctcaaactgttggctacttgagggagacttcaaacaaggcacacactgtagaattgagattgtttttggaagctgaatatagtccggatcttcgattgctcccacttcctgataagacaaaagatgatatacttctgttttttaaactttatgatccagagaaagaagagctcaggtttgttggtaggctttttgtcaaggctgcaggcaggccagtagaaattattgtaaagctgaatgccatggctggttttccaccagatgaggaaattgatctttttgaggaaatcaaatttgagccaaatgtcatgtgcgaactcattgataagagaattacttttcgagctagccagcttgaagatggggacatcatttgttttcagagatcccttacctctgaagaggatatacatcgatatcctgatgttccttcatatttggaatatgttcataatcggcagattgtacattttcggcgcctggataagccaaaggaagatgatttttgtttggaactctcaaaactcttcacttatgatgatgttgtggagagagttgcacagcagcttgacttggatgatccttcaaaaatccgactcacagcacataattgctactcacagcaaccgaagcctcaacccatcagatacagaggagtagaccacttaagtgatatgctaacacattataatcagacttctgacatcttgtattatgaaatcctcgatatcccacttccagagctgcaagggctaaaaacattgaaggttgcttttcatcattcaacaaaagatgaggtatctgtgcacagtattagactgcccaaacagagtactgttggtgatgtcatcaatgagctcaagacaaaggttgagctttcaagtccaaatgcagatattagattgcttgaggtcttctaccacaaaatttacaagattttccccttgaatgagaagattgagaacataaacgatcagtattggactttgcgagccgaggaggttcctgaagaggagaaaaatttaggccctcaggaccggctgattcacgtgtatcatttcacgaaggatgcatcgcagaaccataatgtgcaaaactttgggagcctttcttttggctatccatgaaggagagacattagcagaagtaaaagaaagaataaaaaataaattgcatgttcccgacgaagaattttgcaagtggaatttcgcattcatttctttgggtcgtcctgaatatcttcaagatccagacattgtgtctacccgttttcagagacgagatgtgtacggagcttgggaacagtaccttggtttggagcattctgatagtgctccaaagaaatcacaccaagctaatcataatcgccacacctttgagaagcctgtaaagatatacaattaaatgcagaaatggcactccctcaatatagactgaaggattggacctatgggagccgttacttcaatgaatggaattcgaggagtcatataattgtggtccttggttcggatgagctttctgccatccgtgttttttgagtggcaactacattttatttcatttcgctatacatgttatcactgcgtactatcagtgttgccatgttcacatattgtcgagtatatctccagggttataaattggaatattgtagtgtttttgcttgttatcaaatagtaaaacagatggaacatgtgaaaaatttagtcttggctttgataccttgcaacgtgtcaaacttctaggtgtttgtcatacaactgttgctctgcactagcgttgcatgcgacaatgagccgctgtttaaatgagttgctcatgtatttcttggaagagattctagttttacttaggtgattcttttgaagttgtataacattcccattttgtaatctattgcccctctgatattggttacatttggttttgtacctacaggatgataataatagctacttacatttgtatttggttctgac

SEQ ID NO: 2480 - DNA, 2277 bp, Panicum virgatum
cctgcagttttcaccctaacctggctgcacttgccggaggtaagaaagatgacaggagcattaatttttttttctcaaatacgcagaaaagttgcacatcattgtattaagcagaagaataaaggagtttgcaatggcccaaacgccgagtggaggcttggcaggtctaaacggcaagccgtttgaataagaaggaacatcatatgggagcattaatcacggtgctaattaaaattttaaaacaacggagcttgaatcgagcgccagttccaacaacaaaaaggaaaaaaaaagagaaatttggcgccaaggagcagtgaaagaaagaaattgatatgttatgccagctgtcatcacgccacttgccggctgccgcgtggcccctgctccgccacgtcatcggctgcgatccagcccatctcaccctgctagatatttaagcagttaaagtggaccagtccgttacgttatccttgccaagaacccaagacacgctgcagctcgagccagaagccatggcgcgccggccggacgccgaggcgcccctgctcggcaagcccgatgccgcctccccgccggcgacgccgccgccgccgccgaagcgcaacaagtaccccttcttctgcgccgtgctcgcctccatgacctccgtcctcatgggctacaacgtggcggtgatgagcggcgcgcagatcttcatggcggaggacctgggcatcagcgacgcgcaggtggaggtgctctcgggcgtcatcagcatctactcgctcgccggcgcgctgctggcggggtggacctccgaccgcctcggccgccgcctcaccatcgtgctcgccaacgtcttcttcctcgccggcccgctcatcatggcgctcgcgggaggctacgccgcgctcatggcgggccgcttcgtcgccggcgtcggctccgggtacgcgctcgtcatcgcgcccgtctacgccgccgagatcgcgcccgcgtcgtcccgcggcctcctcacctcgcttcctgagatctttatcaacaccggggtgatgctgagctacgtttccaacctcgccttctcggggctgcccgtgcacctctcgtggcgggtgatgttcgcggcggcggcggtgcccacggtgttcctggcggccggcgtgctcaccatgccggagtcgccgcggtggctcggcatgaagggcagggtcgccgaggccaaggccgtgctcgacaggacgtcggacacgcccgccgaggccgagcaacggctgctggagatcgaggccgtcgtcaccagcggcggaggcggcgcgtggaaggaggtggccaccaaggccggcgtccgccgcgtgctggccatcgtgctcacgctgcagttcttccagcaggcgtcgggcgtcgactcggtggtgctgtacggcccgcgcgtgctggccatggccggggtcacctccaacaccctgctcctgagcctcaacgtcctcttcggcgccgccaaggcggggtccatcctcgtcgccatggtgctcgtcgaccgcgtcggccgccgcccgctcctcctcgcgagcacgggcggcatgacggcggccctgctcgtcctgggctccctgttcgccgcgttcaccggcgccaaggacgacgccgcggtggccgcggtgagcgtcgccgccgtggtggcgttcgtggtggccttctccgtcgggctcgggccgttggcctgggtgtacagctccgagatcctgccgctccggctgcgggggcagggcgccgggctcggcaccgccatgaaccggatcatgagcggcgtggttaccatgaccttcatctcgctctaccaggccatcaccatggccggcgcgttctacctctacgccgccatcgccgcggcctcgttcgtgttcgtctacgcgtgcttgccggagaccaggggccggagcctcgaggacatggaggagctcttccacaccaagtgattcgtgtgatctgaccgaaccatcgattcgactcgattcagtggcattgccaatttggcactgttggagctttgtctagaccttggtagctcgttaacacaaaatgctcctgcagatgcaaattgcaacactgtaaatttgcattcttttttgcaagaccatcgggaataaaagattttgatggctggtatgtcgattatttggtgaatagtgctgctagaattaccctccatgcatatactggacgtagtcatagaacagaggaacaattcatatatacacttgtattggtgcgtaaagatgggagcaaaaaaaaatt

SEQ ID NO: 2481 - DNA, 1911 bp, Zea mays
cgacggctatccaggctccagtcgtccccggattagttgtactgtacattgttcctgcgaagacactgggtcgtccgggtcaatcggcagcttgaaccagccatggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacaacgtcgcggtgacgagcggcgcgcagatcttcatggcggaggacctcgggatgagcgacgcgcagatcgaggtgctctcgggggtcatcaacatatactcgctcgtcggcgcgctgctggcaggctggacctccgaccgtctcggccggcgcctcaccatcgtcctcgccaacgccttcttcctcgtcggcccgctcgccatggcgcttgccggcgggtacaccttgctcatggtgggccgcttcatcgccggcgtcggcgtcgggtacgcgctcgtcatcgcgccagtctacgctgccgagatcgcgccggcgtcatcccgcgggctcctcagctcacttcctgagatttttatcaacactggggtgatgctgagttacgtgtcgaatctcgccttctcggggctgcccgtgcacctgtcgtggcgggtgatgttcgcggcgggcgtggtgcccaccgtgttcatggcggccggggtgttcaccatgccggagtcgccgcggtggctggttatgaagggccgggtcgccgaggccaaggccgtgctcgacaagacgtcggacacgcccgctgaggccgagcagcggctgctcgagatcgaggacgtcgtgatggacagcagcggcgacagcggcgcgtggaaggaggtggcgacgaaggctggcgtccagcgcgtgttggcaaccgtggtgacgctgcagttcttccagcaggcgtcaggcatcgactcggtggtgctgtacggcccgcgcgttctcgccatggctggtgtcacgtccaacagcttgctcctgagcctcaacatcctcttcggcgttgccaaggttggctccatcctcatcgccatggcgctagccgaccgcgtcgggcggcgcccactcctgctggtcagcactagcggcatgacggtggcgctgctcgtcctaggctccctgttcgcggtgtttgcgggagccaaggataacgctgcggtggctgcggtgagtgtggtggccgtcatggcgttcgtgatggccttctccgtcggcttgggccctctggcgtgggtgtacagctccgagatactgccgctccgacttcgcgggcagggtgccgggctcggcaccgccatgaaccggatcatgagcggcgtgatcaccatgaccttcatctcgctctaccagggcatcaccatggccggcgcgttctacctttacgccgccatcgccgccgcgtcgttcgtgttcgtgtacgcctgcctgccggagaccaggggccggagcctcgaggacatggaagagctcttccacaccaagtgatttcgtatgtgctgatccaaccaccatttggttcaattctcgattcagtggcaatgcagattttgccattgttggagctggttttgagcttggtcgttatcatcatggcacatgcgtatacaattgcaagattatattgaaatcgattgattgagccggttggcgtcgacatgggaacacgtgcatatatagaattgaagcattgtacacatactgcataatcatggccatttattttagattcaacatttcttttatatctatttcttcgtacacagaacaaggtgaaagtggtggaaggtagtgatggaggatgtttttttacaaaatatacaaggcaacaagagaggtgtgaaaagacgtcaaatatgt

SEQ ID NO: 2482 - DNA, 1697 bp, Setaria italica
tacgttatcctcgccaagacgccgccgccgtccgggacctgcagccagagccagagaagccatggcgcagcgcccggacgccgaggcgcccctgctcggcaagcccggcgccgcctccccaccgtcgccgccggcgaagcgaaccaataagtaccccttcttctgcgccgtgctcgcctccatgacctccgtcctcgcgggctacaacgtggcggtgatgagcggcgcgcagatcttcatggcggaggacctcggcgtcaccgacgcgcaggtcgaggtgctctcgggtgtcatcaacgtctactcgctcgtcggcgcgctgctggccgggtggacctccgaccgcctcggccgccgcctcaccatcgtgctcgccaacgtcttcttcctcgtcggcccgctcgccatgacgctcgccggagggtacgccgtcctcatggcgggacgcttcgtcgccggcgtcggcgtcgggtacgcgttcgtcatcgcgcccgtctacgccgccgagatcgcgccggcgtcctcccgcggcctcctctcctcgctccccgagatctttatcaacagtggagtgatgctgagctacgtcgccaacttggtcttctcggggctgcccgtgcacctgtcgtggcggttgatgttcgcggcgggggtggtgcccacggtgttcctcgccgccggcgtgctcaccatgccggagtcgccgcggtggctcgccatgaagggccgggtcgccgaggccaaggccgtgctcgacaagacgtcggacacgcccgccgaggccgagcagcggctgctggagatcgaggacgtcgtgaacggcggcggccggagcggtgagggcagcggtggcggcgcgtggaaggaggtggcgacgaaggccggcgtccgccgcgtgctggccatcgtgctgacgctgcagttcttccagcagtcgtcgggcatcgactccgtggtgctgtacggcccgcgcgtcctcgccatggccggggtcacctccaacaccctgctcctgagcctgaacgtcctcttcggcgtcgccaaggccggctccatcctcatcgccatggcgctcgccgaccgcgtcggccgccgcccgctcctcctcgtaagcacgggcggcatgacggcgtccctgctcgtcctgggctccctgttcgcggcgttcaccggcgccaaggacgacgccgcggtggccgcggtgagcttcgcggccgtggttgcgttcgtcgtgtccttctccgtcgggttcgggccgctcgcctgggtgtacagctccgagatcctgccgctccggctgcgcggccagggcgccggactcggcaccgccatgaaccggatcacgagcggcgtcgtcaccatgaccttcatctcgctctaccaggcaatcaccatggccggcgcgttctacctctacgccgccatcgccgccgcctcgttcgtgttcgtctacgcgtgcctgccggagaccaggggacggagcctcgaggacatggaggagctcttccacaccaagtgattcgtacgtgtgattagtttcgattcagtggcaatggcattgatctttgtcgatcgttgacacaaatgacacctgcaagtacaaattacgacactgtaaatttgtattctttgttcgcaagactatacgagaataaaagattttgcgcttcatcatactgttccgttcatggctgaaa

SEQ ID NO: 2483 - DNA, 1903 bp, Panicum virgatum
gagaaattgaatttagaggatgacttaacagaaatattaactacctatgacatgtgggtcctgtgataggtagttaatatagtggagaggtatagatgatgaataggtgtagagaaattgaatttagaggatgacttaacagaaatattctctttaaaggatgaatatagagtagaatgactgtgcatagccttatatactaccaaactcacccgctgtcttggacaggtcatcctgagcccgcggccggcgagccatggcgcaccaaccaggagacgccgaggcgccgctgctcgccaagccggcggcgaagcgcaacaagtacccctttttctgcgccgtgctcgcctccatgacctccgtcctcacgggctaccacatggcggtgatgagcggcgcgcagatcttcatggcggaggacctgggcatcagcgacgcgcaggtggaggtgatctcgggcgtcatcaacatctactcgctcgtcggcgcgctgctagcggggtggacctccgaccgccacggccgccgccttaccatcgtgctcgccaacgtcttcttcctcgccggcccgctcgccacggcgctcgggggagggtacgccgcgctcatggtgggccgcttcatcgccggcctcggctccgggtacgcgctcgtcgtcgcgcccgtctacgccgccgagatcgcgcccgcgtcgtcccgcggcctcctcacctcgcttcctgagatctttatgaacaccggagcgatgctcagctacgtttccaacttggccttctcggggctacccgtgcacctgtcgtggcgggtcatgttcgcggtggcggtggtgcccacggtgttcctggcggccggcgtgctcaccatgccggagtcgccgcggtggctcgccatgaagggcagggtcgccgaggccaaggccgtgctcgacaagacgtcggacacgcccgccgaggccgagcagcggctgctggagatcgaggcagtcgtcagcagcggtgaaggcggcggcggcgcgtggaaggaggtggccacaaaggccggcgtccgccgcgtgctggccatcgtgctcacgctgcagttcttccagcagtcgtcgggcatcgacacggtggtgatgtacgccccgcgtgtgctggccatggccggggtcacctccaacaccctgctcctgagcctcaacgtcctcttcggcgtcgccaaggccggctccgtcctcatcgccatggcgctcgccgaccgcgtcggacgccgcccgctcctcctcgcgagcacgggcggcatgacggcgtccctgctcgtcctgggctcgctgttcgtggcgttcgccggcgccaaggacgacgccgcggtggccgcggtgagcgccgccgccgtggtggcgttcgtggtggccttctccgtcgggctcgggccgctggcctgggcgtacagctcggagatcctgccactccggctgcgcggccatggcgcggggctcggcaccgccttaaacctgttcgtgagcggcgtcgtcaccatgaccttcatctcgctctaccaggccatcaccatggccggcgcgttctacctctacgccgccgtcgccgcggcctcgttcgtgttcatctacacgtgcctgccggagaccatgggccggagcctcgaggacatggaggagctcttccacaccaagtgattcgtgtgatctgaccaaaccatcaattcgattcgattcagtagcattgccaaatgccaatttggcattgtcggagcttcgtctagaattttggtcgatcacggacgcaaatatgactcctgcaaatacaaatttcaacactgtaaatttgtattctttttatcaagaccacgggaataaaagaatttgcacttcatcatgctgttaatgatgatggaggcattattt

SEQ ID NO: 2484 - DNA, 1638 bp, Panicum virgatum
cctactcccctgtccgatcggctacctaactcccgctgtcttggacaggtcatcctgagcccgccgccggcgagccatggcgcaccaaccaggagacgccgaggcgccgctgctcgccaagccggcggcgaagcgcaacaagtacccctttttctgcgccgtgctcgcctccatgacctccgtcctcacgggctaccacatggcggtgatgagcggcgcgcagatcttcatggcggaggacctgggcatcagcgacgcgcaggtggaggtgctctcgggcgtcatcaacatctactcgctcgtcggcgcgctgctggcggggtggacctccgaccgccacggccgccgccttaccatcgtgctcgccaacgtcttcttcctcgccggcccgctcgccacggcgctcgggggagggtacgccgcgctcatggtgggccgcttcatcgccggcctcggctccgggtacgcgctcgtcgtcgcgcccgtctacgccgccgagatcgcgcccgcgtcgtcccgcggcctcctcacctcgcttcctgagatctttatgaacaccggagcgatgctcagctacgtttccaacttggccttctcggggctacccgtgcacctgtcgtggcgggtcatgttcgcggtggcggtggtgcccacggtgttcctggcggccggcgtgctcaccatgccggagtcgccgcggtggctcgccatgaagggcagggtcgccgaggccaaggccgtgctcgacaagacgtcggacacgcccgccgaggccgagcagcggctgctggagatcgaggcagtcgtcagcagcggtgaaggcggcggcggcgcgtggaaggaggtggccacaaaggccggcgtccgccgcgtgctggccatcgtgctcacgctgcagttcttccagcagtcgtcgggcatcgacacggtggtgatgtacgccccgcgtgtgctggccatggccggggtcacctccaccaccctgctcctgagcctcaacgttctcttcggcatcgccaaggccggctccgtcctcatcgccatggcgctcgccgaccgcgtcggacgccgcccgctcctcctcgcgagcacgggcggcatgacggcgtccctgctcgtcctgggctcgctgttcgtggcgttcgccggcgccaaggacgacgccgcggtggccgcggtgagcgccgccgccgtggtggcgttcgtggtggccttctccgtcgggctcgggccgctggcctgggcgtacagctcggagatcctgccactccggctgcgcggccatggcgcggggctcggcaccgccttaaacctgttcgtgagcggcgtcgtcaccatgaccttcatctcgctctacaaggccatcaccatggccggcgcgttctacctctacgccgccgtcgccgcggcctcgttcgtgttcatctacacgtgcctgccggagaccatgggccggagcctcgaggacatggaggagctcttccacaccaagtgattcgtgtgatctgaccaaaccatcaattcgattcgattcagtagcattgccaaatgccaatttggcattgtcggagcttcgtctagaattttggtcgatcacggacgcaaatatgactcctgcaaatacaaatttcaacactg

SEQ ID NO: 2485 - DNA, 2105 bp, Oryza sativa
tccatctctctcattacactcctttcaaaaacctccaaaacaaaaagaaaaaaaaagaagaagaagaagaaaaaaaccctccaaaacaaaagaaaaaaaagagaaaaaaagaagaagaaaaaaacatccagatatatatagccatactgcatactgttgtagctaattaagctatagcttggtaatccgcagccatggcgccggacgtcgaggcgcggctgctcgccgcctcctccaagccggccaccgccgccgccgcctcgctgccgcgccgcaacaagtaccccttcttctgcgccgtcctcgcctccatgacgtccgtcctcatgggctacaacgtggcggtgacgagcggggcgcagatcttcatggcggaggacctgggcgtgagcgacgcgcagatcgaggtgctttcgggggccatcaacatctactcgctcgtcggcgcgctgctcgccgggtggacctccgaccgcctggggcggcggctcaccatcgtgctcaccaacggcttcttcctcgccggcccgctcgtcatgtcgctcgccggcgggtacgccgcgctcatggccgggaggttcgtcgccggcatcggcgtcggctatgccctcgtcatcgcccccgtctacgccgccgagatctcccccgcctcctcccgcggcctcctctcctccctccccgagatatttatcaatgggggagtgatgctgagctacgtgtcgaacttcgccttctcggggttgccggtgcacctgtcgtggcggctgatgttcgccgccggcgtggtgccgacggtgttcctggcggcgggcgtgctcaccatgccggagtcgccgcggtggctggcgatgaaggggcggcgcggcgaggcgagggtggtgctcgaccgcacgtccgacacgccggccgaggccgagcagcggctgcaggagatcgaggacgtcgtcgccgccgccggctccgttgccggcaacggcaacggcggcggcggcgcgtggaaggaggtggcgaccaagcccggcgtgcggcgggtgctcgccatcgtgctgacgctgcagttcttccagcaagcgtcgggcatcgactccgtggtgctgtacggcccgcgcgtgctcgccgcggcgggtgtggcgtcgaacaccctcctcctggggctcaacgtggtgttcggcgtcgccaaggcgagctccatcctcgtcgccatggcgctcaccgaccgcgtggggcggcgcccgctgctgctcgccagcacgggcggcatgacggcgtccctcctcgctctcggctcggtgttcgccgcgttcggcggcgcgagggacgacgcggcggtggcggcgggcgccgccgtcgccgtggtggtggcgttcgtgtgcgcgttctccgtcgggatcgggccgctggcgtgggtgtacagctcggagatcctgccgctgcggctgcgcgggcagggcgccggcgtcggcaccgccatgaaccgcgtcgtcagcggcgtggtcaccatgacgttcatctcgctctacggcgccatcaccatggcgggggcgttctacctctacgccgccatcgccgccgcctccttcgtgttcatctacgcctgcctgccggagaccagggggcggagcctcgaggacatggaggagctcttccacaccaagtgatgatctcatcttccatcaatgaatcaattcacatatatatgcatttgggttgttgcaacattttgaatggaaagtttgattctttcttggtaagattatcaaaggtttttcatgttcatttggctgattaattggtatactataaatttattattactgttgaaattgacatgtaaagatcggtgggacagtggatacatactggctgaatatggggaaaagagaaaagtttagaacggagggattttgtattatagaaagaaaactaaaacatgtgtgtttaattttgtaaaaatcctgtaaattttcttgacgagcctttatcggttggttttgctatttatcaggcgagccatatctcaagttccaagttccaatctctactactagtctagtgggtacagaaggactattttaatgggaggttaatgggaggcctaatttggg

SEQ ID NO: 2486 - DNA, 1680 bp, Avena sativa
gtaatcccaaatttccgtgggaaaccagagaccggcagtagctagccagtgctatggaggagcagcaccggctggacaacgccgaggctccgctgctggctgccgcagccaccaagcccgatggcgccgcgtcatcgtcgccgacgcgcaacaagtaccccttcttctgcgcggtgctcgcctccatgacctccgtcctcatgggctacaatgtggcggtgacgagcggggcgcagatcttcatggcggaggacctcgggttgagcgacacgcagatcgagctgctctccggcgccatcaacatctactcgctcgtcggcgcgctgctcgccggctggacctccgaccgcctcggccgtcgcctcaccatcgtgctcaccaacggcttcttcctcgtcggcccgctcatcatgacgctagccagcgggtacgccgcgctcatggcggggagattcatcgccggcatcggcgtcggctacgcgctcgtcatcgcgccgatctacgccgctgagatcgcgcccgcctcctcccgcggcctcctcagctcccttcccgagatttttatcaacaccggagtgatgctgagctacgtgtccaacttcgccttctcgactttgccggcgcacctgtcctggcggctgatgttcgcggcgggggtggtgcccaccgtgttcctcgcggccggcgtgctcaccatgccggagtccccgcgttggctggcgatgaagggccggacggacgaggcgaaggccgtgctcgaccggacgtctgacacgctcgctgaatctcagcagcgtctgctggagatccaggaggtcgtcgacacggacagcaacggcgccggcggtggcgcgtggaaggaggtggcgaccaaggccggcgtccggcgggtgctggccaccgtgctggcgctgcagttcttccagcaggcatcgggcatcgactcagtggtgctgtacggcccgcgcgtgctcgccatggcgggcgtcacctccaacaccctgctcctaggcctgaatgtcctcttcggagtggccaaggctggctccatcctgatcgccatggtgctcgccgaccgtgtaggccggcgccctctgctcctagtgagcgccggcgggatgacggcatcgctgctcgtcttggggtctgtgttcgcggccttcggcggcgccaaggacgacgccgttgttgccgcagtcgccgtggcggccgtggtggcgtttgtgtgcacgttctccgtcgggttcgggcccctggcgtgggtatacagctccgagatcctgccgttgcggctgcgcggacagggcgccggactcggcaccgccatgaaccgcgttatgagtggcatcgtcaccatgaccttcatctcgctctacggcgccatcaccatggccggcacgttctacctatacgcagccgttactgctgcctctttcgtgttcatatacacctgcctgccggagacaaggggcaggaacctcgaggacatggagcaactcttccgcacaaagtgattaatccatccatcacattagaaccaatggaaaatattggagattctcgacctcgaaagtttgtgatcaagaggtatacacgattatcgaaattccattctttctccaggatattgcacaaggcattgctattcatcaggcatttccatgggcgaattacatcact

SEQ ID NO: 2487 - DNA, 1825 bp, Panicum virgatum
atggcgcaccggccggacgccgaggcgcccctgctcggcaagcccgacgacgcctccttgccggcgaggcgcaacaagtaccccttcttctgcgccgtgctcgcctccatgacctccgtcctcacgggctacagaacggatcctacttgctccatcgccaggttccccaatctttccatatatgtgtctcctcgtacggatgctgagcacccgcgcactgtgtgccatggcatgtccggcggcagacgtggcggtgatgagcggcgcgcagatcttcatggcggaggacctgggcatcagcgacgcgcaggtggaggtgttctcgggggtcatcaacatctactcgctggccggcgcgctgctggcggggtggacctccgaccgcctcggccgccgcctcaccatcgtgctcgccaacgtcttcttcctcgccggcccgctcgccatggcgctcgcgggagggtacgtatgccgcgctcatggtgggccgcttcgtcgccggcgtcggctccgggtacgcgcccgtcatcgcgcccgtctacgccgccgagatcgcgcccgcgtcgtcccgcggtctcctcacctcgcttcctgagatcttcatcaacaccggagtgatgctgagctacgtttccaacttggccttctcggggctgcccgtgcacctctcgtggcgggtgatgttcgcggcgggggtggtgcccacggtgttcctggcggccggcgtgctcaccatgccggagtcgccgcagtggctcgccatgaagggcaggctcgccgaggccaagaccgtgcgctcgacaagacctcggacacgcccgccgaggccgagcagcggctgctggagatcgaggacgtcgtcagcagcggcggccggagcggcggcggcgcctggaaggaggtggccaccaaggccggcgtccgccgcgtgctggtcatcgtgctcacgctgcagttcttccagcagtcgtcgggcatcgactcggtggtgctgtacggcccgcgcgtgctggccatggccggggtcacctccaacaccctgctcctgagcctcaacgtcctcttcggcgtcgccaaggccggctccatcctcatcgccaaggcgctcgccgacagcgtcggccgccgcccgctcctcctcgcgagcacgggcggcatgacggcgtccctgctcgtcctgggctccctgttcgccgcgttcgccggcgccaaggacgacgccgcggtggccacggtgagcgtcgccgccgtggtggcgttcgtggtggccttctccgtcgggctcgggccgcgtgcctgggtgtacagctccgagatcctgccgctccgcctgcgcggccagggtgccgggctcggcaccgccatgaaccggatcatgagcgcgcgtggtcaccatgactttcatctcgctctaccaggccatcaccatggccggcgcgctctacctctacgccgccatcgccgcggcctcgttcgtgttcgtctacgcgtgcctgccggagacccggggccggagcctcgaggacatggaggagctcttccacaccaagtgattcgtgtgatctcaccaaaccatcaattcgattcgattcaagtggcattgccaaatgcctatttggcagtgctggagctttgtctagaattttggtcgatcacagacacaaatgactcctgcaaattaatgggttcaggatagaaggctgagattgatctccattaaacctactacacaccactttatatcagaaaagtccatgggggtgtgaatagcatgtttgtgttagataattaggcaattttcggtatattttaattccaaatatta

SEQ ID NO: 2488 - DNA, 1947 bp, Triticum aestivum
gatccagtcatcaatattcctgcatgactagtaaactgaaatttccgtgccaaacacacccaaaaaccagggacgggcagtagttctagccatggaggaggagcagcaccggcaggactccgaggctccgctgctggccgcctcgaagcccgatggcgccgcgtcttcgtcgccgccccgcaacaggttccccttcttctgtgccgtgctcgcctccatgacctccgtcctcatgggctacaacgtggcggtgatgagcggggcgcagatcttcatggcggaagacctcggggtgagcgacacgcagatcgagctgctctctggtgccatcaacatctactcgcttgtcggcgcgctgctcgccggctggacctccgaccgcctcggccgccgcctcaccattgtgctcaccaacggcttcttcctcgttggcccgcttatcatgacgctcgccggcgggtacacggcgctcatggcgggacggttcatctctggaatcggcgtcggctacgcgctcgtaatcgcgccgatctacgctgccgagatcgcgccggcctcctcccgcggccttctcagctcccttcccgagatttttatcaacaccggggtgatgctgagctacgtctccaacttcgccttctcggcgttgccagcgcacctggcgtggcggctgatgttcgcggccggagttgtgcccaccgtgtttctggcggctggcgtgctcaccatgccggagtcgccgcggtggctggccatgaagggccggctggacgaggcaaaagccgtgctcgacaggacgtcggacacgctcgccgatgccgaacagcgtctgctggagatcgaggaggttgtcgacgccggcagcaacggcggtggcagcacgtggaatgaggtggcgaccaaggccggcgtcagccgcgtgctggccacagttctggcgctccaattcttccagcaggcgtcgggcatcgactccgtggtgctctacggcccgcgcgtgctcgccatggccggcgtcacatccaacaccctcctcctgggcctcaacgtcctcttcggcgtggccaaggcgggctcgatcctgatcgccatggcgctcgccgaccgtgtcggccgacgccctctgctcctggtaagcaccggcggcatgacggcgtcgctgctcgtgctgggctccgtgttcgctgctttcgccggcgccaaggacgacgcggcggtggccgccgtggccgtggcggctgtggtggcgttcgtctgcaccttctccgtcgggttcgggcctatggcatgggtgtacagctcggagatcctacctctgcggctgcgcggacagggcgctgggctcggcaccgccatgaaccgcgtcatgagcggcatcgtcaccatgaccttcatctcgctctacggggccatcaccatggccggcgcattctacctttatgccgccgtggcggctgcctcgttcgtgttcatctacacctgcctgccggagaccaggggccggaacctcgaggacatggagcagctcttccgcacaaagtgatcaatccaccaacccgtcctcacattgataattgtcaacttgtgattggaaatagggcggataggatggcccacagagtaaagtattccctccggtcctttttactctgcacgttagatttcctgaaaatcaaattttgctaagtatatcataatgataaattagtagagtttttaggtatcttgcggtatatcataagtttgggtcttgttatacatatgataatacagacaatattattggcaatcctgttttttcttcttcatagggcattgttaaatgggaatataacatacccattgggtagagggtacgggtagggaatcgtataacccagcctcatgtacccatttaaatgttgacaagtgggttttctttaatatcctaacgtattaactttcccc

SEQ ID NO: 2489 - DNA, 1722 bp, Hordeum vulgare
ggtcgatccagtcaatatgactaaactgaaatttccgtgcgagacacaccggaaaaccagggacgggcagtagctagttacggtgggtagctagccatggagcagcagcaccggccggactcggagtcggaggctccgctgctagccgcctcgaagcccgatggcgccgcgtcttcgtcgccgcggcgcaacaggttccccttcttctgcgccgtgctcgcctccatgacctccgtcctcacgggctacaacgtggcggtgatgagcggggcgcagatcttcatggcggaagacctcggggtgagcgacacgcagatcgagctgctctccggtgccatcagcatcttctcgctggtcggcgcgctgctcgccggctggacctccgaccgcctcggtcgccgcctcaccattgtgctgaccaacggcttcttcctcgttggctcgcttatcatgacgctcgcgggcgggtacacggcgctcatggcggggcggttcgtcgctggaattggggtgggttacgcgctcgtaatcgcgcccgtctacgctgccgagatcgcgccggcctcctcccgcggccttctcagctcccttcccgagatttttatcaacaccggggtgatgctgagctacgtgtcaaacttcgcgttctcggcgttgccagcgcacctgtcgtggcggctgatgttcgcggtgggggttgtgcctaccgtgtttctggcggctggcgtgctcaccatgccggagtcgccgcggtggctggcgatgaagggccggctggacgaggcgaaagccgtgctcgacaggacgtcggacacgctcgccgaggccgagcagcgtctgctggagatcgaggaggttgtcgtcgccggcgccagcaacggtgccggcgggacgtggaatgaggtgacgaccaaggccggcgtcaggcgcgtgctggccacagttctggcgctgcagttcttccagcaggcgtcgggcatcgactcggtggtactctacggcccgcgcgtgctcgccatggccggcgtcacgtccaacaacctcctcctgggcctcaacgtcctcttcggcgtggccaaggccggctcaatcctgatcgccatggcgctcgccgaccgtgtcggccggcgccctctgctcctggtgagcaccggcggcatgacggcgtcgctgctcgtgctgggatctgtgttcgctgctttcgccggcgccaaggacgacgcggcggtggccgccgttgctgtggcggctgtggtggcgttcgtctgtaccttctccgtcgggctcgggcctctggcctgggtgtacagctcggagatcttacctctgcggctgcgcggacagggcgccgggctcggcaccgccatgaaccgcgtcatgagcggcatcgtcaccatgaccttcatctcgctctatggggctatcaccatggccggcacattttacctttacgccgcagtcgcggctgcctcgttcgccttcatctataccttcctgccggagactaggggccggaacctcgaggacatggagcagctcttccggacaaagtgatcaaaacaccagcccgtcctcacattgatatttcgtactcctgattagctacttgtgattggaaatagggccacagatatttcatactctggattttgatcgtgaatttgtgatcaaacggtaaacgctatacaacattattaaaacgattctttcttttcctaaaaa

SEQ ID NO: 2490 - DNA, 1889 bp, Brachypodium distachyon
gagcatgtggtggcaacagtataaatccaaggccagctagacatcctagtcaccttcaacctctagccaaacaatccgagtcaataccactacagcgctataccaaaaggttccgtgtcacacgtagcagatcgagacagccgccgcagctagctagccagccatggacgccgccgaggagccgctcctggccgcagcctccaccaagcccgatggcgctccgccgccgcgaaacaagtatcccttcttctgcgccgtgctcgcctccatgacctccgtcctcacgggctacaacgttgcggtgatgagcggggcgcagatcttcatcgcggaggacctgggcgtgagcgacacgcagatcgagctcctctccggcgccatcaacatctactcgctcgtcggcgcgctgctggccggttggacctcggaccgcctgggccgccgcctcaccatcgtgctcaccaacgccttcttcctcctcggcccgctcaccatgtccctcgccgccggctacccggccctcatggcggggcgcttcgtgtccggcgtcggcgtcggctacgcgctcgtcatcgcccccgtctacgccgccgagatctccccggcttcctcccgcggcctcctcacctccctccccgagatttttattaatacaggggtgatgctgagctacgtgtccaatttggtcttctcgggcttgccggcgcacctgtcatggcggctgatgttcgcggcgggggtggtgccgacggtgttcctggcggcgggggtgctgacgatgccggagtcgccgcggtggctggcgatgaagggccggacggaggaggcccgggccgtgctgggccggacctcggacacgcccgccgaggcccagcagcggctgctcgagatccaggaagtcctcatcgtctccgtccccggctccggcaacggcaacggcaacaacagcgcgtggaaggaggcggcgagcaaggccggcgtgcggcgcgtgctggccacggtgctggcgctgcagttcttccagcaggcgtcggggatcgactccgtcgtgctctacggtccccgggtgctcgccatggccggcgtcacctccaacgcgctcctgctgggcctcaacgtgctcttcggcgtcgccaaggccggctcgatcctgatcgccatggcgctcgccgaccgcgtgggccggcgccctctgctgctcgtgagcacgggcggcatgacgctctcgctgctcgtgctcggctccgtcttcgcggcgttcgccggcgtcaaggacgacgccgccgtggccgcggtcgccgtggtcgccgtagtggcgttcgtgtgcaccttctccgtcgggctcgggccgctggcgtgggtgtacagctccgagatcctgccgctgcggctgcgcgggcagggcgccgggctcggcaccgccatgaaccgcgtcgtgagcggcttggttaccatgacattcatctcgctctacggggcaatcaccatggccggcacgttctacctctacggcgccgtcgcggcggcctctttcgtgttcatctacacatgcttgccagagaccaggggccggaacctcgaggacatggagcagctcttccgcacaaagtgatcatcaatcgtatccaaccaattccatcatatttttggcactgccaatgaagttgttggtaacttggtatacattatacagtagtacaagattgtcggaatttgatttttttctggacaatatcatcaaaaagatttggaatagtaggaaaattctgaatcacatttgggcatccggacaaattttgaatgacaaacatgtaattctctccatctatttttttttgagagagaattctctccatctattaagccgggtattctcgaaaaaaaacccg

SEQ ID NO: 2491 - DNA, 1545 bp, Secale cereale
acccgcaacaggttccccttcttctgtgccgtgctggcctccatgacctccgtcctcatgggctacaacgtggcggtgatgagcggggcgcagatcttcatggcggaagacctcggggtgagcgacacgcagatcgagctgctctccggtgccatcaacatctactcgctcgtcggcgcgctgctcgccggctggacctccgaccgcctcggtcgccgcctcaccattgtgctcaccaacggcttcttcctcgttggcccgcttatcatgacgctcgccggcgggtacacggcgctcatggtggggcggttcatctctggaatcggcgtcggctatgcgctcgtaatcgcgcctgtctacgctgccgagatcgcgccggcctcctcccgcggcctcctcagctcccttcccgagatttttatcaacaccggggtgatgctgagctacgtgtccaacttcgccttctcggcgttgccagcgcacctgtcgtggcggctgatgttcgcggccggggttgtccccaccgtgtttctggcggctggcgtgctcaccatgccggagtcgccgcggtggctggcgatgaagggccggctggacgaggctaaagccgtgctcgacaggacgtcggacacgcttgccgaggccgaacagcgtctgctggagatcgaggaggttgtcgacgctggcgggagcaacggcgatggcggcacgtggaatgaggtggcgaccaaggccggcgtcaggcgcgtgctggccacagttctggcgctgcaattcttccagcaggcgtcgggcatcgactccgtggtgctctacggcccgcgcgtgctggccatggccggcgtcacatccaacaccctcctcctgggcctcaacgtcctcttcggcgtggccaagacgggctcgatcctggtagccatggcgctcgccgaccgcgtcggccggcgccctctgctcctggtgagcaccggcggcatgacggcgtcgctgctcgtgctgggctccgtgttcgctgctttcgccggcgccaaggacgacgcggcggtggccgccgtggccgtagcggctgtggtggcgttcgtctgcaccttctccgtcgggttcgggcctatggcatgggtgtacagctcggagatcctacctctgcggctgcgcggacagggcgcggggctcggcaccgccatgaaccgcgtcatgagcggcatcgtcaccatgaccttcatctcgctctacggggccatcaccatggccggcgcattctacctttatgccgccgtcgcggctgcctcgttcgtgttcatctacacctgcctgccggagaccaggggccggaaccttgaggacatggagcagctcttccgcacaaagtgatcaatcgaccaacctgtgctcacattgatattgtatacttctataattgtcaacttgtgattaagaaatctctggatttggatgataaattttgtgatcaaacggtatacaacattatcaaaatgattctttctatcccccgcgaaaagaaataaaaaccgattctttcttaac

SEQ ID NO: 2492 - DNA, 1490 bp, Pennisetum glaucum
acgtggcggtgatgagcggcgcgcagatcttcatggcggcggacctcggcgtcaccgacgcgcaggtcgaggtgctctcgggcgtcatcaacatctgctcgctcgtcggcgcgctgctggccgggtggacctccgaccgcctcggccggcgcctcaccatcgtcctcgccaacgtcttcttcctcgtcggcccgctcgccatgacgctcgccggagggtacgccgtgctcatggcgggccgcttcgtcgccggcgtcggcgtcgggtacgcgttcgtcatcgcgcccgtctacgccgccgagatcgcgccggcgtcctcccgcggcctcctcagctcgctccccgagatttttatcaacactggagtgatgctgagctacgtttccaacctggctttctcggggctgccggtgcacctctcgtggcgagtgatgttcgcggcgggggtggtgccgacggtgttcctcggcgccggcgtgctcaccatgccagagtcgccgcggtggctcgccatgaagggccgtgtctccgaggccaaggccgtgctcgacaagacgtccgacacggccgccgaggctgagcagcggctgctggagatcgaggacgtcgtcaacggcggcggccggagcggcgagggcggcggcagcgcgtggaaggaggtggcgacgaaggccggcgtccggcgcgtgctggccaccgtgctgactctgcagttcttccagcagtcgtcgggcatcgactccgtggtgctgtacgggccgcgcgtcctcgccatggccggggtcacctccaacaccctgctcctgagcctgaacgtcctgttcggcgtcgccaaggccggctccatcctcatcgccatggcgctcaccgaccgcgttggccgccgcccgctcctcctcgccagcacgggcggcatgacggtgtccctgctcgtcctgggttccctgttcgcggcgttcaccggcgccaaggacgacgtcgcggtggcctccttgagcttcgccgccgtggtggcgttcgtcgtgtccttctccgtcgggttggggccgctcgcctgggtgtacagctccgagatcctgccgctccggctgcgcgggcagggcgccgggctcggcacggccatgaaccggatcatcagcggcgtggtcaccatgaccttcatctcgctctatcaggccatcacgatggccggcgcgttctacctctacgccgccatcgctgccgcctcgttcgtgttcgtctacgcgtgcctgccggagaccaggggacggagcctcgaggacatggaggagctcttccacaccaagtgattcgtacgtctgattaggttcgatttagcggcaatgccgatgaattttgtggatcgttgacacaaatgacacctgcaggtacaaattacggcactgtaaatttgtattctttgttcgcaagactacgagaatattcgattttgcgcttcaatcatcatactgttccgttccttctgaaaa

SEQ ID NO: 2493 - DNA, 2046 bp, Panicum virgatum
aaaacatcagtacacgtcaccttttacatcctaggtggacgacacgttggcagccaagcatccacactcgcgtccacgtcagctccacgcgacgtgcctcacagcccttgcaccgccacgtcattgcccggctccctgtatatctgtccgcgctcattactcgcctgtcccccggggcaattaagccgctgccggcgacacacgacaggtcaccgtgagccgggcggcgagccatggggcaccaaccacgagacgccgaagcgccgctgctcgccaagcccgacgccgccgcgcccgcgccggcgccggcgccggcggtgaagcgcaacaagtaccccttcttctgcgccgtgctcgcctccatgacctccgtcctcacgggctacaacgtggcggtgatgagcggcgcgcagatcttcatggtggaggacctgggcatcagcgacgcgcaggtggaggtgctctcgggcgtcatcaacatctactcgctcgccggcgctctgctggcgggctggacctccgaccgcctcggccgccgcctcaccatcgtgctcgccaacgtcttgttcctcgccggtccgctgtgcatgacgctcgcgggagggtacaaggcgctcatggtgggccgcttcatcgccggcatcgccgtcggctacgacttcgtcatcgcgcccatctacgccgccgagatctcgccggcgtcctcccgcggcctccttacctcagtccccgagatttttaacaacacgggagtgatgctgagctacgtgtcgaacctcgccttctcggggctgtcaccgcacctgtcgtggcgcgtgatgttcgccgcgggggcggtgccgccggtgttcctggcggccggcacgctcaccatgccggagtcgccccggtggctggccatgaagggccgggtcgccgaggccaaatccgtgctccaccggatgtcggacacgcccgccgaggccgagcggcggctgctcgagatcgaggacgtcgtctccggcggcgcccaagggaaagggagtagcagcgcgtggagggaggcggcggcgaagcccggcgtccgccgcgtgctggccatggtgctcacgctgcagttcttccagcaggcgtccggcatcgactcggtggtgctgtacggcccgcggatcctcgccgcggccggcgtcgcctccaacacctcgctcctcagcctcaacatcctcttcggcgtcgccaaggcggggtccatcctaatcgccatggcgctggtcgaccgcgccggccgccggccgctgctcctcgtgagcacgggcggcatgacggcatcgctgctgctcgtgggctccctgttcgcggcgtccgcgggcaccaggggcggcgccgcggcgtcggcggcgagcgtggccgcggtggtggcgtacgtggtgttcttctccatggggctggggcccatggcgtgggtgtacagctccgagatcctgccgctccggctgcgggggcagggcgcggggctcggcactgccatgaaccgcaccatgtgcgcggtggtcatcatgaccttcatcacgctctacaaggccatcaccatggcgggggcgttctacctctacgccgccatcgccgcagcagcgttcgtgttcgtctacgcgtgcctgccggagaccaggggacggagtctcgaggacatggaggagctcttccacaccaagtgattcgtgtcatctttctgatcattcaaatggaggctacggttgtaatcattcaattcaaatgttcgagttttgggctttggcccaaataagtttccatataaaccaaattaggccttctgttgctgcttactccacggtatggtttggagctatccactcggtttacagcagtctagagaggaaatcaaactaatggcaggaaataatttcctgtaataatcagccttcatgactgattattgaaggcttttggttttgtttacaaattcaattaattatgtactgtaccagtagtgcgacatgtgctggtacagtgtgacatgtgctaaaccaaattcacccctccagtcct

SEQ ID NO: 2494 - DNA, 1561 bp, Setaria italica
cggggacacgctgcggactgagccagcgagcgacatggtcagcccacgagacgccgaggcgccactgctctccgagcccgacgacgccgccgctccggcgccggcgcccgggaagcgcaacaagtaccccttcttctgcgccgtgctcgcctccatgacctccgtcctcacgggctacaacgtggcggtgatgagcggcgcgcagatcttcatggcggaggacctgggcatcagcgacgcgcagatcgaggtgctctcggggatcatcaacctctactcgctcgccggcgcgctgctggccgggtggacctccgaccgcctcggccgccgcctcaccatcgtgctcgccaacgtcctcttcctcctcggcccgctgtgcatgacgctcgccggagggtacaacgcgctcatggtggggcggttcattgccggcatcgccgtcggctacgacttcgtcatcgcccccatctacgccgccgagatcgcgccggcgtcctcccgcggcctcctcacctcagtccccgagatttttaacaacactggagtgatgctgagctacgtgtcgaacctcgccttctccgggctgccggcgcacctgtcgtggcgtgtgatgttcgcggccggggtggtgccgccggtgttcctggcggtaggcacgctcaccatgccggagtcgccgcggtggctggtgatgaagggccgggtcgctgaggccaaggccgtgctcgacaggacgtcggacacggcagcggaggccgagcagcggctgctcgagattgtggacgtcgtctccggcgacagcggcggagggaaagggaggagcagcggcgcgtggaaggaggccgcggcgaagcccggcgtccggcgcgtgttggccatggtgctgacgctgcagttttttcagcaggcgtcgggcatcgactcggtggtgctgtacggcccgcggatcctcgccacggctggcgtcaccagcacctcggtcctcagcctcaacgtcctcttcggcgtcgctaaggccgggtccatcctcatcgccatggcgctggtcgaccgcgccggccgccgcccgctgctcctcgtgagcacgggcggcatgacggcgtcgctgctgctggtgggctccctgttcacggcgtccgcgggcgccgccaagcaggacgcggtggcgtcgacggcgagcgtggcggcggtggtgtcgtacgtggtgttcttctccatggggctggggcccatggcgtgggtgtacagctcggagatcctgccgctgcggttgcgggcgcagggcgccgggctcggcacggcgatgaaccgcgtcatgtgcgcggtggtcatcatgaccttcatcacgctctacaaggccatcaccatggcgggagcgttctacctctacgcagccatcgcgggcgccgcgtttgtgttcgtctacacgtgcctgccggagaccaagggacggagcctcgaggacatggaggagctcttccacacaaagtgacaagtgtgatctgatccaacaatcattcagacaaatgtatgagttttggactttggccaaaataaattt

SEQ ID NO: 2495 - DNA, 2089 bp, Panicum virgatum
accagctaggcacatacaaggtggacaacaccttggcacgccgcacccgcacccacgtccacgtcagctccacgcggactcgcctggtggcccacgcggcgccacgtcatcggccggctcgtctgtcccgactcccggggcaattaaagcccggccatcgaccagcacccgctgccctcgacaggtcaccctgtcccctgagtcggccggcgagccatggcgcaccaaccacgagccgccgccgaggcgccgctgctcgccaagcccgacgccgccgtgccggcgccggcggcgaagcgcaacaagtaccccttcttctgcgccgcgctcgcctccatgacctccgtcctcacgggctacaacgtggcggtgatgagcggcgcgcagatcttcatggcggaggacctgggcatcagcgacgcgcaggtggaggtgctctcgggcgtcatcaacctctactcgctcgccggcgcgctgctggccggctggacctccgaccgcctcggccgccgcctcaccatcgtgctcgccaacgtcctgttcctcgccggtccgctcgtcatggcgctcgcgggagggtacggcgcgctcatggtcggccgcttcatcgccggcatcgccgtcggctacgacttcgtcatcgcgcccatctacgccgccgagatctcgccagcgtcctcccgcggcctccttacctcagtccccgagatttttaacaacacgggagtgatgctgagctacgtgtcgaacctcgccttctcggggctaccaccgcacctggcgtggcgggtgatgttcgcggcgggggcggtgccgccggtgttcctggcggccggcacgctcaccatgccggagtcgccgcggtggctggtcatgaagggccgggtcaccgaggccaaatccgtgctccaccggacgtcggacacgcccgccgaggccgagcggcggctgctcgagatcgaggacgtcgtctccggcggcggccaagggaacgggagcagcagcagcgcgtggaaggaggcggcggcgaagcccggcgtccgccgcgtgctggccatggtgctgacgctgcagttcttccagcaggcgtcgggcatcgactcggtggtgctgtacggcccgcggatcctcgccgcggccggcgtcgcctccaacacctcgctcctcagcctcaacatcctcttcggcgtcgccaaggcggggtccgtcctgatcgccatggcgctggtcgaccgcgccggccgccggccgctgctcctcgcgagcacgggcggcatggcggcgtcgctgctgctcgtgggctccctgttcgcggcggcgtccgcgggcggcaccgagctgggcggcgccgccgcggtgtccgcggcgagcgtggccgcggtggtggcgtacgtggtgttcttctccatggggctggggcccatggcgtgggtgtacagctcggagatcctgccgctccggctgcgggggcagggcgcggggctcggcaccgccatgaaccgcaccatgtgcgcggtggtcatcatgaccttcatcacgctctacaaggccgtcaccatggcgggggcgttctacctctacgccgccatctccgcggctgcgttcgtgttcgtctacgcgtgcctgccggagaccaggggacggagcctcgaggacatggaggagctcttccacacaaagtgattgttgtacggtctgatcattgaaatgtaagagttttgggctttggcccaaataaattttcatataaacaaaattaggcctgctcaacatagggcggtgacatggcgccatcgcgaagattgcggtgatgtgaaggtgacgtgtctgtccagtggtctgagaaaaactatggttttacccctactaggtatttgggttgtgtgcttcctgtaaggacgttttgaacatttgctaggcgcctatgtatatatgtggatggaatgttagatagttatatctttcggtgtaggttctctcatttattttgagagagagatttttagagtttaaaagagaggaatgtctctttgatttgagttttttgccatctagcattgtggaatcgaaagatcaatctcgtgttcat

SEQ ID NO: 2496 - DNA, 1322 bp, Zea mays
aacagtgtcgccactcgccacagagcgctccatcaacacgaccgccggtataaacgcagcccccctccggcctccaccaaggccaacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggaagctaaatcacaagaacattcgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacaaggacgcttccgttgacaataaaaatctaacagttgatgttgagactatgaggagaaaggtgaacatagccgaggaagctgtcaggaggctaactgggatcaccctcatgctaccgaccgcttttgagaagcccacgagcagcgcgcccctgtcatcatgtccatctgatgcagcttctgcttctgcttctgccgccattgaagacagcgtgaagcatttcctccaggcgccacttgaaaacagtgggatcatcccaaacgcagcagtttttcagaccaagccagcttctctgcaccgtgttgctagcctggagaacctgcagaagaggatcgtcggggatgcaatgtattccgagaccgcgtcaacgacattctcagatcctgaagctcttgccgataggtaaaggttgctcctgtcctgtgatgaacagccgtgtgatgctctagcggcctaagtgcttctggtaatggaagttgtagcacccatgcgcctgggtggggtctacacagtgatttgtacactattttgaaggttaataataattgttgagaaatgatctcatccctttgtacctatataagtaaagtattccattaataaagagaatagagttttcactcttcat

SEQ ID NO: 2497 - DNA, 1391 bp, Setaria italica
atgagaatcaaaaccaaagggcatttccggaaaagtcccacagtgtcgccactcgcccactggcgccccagcaacgctgccggtataaacgcggcctcccctccggtgtccaccattgctcaggttgctcccagctcccttccttccccctcaggccctcaccgaggtacgaggtgcgagaaagaaagcgactttcctccgagcatggcgggcggctgcgccgaagacgacgtggtggaggtgagctgcggcgggggcggccgcgaccccggcgcctacgcggcggtgctcaagaggaggctcgacctgtactgcgccgccgtcgccaaatccatggaagctaaatcacaagaatcttcgttgggctaccccaacacacaagcttcaaatacttcacaattgatttctcaagcttcctttgatgatgatggagatggggcagatctagttacaaactcaaacatcatagactatgatgattttcgaggcaagccagctaacagtggcacatcaaaggaacaatcagatgatgatggcgatcttgaggagaatactgaccctaccaatacaaagaagatgaggagaatgctttcaaatcgagaatcagctaggcgatcaagaaagaggaagcaagaacacctgaccgatcttgaatcacaggtttccaggttaacatctgagaatgcatctttgctaaagcgcttggctgatatgactcagaaatacaaggatgcaacccttgacaatagaaatcttatagttgatgttgagactatgaggagaaaggtgaacatagcagaggaagctgtcaggagactaactggaacaaccctcctattacccaccacatctgacaagcccgcgagtagcatgcgcttgacttcatgtgcatctgatgcagcttctgcttctgtcgccattgaagacagcatggaacattttctccgggcgccatttcaagacagtcagaccaagctcgacctccaaaatgcagaaattcctttggccagtggagagataggcaccaagctggctcctatgcgacgtgtcgctagcttggagaacctgcagaagaggatgcatggagattcattacattctgagactgcatcaacgttctcatcagatcctgaatcttttgctcataggtaacatgggttataaagattgctctctgatgagcttgccttttaatgttctagcgagctaagttttgtgttatgaagcttgcagcacccacatctgggtgagatccatactgcgacatgtacactatcttaaggttaaaggacatgtgttgtgaatcggaggagtagtaacctcagatatatgaatacatcatactagatgaaattctgcaatatatttacttgcacatggttgtttttgtc

SEQ ID NO: 2498 - DNA, 1523 bp, Zea mays
tcatcactccctcgtcccccttccactttccccacctcacccggtcaccccttctctgcctcgtctccactcctccccccgccgccctcgccccagagccccgccgcgcgattgggctctgcaccctcctcggatccgctgccgcacgtcgtcgccaatcgacattccccgtttccctccgccggttcccgttgctgcgcctgcctgctttacccccttaccgtttcctgaccctgtcctggttcgcgggtttcccgaattcgcgcgctcttgcggcggcgagatccggcccgctcgtcgtagggagagggagccgaccgctcctgatccgagccgcgccccgcgggggtttcgtatcccgttctcccttctggtccggccacaggatcgcagtcgcaaggctgaggagcagcaggggagatggcgccgccctacgtgctgtcgctgctgctgctgctggtgctgtccgtcccggccgtcttcctcgtcgcgccgcgcctcatcccgccccgcgcgctcccggccatcccggacgccgacgagacggaggacctcgcgctgttccgccgcgccgtgctcctctccgccgcgccctcctccaaggccggcgctggccccgcctccccctcgcgtttcttcggcgctgcccaccgccgacagaggaagcagaaggtggcctttctcttcctcaccaactccgacctcgtcttcgccccgctctgggagaggttcttcgcgggccaccacggcctcctcaacgtctacgtccacgccgacccggctgcggcgttcgccctcccgcccacgccctccttccgcggccgcgtaatccgggggaaggccacccagcgcgcctccgccacgctcatctccgccgcgcgccgcctcctcgccaccgcgctgctcgacgacccggccaaccacttcttcgcgatgctctcccagtcctgcgtcccgctgcggcccttcccggccctctaccgcacgctcaccgctgacactgccggcccgcgcggccgccaccgcagcttcatcgagatcctcgacgccgagcccactctgcacgaccgctactacgcgcgcggcgacgacgccatgctcccggaggtgccctacgagagcttccgcgtcggctcccagttcttcgtgctcaccaggaggcacgctgtcatggtggtcagggacaggaggctttggaacaagttcaagctgccgtgtctcgtcaagaggaagcactcgtgctacccggaggagcactacttcccgacgctgctggacatgcaggaccccgcaggatgcaccaagttcacgctcaccagggtgaactggaccgactcctttgacggccacccgcacacgtaccagccggaggaggtgtccccggagctcatcagggacctcaggaagtccaatggcacatactcccacatgtttgcgcgcaaattcgcgcctggatgccttgcgccgctcatggagattgccgactctgtcattctccgtgactaggctgcttcttagcatcc

SEQ ID NO: 2499 - DNA, 2056 bp, Panicum virgatum
cgtcctcactcccctctctttccccaacccctcctccctctgctccgcttcttctccactcctcctcccgcccgcccccgccgggctgcgccggatccgccgcgcgccgcgccattccctcctccgccccccgccggtccctctgctccacgctcccgccgcttctccttccattcttgatcctgctctgctcccccgcaagttcccgaatttatcaccccccggcttcctccgattaatgcccgcgggctccgatccccgcaggcagagacacccatcctgaatcgcgggggtcattttattttattttatttttggtctgagattgagcgttccttccactccctcggtgcctgtcggttgatcggagcccggggatcgccgcggcgtttgcgtcctccggtcgggcgggtggctgagcgatggcgtcgccgtacgccgcctcgccgtacgtcctgtcgctgctgctgctgctgctctccatcccggccgtcttcctcctcgcgccgcgcctcatcccgccgcggacgctcccggccatcccggacgccgacgagaccgaggacctcgcgctcttccgccgcgccgtcctcctctccgccgcgccctcgtcctccaagcccgccgacgccgcaaccccctccttcttcggcggcgccgccggcttccggaagaggaagaagaagcagcagcccaaggtggcgttcctcttcctcaccaactccgacctcgtcttcgccccgctctgggagaagttcttcgagggccaccacggcctcctcaacgtctacgtccacgccgaccccgccgcggcgctcgccctgccgccgacgccctccttctggggccggatcatccccgggaaggccacccagcgcgcctccgccacgctcatctccgccgcgcgccgcctcctcgccaccgcgctgctcgacgacccggccaaccacttcttcgcgctgctctcccagtcctgcgtcccgctccacccgttcccggccctgtaccgcacgctcaccggcgacattgccggacccaagggccgccaccgcagcttcatcgagatcctggatgccgagcccacgctgcacgaccgctactacgcccgcggcgacgacatcatgctcccggaggtgccgtacgacagcttccgcgtcggctcccagttcttcgtgctcaccaggaggcacgccgtcacggtggtcagggaccggaggctctggaacaagttcaagctgccctgcctcgtcaagaggaagtactcgtgctacccggaggagcactacttcccgacgctgctggacatgcaggaccccagcggatccaccaagttcacgctcaccagggtcaactggaccgactcctttgacggccatccgcacacctaccagccggaggaggtgtccggggagctcatcagggagctcaggaagtccaacggcacctactcgcacatgtttgcgcgcaaattcgcacccgagagccttgggctgctgatgaagattgccgactccgtcatcctgcgtgactaggcttgttgtatctgtttgcagagctgaaagcagtcaaagcaccgagggttgtgatgtgataaacaagcgtaagctgatccatccattccctttggaattcttcagataggagcaaccagcacccactttgctttgttcctgctgttggtctttggcaaaagatgttgccatgcttcagagacagagagcatgatggtgttggtggcggaaggccccagctgcctcttgtgagtattttttgtttttgtgtgtcttgtttcttttttttcccaatgtgagctgcgtggtggcagaagatgagggagaagttgttggtacgtaataggttgtagttagcatgatcatcctgtgtattagcatggagacaatatgtggatacatgcagtgatggtttgtagtatatatatatatatatatgtcaatatcacgccttcttaaaatgtatcatttgtgccgtggcaccattggcttacctttcaagtctgtcactatgtggtaaagtctcacagcttcacagctgtctt

SEQ ID NO: 2500 - DNA, 2054 bp, Setaria italica
cgccctcactcccttctctttccccaaccccctgctccgcttcttcttctccactcctccctcctccctcccccgccgcgcgattgggccggatccgccgcgcgcctcgccattcccagccctcctcctcctctccccgccgtcctgccggtgctcctcggttccatgcggctgctgctggtctcgctgagcctgccgctgcggtttctctccccttccattcctgatcctgctctgctccgcggggttccctgatttacccctcctcccaccttcctccggttaatgcccgcgagatccgatcccagcagggaaagaaacccctcctgaatcgcggggattttgattgctcttggtgtttccattcccgtcgtctcctgtcggttgatcggggtccggggatcaccttcctcccgttcgagagagaagaaggatggcgacgccgcacgccgcctcgccgtacgtgctgtcgctgctgctgctgctgctctccatcccggcggtcttcctcctcgcgccgcgcctcatcccgccgcggacgctcccggccatcccggacgccgacgagaccgaggacctcgcgctcttccgccgcgccgtcctcctctccgcggcgcccgcctccaaggccgccgccaccgccgccgaccccgccggcgccgccaccacctccttcttcggcggctacgggaggaagaagaagaggcagcagcccaaggtggcgttcctcttcctcaccaactccgacctcgtcttcgccccgctctgggagaagttcttcgccggccaccacggcctcctcaacgtctacgtccacgccgaccccgctgcggcgctcacctcgcccccgacgccctccttcaggggacggatcatccccgggaaggcgacccagcgcgcctccgccacgctcatctccgccgcgcgccgcctcctcgccaccgcgctgctcgacgaccccgccaaccacttcttcgcgctgctctcccagtcctgcgtcccgctgcatccgttcccgtccctctaccgcacgctcaccggcgacaatggcggccccaagggccgccaccggagcttcatcgagatcctcgacgccgagcccacgctgcacgaccgctactacgcccgcggcgacgacgtcatgctcccggaggtgccgtacgacagcttccgcgtcggctcgcagttcttcgtgctcaccaggaggcacgccgtcatggtggtcagggacaggaggctctggaacaagttcaagatgccctgcctcgtcaagaggaagtactcgtgctacccggaggagcactacttcccgacgctgctggacatgcaggaccccggcggatccaccaagttcacgctcaccagggtcaactggaccgactcctccgacggacatccgcacacctaccagccggaggaggtgtccggggagctcatcagggagctcaggaaatccaatggcacctactcgcacatgtttgcacgcaaattcgcgcccgagtgccttgggccgctgatgaagattgccgactctgtcatcctgcgtgactagcctggttgtgaccgtttgcagagctgaaagcactgagggttgtgatgtgatgaacaagcgtaagcttatccatccattccctttggaattcttcagacaggagcaatgagcatcaagccgattttgctttgttcctgcagttgatctttggcaaaagatggtgccacgcctcaagagagtatgatggtgctgttggtggcgaaagggccccagctgcctcttgtgagtattttttttttgtgtgcgtccttgttgtttcttttctttccccaatttgagcttctggtggcagaagatgagggagaagttggcacgtaataggtcgtagttagtatgatcatcctgtgtattagcatggagaatctgtggatacatgcagtgatggtttgtagtgtctgttatatatatacatatgtcaatatcacgccttcttaaaatgtatcatttgtgtcatggcaccattggcttgcgtttgaagtcataccattggcttgcctttcaa

SEQ ID NO: 2501 - DNA, 2086 bp, Hordeum vulgare
ggagagcagagcagagcagcaagagcccccacaaaagcagcagagcacaacacctcaccccctcactcctcccccacctcttctccctccaaaaaccagcgcctttccccctccaaacgccgcatccgtcccgccagaaccgcgagatcggatccgagcaccaccagcagcagattccgcgccacggcaacgagctcctccccgtccttcttcccctccgcggaggctggtccgattcgatcctccaggcgcgccggcgctctccgttggtggaatctttcccccgctcgatccatgtccgggcggcccccgttcttgccagcgagatccggtcagtccctcccgagcggcaggatctctctgtgatccccctctccgccttcttctttcccggcgggaagatccggggtttcttgggcggtttcctcgggggctcgccggacatggcgtacgcgtcgccgtacgtgctgtcgttcctgctgctgctctccatcccggcggtctacttcctcgcgccgcgcctgctgctgcccaagacgctcccggccatcccggacgcggacgagacggaggacctggcgctcttccgccgcgccgtgctcctctcggccgcgccgggcgcgcccgtcgccgccgccttctgccgccgcccgcaggcgcggcccaaggtggccttcctcttcctcaccaactccgacctcgtcttcgcgccgctctgggagaagttcttcgcggggcaccacggcctgctcaacgtctacgtccacgccgaccccgccgccaacctcacgctgccgccgaccccgtccttccgcggccgcatcatccgcggcaaggccacggcgcgcgcctccgccacgctcatctccgcggcgcgccgcctcctcgccaccgcgctgctcgacgacccggccaaccacttcttcgcgctgctctcccagtcctgcgtcccgctcctcccgttccccgccctctaccgcaccctcgtcaccgacaacaatgccgccggcgccggccgccaccgccgccaccgcagcttcatcgagatcctcgacagcgagcccaccctgcacgcccgctactacgcgcgcggcgacaacgtgatgctcccggaggtgcccttcgaccgcttccgcgtcggctcgcagttcttcgtgctcgccaggcggcacgccgtcatggtggtcagggacaggaggctctggaacaagttcaaggcgccatgcctcgtcaaggagaaggactcgtgctacccggaggagcactacttcccgacgctgctcgacatgcaggaccccgacggctgcaccaagtacaccctcaccagggtcaactggaccgacgccgtcgacggccacccgcacacctaccagccggaggaggtctccggggacctcatcagggagctcaggaagtccaacggcacctactcccacatgttcgcgcgcaagttcgcggcggggacccttgcgccgctcatggagatcgccgactccgtcatcctgcgtgactaggcgctccggtgttcgtcgagatgaacagaacaagggttgtgatgtgatgaagaagcataagctgatccatccattcctttgtggtttcttcagagatgagcaagccagcaccaaacctacttcgccttgttgttccgtcagtgtccgtcggccgcgaaggggatgctgctgcttgctcagactcaagagagtgatgttggtgtcggtggcgaagtgccccgactgcctctatcctatgtgagtatttgttgtgtttcttggtgttttcctttccactttgatccgagcgagaggaagtcgttggcacgcggtaggcgtgttagctggtagttagcacggatgatcatcctatgtattcacaatggaggcaacctgtcgatacatgtagtgatggtttttgtagtatatgttatccccatgttgtcattgtcaatatcacacaccttttcctctaaatgtgtcatctgtatcatggtaccactatcttcttgctttgaaccgaagttgcttatattctttctggctttaggtgccaaccgcacctgccttagcatatacagtactcaattcct

SEQ ID NO: 2502 - DNA, 2048 bp, Secale cereale
ggggacaaccaacgacgccttaccccctcccaaacgaccgcaccaacgagcagcccagtcccgccagaaccgcgagatcggatccgagcgccgccagcggcagattcggcgccacggcgacggagccagagcccccgctgctccccccggagaggtgccccggctcgtgatcctggttcgttcggcttctcctgcgaaatctgctcgatccatgcccgggaggtgcccgttcttgcccgcgagatccgtccggcccgtcctgagcagcaggatttctctgtgatcctcgtcttggccttcttccccggcgccaagatccgggatttcccttcggtttctctagcgtgcgttttcttggggctcgccggagcgccgccggcgccgggcatggcgtacgcgtcgccgtacgtgctctcgttcctgctgctgctgtccatcccggcggtctactacctcgcgccgcgcctgctgctgcccaagacgctgccggccatcccggacgcggacgagacggaggacctggcgctcttccgccgcgccgtgctcctctcggcggcgccgggcgcgcccggcgccggcgcgttcggccgccgcccgccgcagccgcggcccaaggtggccttcctcttcctcaccaactccgacctcgtcttcgcgccgctctgggagaagttcttcgcggggcaccacggcctcctcaacctctacgtccacgccgaccccgccgccaacctcacgctgcccccgaccccgtccttccgcggccgcatcatccggggcaaggccacggcgcgcgcctccgccacgctcatctccgccgcgcgccgcctcctcgccaccgcgctgctcgacgacccggccaaccacttcttcgcgctgctctcccagtcctgcgtcccgctcctcccgttccccgccctctaccgcaccctcctcaccgacagcaatgccgccggcgccggccgccaccgccgccaccgcagcttcatcgagatcctcgacagcgagcccacgctgcacgcccgctactacgcgcgcggcgacaacgtgatgctcccggaggtgcccttcgaccgcttccgcgtcggctcccagttcttcgtgctcgccaggcggcacgccgtcatggtggtcagggacaggcggctctggaacaagttcaaggcgccgtgcctcgtcaaggagaaggactcgtgctacccggaggagcactacttcccgacgctgctcgacatgcaggaccccgacggctgcaccaagtacacgctcaccagggtcaactggaccgacgccgtcggcggccacccgcacacctaccagccggaggaggtctccggggacctcatcagggagctcaggaagtccaacgggacctactcccacatgttcgcgcgcaagttcgcgccggagacccttgcgccgctcatggagatcgccgactccgtcatcctccgtgactaggcgctccctcaccggagcgcaaagtgttcgtggacatgaacagaacaagggttggtgatgtgatgaagaagcataagctgatccatccatcccctttgtggtgtcttcagagaggagcaagcaaccagcaccaaacctacttcgccttgttgttccgtcgctgggcgttcggcgaaggggatgctgctgctgcttgcttgctcagaatcagagagtgatgtggtgttggtggcgaagtgccccggctgcctccatcctatgtgagtatctgttgtgtttcttggtgttttcccttcccactttgatccgagcgagagcgagtcgttggcgcggcacgcggtaggcgtgccgtccctggtagttagcacgaatgatcatcctatgtattcgcaatggaggcaacctgtcgatacatgtagcgatggtttttgtagtatatgttatccccatgttgtcattgtcaatatcacacgccttttccctctaaatgtatcatcatcatctgtatcatggtgccactattttcttgctttgaacccaagttgcttatattctttctggctttaggtggcaaccgcacctgcctt

SEQ ID NO: 2503 - DNA, 2235 bp, Brachypodium distachyon
aaaccgtggcattagcttagagtagagtagagcaggacagtggggttcttgagagcagagcagagcagagagtcccacaaaagcagctgagcacaacacctcactcactcctctttccccaacctccgggctcatccccatccagctacctattctccctccaaaaatttccccgccagaatcgccagatccgatccaggaagcagcggcagcgcccgggcctccactcgcgccgccgcaagagagcccggctcagttcttctcgcgctctgttcttctttacctgcggcggtcagttggttcttcttatctttggtttcgcgcgcgcgcttgatcctggagttcttgttgcccgagatccggtgtcccgggggagaagttggagaaccctattcgtgggttttgttttttccctgctcttgatccagctgagttcgtgcggcaatctcttcgtctgattcttgttcccgggcgcaaagatccaggattttcttcttcaatctcttcgtctgattctgttgaatttgttgtggtcgccggagatggcgccgccgtacacctcgccgtacgtgctgtcctcgctcctgcttctgctgtccatcccggctgtggtgctcctggcgccgcggctgctgctgcccaggacgctcccggccatcccggacgccgacgagtccgacgacctcgcgctgttccgccgcgccgtgctcctctcctcctccggctccggcgccggcggagccggcggcttcgtcgtccgcgggcggccgcagcccaaggtggccttcctcttcctcaccaactccgacctcgtcttcgccccgctctgggagaagttcttcgcggggcaccatggcctcctcaacctctacgtccacgccgacccctccgccgtgctcgcctcgcccccgacgccttccttccgcggccgcttcatctccggcggcaaggccacggcgcgcgcctccgccacgctcatctccgctgcccgccgcctcctcgccaccgcgctcctcgacgatccggccaaccacttcttcgccttgctctcccagtcctgcgtcccgctccacccgttccccacgctctaccgcacgctgctctccgacaacaacaatgccggtgccgggcaccgccgccgccatcgcagctttatcgagatccttgacagcgagccgacgctgcacgaccggtactacgcccgcggcgacaacgtcatgctcccggaggtgccgtttgacgctttccgcgtcggatcgcagttcttcgtgctcgcaaggcggcatgccgtcatggtggtcagggacaggaggctgtggaataagttcaaggtgccgtgcttggtgaaggagaaggactcctgctacccggaggagcactacttcccgacgctgctcgacatgcaggaccctgatggatgcaccaaatataccctgaccagagtcaactggacagacgccgtcgatggccacccgcacacataccagccggaggaggtatctggggagctcatcggagagctcaggaagtccaatgggacctactcgcacatgtttgcgcgaaaatttgcgcccgagtgccttgggccgctgatggagatcgctgactctgtcatcctgcgtgactaggtgccggaccggagtttgtgtttgcagagctgaacaggatgaggattgtgatgagatgaacaagcataagctgatccatccatccctttgtagtttcttcagagaacagcaaactttgccttgttccatcagtggctgttgtcaaagagatgctgctggtcagaaagtgatgtagtgtcggtggcgaagggccccaactgcctctatgtgagtattgttgtgtttcttggtttctttttttcttcccaatttggtccgatggagaagttgttggcacgtaataggtcgtagttagcacgaatgatcatcctatgtattagaatggaggcaacctgtcgatacatgcagtgatggtttgtagtatatgttatcatgttgtcaatatcacacactctttctctaaatgtatcatctgtatcatggcaccactatattcttggctttgaactgaagtcatatatattctggctttaggtggcaactgcacctgccttagcatatactgctccaattctgaacagcaagactgcaattctgccctactaaactgctaacagatagtcaaaaagtagctatccaaacaggattaaacaacccatcacagtaa

SEQ ID NO: 2504 - DNA, 1951 bp, Avena sativa
cccctaacttcttcctccgtcctccctccaaataaatcagtcccgccacaaccgcgagattggatccgaagaccagcaccgcagatttggcgcgagatcctcttctgttccttcctgcggtttctcttcaccacttgatcccagagatttgatccccttgaggagcgcacgcaaacactttgagcgcgcgtccctgtttttcttgcaaaatctgtctctgttcggtcgattcatgtcccggcggtccctgttcttgctcacaagatccggtgcccggagggtcctcctctgatccagtcgaagatccgagctttttctctttattcccaccccaaggctcgccggagatggcgccgccgtacgcctcgccatacgcgctgtccttcctcctgctcctgctctccgttccggcggtgttcttcctcgcaccgcgcctgctgctgcccaggacgctcccggccatcccggacgccgacgagaccgaggacctcgcgctcttccgccgcgccgtcctcctctcggccgcgcccgccgcgtcaggctccctcttcggccgccgcccgcaggtgcagcccaaggtggccttcctcttcctcaccaactccgacatcgtcttcgcgccgctctgggagaagttcttcgcggggcaccacggcctcctcaacctctacgtgcacgccgacccttccgccgtcctcaccgcgcccccgaccccatccttccgcggccgcatcatccgcggcaaggccaccgcgcgcgcgtcggcgactctcatctccgccgcccgccgcctcctcgccaccgcgctccccgacgacccggccaaccagttcttcgcgctgctctcccagtcctgcgtcccgctccaccccttccccaccctctaccgcacgctcgttaccgacaacaatgccggccccggccgccaccgccaccgcagcttcatcgagatcctcgacagcgagtccacgctgcccgcccgttacaacgcccgcggcaacgacgtcatgctcccggaggtgccgttcgaccgattccgcgtcggctcgcagttcttcgtgctcgccaggaggcacgccctcatggtggtcagggacaggaggctctggaacaagttcaaggccccgtgcctggtcaaggagaaggactcctgctacccggaggagcactacttcccgacgctgctcgatatgcaggatcctgaaggctgcaccaagtacacgctcaccagggttaactggaccgatgtcgtcgacggccacccgcacacgtaccagccggaggaggtgtccggtgagctcatcagagagcttaggaagtccaatgggacgtactcgcacatgtttgcgcgcaaatttgcgtccgcgactcttgggccgctcatggagatcgccgactccgtcatcctgcgtgactaggcgcggattgtgtgttcgtggagcttgaacagaacaaggtttgtgatgtgatgaacaagcgtaagctgatccatccatccacccccttgcagtttcttgagagtggagcaaccaaccagcaccaaacccactttggcttgttcccatccatcagtggccgttagcaaagcaacgctgccgagtgatgtggtgttggtggcgaatggccccggcaacctcttatgtgagtattgttgttgcgtttcttggctttcttctttccagtttggtccggttgaaggagaagttgttggcacgtagtaggtcgtagttagcaagaatgatcatcctatgtattagaatggaggcaacctgtctgtcgatacatgtagtgatggtttgtagtgtatgttttatcgtatttggcaattgttaatatcacaccttttgctctatgagtcttatcagctgtatgaatcatggcgccactgtcttgtttctttgaactgaagccctatatgagtgttctggatttaggtggcaaaaaaaaaaaa

SEQ ID NO: 2505 - DNA, 1426 bp, Panicum virgatum
cactcctcccgcccgccgccccagccgcgcgattggcccgccgggctgcgccggatccgccgcgcgccgcgccattcttccctcctctgctccatgcgcctgccgcggtctcgctcccgcttctccttccattcttgatcctgctctgcgccgcaagttcccaaatttatcgccccccggcgtcctccgattaatgcccgccggctccgatccccgcaggcagagaaacccctcctgaatcgcggggatttttctttatttttcttggtccggaattgagcgttccttccattcccttggtaactaactgtgtgtgggttgatcggagcccggggatcgccgccgcggcgtttgcgtcttctgggcgggtggctgggagatggcgtcgccgtacgccgcctcgccgtacgcgctgtcgctgctgctgctgctgctttccatcccggccgtcttcctcctcgcgccgcgcctcatcccgccgcggacgctcccggccatcccggacgccgacgagaccgaggacctcgcgctcttccgccgcgccgtcctcctctccgccgcgccctcgtcctccaagcccgccggcgccgcgaccccctccttcttccgcggcgccggcggcttcctgaataacaagaggaagaagcagaagcagcagcccaaggtggcgttcctcttcctcaccaactccgacctcgtcttcgccccgctctgggagaagttattcgcgggccaccacggcctcctcaacgtctacgtccacgccgaccccgccgccgcgctcgccctgccgccgacgccctccttccggggccggatcatccccgggaaggccacccagcgcgcctccgccacgctcatctccgcctcgcgccgcctcctcgccaccgcgctgctcgacgacccggccaaccacttcttcgcgctgctctcccagtcctgcgtcccgctccacccgttcccggccctctaccgcacgctcaccgccgacattgccgggcccaagggccgccaccgcagcttcatcgagatcctcgacgccgagcccacgctgcacgaccgctactacgcccgcggcgacgacgtcatgctcccggaggtgccgtacgacagcttccgcgtcggctcccagttcttcgtgctcaccaggaggcacgccgtcatggtggtcagggaccgcaggctctggaacaagttcaagctgccctgcctcgtcaagaggaagtactcgtgctacccggaggagcattacttcccgacgctgctggacatgcaggaccccggcggatccaccaagttcacgctcaccagggtcaactggaccgactccttcgacggccatccgcacacctaccagccggaggaggtgtccggggagctcatcagggagctcaggaagtccaacgcacctactcggtacatgttt

SEQ ID NO: 2506 - DNA, 2333 bp, Oryza sativa
ccccaacctcctctcctctcctctcctctcctcttcttctccctccaaaaatctcctcctccgcttcactcgctccccttccctccattccattcccttcctcttcgcccgccgcgagatcggtagaccaaattaaccacactcgcgccgccattctcttcttcttcttcttcttcttcttcttcttcttcagttgagctgcttgtcccgagctctgctcgtttcttggcgtcttctttcttcttcttcctcctcggtgcggttgcggtttcgttttcgttttctttcccctttttctgtcggttaattcggcgacgtctgatccgccatgagagcgagcagtttgttcactcagttccccttcgtctgatactgatccctcctcactctctgctcgatttctcatcgtctctgtaagcaagatccgatccccggaggccaaaacccctcccgaatcgcgtggttcttgtttgttctaatcatccttcgattgggttgggttgagcaatcgattgcgttgttgttcttgctgatccgaagatccaaaggaggaggaggagcttgaggttgaaatttctcgccggagatggcgctgccgcacgccgcctcgccgtacgtgctgtcgctgctgctgctgctctccatcccggcggtgttcctcctcgcgccgcgcctcctcccgcccaagacgctcccctccatccccgacgccgacgagaccgacgacctcgccctcttccgccgcgccgtcctcctctccgccgccccggactcctcctccgcctccgccggcgccgcctccctcttcgggcggcggccgcagcccaaggtggcgttcctcttcctgaccaactccgacctcgtcttctccccgctctgggagaagtacttcgccgggaaccaccacctcctcaacctctacatccacgccgaccccagcgccgccgtcgacctccccgccaccgcctccttccgcggccacgtcatccgcggcaccaaggcgacggcgcgcgcctcggccacgctcatctccgccgcgcgccgcctcctcgccaccgccctcctcgacgacccatcgaaccacttcttcgccctcctctcccagtcctgcatccccctccaccctttccccaccttctaccgcaccctcctctccgacagcgacaacaatggcggctcgcctcgccgcccccgccgccgccgcagcttcatcgagatcctcgacaacgagccgacgctccacgaccgctactacgcccgcggcgacgacgtgatgctacccgaggtgccctacgacagcttccgcgtcggctcgcagttcttcgtgctcgtgcgccgccacgccgtcatggtggtgagggatcggaggctgtggaacaagttcaagctgccatgcctgaccaagaggaaggactcgtgctacccggaggagcactacttcccgacgctgctcgacatgcaggatccgcagggatgcaccaagttcacgctcaccagggtcaattggaccgactccgtcgacggccacccgcacacctaccgccccgacgaggtctccggcgagctcatcagggagctcaggaagtccaatgggactcactcctacatgttcgcgcgcaaattcgcgcccgattgcctcaagccactgatggagatcgccgactccgtcatcctgcgagactagatgaatgatgctgtgtttgcaagagatgaatgcaatgagggctgagatgtgatgaacaagcataagctgatccatccatacccttgcagattctccagagagtacaaaccaggaccaagccttggtttgctttgttttcttcaactgcactcgtcaaaaagatggtgcttctcgagagagcatgatggttggtgttggtggcaaaagggccccagctgcctcctatgtgagtatttttctctgtatcttttgttttccctttcgaatttgagctcaagtggtggccaaaatgaggaggggagaaggttgttggcacgtaattagagtagtagttagcatgatcatcctatgtattacatggaggaaaatctgtcgatacatgcagtgatggtttgtagtgtatgtttatatacaatatgtcaatatcaagccctttttttcgtccgaaatgtatcgtttgtatcatggaaaacctatcttgtgtttgaagtcatattctgccattaggtggttactgctaactgcactttccttgcaaatctgatctctgaagaggaaaggactaccaatgtttatactaacaaaaatatgaatcaatcagcctttgaaactgaaataagtacttctgaagattatgatgttgtttttg

SEQ ID NO: 2507 - DNA, 1010 bp, Setaria italica
gagagaactctgccgcgctagctgctcgctcgctccacccgatcgagcgagcactcgtcacccgtcaatcccgacacgcgacgcggcgaagccatggggaggtcgccgtgctgcgagaaggcgcacacgaacaagggcgcgtggaccaaggaggaggacgagcggctggtggcgtacatccgggcacacggggaagggtgctggcgctcgctgcccaaggccgcggggctgctgcgctgcggcaagagctgcaggctgcgctggatgaactacctccggccggacctcaagcgcggcaacttcaccgacgaggaggacgagctcatcatccgactgcacgcactcctcggcaacaagtggtctctgatcgccgggcagctgccgggccgcaccgacaacgagatcaagaactactggaacacgcacatcaagcgcaagctcctcgcccgcggcatcgacccgcagacgcaccgcccgctcggagccggcggcgccggcgccgacgccgcggcggctaccggcatcgcggcgcaccgggcggcggcgctgctgcaccccgcagccgccgccccggcttctcccgtcgcgctcgccgtgatcaaaccggcgccggcggagtcgtcggacgacggcgggcgcagcagcagcagtagcggtggcgcgagcacgggggagccacggtgccccgacctgaacctcgacctgtccgtcggcctgccggcggccgacacgcccacctcgcagccgcagccggtggtgtgcctctgctaccgcctgggcctccgcgccggcgaggcctgcggctgccaggctgacaagccgggcccgcaggggttcagatatttcaggccgttggagcagggccagtacatatgaatcacccagagagaggactgatggaggagtcgctgtgtttagatagcttcatcgcggcaatttgtaagacaggcagttttctgagtaacggacagcactgttcaagggagggaaatgaaaaaggaggttaaaac

SEQ ID NO: 2508 - DNA, 1209 bp, Saccharum officinarum
gtgtttcacacttctatcttgtgaataccaagcttgactgccggccggatctcatcccatgcgagaggctaagaggggactatagctgtggcgtgcgaaggaccacgaaagcagccaagcaagcatcggtggtgcggtggccgcccgtagcacctccatcatggggaggtcgccgtgctgcgagaaggcgcacaccaacaagggcgcgtggaccaaggaggaggacgagcggctggtggcgtacatccgggcgcacggggaggggtgctggcgcccgctgcccaaggccgcggggctgctgcgctgcggcaagagctgcaggctgcggtggatgaactacctccgcccggacctcaagcgcggcaacttcaccgacgacgaggacgagctcatcatccgcctgcacagcctcctcggcaacaagtggtctctgatcgccgggcagctgccgggccggacggacaacgagatcaagaactactggaacacgcacatcaagcgcaagctcctggcccgcggcatcgacccgcagacgcaccgcgcgctcggcgccgacgccgccacggctcccggcgtcgcggcgcaccaccgggcgacagcagcggcgctgctgcaccacgcgggcgccgccgtcgtcgtcgtcccggcccccgtcaagctcgccgccgtgaagccggcgccggcggagtcgtcatccgacgacggcggaagcagcagcggcagtagtagcggcggcggcgcgggggagccgcggtgccccgacctcaacctcgacctgtccgtgggcccgccggcggtggtggccgacactcccaccttgcatctggcggtgtgcctgggctatcgcctgtgccttcgtcctgggaggtttgctgttactatgctcaaattgtattgtgtgagtatctggttttattgatttcgggctggttgatattggaactatgtcttattgtaatgcgttctgtgttatatgtgcgtttctgttggtttactagtgtacactgaattgttatattaattatatttgatatgaaatgtaattaatagtctgtataccttattcgtattgttttctaatatggactgtcgacatggttcgtatatgtcattcataattgatatggtaatgagattgtcttgcttctagagaattttatgtgtaataatatttggaattggaattgttatttaatgtcggtttagaag

SEQ ID NO: 2509 - DNA, 1039 bp, Zea mays
gccgttgcttcgcgacacctcgctcgcttctcttccaggcttccacctccacttccacatggccgctcccatccacgcgcgtctcctcccgctccccttgcacccgaacccaagccccagtctccacgcgagcggcacacgacgggtgccctggcccccgcgccaccgccgccgctgcctcgcgacgccgccgtcgcggaacgggagctcctcctcgccggagattgactggtgcccggtgcctccggaccagctccccgtgaacgagtacgaggcgctcgcggcctccctgcccttctcctgggcggcggggggcctccgcgtctactgctcccgcctcgcgctcacgggcgccgccgtcgcgctcttcgtcgggctcccggtcgccgccttcgggggccgcggcggggccggcggcgacgctctgcacctcgcgctcggtgccacggggtccgggatcctcgccgtcacgctcgctgtcgtgcggatgtacctcgggtgggcctacgtcggcaaccgcctgctcagcgccacagtggagtatgaggagacgggatggtatgatggtcagatatgggttaaaactccagaagttttagctcgtgatcggcttctaggctcattttctgtcaagcctgtgctaaacagggtgaagttcaccttggtgggtctggcaggctccctgatcctttgcattcttctgtacgtgaacacggaaaccccaaaggaaccttatggaaataccggtggaaggtctatcccgggagtgtacagcgacgctgctgcaaggtcgtttgagcccgatgcattctgtggagaacctgatttgtcgtagcatcgtaaagcgtggagcatggaaggtttgtagatggcggtatatatggtctcacagggtatatacgggggtttctgtacggggtttctgatccatcaaactagggtaatgtaaatatttggccacacccacactagtatcgacattttagacgcaagcctcttatgaaaatttatgctgacgggccacggtgaagtgaaaggg

SEQ ID NO: 2510 - DNA, 1786 bp, Panicum virgatum
cggaaaggattgccaatttgcaccctaaagaacacattcccttccaacgaaaccagaacttgttgtatacctaggagcacatcacatgaaacataattacaatataaacactgctgtgccttttgaaaaataaaaaataaaaacactgctgtgcttaggggtggtaatgggccatggcccttgtggcctcttcacagcccaacaagatccttaaattatttagttcaaaattgtataagattacaacctgatttttttagaacccggcccttagtttttctagttcaaaattttggactctttaccgcccctactactgtgctcctttcaaatgggtcaatgggtcagatgggcccgaagtgattacggtatcccatggtcgcattcgcgctagtgggccgcatggcccacctaaggccgaaaagatctcacgtcgagatctcggtccggtttcctccagtgccgagaagcagcagcgtctgactgcggagtcgaagtgtgccaactgctaaacgtggagagcaggaggcggccacgcaaacgccacgacccacgagacgagggagcgaaaccgacgccgccgagccgttgcttcccggctcacagcacccgcgctccggcagcccggcccgctttcccttccccatggccgcctccctcccctccccgcccctccaagcgcgcctcctcccgctccccctgcccccaaaccctggctccgctcccccgcgggcggcgcgcggcgggtcgctcggccccggcctccgcgccaccgctgcctcgcgacgccgccgccgtcgcggaacgggagctcctcctcgccggagaccgagtggtgcccggtgccgccggaacagcggccggtgaacgagtacgaggcgctcgcgtcctccctgcccttctcctgggcggcgggggacctccgcgtctactgctcccgcctcgcgctcacgggcgccgccttcgcgctcttcgtcgggctccccgtcgccgccttcgggggccgcggcggggctggcggcgacgccgtgcacctcgcgctaggggccacggggtccgggatcctcgctgtcacgctcgctgtggtgcggatgtacctcgggtgggcctacgtcggcaaccgcctgctcagcgccacggtggagtatgaggagacgggatggtatgacggacagatatgggttaaaactccagaagttctagctcgagatcggcttctaggctcattttctgtcaagcctgtgctgaacagagtgaagtttactttggtgggtctggcaggctccctgatcctctgcattcttctatatgtcaacactgagaacccaaaggaaccgtatgaaaatacgggtgggagggcaatccctggagtatacagtgacactgctgcaaggtcatttgaacctgatgcattctgtggagaacctgatctgtcttaacaactgaaagtgtgtagcaagtactattacaggttcttgcctttgtaaatggtggatgcatccattcctgtttgggtttttcgatccatcagggtaatgtaaatatttgaccatacgtagtactgatacatttagacacaagttctcgtgaaaatttactgtgctcggcccaaaattcaagggctaaattgcgcttggattgactgaaattttgttcttccgggtcaaagctctcgtgaagcgaagcttccctcctgcttacgggcacggcctggaagctgcagaacatcagaaatataccaggacaaaggccaattgtcgcttctttccagatacgtcactgttat

SEQ ID NO: 2511 - DNA, 1079 bp, Setaria italica
gccgttgcttcccggctcacaacacccgcgctcgcggctcgccttccctcccccccatggccgcctccttctcctccccgcccctccacgcgcgcctcctcccgctccccccgccccaaaacccctgccccgccgtccccgcgagcggcgcgcggcgggccgctcggcctcggcccccgcgccagcgctgcctcgcgacgccgccgtcgcggaacgggagcttctcctcgccggacaccgagtggtgcccggtcccgccggagcagcggcccgtgaacgagtacgaggcgctcgcgtcctccctgcccttctcctgggcggcgggggacctccgcgtctactgctcccgcctcgcgctcacgggcgccgccttcgcgctcttcgtcgggctccccgtcgccgccttcgggggccgcggtggggccggcggcgacgccgtgcacctcgcgctcggggccacggggtccgggatcctcgctgtcacgctggccgtggtgcggatgtacctcgggtgggcctacgtcggcaaccgcctgctcagcgccacagtggagtatgaagagacgggatggtatgacggacagatatgggttaaaactccagaagttctagctcgtgatcggcttctgggctcattttctgtcaagcctgtgctgaacagagtgaagttcaccttggtgggactggcaggctccctgatcctttgcattcttctttacgtcaatactgaaaacccaaaggaaccgtatgaaaatactggtggaggagcaatccctggagtgtacagtgatgctgctgcaaggtctttcgagcctgatgcattctgtggagaacctgatctgtcgtaacaacggaaagcgtggatagattttcagatgatggaagatggtattacaggttcttgcctttgtaaatggtggatgcttccatttctgtttgggattttttgatccatcagggtaatgtaaatatttgaccatacgtagcacagtagtactgatattttagatacaagttcttgtgaaaaatttatggtgctcggcccaaaattgaaaaattgcgaatggattgacttctca

SEQ ID NO: 2512 - DNA, 1020 bp, Panicum virgatum
  misc_feature (773)..(773): n is a, c, g, or t
  misc_feature (776)..(776): n is a, c, g, or t
  misc_feature (839)..(839): n is a, c, g, or t
  misc_feature (849)..(849): n is a, c, g, or t
  misc_feature (856)..(856): n is a, c, g, or t
  misc_feature (882)..(882): n is a, c, g, or t
  misc_feature (899)..(899): n is a, c, g, or t
  misc_feature (908)..(908): n is a, c, g, or t
gccttcccttccccatggccgcctccctcccctccccgcccctccacgcgcgcctcctcccgctccccctgctccgaaaccctggctccgctctccccgcgcgcggcgcgcggcgggtcgcgaggcctcggcctccgcgccaccgctgcctcgcgatgccgccgccgtcgcggaacgggagctcctcctcgccggagaccgagtggtgcccggtgccgccggaacagcggccggtgaacgagtacgaggcgctcgcgtcctccctgcccttctcctgggcggcgggggacctccgcgtctactgctcccgcctcgcgctcacgggcgccgccttcgcgctcttcgtcgggctccccgtcgccgccttcgggggccgcggtggggctggcggcgacgccgtgcacctcgcgctcggggccacggggtccgggatcctcgctgtcacgctcgccgtggtgcggatgtacctcgggtgggcatacgtcggcaaccgcctgctcagcgccacggtggagtatgaggagacgggatggtatgacggacagatatgggttaaaactccagaagttctagctagagatcggcttctaggctcattttctgtcaagcctgtgctgagcagagtgaagtttactttggtgggtctggcaggctccctgatcctctgcattcttctatacgtcaacactgagaacccaaagcaaccgtatgaaaatacgggtgggagggcaatccctggagtgtacagtgacactgctgcaaggtcatttganccngatgcattctgtggagaacctgatctgtcttagcaacggaaaacgtgtagcatggaagatttntagatgatgnaagatantattacaggttcttgcctttgtaaanggtggatgcatccattnctgtttggntttttcgatccatcagggtaatgtaaatatttgaccatacgtagtactgatacatttgacacaacttgtgaaaaattacggtgcttggcccaaaattcaagggctaaattgt

SEQ ID NO: 2513 - DNA, 1214 bp, Triticum aestivum
gcaaaaaccgcgaccgagccagcctgaggcctgagccgaacctccactccaggccgccgccgctgttgcttccggttcgccaccactcgctcggtcgctccgctcgccgcacccgcactgcagtctgcatcccccttcccttccccatggccgcctcgccttccctccacgccccccgcctcctccacctgctcccgaagcccgccccgactctcggcaggccccggcggcggcgcctcgcgacggcgccggcgtcggctgtgccgccgtcgaggaacgggagctcggcggggacggactggtgccccgtgcccccggagcagcggcccgtgaacgagtacgaggcgctggccgcgtcgctgcccttctcctgggcggcgggggacctgcgcctctactgctcccgcctcgccttcacgggggccgccttcgcgctcttcgtcggcctccccgtcgcggccttcggcggccgcgggggcgccggcggcgacgccctgcacctcgcgctcggggccaccggctccggcatcctcgccgtcacgctcgccgtcgtaaggatgtacctcggctgggcctacgtcgggaaccgcctgctcagcgccaccgtcgagtatgaggagacgggatggtacgacgggcagatatgggttaaaaccccagaagttctagctcgtgatcgtcttctcggatcattttctgtgaagccggtgctgaacagagtgaagttcaccctggtgggcctggcggtgtcgctgaccctctgcatcctcctctacgccaacaccgagaagccgagggagccgctggagaaccccgccggcgggagggccatccccggggtgtacagcgacgccgccgcgaggtcgttcgagcccgacgccttctgcggggagcccgacctcggcggcggcgaccagtcgtaactttcgacggtggttctggtggaaggcgatgacaggatcatctatctcatagcatccatcctgttcatcagggtgaagtggtgtaaatatctagccgtacatagcgatagtccatacgaaaaatgaaatcccttgtatagttgtatgtagctgttggtcctgtgtatcttggtccggtttggctggcggggacgtgacaggcgaggtgacggcgacgccgttgggtcatccgccagcgccaggaatgtcgttgacgcggttgggagggttcgcgtcttgtgtggcgtgccg

SEQ ID NO: 2514 - DNA, 1152 bp, Avena sativa
ccggttcgccgctacctgcctcgcgtcgcttgctgctgcccgctgcatcccccttccgttccccatggcctcctccctccacggcccccgcctcctcccgctcctcccaaaccccaccccgagcctcggcaggccccggcgagggcagcggaggcgcttcgcacaggtcgcggcggtgccgccgtcgcggaacgggagctcggcgggcacggactggtgcccggtgccgccggagcagcggcccgtgaacgagtacgaggcgctggccgcgtcgctgcccttctcctgggcggcgggggacctacaggtctactgctcccgcctcgccttcaccggcgccgccttcgcgatcttcgtcggcctccccgtcgcggccttcggcggccgcggcgacgccgtgcacctcgcgctgggagccaccggctccgggatcctcgccgtcacgctcgccgtcgtgcggatgtacctcggctgggcctacgtcgggaaccgcctgctcagcgccaccgtggagtatgaggagaccggatggtacgacgggcagatatgggttaaaaccccagaagttttagctcgtgatcggcttctcggttcattttctgtgaagccggtgctgaacagggtgaagttcaccctggtgggtctggcggtgtccctgaccctctgcatcctcctctacgccaacaccgagaagcccaaggagccgtacgagagcaccaccggttccgcgagggccatccccggggtgtacagcgatagcgccgcgaggtcgttcgagcccgacgcgttctgcggcgaacccgatctcggcgaccagtcgtagtgctgcagcgtgtggacggtgcataatatggggggtgatatgacctggcagctggcaggcgatctttgtaactgtaactgtaaatggtggatacgtcacatatgccattgcatatttgcgttggtgttctgacgatggaaggcgatgccaagacctcgtcgtattcatctttgtaactgtaactgtaaatggtggggtttactcgtccgggtaatgtaaatatttgacctgtacgtagtgatagattgcacaaaatccactgtatatatatataggtctcgctcctgtataaatgtatcttcgtggcagaggaatggagtgtacgtata

SEQ ID NO: 2515 - DNA, 1285 bp, Brachypodium distachyon
ggaccaagccattgttccttccggttcagcactacctcccttctcgcttcgcttgctggcttccttcgctgctgcactgcatccccttcctttcgccccccaatggcggcctcgccttccctccacgccccacgcctcctcccgctcctccccaacacccctaccccgatcccccctgccgcgagcgtatgtcccccacggcgaagcccgcgcccgcgccggcgcttcgcggtgccgccgtcgcggaacgggagctcggcggggacggactggtgccccgtgccgccggagcagcggcccgtgaacgagtacgaggcgctggccgcgtcgctgcccttctcctgggccgcgggggacctgcggctctactgttcccgtctcgcggtcaccggcgccgccttcgcgctcttcgtgggactccccgtcgcggctttcggcagccacggggtatccggcgacggggtgcacctcgcgctcggggccacgggctccgggatcatcgccgtcacgctcgccgtcgtgcggatgtacctcggatgggcttacgttgggaaccgactgctcagcgccaccgtggagtatgaggagacaggatggtacgatgggcagatatgggttaaaacgccagaagttttagctcgtgatcgtcttctaggatcattttctgtcaagccggtgctgaacagagtgaagttcaccttggtgggtctggcggtgtccctgaccctctgcatcattctctacgtcaacaccgaaaagccaaaggagccattcgaaaacaccagcggaagggccatccctggggtgtacagcgatacagccgcccggtcattcgagcccgacgcattctgcggagaacctgatattggcgatcagtcgtaacaccgcagtttgtggatggcgatatctggaatttcgttctcttcctttgcaatgctagaaaggggaggagacaagaaaaaagatgttgcagtggtcattggtgtatagtggaaggctatggcaaagatctcgtcatattcatctcgtccctctaaatgtaaatggtgggtttattcgtcagggtaatgtaaatatatatagatgtacatagtgatagctcatagtacaaaattcctcgcctaattttggacccagtattttctttccagcagaacggagtcctggagactggagctctgcacttctgctggtgagctcttggcaatggtcagctccatgtgctggtaggactaggctttggcctgatcggcctggctcggaccaaaatgaaccatggctacgt

SEQ ID NO: 2516 - DNA, 1690 bp, Oryza sativa
tgtgcagtgagcttactgaagtctgcaacacgaggcagagccacgcacgcaacgaaacccgaagccgttgcttcgcggctctcgcaaccctcactctcctcgccttcccttccacggacatggccgccgctcccctctcccctcctcctcccctccacgcgcgcctcctcctcctcccgcctctcctcccgacgatggccgggggctcccgcggacggcggcgggggcgggggcgccgccggttcgcggtcccgccgtcgcggaacgggagctcgtcgcaggggacggagtggtgccccgtgccgccggagcagctgccggtgaacgagtacgagtcgctggcggcgtcgctgcccttctcgtgggcggcgggggacctcacggtctactgctcccgcctcgcgctcaccggcgccgccttcgcgctcttcgtcggcctccccgtcgcgtcgttcggcggccgcggaggggccggcggcgacgccgtgcacctcgcgctcggggccaccgggtccgggatactggccgtcacgctcgccgtggtgcggatgtacctcgggtgggcgtacgtcggcaaccgcctcctcagcgccaccgtggagtatgaggaaacgggatggtacgacgggcagatatgggttaaaaccccagaagttttggctcgtgatcggcttctaggttcattttctgtcaagcctgtgctgaacagagtgaaatttaccttggtggggctggcagtgtccctgattctttgcattcttctctacgccaacaccgaaaacccaaaggatccttttgaaaacactgtcgggcgtgctatccctggagtgtacgatgatacttctgcaaggtcattcgagcctgatgcgttctgtggagaacctgatctcggtgatctgtcataactgtaaagatcgtggatgatacctactcgttgtaatctgtgacatgggccacatggtgtttctcttccttagcatagctcgaacggaggagatagcatacatataacaaacaccataggtataaggtattccatgggaaggtgacaagatgtctccgtcctagaattgctgaattttgtgatgcttcataaagaatgtaaatatttaaccacataatatacccccatagttatagctcatagtacaaaagtttttgtaaattgggggaaacacgggtggtgtggtggtggagtcgtggatgcatgactccacttatcaagtttaaatcttgatgcccacaaatattacacacatgtaggtgaactttcaacaagactttagcgagactagttgaatgcttgtgctttgcgacaagaattaatgcttgtgctttgcgacaagaattaaaaaacagaacctcaccgtcaccgtacactcaaagcctaaaaaaataaaataaaataattctaattgttaaaatctttaggtaaaatattattgtcattatttttgacacagtttaatggcttgaggttggggaagggaaaattcacatatttcactctttgtggaccgacacggcaatggtggtgggtggttgcagattcatcactcaccatcaccattggagtcttttaaaagagtatagataagagatgtgccgctgattttcgtctcttagaacatgtttaggagacgtattcgtgggggtgttgcgtgtgtattggtgtgtgcacgcgcgcaat

SEQ ID NO: 2517 - DNA, 2734 bp, Zea mays
ctcgcgttcggatcagcctctctgtcatgtcgccaatacagcgcagcgctccgcatccacccaaatcggagtagggtcgtcagtacagcgcgacgccctgccagtagccgccgcaaccggccgccggtcccgcgcgaggggaggaggagatcactgcggcggcgtcttctgccggtttgaggattcggggcatcactgcagcagctggcgccaggctccagcatggacacggcgtttctgagtcctccgcttgcccgtaatctggtttatgacgagtttgccgttcttcaccccactagctacccttttcatactcttcggtatttgagatgcaatccaatgtattcgagaccgctgctaacaatagcaccagcctcaccatcaaggggcttgattcagagagtggccgcactacctgatgttgatgatttcttctgggagaaggatcctactccaatacttgacacaattgatgcacccattcatttgaaaaatctatctagtaaggagctcaagcagttagccgatgaagttcgttcagaaatagctttcataatgtccagaaaatgccaaccgtgtggtgctgatcgctcagttgtggagctgacaattgctatacattatgtgttcaatgccccaatggataagatactatgggatgctggtcaacatgcatatgcgcacaagattctcacaggaaggcgctctctcttccatactattacacagaaaaatggcctttctgggttcacgtcgcgttttgagagcgagtatgatccctttggtgctggacatggatgcaatagtctatccgctggccttgggatggcggttgcaagggatataaatgggagaaaaaatcgaatagtgacagttataagtaattggacaaccatggctggccaggtgtacgaggcaatgggtcatgctggcttcctcgattccaacatggtggttattctaaatgatagctgtcataccttgcttcctaaagcagatggcggggcaaagatgtcagtcaatgccttttctagtgctctaagcaagattcaatccagcaaaggatttaggaggtttagagaggctgctaagggacttgccaaatggtttggcaaaggaatgcacgaatttgctgccaaagttgatgagtatgctcgtggtatgataggtcctcatggtgcaactctttttgaagaacttggattatattatattggtcctattgatggacgtaacattgatgatctcatctgtgtacttaaggaagttgcgagcttagattcaactggcccagtacttgtacatgtaattactgggactgaaaatgacactggtggaattattggaagtgaaataaatgcagttgaggaagggccttcaaactcaagccctgatcttctaaagtttttaggaactggactttctaggacatataatgactgctttgtagaagcactaacagcagaagcagagaatgacaagcgcattgtggtagttcatggcggcatgggaatcgatcgatcactccgcttattccagtccaggttcccagacagattttttgacttgggcatcgctgagcaacatgctgttaccttttctgctggtttggcatgcggaggtctaaagcctttctgcataattccatccacatttcttcagcgagcatatgatcagataattgaagatgtggacatgcaaaagataccagttcgatttgctatcacaaatgctggtctggtaggatctgagggtccaactaattcaggaccatttgatattacattcatgtcatgcttgccaaacatgattgtcatgtcaccatctaatgaggatgaacttattgacatggtggcaacagctgcaatgattgaggacagacctatttgcttccgctatcctaggggtgccattgttgggactagtggaagtgtaacatatgggaatccatttgagattggtaaaggagagattcttgtcgagggaaaagagatagcttttcttggctatggcgaggtggtccagagatgcttgattgctcgatctcttttatccaactttggcattcaggcgacagttgcaaatgcgaggttttgcaagccgcttgacatcgacctaatcagaacgctgtgccagcagcatagttttcttatcacagtggaagaaggaacggttggtggctttggatcacatgtctcacagtttatttctctcgatggtctacttgacggtcgaacaaagtggcgacccattgtgctgccagacaggtacattgagcatgcatcgctcgcagagcaacttgacctggctggcctaactgctcatcacatagctgcaactgcattgaccctcctagggcgtcatcgtgatgcccttctgttgatgaagtaggggaaggaaccaccaagaagaatggaattggatagataaaaggcaatatgtgcaaaagttgattcggaggacgctcatcatgctgttttacgattgtgttgtctggatagaactgaagcgtgccgtgggaggtggccaaatgcacaaatcccaaagagggacgacaaagcctatagcaccatagattaatagtcacggtgtatatactaaaaagaatttacagagcaccgatgtaacgttgttactgtgcatgttaatactgaaattgtggtacgacgccaactaggagaatgagctggagctgacatgtttcagttaatgtaataaagctacttagttttgt

SEQ ID NO: 2518 - DNA, 2643 bp, Setaria italica
tccgttgggattagcctctctgtcatgtcgccagtacagcgcgacactccgcatccacccaaatcggagctagggctgctggccttgctgccccccacgcaaggcgccaggagccgccgcatccgaccgcgtcgccgccggtcccacgcgaggagaggcggcggcggcgtcttctgccggtttgagatttggggcaccagctacgcccggctccagcatggacacggcgtttctgcgttctccgcttgctcgtaatctagtttatgacgagtttgctgttcttcactccacaagctaccgtttccatcctctgcgatatttgagatgcaacccgacagactcaaggccctgccaaacactgtctgcttcacctttaaggggcgtgactcagcgagtggccgcgctacctgatgtcgatgattttttctgggagaaggatcctactccaatcctggacacaattgatgcgcccattcatttgaaaaatctatctagtaaggagctcaagcagttagctgatgaagttcgttccgaaatatctttcataatgtccagaaaatgccagccgtgtggtcctggtcgctcggttgtggagctgacaattgctatacattatgtgtttaatgccccaatggataagatactatgggatgctggtcagcatgcgtatgcacacaagattctcacaggaaggcgctctctctttcataccattaaacaaaaaaatggcctttctggtttcacatctcgttttgagagcgagtatgatccctttggtgctggacatggatgcaatagtctttccgctggccttgggatggcggttgcaagggatataaatgggagaaaaaatcgaatagtgacagttataagtaattggacaaccatggctggccaggtgtacgaggcaatgggtcatgctggtttcctcgattccaacatggtagttattctaaatgatagttgtcactccttgcttcctaaagctgatgaccggccaaagatgtcagtcaatgccttttctagtgctctcagcaagattcaatccagcaaaggatttaggaggtttagggaggctgcaaagggacttgccaaatggtttggcaaagggatgcatgaatttgctgccaaagttgacgagtatgctcgtggtatgataggtcctcatggagcaactctttttgaagaacttggattatattatatcggtcctattgatgggcataacattgatgatctcatctgtgtattaaaggaagttgcaactctagattcaactggtccagtacttgtacatgtaattactgggactgaaaacgacactggtggaaatattagcagtgaaataactccaaatgaggaagggccttcaaactcaagccatgatcttcttaaatttttagaaactggactttctaggacatacaatgactgctttgtagaagcattaaccgcagaagcagagaatgacaagtgcattgtggtagttcatggtggcatgggaatggatcgatcactccgcttattccagtccagcttcccagacagattttttgacttgggcatcgctgagcaacatgctgttaccttttccgctggtttggcctgtggaggtttaaagcctttctgcataattccatccacatttcttcagcgagcatatgatcagatagtagaagatgtggacatgcaaaagataccagttcgatttgctatcacaaatgctggtctggtggggtctgagggcccaactaattcaggaccgtttgatattacattcatgtcctgcttgccaaacatgattgtcatgtcaccatctaacgaggatgaacttgttgacatggtggcaacagctgcaatggttgaggacagacctatttgcatccggtatcctaggggtgccattgttgggactagtggcactttaacatatggaaatccacttcagattggtaaaggagagattcttgttgagggaaaagagatagcttttcttggctatggtgaggtggtccagagatgcttgattgctcgctctcttttatccaactttggcattcaggcgacagttgcaaatgcgagattttgcaaaccacttgacattgatctgatcagaacgctatgtcagcatcatagttttcttatcacagtggaagaaggaacagttggtgggtttggatcgcatgtctctcagtttatttcactcgatggtctacttgatggccgaataaagtggcgacccattgtgctaccagacaggtatatcgaacatgcttcacttgctgagcaactcgacttggctggcctaactgctcaccacatagctgcaaccgcattgaccctcctaggtcgtcaccgagatgcacttttgttgatgaagtagggaaaaggagccaacaagaagaaaagttaaagaaatttgtactgtgcaaaagtttggcacgaagaacgctccttatatgattgtttttgggagaactgaacctgtcctgggagttggccaaatgcactactctgaagagcgacggcaaagccagcatcatgtttgcggtgtacatacatactgtaaatcccattttggggactaggtgaatccgtgtcacaggcaaaactagatgaataaattatatatgcgtcaggatc

SEQ ID NO: 2519 - DNA, 3294 bp, Panicum virgatum
cggcaacgggcgcgggaggaggatggggtgcaactgccggcggcaggccccacaccacgtcgccgcgttgcggacggccgctaccgcgctagctttggcgcgcgggagccccgtccgcaacggtagcgtgtggggtagcgagtgccgctgcagcaaaaaaaggtgcgctatgggtgcgctaaatccttacagctaaatccttacagagcagggtagcgagtcccactgcgtacagctaaaactgcaaaaggcgcctcaatttggctacagctcgccgcactacgaagccgacgtggagggaatatcattacaagacaagagcaattaactaggactcaaaaaagattagaaatttctgctttgattagtctctccgtcatctcgccggtacagcgcgacactccgcatccacccaaatcggagctagggctgctggcctgctgccccccacggaaaggctccaggagccgccgcatccggccgcatcgccgccggtcccgcgcgaggagagacggcggcggcggcgtcttctgcccgtttgagattcggggcacccgctaacgcggccggctccagcatggacacggcgtttctgcgttctccgcttgctcgcaatctagtttatgacgagtttgccgtgcttcactccccaagctaccgtttccatcctctgcggtattccaggtcgcaatccgacaaactcgacgccctgccaaacgttgtctgcttcgccatcaaggggcttaactcagcgagtggccgcattacctaatgttgatgattttttctgggagaaggatcctactccgatcctggacacaattgatgcgcccattcatttgaaaaatctatctagtaaggagctcaagcagttagctgatgaagttcattctgaaatatctttcataatgtccagaaaatgccagccatgtggtcctggtcgctcagttgtggagctgacaattgctatacattatgtgttcaatgcaccaatggataagatactgtgggatgctggtcagcatgcgtatgcacacaagattctcacaggaaggcgctctctctttcatactattcaacagaaaaacggcctttctggttttacatctcgatttgagagcgagtatgatccgtttggtgctggacatggatgcaatagtctttctgctggccttgggatggcggttgcaagggatgtaaatgggagaaaaaatcgaatagtgacagttataagtaattggacaaccatggctggccaggtgtatgaggcaatgggtcatgctggtttcctcgattccaacatggtagttattctaaatgatagctgtcactccttgcttcctaaagctgatggccagccaaagatgtcagtcaatgccttttctagtgctgtcagcaagattcaatccagcaaaggatttaggaggtttagggaggctgcaaagggactcactaaatggtttggcaaaggaatgcatgagtttgctgccaaagttgacgagtatgctcgtggtatgataggtcctcatggagcaactctttttgaagaacttggattatattatatcggtcctattgatgggcataacattgatgatctcatctgtgtattaaaggaagtcgcaacactagattcaactggtccagtactggtacatgtaattactgggactgaaattgacactggtggaaatattaggagtgaaataactccaaatgacgaagggcctccaaactcaagtcatgatcttcttaattttttagaaactggactttctaggacatataatgattgctttgtagaagcattaacagcagaagcagagaatgacaagcgcattgtggtagttcatggtggcatgggaatggatcgatcactccgcttattccagtccagattcccagacagattttttgacctaggcatcgctgagcaacacgctgttaccttttctgctggtttggcctgtggaggtttaaagcctttctgcataattccatccacatttcttcagcgagcatatgatcagatagttgaagatgtggacatgcaaaagataccagttcgatttgctatcacaaatgctggtctggtggggtctgagggcccaactaattcaggaccatttgatataacattcatgtcctgcttgccaaacatgattgtcatgtcaccatctaacgaggatgaacttattgacatggtggcaacagctgcaatggttgaggacagacctatttgcttccggtatcctaggggtgccattgttgggactagtggcaccttaacgtatgggaatccacttcagattggtaaaggagagattcttgttgagggaaaagagatagcttttcttggctatggtgaggtggtccagcgatgcttaattgctcgttctcttttatcaaactttggcattcaggcaacagttgcaaatgcaagattttgcaagccacttgaccttgatctaatcagaacgctatgtcagcagcatagttttcttatcacagtggaagaaggaacagttggcggctttggatcgcatgtctctcagtttatttcactcgatggtctacttgatggccgaataaagtggcgacccattgtgctaccagacaggtatattgaacacgcatcactcgctgagcaactcgacttggctggcctaactgctcatcacatagctgcaaccgcattgaccctcctagggcgtcaccgagatgcacttctgttgatgaagtagagaaacggaaacaagaagaaaatttaaaatcaattcgtactgtgcaaaagtttgacacgaagaacactgaacctgaacctgtcgtgggaggtggccaaatgcactactcctactccgaagagtgacggtaaaggcaacattgtgtttgcgctttgcatactataaaccctattttgggcatcaggtgaaccccgcaaagcatttacaggatgatacgtttgtaatgtcagaaatgtgcatgtaaatactaaaatgacggtgctattttggtgattaggccccgtaaagaatttacacgttgatacgctgtaatgtattgtggatgtaaataggtgctgaggtgccatgtatcggtcacttaataaggcatctgagtccatgatgtaccacttccactctgaatgaaatgatatgacgaatttggggttgtgaacactgaaaagaacaggtgaacccagcaaaattttgtgccagattccagtagtacagcgatctaattcggcaaaatttctacagccgttcatccaactccgtattgatcaatgctggc

SEQ ID NO: 2520 - DNA, 4409 bp, Oryza sativa
gcctaactaatctgtcatgtcaagagcgcagaggagcactccgcgtcccaaatcccaaaccggagctagggttgctgctgctgccactcgcgagcagcagcgccccctcacgctgagccgcctccggctccctcgccgccgatcctgcgcgtgcggcggcggcgggtggccggtttgaaggaggagaggaggcttttggtcgtcactccttgcgcaggatgggtgggagatatctgcattctccacctgctgttaatttaatctgtgaggaatcaacttttgtgcgctcaacaagttgctgtctccactcttgtctgtgtttgagatgcaaaacatcgaatttgaagccatgtcgaacactggtgttcaatatgccatcaaggcgcttcaatagaagagtggctgcgctgccagatgtcgatgatttcttttgggagaaggatccaactccaatcctggacacgatcgatgcacccatccatttgaaaaatctatctagtaaggagttaaagcaactagctggtgaagttcgatcggagatatctttcataatgtcgaggaaatgccaaccatgtaacactggacattctgttgtggagctcgctattgctatacattatgtcttcaatgccccaatggataagatattatgggatgctggtcagcatacatatgcacacaagattctcacaggaaggcgctcactctttcatactattaagcaaagaaaggggctttcaggtttcacatcccgtttcgagagcgaatatgatccctttggtgcaggacatggatgcaatagtctctccgcaggccttgggatggcagtcgcaagggatctaggtgggaggaaaaaccgaatagtaacagttataagtaactggacaactatggctggtcaggtgtatgaggcaatgggtcatgccggtttccttgattctaacatggtagtgattttaaatgacagccggcacaccttgcttcctaaagcagatagccaatcaaagatgtctattaatgccctctctagtgctctgagcaaggttcaatccagcaaaggatttagaaagtttagggaggctgcaaagggactttccaaatggtttggtaaagggatgcatgaatttgctgccaaaattgatgagtatgcccgtggtatgataggtcctcatggagcaactctttttgaagaacttggattatattatattgggcctattgatgggaataacattgatgatctcatttgtgtactcaaggaggtttctactctagattctaccggcccagtacttgtgcatgtaatcactgagaatgaaaaagactcaggtggagaatttaatagtgagattactcccgacgaggaagggcctccagactcaagccaagacattctaaagtttttagaaaatggtctttctaggacatataatgattgctttgtagaatcactaatagcagaagcagagaatgacaagcatattgtggtggttcatggaggcatgggaatagatcgatcaatccaattatttcagtccagatttccggacagatttttcgatttgggtatcgccgagcaacatgctgttacgttttctgctggtttggcatgcggaggcttaaagcctttctgcataattccatccacctttctccagcgagcatatgatcagatagtcgaagatgtggacatgcaaaagataccagttcgctttgcaatcacaagtgcaggtctggtgggatctgaaggcccgactaactcaggaccatttgatattacattcatgtcatgcctgccaaacatgatcgtcatgtcaccatctaatgaggatgaacttattgacatggtggcaacagctgcaatggttgaggacagacccatttgcttccggtatcccaagggtgccatcgttgggactagtggcactttagcatatgggaatccacttgagattggtaaaggagagattcttgctgaggggaaagagatagcttttcttggttatggtgatgtggtccagagatgcttgatagctcgatctcttctgttcaactttggcatccaggcaactgttgctaatgcgagattttgcaagccacttgacattgatctgataagaatgttgtgccagcaacacgatttcctaatcaccgtggaagaaggaacggttggtggttttggctcacacgtctcgcaatttatttcactcgatgggttgcttgatggcaaaataaagtggcgacccattgtactaccagacaggtacatcgaacacgcttcgctcacagagcagctcgacatggctgggttgactgctcatcacatcgcagcaaccgcactgacccttttagggcgacaccgagacgcacttttgttgatgaagtaagaaggaaaaatgagctagaaaagaatgaaaagttgtgcagcaagtttgagctggtagaagacagccaaattgctgtttcatggatattcttcagtctttcagaggaaactgagattgccatggcagatacagcctgtgtgcaccactgaaagagcttgcaagtttttatctgtgctccagatgcttactgtaatctgttcatgggggctgtacatactataaaccctgttttgatgatgattatgttaaaccctatcaagtgcttgtaacaggaaggggataatcatcttgctgatgtaaatactcgaggaataaatgtgctgtgtgtgtgtgtgtatgactccaagtgaagagagagctgtgtctaaattgtaatcgagtaacccttcagaactttggatgcagtgaatcctctctgaatgagatcataaaatgttgaaattgggtgtgaactgtgaatgaacggctaaatcaaatccttcaggctgttgacttcttcagaaaacagcaaatttatcattactgagccctctcaaactgggagcatcaactactcctgtaaaatgttgagaaaggtgtttgactttgagactgagcacacatgggcatatgacagcaatcatgaagccaattaaccaatcgagcgatgaattactgatacaacaaaatctctggcacttttatcatgcctcacacaacacagcctcggtgtacatattctgggtagtattacacaatgtggccattaggccctctattaaaaaccaaatacaccagggaggagttcagcttggctccaactatcaagcaaggttcagacatggtagccagtacacaatcttttcatcaattgaatcagatccagtcagcgttctgtaatgacagcaacaaaaaaaaggaccaggttaggttgaattcttattgttacagaaagcactgaaataaagcattgcgtggcgggtattaagatgactattagtgcccactacagtttatatgttggcatattatctgactttgaaaataaagaaagaaaaatgcataaacacattgtagtcttaggaaccaaaccttgctctattctaagtaaatcttggttgtgattgcgggaagctgcttgccagatgactcatgcaattcatatgtgaactccatatccatgagccgatgattctcttttgagcgaaccattgtgaaagaaactttaacattgtccccttcgtttactttcagaggcggagtcagcaagaataccttgaaaagaatcagagcaatagtaaatatgtgtgaattgtgccagataactatggtctatgatatgcatttccataatgacaatcaattgaaagaaattattgttttgaataaaagcccttatacataaacatgtgccattcaaataaagatattgctctttatctaagtatcagttttgcatgaaaggttttgaaatctgtttgtccttacaattaattgtaaataaaagagagactggagcttccctctttacatgatttcttctttacatatcaacactcacacattaaaaagaacaatacatacatttcaaattatggactagctggtaacaaatttctgcagttataaaatacaatagcttaattccaggaaaccaacctgctggccccagtgagtgccaccattcacatcaggagctgtgcttaactcaacttcttgagttgcagggttttgcttactaccctagaaagagttaaagagaaaatagtgagcatatctcactgaatcatgagataaattaagtgccagttcagtttgacatactcgaaaatgaacatcaaaccatccagcaagagctgctaatcttgtcatatccagcttgattggcattgtaacctgtgctcgaacttctcgaatctcatcaaccgttgctgtcaagcaatcaatttccttaataacagcagcttgccctataacttggtttggatgaagattattccatatggcagactgcagaagaatacaaccaaatgtacactgagc

SEQ ID NO: 2521 - DNA, 2487 bp, Zea mays
atacacatccgcgcatattcccttccctccccttcttcccccgtcgcctttccctcccccgtccgctgcattccttcccgtcccatccccgagcagaaaccaaccccaccaccaccgcgccctcctcctccgcccggtcgccggcgccatgaccggcgcggcggcccccgcggcgcccccccgcggcggcgcctccgcgtcccagccccacgccgcggcgcccgcggggaagagagcgggatgcgagccggtgcggaaggcggggcccgtgaccatggagcacgtgctgctagcgctccatgagacggaggccgagcgggaggcgcggatccgggacatgtttgccttcttcgacaccgcgggcagtgggcagctcgactacgcgcagatcgaggctggcctcgccgctctgcaggtgcccgccgagtgcaagtacgcgagggagctgctccgcgcctgcgaccgcgatcgcgacggccgcgtcggctacgatgacttcaggcgctacatggatgacaaagagctcgagctctaccgcatcttccaggccatagacgtcgagcacaacggatgcatcctccccgaggagctctgggacgcgctcatcaaggctggtatagagattaatgatgaagagctggcaagatttgttgagcatgtggataaggacaacaatgggattattacttttgaagaatggagagattttcttctactgtaccccaatgaggcgaccattgagaacatttatcatcactgggaaagagtctgccttgttgatataggtgaacaggctgctataccagaaggcataagtaaacatgtcaatgcaagcaaatatcttattgctggagggattgctggtgcagcatctcgtactgcaactgctcctctggatcgcctcaaagtgatcatgcaagtacaaacaacacgtacttcagtcatgcatgcaattaaagatatctggactaaaggtggcatgctgggattttttagagggaatggattgaatgttgtaaaagttgctccagaaagtgcaataagattttatgcctatgaaatgttaaaagaatatattatgaagagaaaaggagaaaataagagtgaagttggtgcttctgaacgtctcattgctggtggtttagcaggtgcagtggctcaaacagcaatttatcctatagagttagtaaagactcgtctacagacttattcaggtgaggttggttatgttcctagaattggtcagctctcaagggatattttggtgcatgaaggtccccgagctttttatagaggtcttgttccatctttgcttggtatcgtaccttatgctggaattgatcttgctgtatatgagactttgaaagatgtgtcgaagacatatatactgaaggacagtgatcctggtcctctagtacagcttggttgtgggacggtctctggagccctaggggcaacatgtgtttaccctttacaggttatcagaacaagactgcaagctcaacaagccaattcagaatctgcctatagaggaatgtctgatgtcttttggagaaccctacatcatgagggtgtttctggattctacaagggaattctaccaaatctccttaaagtggtgcctgctgcaagtattacctatctagtttacgaggcgatgaagaaaaatttgtctcttgattaaattgtggagttgttggtgggaaaaacagccatcattattggcatggctgactgtagagataatgacgacacatgaattttactggttgaatagttcctttttgaagataaagatggtgccttcaatatagaactagaagcaacggtggcattttcctcctaattttgattcagcagaaatgaagtgataattatgagatcatcgagacatccatgcctggcatactgcttacgacaccatcgacaccgagttaactgttcatgaatttccgaaggcttgttttatcccccgtctggggcgagttttgttagtctgtaacacactgggaaactctcctaacttaattgcaatcccttgtgctcctcaacttgactggagctgtgacatttgctgacagccaaaaaaaaaacccggcaaaaagggtgctggtgatacctgtacgtattttccacggcgacttggcataaatcaatgcctagtgaatgtaataatccgcccgttcccgttagtcttacttatggtttccaatgaccctgttgcatatatttgcattgccaaagcaaggtgtgtgtgcataaaaagtgccaaagcagatggcaaacaactcacaaggtgcataaggggtttgtagacaaccgcaaggtgcaaaagctgcttagtgcttcatgaggaacatgagcatgccccccacgttgtacgggtaggttcgtgaaataggagtggtaacggatcatgatttaaatgatttttttacaatttatttgagtctttaattaattttagttcaaaaataaataaaaata

SEQ ID NO: 2522 - DNA, 2545 bp, Panicum virgatum
cctcaagacacacccacgctgccacgcatattcccttcccgtcccttcccttcttccgcttctcctttccccctctgctccattccattccccgaaaccaacccaaaccaccccaccgccaccgcctccgcctcgccgccggcgccatgaccggcgccgcggcccacgcggtggagccccgaggtggcgcctccgcgccccagccccccgctgcagcgaccgcggccgcggccaagggggcgggcgggcgcgagccggcgcggaaggcggcgcccgtgaccatggagcacgtcctcctcgcgctccacgagacggaggccgagcgggaggcgcggatccgggacatgttcgccttcttcgacgccgcggggcgcgggcagctcgactacgcgcagatcgaggcgggcctcgccgcgctgcaggtgcccgccgagtgcaagtacgcccgcgagctgctccgcgcctgcgaccgcgaccgcgacggccgcgtcggctacgacgacttccgccgctacatggacgacaaggagctcgagctctaccgcatcttccaggccatcgacgtcgagcacaacggctgcatcctccccgaggagctctgggacgcgctcgtcaaggctggtatagagattaatgatgaggagctggcaagatttgttgagcatgtggacaaagacaacaatgggattattacttttgaagaatggagagactttcttttgctttaccctaatgaggcaaccatcgagaacatttatcaccactgggaaagagtctgccttgttgatataggtgaacaggctgctataccagaaggcataagtaagcatgtcaacgcaagcaaatatctgattgctggagggattgctggtgcagcatcacgcactgcaactgcacctctggatcgccttaaagtgattatgcaagtacaaacaacacgtactactgtcatgcatgcaattaaagatatttgggataagggtggtatgctgggattttttagagggaatggattgaatgttgtaaaggttgctccagaaagtgcaataagattttatacctatgaaatgttaaaagaatatatcatgaagagcaaaggagaaaataagagtgaagttggtgcttctgaacgtctggttgctggtggtttagctggtgcagtgtcccaaacagcaatttatcctatagatttagtaaagacacgtctgcagacttattcatgtgagggtggtaaagtccctagaattggtgcactgtcaagggatatttggatgcatgaaggacctcgggcattttatagaggtcttgttccatcattgcttggtattataccttatgccggaattgatcttgctgtatatgagactctgaaagatgtgtcaaagacatatatactgaaggacagtgatcctggtcctctggtacaattgggctgtggaactgtttctggagctctaggagcaacatgtgtttaccctttgcaggttatcagaacaagactgcaagcacaacaagccaattcagaatcagcctatagaggaatgtctgatgtcttctggagaaccctacaacatgagggcatttctggtttctacaaaggaattctgccaaatctccttaaagtggtgcctgctgcaagtattacctatcttgtctatgaggcgatgaagaaaaatctctctcttgattaaattcaggagttctgcaaaaatcagccatcattattgacatggctgactgtgtagagataatgacgacacatggttcaatagttcctttttgaagtcaaagatggcgccttcagtatagaactggaagcttggtggcattttcctcctaattttagttcagcagagatgaagttataatcttgagatattgacttatcgaggcactttgcccagcatactggtaacaatcctacttgttgatttatactgctgccattacacttgatatgcatttttctcttcaatcatagttatttttctgtacataatcatcctttttgaacgtagtggggatttcgttcttgctatgagcagcttatattgtacataaacccctgttttataatataaaaaaataggtaggggcctcccctgctgacttcggtaaaaaaaaggttttggaaatgcgatttgaatggctgctttgtaccaccaaaatcatgcggtttgccgcacatgtcccatccatcctcggattcctcgaatgctatgaaccttagttcatttggggatagggaggataaccattgccaggaagatggccgggcaaagtcggcgtggagggagactagacttttgggggacttgggaattgattcttgtttattgtttcattgcttaattaaaagagatacaatcccatccttatatagatgggctgacttgacccttaagaaaccaatctctaaatttaaggaaataacaaactaatataatctaatctttcctaatatcctagattcattactgttcacggcgtgaacagtactttctacccataacatcgaactccatggctaatttaattgtgtggt

SEQ ID NO: 2523 - DNA, 2527 bp, Setaria italica
cctcagacacacacatccacgcatattcccttcccttcttcccccttctcctttccctccccactccgctccattccattccccgaaaccaacccaaaccaccccaccccaccaccaccgcctccgcctcgccgccggcgccatgaccggcgccgcggcccacgcggtggacccccgcggcggcgcctccccaccccatccccccgccgcagcgaccgcggcggcggcggcggcggcgaagggggcggggggaggagcgggcgggcgcgagccggcgcggaaggcggcgcccgtgaccatggagcacgtgctgctcgcgctccacgagacggaggccgagcgggagtcgcggatccgggacatgttcgccttcttcgacgccacggggcgcgggcagctcgactacgcgcagatcgaggcgggcctcgccgcgctgcaggtgcccgccgagtgcaagtacgcccgcgagctgctccgcgcctgcgaccgcgaccgcgacggccgcgtcggctacgacgacttcaggcgctacatggacgacaaggagctcgagctctaccgcatcttccaggccatcgacgtcgagcacaacggctgcatcctccccgaggagctctgggacgcgctcatcaaggctggtatagagattaatgatgaggagcttgcaagatttgttgagcatgtggacaaagacaataatgggattattacttttgaagaatggagagactttcttttgctttaccctaatgaggtaaccatcgagaacatttatcatcactgggaaagagtctgccttgttgatataggtgaacaggctgctataccagaaggcataagcaagcatgtcaatgcaagcaaatatctgattgctggagggattgctggtgcagcatcacgtactgcaactgcacctctggatcgccttaaagtgatcatgcaagtacaaacaacacgaactacagtcatgcatgcaattaaggatatctgggctaagggtggtatgctgggattttttagagggaatggattgaatgttgtaaaggttgctccagaaagtgcaataagattttatgcctatgaaatgttaaaagaatatattatgaagagcaaaggagaaaataagagtgaagtcggtgcttctgaacgtctcattgctggtggtttagctggcgcggtggcccaaacagcaatttatccaatagatttagtaaaaacacgtctacagacttactcatgtgagggtggtaaagttccgagaattggtgcactatcaagggatattttgatgcatgaaggtcctcgagcattttatagaggtcttgttccatcgttgcttggtattgtaccttatgccggtattgatcttgctgtatatgagactttgaaagatatgtcaaagacatatatactgaaggatagtgatcctggtcctctagtacaattgggctgtggaactgtctctggcgctctaggagcgacatgtgtttacccattacaggtcatcagaacaagactacaagcacaacaggcaaattcagaagctgcctatagaggaatgtctgatgtcttctggagaaccctacagcatgagggcgtttctggattttacaaaggaattataccaaatctccttaaagtggttcctgcagcaagtattacctatctagtgtatgaggcgatgaagaaaaatctctctcttgattaaattcaggagttctgcaaaaatcagccatcatattgacatggctggctgtagagataatgacgacacatgaatttactggttcaatagttccttcttgaagtcaaagatggtgccttcagtatatagaactggaagctatggtggcattttcctcctaattttgattcagcagagatgaagtgataatctcgaggcaccatgtctagcatactgttaaatggcaccgttggcaccaagttagctgctcattgcgaattcccgaaggcttattttgacccgtctggggtgagttttgttagaggaactgtaacacagggaaactctctcctaacttaatttgcaattccttgtgctcctgagcttcactggagctgcaacctttactgaccgtgaaattgccctgcagaaagggtgctgattatacatgtatgtatttcccacggcgacctggcacaaagtaaatgcctatatgtaataatcctcccttatcgtcagcatatagcttccttatgtttcgctcggttggtagagcctcacccacccgatatggaacctggatagtcatcgtaggtggtgttggtacctcctacagggttcggcactccactgtctttaaggaaagctagggttagggtggatgctctgttcatggaattttttttttaaaaaaaattgctgttttctctgttgcattcatttgaagctggagtcatgtaaagattgcaaaagatacgcaagcggcatcagtatgtagatgtcctaacctagttccgaggtgttcgcaatcgcaaggtgcaaaagcttgttggaggcttggtg

SEQ ID NO: 2524 - DNA, 4043 bp, Oryza sativa
ctctcacatccacgtatattcccttccccttctccaacctttcctcctctttccattcccattccattccccaaaccaacccaacccaccaccaccaccaccggcgccgccgccgccgccgcctccccctcacccccattccttcctcgccgccggcgccatgcccggcgcggcggtccacgcggtggacccacggggcggcgcctccccgccccccgtcgccaaggcggaggcggcgacggctgcagcggcggcggcgggagggtgcgagccggcgcggaaggcgggggcggtgaccatggagcacgtgctgctggcgctgcacgagacggaggcggagagggaggcgcggatccgggagatgttcgccttcttcgacgtggacgggcgcgggcagctggactacgcgcagatcgaggccgggctcgccgcgctgcagatccccgccgagtgcaagtacgcgcgggagctgctccgcgcctgcgaccgcgaccgcgacggccgcgtcgggtacgacgacttcaggcggtacatggacgacaaggagctcgagctctaccgcatcttccaggccatcgacgtcgagcacaacggctgcatcctccccgaggagctctgggacgcgctcgtcaaggctggtatagagattgatgatgaggagcttgcacggtttgtcgagcatgtggacaaggacaacaatggaattattacttttgaagagtggagggactttcttttgctatatcctaatgaagtaaccattgagaatatttatcatcactgggaaagagtatgtcttgtagatataggtgaacaggctgttataccagaaggcataagtaagtcggtcaatgcaagtaaatatctgattgcaggagggattgcaggtgctgcatctcgtactgcaactgcacctcttgaccgccttaaagtgatcatgcaagtacagactacacgaactacagtcatgcattcaattaaggatatatggagccagggtggcatgttagcattttttagagggaatggattgaatgttgtgaaagttgctccagaaagcgcaataagattttatgcctatgaaatgctgaaagaatatattatgaagagcaaaggagaaaataagagcgaagttggtccttctgaacgtcttgtagctggtggtttggctggtgcagtagcacaaacagcaatttatcccgtagatttagtgaaaacacgactgcagacttattcatgtgtggatggtaaagtacctagtcttggtgcattgtcaagggatatattgatgcacgagggtcctcgagcattctatagaggtctggttccatctttgcttggtattgtcccttatgccggaattgatcttgctgtatatgagacattgaaagacgtatccaagacatatatcctgaaggatagtgatcctggtcctctagtacaactgggctgtgggactgtatcaggagccttgggggcaacatgtgtttaccctttacaggttatcaggacaagactgcaagctcaacgagccaattcagaatctgcatatagaggtatgtctgatgtattctggagaacgctacagcatgagggtgtttctggattctacaaaggaatcctaccaaatcttcttaaagtggtgcctgcagcaagtattacctacctagtgtatgaagcaatgaagaaaaatctctcccttgattgaattacggagctgtttggcaaatcggccatcatttattgacatggctgactgtagagataatgacgatacatgattttactggttaagtagctacttttttgaagtgcaagacggtgccttcaggacagaatttgaagctatggtggcatctctcttaattttcatttcccagaaatgaagcgataaccatcagatcattgagacatctttgctggcgtactggtacaattcctaactgtcatgttatatcacaacagttatacttgacatgcccttctgttctttataacaactcctttttgtacatacacaactactttatgctgctgcacatacttggaagtgaatagtgaacaacatagcttatattagcagccacagcgactagagctgatgatgtttcttaggagttagcttatgtaattatgcttaatcagcaagcttgaaaactgagcattttgtcctttttttcccttgatcctgtgacagagaaacccagtgggtactggaagctaaatgcctaaaatttgctgatcctggtgtacagtttaactgtgctcatatggatagttaatactctataatactttagtcttctagaagtggaacatactgtaagagacagctatcgtatgcataactttttttttgtatcatagctgaatacaccttggtatcatgaatagacttcaaaaaaagtgaaagacttgaaaaggactatgttaatactttagtttattatttagttaagctgcaggatattcagaggtatgagtatggacccagtataagttaaatgtgtgtgcatattaatggccaaagtaagatcgaatttgactgatactagatctggaatcaaatatgttaatggccaaagaacctgaaaggtacagacggaaatccattccatactgtttttgcagctaaatctgcttgctcgtcctcctcctccgatcttgtctattacattaatgcacacaagagagcgtctaaacattaggacatttaaatttcattatatgtgccaatcacggaatcacctgccatggaagtgactaaatatttttttttcctgttaataatatttgtatgtcctggaatatcaatgggatcagttctgtttggaagcatgatctctatatgactttataaggtgatgaaatgaaatgttgtttgctttgaatgaagaaacattattaacttgtatagaatagttagcttgaaacgttatgagatttgtggtctattttgtctccttgaaaaccgtatgtataagtggtacttctgttctagatgccctggtacttcaaaataataggaataaaaacaacaatttaattatcttttctttgttatgagccttgattccagatttcaggacttgggagcattgccgtggcaaactagtactaagtatgcccagagtttaacgaatcttagtttgtactcattgtcccatacaattcatgcaactgataacaaatatgcttgttgaaatctgtcgaatatacagctggctcttttcatgtgtcaggttctaattgtattattggagccaacttcatagcattactgcaatattgtttgccaatagtttcaattccactccaaatgaactatgttacctactctctctgtccacaaatataaggggattttagctatgcacctgggagcacttgtccatgtatatagtcaaaataccttatatgtggacggagggcctgatccttggtgaattatgatactgttctaattcaagagttagtttatgaacatgataatttgttcagttatttaaacttgtaactcatgttctcacagatctggacaaattctcttctttatgactcatttcctttacttttgacatttcagtaaggcatcgtttgctccgagttagctggtcctcgtgaattcctgaaggcttattttgcccctgtcctggggtgagttttgttagtcaaactgtaaaacacaggaaaacactctttaacttaatttaccattccttgtgctcctgaaattaaagaggagcttgacctttactgacgacgaaattgccctgcagaaagggtgctggttatacatgcctgtattgccccttggctacatgccaaaaaagtcaatgcctactgtatgtaataatctgccagctttaccaatataacttccttatggttaccctgttaaatgaatacgcaaatgacccggtgagcagtgtaaagacggtaaaatgcccctcaaattgtatgtgtacatgtatatatatgtgcttagaagttagaagttgatccctttctggactgcttacatggcagtcttctcttgttcc

SEQ ID NO: 2525 - DNA, 2390 bp, Brachypodium distachyon
ttcccttcgtcccctctcctttccttctccgttcgattccattgcctgcccccaaaccaacacaacccaccaccacctcctcctcctcccattccgtctcgccgccgtcgccatgcccggcgcggcggcccacgcggtggaaccccgcggccccgccgcctcccctccccccgtggctgccacagcggcgacggcaacggcgacagcagggggagggtgcgagccggcgcggaaagcgggccccgtgaccatggagcacgtgctgctggcgctccacgagacggaggcggagcgggaggcgcggatccgggacatgttcgccttcttcgacacgtcgggccggggccagctcgactacgcgcagatcgaggccggcctcgccgcgctgcaggtccccgccgagtgcaagtacgcgagggagctgctccgcgcctgcgaccgcgaccgcgatggccgcgtcgggtacgaggacttcaggaggtacatggacgacaaggagctcgagctctaccgcatcttccaggccatcgacgtcgagcacaacggctgcatcctccccgaggagctctgggacgccctcgtcaaggctggtatagagattgatgatgaggagcttgcacgatttgttgagcatgtggacaaggacaacaatggaatcattacttttgaagagtggagggattttcttatgctttatcccaatgaagcaacaattgagaacatttatcatcactgggaaagagtttgccttgtagatataggtgagcaagctgctataccagaaggcttaagtaagcatgtcagtgcaagcaaatatcttattgcaggaggcattgctggtgcagcgtctcgtaccgcaacagcacctcttgatcgtcttaaagtgatcatgcaagtacaaacaacgcgaactacggttgcacatgcagttaaggatatatttatccggggtggtcttctgggattctttagagggaatggtttgaatgttgtaaaagttgctccagaaagtgcaataaggttttatgcctacgagacgttgaaagaatatattatgaatagcaaaggagaaaataagagtgcagttggtgcttctgaacgccttgttgctggtggtttggctggtgcagtagcacaaacagcaatttatcccatagatttagtgaagacacgcctacagaccttttcatgtgtgggtggtaaagttcctagtctcggtacattatcgagggatatatggatgcatgaaggtcctcgagcattctatagaggtcttgttccatctttgcttggtattgtcccgtatgctggaattgatcttgctgtatacgagactttgaaagatgcgtccaggacatatatcctgaaggacagtgatcctggtcctctagtacaactgggttgtggcactgtctctggagctttgggagcaacatgtgtttaccctttacaggttatcagaacgagactgcaagctcaacgagccaattcagagtctgcatatagaggaatgtctgatgttttctggagaaccctacagcatgaaggcatttctggattctacaaaggaatccttccaaatctccttaaagtggtgcctgctgcaagtattacctatctagtttatgaggcaatgaagaaaaatctgtctcttgattaaattcttgaattgttttacaaatcggccattattattgacatggctgactgtagagataatgacggcatatgagtttactggttaaagagctcccttttttgacatgaaagatggtgccttcaggatagaactgaaagtgattgccaccctacttgttaaatgaaaatgaagagattatcatgagatcatcaaggctggcatactggtaatggttccttcttatcaagttgtattcgagcaatcaattatactttagtgtgcatacactacttttcaactgcggcagatatttggtagcttggaatcataataaacttgtgaagtacttacagtgtgttgcgagcagcagctcatttcttgggaactaccactaataacattctttaggagcaattttaagctgataatgagcaaagaaaaggcatgtaattatgaccactttatatcttagtggagtaccttggttgtctgtgtacagttctttgtcgttgcagggagtaccgtcagtagctaaatgctaattttggtgtgcagtttgataatgctaatatgaatagcaataaatactcttagaagtggaatgaactcttatgtaacaagtttggcatacacaatacatatattgtcatctaccacagctgaatatatgtaggtctcatgagtagactaaaacaatgactcagcagttaaaggtctgtttatttcgagaacactataggttttatagagc

SEQ ID NO: 2526 - DNA, 2238 bp, Triticum aestivum
cattccgcctcgccgccgccgtcgccatgcccggcgcggcggcccacgcggtggaaccccgcggcaccgccgcaccctctccccccgtggccgccgcggcgacggcgccagcggcagcggcaggggggccttgcgagccggtgcgtaaggcgggccccgtgaccatggagcacgtgctgctggcgctccacgagacggaggaggagcgggaggcgcggatccgggacatgttcgacttcttcgacacgtccgggaggggccagctcgactacgcgcagatcgaggccggcctcgccgcgctgcaggtccccgccgagtgcaagtacgcgcgggagctgctccgcgcctgcgaccgcgaccgcgacggccgcgtcggctacgacgacttcaggcgctacatggacgacaaggagctcgagctctaccgcatcttccaggccatcgacgtcgagcacaacggctgcatcctccccgaggagctctgggacgccctcgtcaaggctggtatagagattgatgatgaggagcttgcacgatttgttgagcatgtggacaaggacaacaatggaattattacttttgaagaatggagggattttcttatgctttatcccaatgaagcaacaatcgagaacatttatcatcactgggaaagagtttgccttgtagatataggtgaacaggctgctataccagaaggcttaagtaagcatgtcagcgcaagcaaatatctgatcgcaggaggcattgctggcgcagcatctcgtactgcaacggcacctcttgatcgtcttaaagtgatcatgcaagtgcaaacaacgcgtactaccgtcacacatgcagttaaggatatatttatccggggtggtctattgggattttttagaggtaacggtttgaatgttgtaaaagttgctccagaaagtgcaataaggttttatgcgtacgagacattgaaagagtatataatgaacagcaaaggagaaaacaagagtgcagttggtgcttctgaacgcctcgttgctggtggtttggctggtgcaatagcacaaacagcaatttatcccatagatttagtaaagacgaggctgcagactttctcttgcgagagtggtaaagttcctagtcttggtacattatcaagggatatattgaagcatgaagggcctcgagcattctatagaggtcttgttccatctttgcttggtattgtcccttatgctggaattgatcttgctgtatacgagactttgaaagatgcctccaggacatatatcataaaggacaccgaacctggtcctctagtacaattgggttgtggcactgtctctggagctctgggagcaacatgtgtttaccctttacaggttattagaacaagactgcaagctcaacaagccaattcagaggctgcatataaaggaatgtctgatgtgttctggagaaccctacggcacgaaggcgtttctggattctacaaaggaatcctaccgaatctccttaaagtggtgcctgctgcaagtattacctatctagtttatgaggcgatgaagaaaaatctgtctcttgattaaattctggaattgttttgcaaatcggccattattattggcatggctgactgtagagataatgacgacacatgaatttactggttaaagagctcctttttttgacgcgaaagatggtgccttcaggatagaactgaaagctattgctatcctacttgttaaatgaaaacaaagagattatcatgagatcatcaaggctgtcacactggcatactggtaatggttccttcttgtcaagttgtattacaactatcagttatacttcataggccccttttgtcttctcatgacagctcctgtgcatacacaactacctactgctgcacacatttgacaattagtaacagtactgaagtacttaggatgttgtgatccatagctcatttcttgggaactaattataataaagtatttaggagtttcttaagctgataatgaacaatcaaaaagcttgtaattgatgaccactttcaatcttggtacttcgattatctgtacattttcttttgtcatgtacagagcaccagggaatattgttagcaaccattgtgcacagtttgataatgtgaatgtgaagaacgacatgccatgattctgttagaagtggcatggactctctcgaaaattcacaagtttggcatacgtgacacatattgtcatctagcac

SEQ ID NO: 2527 - DNA, 2027 bp, Panicum virgatum
ggccaagggggcgggcgggcgcgagccggcgcggaaggcggcgcccgtgaccatggagcacgtcctcctcgcgctccacgagacggaggccgagcgggaggcgcggatccgggacatgttcgccttcttcgacgccgcggggcgcgggcagctcgactacgcgcagatcgaggcgggcctcgccgcgctgcaggtgcccgccgagtgcaagtacgcccgcgagctgctccgcgcctgcgaccgcgaccgcgacggccgcgtcggctacgacgacttccgccgctacatggacgacaaggagctcgagctctaccgcatcttccaggccatcgacgtcgagcacaacggctgcatcctccccgaggagctctgggacgcgctcgtcaaggctgtttgctgtttgcaggtatagagattaatgatgaggagttggcaagatttgttgagcatgtggacaaagacaacaatgggattattacttttgaagaatggagagactttcttttactttaccctaatgaggcaaccatcgagaacatttatcaccactgggaaagagtctgccttgttgatataggtgaacaggctgctataccagaaggcataagtaagcatgtcaacgcaagcaaatatctgattgctggagggatagctggtgcagcatcacgtactgcaactgcacctctggatcgccttaaagtgattatgcaagtacaaacaacacgtactactgtcatgcatgcaattaaagatatttgggctaagggtggtatgctgggattttttagagggaatggattgaatgttgtaaaggttgctccagaaagtgcaataagattttatacctatgaaatgttaaaagaatatatcatgaagagcaaaggagaaaataagagtgaagttggtgcttctgaacgtctggttgctggtggtttagctggtgcagtgtcccaaacagcaatttatcctatagatttagtaaagacacgtctgcagacttattcatgtgagggtggtaaagtccctagaattggtgcactgtcaagggatatttggatgcatgaaggacctcgggcattttatagaggtcttgttccatcattgcttggtattataccttatgccggaattgatcttgctgtatatgagactctgaaagatgtgtcaaagacatatatactgaaggacagtgatcctggtcctctggtacaattgggctgtggaactgtttctggagctctaggagcaacatgtgtttaccctttacaggttatcagaacaagactgcaagcacaacaagccaattcagaatcagcctatagaggaatgtctgatgtcttctggagaaccctacaacatgagggcatttctggtttctacaaaggaattctgccaaatctccttaaagtggtgcctgctgcaagtattacctatcttgtctatgaggcgatgaagaaaaatctctctcttgattaaattcaggagttctgcaaaaatcagccatcattattgacatggctgactgtgtagagataatgacgacacatggttcaatagttcctttttgaagtcaaagatggcgccttcagtatagaactggaagcttggtggcattttcctcctaattttagttcagcagagatgaagttataatcttgagatattgacttatcgaggcaccttgcccagcatactgttaaatggcaccaagttagctgcccattgcgaattcccgaaggcttattttgccccatttctggggtgagttttgttagagaaactgtaacacacagggaaaactctcctaacttaatttacaattccttgtgctcctgaacttttctggagctgtgaccttcactgaccttgaaattgccctgcagaaagggtgctggttatacatgtatgtattttccatggcgacttggcataagtcaatgcctttatgtaataatccgcccttattgccaacatagcttccttaatccttatgatttgctctgttggtagagcctacagttgagatt

SEQ ID NO: 2528 - DNA, 2304 bp, Pennisetum glaucum
ggcggcgggagcgtgcggtgggacggtggcggcggggcaggcggcgacgatggagcacgtgcgcctggcgctgcgggagacggaggcggagcgggaggtgcggatccgggccgtctttgcctccttcgacgccgcggggcggggccacctcgaccacgcgcagatcgccgcggggctcgccgcgctgcgcgtcccggaggggggcgccggcctcgaggactacgcgcgcgcgctgctccgcgcttgcgaccgggaccgcgacggccgggtcgggtacgaagacttccgaaggtacatggacgacaaggagctcgagctctaccgcatcttccaggccatcgacgtcgagcataacggctgcatcctcccggaggagctctgggacgcgctcatcaaggctggtatagagattagtgatgaggagctggcaagatttgttgagcatgtggacaaagataacaatgggattattacttttgaagaatggagagactttcttttgctttaccctaatgaggcaaccatcgagaacatttatcatcactgggagagagtctgccttgttgatataggtgaacaagctgctataccagaaggcataagtaagcatgtcaatgcaagcaaatatctgattgctggagggattgctggtgcagcatctcgtactgcaactgcacctctggatcgccttaaagtgatcatgcaagtacaaacaacgcgcactacagttatgcatgcaattaaggatatctgggctaagggtggtatgctcggattttttagagggaatggattgaatgttgtaaaggttgctcctgaaagtgctataagattttatgcctatgaaatgttaaaagaatatattatgaagcgcaaaggagaaaataagagtgaagttggtgcttctgaacgtctcattgctggtggtttagctggcgcggtggcccaaacagcaatttatcctatagatttagtaaagacacgtctacagacttattcatgtgagggtggtaaagttccgagaattggtgcactatcaagggatattttaatgcatgaaggtcctcgagcattttatagaggtcttgttccatcattgcttggtattgtaccttatgccggaattgatcttgctgtatacgagactttgaaagatgtgtcaaagacatatatactgaaggatggtgatcctggtcctctagtacaattgggctgtggaactgtctctggtgctctaggagcgacatgtgtttaccctttacaggtcatcagaacaagactacaagctcaacaggcaaattcagaagctgcctatagaggaatgtctgatgtcttctggagaacactacagcatgagggtgtttctggattttacaaaggaattctaccaaatctccttaaagttgttcctgcagcaagtattacctatctcgtgtatgaggcgatgaagaaaaatctgtctcttgattaaattcaggagttctgcaaaaatccgccatcatattgacatggctggctgtagagataatgatgacaaacgaatttactggtttagttccttcttgaagtcaaagatggtaccttcagtatatagaactggatgctatggtgccattttcctcctaattttgattcagaagagatgaagtgataatcatgagatactgaggcaccatgtttagcatactgttagatggcaccattggcaccaagttagctgctcattgcgaattcccgaaggcttattttgccccatctgggatgagttttgttagaggaactctgtaacacagggaaactctctcctaacttcatttacaattcgttgtgctcctgagcttcactgtggagctgtgacctttactgaccgtgaaattgccctgcagaaagggtggtggttatacatgtatgtatttcccacggcgacctggcacaaagtaaatgcctatatgtaataatcctgccttatcgtcagcatatagcttccgtatgattggcttggttggtacttggtagagcctccacccgaacttgttcgcaagtggtattggtaccggaaccagttcctacagggttcggcacttgactagctgttgtgacgtggaaatctagggttagggtggatgctctcgcttcatggaaagctaggtttcgggtgtatgcattaccatttaccaaagctgtagtaatgtaaagatggcataaggcatgcaagctgcatcagtgtgtagatgcacgcaaacctggttcggaggtgttcgcaatcgcaaggtgcaaaaagcttgttggtgacatgatgcgccg

SEQ ID NO: 2529 - DNA, 1838 bp, Secale cereale
gaccatggagcacgtgctgctggcgctccacgagacggaggcggagcgggaagcgcggatccgggacatgttcggcttcttcgacacgtccgggaggggccagctcgactacgcgcagatcgaggccggcctcgccgcgctgcaggtccccgccgagtgcaagtacgcgcgggagctgctccgcgcctgcgaccgcgaccgcgacggccgcgtcggctacgacgacttcaggcgctacatggacgagaaggagctcgagctctaccgcatcttccaggccatcgacgtcgagcacaacggctgcatcctccccgaggagctctgggacgccctcgtcaaggctggtatagagattgatgatgaggagcttgcacgatttgttgagcatgtggacaaggacaacaatggaattattacttttgaagaatggagggattttcttatgctttatcccaatgaagcaacaatcgagaacatttatcatcactgggaaagagtttgccttgtagatattggtgaacaggctgctataccagaaggcttaagtaagcatgtcagcgcaagtaaatatctgatcgcaggaggcattgctggcgcagcatctcgtactgcaacggcacctcttgatcgtcttaaagtgatcatgcaagtgcaaacaacgcgtactactgtcacacatgcagttaaggatatatttatccggggtggtctattgggattttttagaggtaacggtttgaatgttgtaaaagttgctccagaaagtgcaataaggttttatgcgtatgagacattgaaagagtatataatgaacagcaaaggagaaaataagagtgcagttggtgcttctgaacgcctcgttgctggtggtttggctggtgcaatagcacaaacagcaatttatcccatagatttagtaaagacgaggctgcagactttctcttgcgagagtggtaaagttcctagtcttggtacattatcaagggatatattgaagcatgaagggcctcgagcattctacaggggtctcgttccatctttgcttggtattgtcccttatgctggaattgatcttgctgtatacgagactttgaaagatgcctccaggacatatatcataaaggacaccgaacctggtcctctagtacaattgggttgtggtactgtctctggagctttgggagcaacatgtgtttaccctttacaggttattagaacaagactgcaagctcaacaagccaattcagaggctgcatataaaggaatgtctgatgtgttctggagaaccctacggcatgaaggcgtttctggattctacaaaggaaatcctaccgaacctccttaaagtggtgcctgctgcaagtattacctatctagtttatgaggcgatgaagaaaaatctgtctcttgattaaattctggaattgttttgcaaaccagccattattattggcatggctgactgtagagataatgacgacacatgaatttactggttaaagagctcctttttttgacgcgaaagatggtgccttcaggatagaactgaaagctattgctatcctacttgttaaatgaaaacaaagagattatcatgagaccatcaaggctgccacactggcatactggtaactgttccttcttgtcaagttgtattacagcaatcagttatacttcataggcccccttttgtctttcttatgacagctcttgtgcatacacaactacctactgctgcacacatttgacaattaggaacagtactgaagtacttaggatgttgtgatccgtagctcattacttgggaacttacttataataaagttatttggtaaaag

SEQ ID NO: 2530 - DNA, 2203 bp, Sorghum bicolor
caaaaaaacagtatttatatcatgatatattgctattttgataaataaaagtattagctggttcaatatctagtccggattgtcagggctgcgagacagcgtggcggatattcgctttccctcgggagaccagacagacccaaacggcagcaaaccacccttctcaaagtttcaattcacaacaccgccgtcagtccgacaccgcagcacagcacctcgccacctccttgctcgctttgcgcttgcgcctcgccgcctcccccctttccccgccgtcgccgccgccggagccatgtccggcgcggcggttcaggcggtggagccccgcccagcggcagccgcgacgaccaccaccgcggcgtctccggccgccacggctcagcccgcggcggcggcgaggggagcgatagggtgcggcggcgcagcgcgtgcgtcggggccggcggcggcgacgatggagcacgtgctgctggcgctgcgggagacggaggcggagcgggaggcgcggatccgcggcgtcttcggcttcttcgacgccgcggggcgggggcacctcgaccacgcgcagatcgtggccggccttgtcgcgctgcgcgtccccgaggggaccgctggcggcgcgggcgccgaggactacgcgcgcgcgctgctacgggcctgcgaccgcgaccgcgtcggccgcgtcggctacgacgacttccggaggtacatggacgacaaggagctcgagctctaccgcatcttccaggccatcgacgtcgagcacaacgggtgtatcctgcccgaggagctctggcacgcgctcgtcaaggctggtatagaaattgatgatgaagagcttgcaagatttgttgagcatgtggataaggacaacgatggtattattacttttgaggaatggagagattttcttttgctttatcctcatgaagcaaccattgaaaacatatatcatcactgggaaagagtctgccttgtagatattggtgagcaggctgctataccggaaggaataagtaaacatgtaagtgcaagcaaatatctgattgcaggaggcattgctggtgcagcatctcgtactgcaactgcacctcttgatcgcctcaaagtaaatatgcaagtgcaaacaaaccgtactacagttctagatgcggttaagggtatatggagagaaggtggtctactgggattttttagagggaatggactgaatgtggtaaaagttgctccagaaagtgctataagattctacacctatgaaatgcttaaagaatacataatgaaaagtaaaggagaaaataagagtgacattggtacttctgggcgtctcatggctgggggtttggctggtgctatcgcacagacagcgatttatcccattgatttggtgaagactcgtctgcagacttacgagggaggcaaaattcctagccttggtgcactatcaagagatatatggatacatgaaggtccccgagcattctacagaggccttgttccatcattgcttggcatggtcccgtatgctggaattgatcttactgtttatgaaacactgaaggaaatgtccaagacatatgtcctcaaggacaacgatcctggccctttagtacagttgggctgtggaacagtctctggagcactaggagcgacatgtgtatatcctttacaagtcatcagaacaagaatgcaagctcagccagccaattcagaggatccatatagagggatgactgattgttttcggagaactctgcagcgtgagggagtttctgggttttacaaagggcttgtaccaaatcttcttaaagtggtgccagctgcaagtattacctatcttgtttatgagacaatgaagaaaagtctctccctagattaagtgactttgtagattctgcatatcagcggctgactgtatagatagtgttgaggcatgatgttcctcgttgagtaggtgctaacttaatgaccctgaagtgtgagatagtattttggccccaggatacagttaatgcagggcattctcattcttattggcagaaataaaactgtgatacctgtcagatcatcaagggaccatattggaatgcaggtagttggccttgtttgtaagcctctactactgctatttctatgtatacttcttttgcagattttggcaatattctgtattttcagtttgcacttacgaactctttgtcaa

SEQ ID NO: 2531 - DNA, 2926 bp, Oryza sativa
ggcaggcatatgcatagagcatagtagtagtagcgttgcagggagagagaggctcttctccttttgatgagcaagcagctcaagagctcatcagcaacagcatcgccatcgtgacagaatattcccttccgacaccacctccgcttcaccctcgcatcgccctcaccgatcacccgccccaaaaccctcgccgtcgcggccgccatgtccggcgcggtggcgacccatgcggcggagcccccccgcccatccgcagcagcagcggaggtggcggtggcggggggagggggagggtgcggggcggcgaggaagccggcggcgacgatggagcacgtgctgctggcgctgcacgagacggaggcggagagggaggcgcggatccgcgccatgttcggcttcttcgacgccgcggggcggggccacctcgaccacgcgcagatcgaggccggcctcgccgcgctccacctcccgccgccgccgccgcccgaggagggcggcggcggctacgcccgcgagctgctccgcgcgtgcgaccgcgaccgcgacggccgcgtcggctacgacgacttccgcaggtacatggacgacaaggagctggagctctaccgcatcttccaggccatcgacgtcgagcacaacggctgcatcctccccgaggagctctggcacgccctcgtcaaggctggcatagaaattgatgacgaggagcttgcaagatttgttgagcatgtggataaggataataatggaattattacttttgaagaatggagggactttcttttgctttaccctcatgaggcaaccattgagaacatctaccatcattgggaaagagtctgccttgtagatataggcgagcaggctgctataccagaacgaataagtaaacatgcaagcgcaagcaaatatctaattgcaggaggtgtttctggtgcaacatcccgtactgctactgcacctcttgaccgtctcaaagtcatcatgcaagtacaaacaaaccgtattacagtattacaagcagtgaaggatatatggagagagggcagtctgcgtggtttcttcagaggaaatggattaaatgtggtaaaggttgctccagaaagtgcaataagattttatgcctacgaaatgctaaaagaatacataatgaaaagtaaaggagaaaataagagcgacattggtacttctggacgtctgatggctggtggtttggctggagcagtggcacagacagcaatttatcccatagatttagtaaagactcgactgcagacttttgcatgtggtagtggtaaaattcctagccttggtgcactatcaagagacatttggatgcaggaaggtcctcgagcattttacagaggcctcgttccatcattgcttggtatggttccgtatgctggaattgatcttactgtttatgaaacactgaaagaaatgtccaagacatatgtcctcaaggatagcgatcctggtcctttagtccaactaggttgtgggacagtctcaggagctctaggagcaacatgtgtttaccctttgcaagtcatcagaacaagactgcaagctcaacgagccaattcagaggctgcatatagagggatgtctgatgttttctggaaaacactgcagcatgagggaatttccggattctacaaagggcttgtaccaaatcttctcaaagtggttccagctgcaagtataacatatcttgtttatgagacaatgaagaaaagtctatcactcgattaaattcttctgtctattttccataccagccatcattattggcatggctgactgtagagatactgttgaagcatggggttattggttgggtaggtgctaacttttcccccgaagtgaaagatggtattttgccttcaggataagagttgaaaagtcttgaccgcaatgtttctcctaaatatgaatggaagaaataaaaaagagtagtactcatcagatcatcaagcgcccatgatgagacacagtgggcattcccgggatctagttagttgttgagttatgatctgctgaaggctccttttgctactgaataagggggaaaatttgttcatacaaattgagatcatcacacattgaaggaagaactctttctgctcctgagctttgacaggagcatgaggtgtgaccttcaccttccttgaagctgcccagcagggcactgctttacatgtactttctaccttatatacctacatatatgtaactacatgatcaacctgggcatcgtcttctggtgacccactgcatcatgcaacataataacctaactaacaagagagaatgtaagaaagcggtaagctgctcgctcttttatatgcttatctaccgttctcgtggatcactgtgtttgcatactagcttttttctttttccatctatttcatcgttcatcaacctaattacctaacctggtgttgtctatggagcttgacttttggaagtactaggagatagtaagactttgttttgataatataatagattttgttgtctgagcgttcatatgcgttactactccagtactcaagtggggaatgaagtgaacattgctcgctgacttgaatttttcacatgtgctagtatccgcgtatctgggtctgacgggcacatctgaattcgatcagagatggatttcccttttctatacagatctcggtggaaacttctcggtaagatttgagatggagctctgaagaagcaaaccaacctctctgcaagtctgcagttgactgtaacgaaacaaaagaatgttaggagtagaagtttggttcatgtcaaaattgaaagtttagttgaaattggaacggtgtgatggaaaagttagaagtttgtgtgtgtaggaaatttttaatgtgacgaacaaattgaaagtttgaagaaaaagtttggaagt

SEQ ID NO: 2532 - DNA, 2888 bp, Panicum virgatum
cttctcaaccccttctgacctctctctcgtgtttgaccttttggcagacttgctgtaccgagaaacaaaagtaggctccactctgctaatcctggctcttgacgtggtggttgcggccacttagcgcgagagcacgggcacgtgttagccgtctccatctcgtccgtcgccaccgccgccctgaatcaaatcagcaggatgtccagattacgtggcgccgcaaggaaaagaaaagggcagccgtgctcggcctgtgcttgctcactgttgcccagctgaagctcgccaagcaccagaggcggttaagctttgggtgggccggcggcatcgcggtcgctggagttggcgccgcggatattcgattccctcgggagagggggagggaggagggggatcgacaaggccggctccacgaagcgaaccggggaaccagccgccctcccgatccagcgcgccccgatcgccgtcgccgcctccccgtcgcctgctccgttgcgcctcccgctatgtccggcgcggcggtccaggcggtggagccccgccggcggctgcagcttctgccggacccacggccgccgcgccccagccggcggcggcggcggcgaggggagggtgcgggggcccggcgcgggcggcggcgacgatggagcacgtgcggctggcgctgcgggagacggaggcggagcgggaggcgcggatccgcgccgtcttcgcctccttcgacgccgcggggcggggccacctcgaccacgcgcagatcgccgcggggctcgccaagctgcgggtccccgcccccgagggggagcccgggccgggggccggggccgaggaggactacgcgcgcgcgctgctccgcgcctgcgaccgcgaccgcgacggccgggtcgggtacgacgacttccagcgctacatggacgacaaggagctcgagctctaccgcatcttccaggccatcgacgtcgagcacaacggctgcatcctgcccgaggagctctggcacgcgctcgtcaaggctggtatagaaattggtgatgaagagcttgcaagattcgtggagcatgtggataaggacaatgatggtattattacttttgaggaatggagagattttcttttgctttaccctcatgaagctaccattgaaaacatttatcatcactgggaaagagtctgccttgtagatataggtgagcaggctgctataccagaaggaataagtaaacatgtgagtgcaagcaaatatctgattgcaggagggattgctggtgcagcatctcgtactgcaacggcacctcttgatcgcctcaaagttaatatccaagtgcaaacaaaccgtactacagttgcacatgcagttaagagtatatggagagatggcggtctagtgggctttttcagagggaatggattgaatgtggtaaaagttgctccagaaagtgctataaggttctacacctacgaaatgcttaaagaatacataatgaaaagtaaaggagaagataagagtgacattggtacctctggacgtctcatggctggtgggttggctggtgctgtcgcccagacagcgatttatcccattgatttagtgaagactcgtctacagacttatgaaggaggcaggattcctagccttggtgcactatcaagggatatatggatacatgaaggtccccgagcgttctacagaggccttgttccatcattgcttggtatggtcccttacgctggaattgatcttactgtttatgagacactaaaagaaatgtccaagacatatatcctcaaggacagcgatcctggccctttagtacagttgggctgtggaacagtctccggagctctaggagcaacatgtgtttaccctttacaagtcatcagaacaagaatgcaagctcagtcagccaattcagaggatccatatagaggaatgactgattgctttcggagaacattacggcgtgaaggattttctggattttacaaagggcttgtaccaaatcttcttaaagtggtgccagctgcaagtattacctatcttgtttatgagacgatgaagaaaagtctctccctagattaaatattgtgtaccggcaactgagtgtagagatagtattgaggcatgccattcctggttaagtacttaagtaggtgctaacgtaacatctctgaagtgtgagagtattttgccctcaagatagagcaaaagcggggcattctcattcttattgacaaaaataaaaaggtgatattatggtacagagatcaagggtccaaacaggaatacagtgtacaggtggtatgtccggcacataatagttagctgttgaggcggttttgttatacaatttgtgaccgttacagggggggtattgttccaccttactccaactgcttgtgcttctgagctttcgacagaagctgccatcttcactgacgcagcagttgcctgcgtaaaagccaaaaggttgcttcatatattatatattctatttgtgtttaccatacatgttcagtgatgagcatgtatctgtattgcttcaatgcgcagctcattgaatgcgatcccttggcttatttgataaatgtagacggtaaactgatgcctgttcataagccaatgcatgcgaccctcggtcacacattccatggagctctgctagtgttggatgtattgtgggtgcctggaaaccgtgcagattggttactgggaagaatggttctttcagttgataatactgacccagtgacccttatcctttccatttgcccttgaatctgcaattgcatctcagagcacgtacgtttcagaagttacattggaggctcacgagattgttgctacatgctagcttcagggatcagatgaagtttcctcaatacttgaa

SEQ ID NO: 2533 - DNA, 1939 bp, Setaria italica
tcaatcagacaccccgcagcgcagggccgcctcgatcgccacctccccttgctcgcttgctccgctgcgccggcgccgcctcggtcggtcccccgccgccagcctcccgccatgtccggcgcggcagtccaggcggtggagccccgcccagcggcagctgctggacccgcggccgccgcgtctcagccggcggcgggagggggcggcggggcggcggggcaggcggcgacgatggagcacgtgcggctggcgctgcgggagacggaggcggagcgggaggcgcggatccgggccgtcttcgcctccttcgacgccgcgggccggggccacctcgaccacgcgcagatcgtcgcggggctcgccgcgctgcgcgtccccgccgtccccgagggggacgcggggtccggcgccggcctcgaggactacgcgcgcgcgctgctccgcgcctgcgaccgcgaccgcgacggccgggtcgggtacgacgacttccgcaggtacatggacgacaaggagctcgagctctaccgcatcttccaggccatcgacgtcgagcacaacggctgcatcctgcccgaggagctctggcacgcgctcgtcaaggctggtatagaaattggtgatgaagagcttgcaagattcgttgagcatgtggataaggacaatgatggtattattacttttgaggaatggagagattttcttttgctttaccctcatgaagcaaccatcgagaacatttatcatcactgggaaagggtctgccttgtagatataggtgagcaggctgctataccagaaggaataagcaaacatgtgagtgcaagcaaatatctgactgctggaggcattgctggtgcagcatctcgtacagcaacggcgcctcttgaccgccttaaagttaatatgcaagtgcaaacaaaccgtactacagttgcacatgcagtcaagggtatatggagagagggtggtctactgggctttttcagagggaatggattgaatgtggtaaaagttgctccagaaagtgctataagattctacacctacgaaatgcttaaagaatacataatgaaaagtaaaggagaaaataagagtgacattggtacctctgggcgtctcatagctggtggtttggctggtgctgtcgcacagacagcgatttatcccattgatttagtgaagacccgtctacagacttatgaaggaggcaggattcctagccttggtgcactatcaagggatatatggatacgtgaaggtcctcgagcgttctacagaggccttgttccatcattgcttggcatggtcccttacgctggaattgatcttactgtttatgagacactgaaagaaatgtcgaagacatatgtcctcaaagacagtgatcccggccctttagtacagttgggctgtggaacagtctctggagcgctaggagcaacatgtgtttaccctttgcaagttgtcagaacaagaatgcaagctcagtcagccaattcagaggatccatatagaggaatgactgattgttttcggagaacactacgtcgtgagggaatttctggattttacaaagggcttgtaccgaatcttcttaaagtggtgccggctgcaagtattacctatcttgtttatgagacaatgaagaaaagtctctccctagattaaatagttttttaggttttctggttttgcataccagcaactgagtgtagagatagtattgaggcatgccattcctggttgagtaggcgctaacataacggctctgaagtgtgagagtattttgccctcaagatagtaaaggcagggcattctcattcttaatgacagaaataaaaaaggtgatatttgtcagatcatcaagggtccatactggaactggaatacaggtagttgtccttctttgttaacctctgctacaagtatttccttttat

SEQ ID NO: 2534 - DNA, 1371 bp, Saccharum officinarum
gcacaggtgcggtcggcgtcaacagtcgcggcacaaccggcaggtgggatgaagaagtgcgcgtcggagctgcagctggaggcgttcatccgggagagcggtgacgacgcccgcgccgccgccgggcgtagcaatcccgggtgcggaggaccaggcgagcccggagggagcggcgtgttctcgcccggcgccggcggcgccctgcctggcgtcggtttcgccgactcgaacaccatggatgaaagcagttggtggtatgggagcgtccgcacgccgaacccagacatgtcgaggacggcgtccatctccgccagcctcggggcagccacctcagcgaaccatgctcttgaaagcgagtcagactccgacagcgaatcactctatgaggtagagggagttccatatgagcgaggcaacaaatccattgaaacgaagcgaattagaaggatggtgtccaacagggagtctgcgcgacggtctaggcggagaaaacaggcacaattgtctgaacttgagtcacaggttgaacgacttaaaggtgaaaatgaaacattgttccagcaactttcagaggccaaccagcagttcagtactgcagtcacagacaacagaatcctcaaatccgatgtagaagcgttaagagtcaaggtaaagatggcagaggatatggtagcgagaagtgctatatcctgtggcctaggcgaccttggcctggcaccatatctgaactcaagaaagatgtgcgaagctttgaatatgctcacaaccacagggttggatttactagggagtgatgcgttcagaggtccaaccgcagctccacaagtacagaactcgccagtacaaagcactgcaagcctagagactctggataatcggaagtccaacgaggtgaccagttgcgcggcggacatttggccttgagcttcaagccattgatcagattcaaagcttgcttcaccaaaaaaacaacagttcctcaactcaaataaatggcggcttgagcagagcttctggcataaattcccttgaaccatatttccacagaagctttataggatgcatcgctcttttgatgtaattgtgtgtgtggtacgtctccagtgggagagtaccatttactggcagttgccttggccgataggggaatgccaaactgaggcaccagtatagtttcaagtagaaaatgaagctgtctttgtacaaagctgcaaatgcaaagtttagaagtaaatgaaacatcctgaataaacgtgtgaagtaggaatgatacttaggtccatttccaggtcaggtgcgacagttatgttcacaacaaaaggtgatacattctgtttcgaaaccattattaatacataggaatgttcaatc

SEQ ID NO: 2535 - DNA, 1540 bp, Zea mays
gcgtcaccatccatttgacgaggcggtttatcccccagcaccccaaccaacctttccacgtaccaccgggtttctgtccgcgccccgcccttcaaaagcaggtccgcacgccggccggcgagacgagacgacaccaccacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggacaccatggatggaggcagttggtggtacgggaacgtccgcacgccgaacccagtcatgtcgcaggcggcgtccatatccgctagccccgggctaaccacctcagccaatcatgctcttgaaagcgagtcagactccgacagcgaatcactgtatgaggtagagggagttccatacgagcgaggtaacagatccattgagacgaagcgaataagaaggatggtgtccaatagggagtctgcgcggcggtctaggaggaggaaacaggcacagttgtctgaccttgagtcacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacaagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttcactactacttgctgggactacaactgtacatcatgatggtaaaatgcataactagtgaggttcttgactcgaa

SEQ ID NO: 2536 - DNA, 2032 bp, Panicum virgatum
cctgccgagtgccgaccacctcgccgagccgccccggcggcagccgctcgctgtcccgtccgacgcggctccacgcgcgcgtcccggtcggggtctcgggtcaacggcgccacgccatcgcccactcaccgggtcccggatcgtgtggctggccgccggccgcgatgctgactcggacgcgcctcgctttcaccgcggatacgcacgggggccgcgccgcacgcagctcagctgccgggctccacccccaccccgtgacagccacggcccaccggacgcggggcccgccggtcggtcgtgcggggcgcccccgcatcggcgtcgctgccgcgccatggccgacgcggatccgagtcagctcgcgtcaccatccgtttgacgagctggttttatcgcccaacaccccaacggcccaaccaacggcctttccacgtagtaccacccgatttgtgctgccccttcaaaagccgccggcccgccggcgacacggacggaagacgacaccaccgcaccactccgcgccggagccgggaaggcagcaggaggaagaaagggcggccggcaccagcagccagcccactgccacgccgcgccggcggacgacggagatgaagaagtgcccgtcggagctgcagctggaggcgttcatccgggaaagcggcgccggcgccgcggagagcaagcccggaagcggaccgagcgagcccggcgggagcggcgtgttttcacccggcggcgtcggcttcggcgactcgaacaccatggatggaagcagttggtggtacgggagcatccgccccgcgaacccagtcgcgtcgcagacggcctccgtctccgctagccccagagcaaccaccccagcgaaccatactcttgaaagcgagtcagactccgacagcgaatcattgtatgaggtagaaggaggttcatgtgagcgaggcaccaaatctatggaaacaaagcgaataaggaggatggtgtccaacagggagtctgctcgacgatccaggcggagaaagcaggcacaattatctgaactcgagtcacaggtcgaacaacttaaaggtgaaaatgcaactctgttcaagcaactttcagaggccaaccagcagttcaccacagcagtcacggacaacagaatcctcaaatcggatgtagaagccttaagagtcaaggtaaagatggcagaggatatggtagcgagaagcgcaatgtcctgcggcctaggtgaccttggtctggcaccatatctgaattcaagaaagttgggccaagctttgaatatgctcacagtcacaggattggatttgctagggagtgaggcattcagaggtccaacggcagctcggcaggttcagaactcaccagtacaaagcactgcaagcctagagagtctggataacaggaagtccagcgaggtgaccagctgtgcggcagacatgtggccttgagattcaggacactgatcagattcaaagcttgctaggcagaaaccgcaccagctcattacctcaaacaattggtgcctctggagcatagcttctgccaagtttccttgaaccatatttctacagaaggctttacacgatcactatgcatcgatcatttgatgtggttatctgatacttctccagtgggaaagataccatttacagaagttgtcatggcaagcagggaatgtggcaaacctcaagtatagtttcaagtataaaatgaccttgtctttgtacaaatctgcaaaagcaaaaaaaaaaaagatgtatttttttctctcttcaacacatagaattaaatgaaacatcctgaacaaatgtgtgaaatagccaagtagggaatgatgcttaggatccacttgcaggtgagacaattacgtttgcaaaaaaaataaaaataaagtgatatattgtctagaaactattacaatccacaggaatgtttgatccggcataagtcatctagtgggtttgcaggactagctctagtggattcaggcatgttttcatcactttatgcaggcactatgattgtccaa

SEQ ID NO: 2537 - DNA, 1316 bp, Panicum virgatum
cgccctttcaaaagccgccggcccgccggcgacacggacggaagacgacaccaccgcaccactccgcgccggagccgggaaggcagcaggaggaagaaagggcggccggcaccagcagccagcccactgccacgccgcgccggcggacgacggagatgaagaagtgcccgtcggagctgcagctggaggcgttcatccgggaaagcggcgccggcgccgcggagagcaagcccggaagcggaccgagcgagcccggcgggagcggcgtgttttcacccggcggcgtcggcttcggcgactcgaacaccatggatggaagcagttggtggtacgggagcatccgccccgcgaacccagtcgcgtcgcagacggcctccgtctccgctagccccagagcaaccaccccagcgaaccatactcttgaaagcgagtcagactccgacagcgaatcattgtatgaggtagaaggaggttcatgtgagcgaggcaccaaatctatggaaacaaagcgaataaggaggatggtgtccaacagggagtctgctcgacgatccaggcggagaaagcaggcacaattatctgaactcgagtcacaggtcgaacaacttaaaggtgaaaatgcaactctgttcaagcaactttcagaggccaaccagcagttcaccacagcagtcacggacaacagaatcctcaaatcggatgtagaagccttaagagtcaaggtaaagatggcagaggatatggtagcgagaagcgcaatgtcctgcggcctaggtgaccttggtctggcaccatatctgaattcaagaaagttgggccaagctttgaatatgctcacagtcacaggattggatttgctagggagtgaggcattcagaggtccaacggcagctcggcaggttcagaactcaccagtacaaagcactgcaagcctagagagtctggataacaggaagtccagcgaggtgaccagctgtgcggcagacatgtggccttgagattcaggacactgatcagattcaaagcttgctaggcagaaaccgcaccagctcattacctcaaacaattggtgcctctggagcatagcttctgccaagtttccttgaaccatatttctacagaaggctttacacgatcactatgcatcgatcatttgatgtggttatctgatacttctccagtgggaaagataccatttacagaagttgtcatggcaagcagggaatgtggcaaacctcaagtatagtttcaagtataaaatgaccttgtctttgtacaaatctgcaaaagcaaaaaaaaaaagatgtatttttttc

SEQ ID NO: 2538 - DNA, 2066 bp, Setaria italica
cttcaaaagcctgacgactcgccggcgacgccaacggaagacgacgtgcgccaccacctccgccggaaccgggaaggcagagcaggagacaggagggcggtcggcacccagtccaccactggcggacggagatgaagaagtgcccgtcggagctgcagctggaggcgttcatccgggaaagcggcgagggcgccgtttccggcgccgcggagagcaagccctccggaagcggaccgagcgagccaggtggcagcggcgtgttctcgcccggcggcatcggcttcggcgacacgagcgccatggatggaaacagctggtggttcgggagcatccgcccggcgaacccagtcgcgtcgcagacggcgtccatctccgctagtcccagggcaaccacttcggcaaatcatgctcttgagagcgagtcagactccgacagcgaatcgttgtatgaggtagagggaggttcatgtgagcgaggcaccaaatctatggaaacaaagcgaataagaaggatggtgtccaacagggagtctgctcgacgatccaggcggagaaagcaggcacaattatctgaacttgagtcacaggtcgaacaacttaaaggtgaaaatgcaactctgttcaagcaactttcagaggcgaaccaacagttcaccactgcagtcacagacaacagaatcctcaaatcagatgtagaagccttaagggtcaaggtaaagatggcagaggatatggtagcaagaagcgcaatgtcctgcggcttaggtgaccttggtctggcaccatatctgaattcaagaaagatgtgccaagctttgaatatgctcacagtcacagggttggatttgctaggaagcgatgcattcagaggtacaaccgcagctcgacaagttcagaactcaccagtacaaagcactgcaagcctagagagtctggataaccggaagtctagtgaggtgaccagctgtgcggcagacatgtggccttgagattcaggacattgatcagattcaaagcttgctaagcagaaaaaaagcaccagttcatcacctcaaattgtgcctttggagcatagcttctgtcaaatttccttgaatcatatttctacagaaggctttacactacgcattgctggtttgatgtagctatgtaggtacttctccggtgggaaagataccatttactggcagttgtcatggcaaccagggaatgcggcaaagctcagagtatagtttcaagtagaaaatgaacttgtcattgtacaaatctgcaaaagcaaaaaatagattatatgaaatatcctgaataaatgtgtcaagcagggaatgatgcttaagatccaaatgcaggccacaggtgagacaattatgtttacaacaaaaataaagtgatacattgtttagaaactattacaatccacaggaatgtttgttccggtacaagtcatctagtgggtttgcagcactagctctagtggattcaggcatgttttcatcactctatgcaggtactgcaactgtataagatgatggtaaacactagtgcggttcttctgtgattcgaaaccttcaggcatggtcaatgctacttacatttcataaaggttccaagcatctagaaagccgaaaggcgaggaggatttcatacacgttacgaagttttatagaaaaggaacatttctagattgagcatcttttctccatattcaaatcatatctgagacctctaaaaatccaagagtgataacgaagaatgagactgaaagaaatcatataaaaagggttgaccgaattctcaaaaggaaagtgaatttgcctctagagaaaccaagggccaccaggcacaacaccttttcgcccaccaaaaggacatgatgatattattctccctctccttatagagaaagtacagcattgctgagacatgacacatgtcaaactgtcgtttgaggctgcagaatttgatctgatcctgtggtccacgacaatctaatgggccatcttgaaagtaccataccttccactaatttgacaacccgtaaagatgcaagtcaatgttatgccttc

SEQ ID NO: 2539 - DNA, 1967 bp, Panicum virgatum
tcgcccaacaccccgcaaccagcagcctttccacgtacccaccaccggattcgcgcccccttcaaaagccgccggcccgccggcgacacggtcggaagacgacaccaccagtccaaccacgccggagccaggaaggcagcagcagggggaagagagcgcggccggcaccagcagccaacggcgcgccggcggacggagatgaagaagtgcccgtcggagctgcagctggaggcgttcatccgggaaagcgccggcggcgcggagagcaagcccggaacaggacccagcgagcccggcgggagcgccgtgttctcgcccggcgggagcgccgtgtctcgcccggcggcgtcggcttcggcgactcgaacaccatggatggaagcagctggtggtacgggagcatccgccccgcgaacccagtcgtgtcgcagacggcgtccgtctccgcagctagccccagagcaaccacctcagctaatcatgctcttgagagcgagtcggattccgacagcgaatcattgtatgaggtagagggaggttcatgtgagcgaggcaccaaatctatggaaacaaagcgaataaggaggatggtgtccaacagggagtctgctcgacgatccaggcggagaaagcaggcacaactatctgaactcgagtcgcaggtcgaacaacttaaaggtgaaaatgcaactctgttcaagcaactttcagaggccaacctgcagttcaccactgcagtcacagacaacagaatcctcaaatcggatgtagaagccttaagagtaaaggtaaagatggcagaggatatggtagcgagaagcgcaatgtcctgcggcctaggtgaccttggtctggcaccatatctgaattcaagaaagatgggccaagctttgaatatgctcacagccacaggattggatttgctagggagtgaggcattcagaggtccaaccgcagctcgacaagttcagaactcaccagtacaaagcactgcaagcctagagagtctggataaccggaagtccagcgaggtgaccagctgtgcggcagacatgtggccttgatattcaggacactgatcagattcaaagcctgcaaggcagaaatcgcaccagttcattacctcaaacatttggtgactctgccttctggagcatagcttctgtcaaatttccttgaaccatgtttctacagaaggctttacactataacactatgcatcgctcgtttgatgtagctgtctgatacttctccagtgggaaagataccattactgaaagctgtcatggcaaacaatgaatgtggcaaacctcaactatagtttcaagtagaaaatgaacttgtctttgtagaaatctgcaaaagcaaaaaaaaaagtattttttctcgaacacatagaattaaatgaaacatcctgattcctgaacaaatgtgtgaaatagccaagtagggaatgatgcttaggatccaactgcaggtgagacaattatgtttacaacaaaataaagtgatatattgtctagaaactgttacaatccacaggaatgtttgatccggcataagtcatctagtgggtttgcaggactagctctagtggattcaggcatgttttcatcactttatgcaggcactatgattgtccaaggtgatggtaaaatacaaaactaatgtggctcttctgtgatttgaaaccttcagtcatggtcaatgcaacttacattttgtaaaggttccaggcatctgaaaagtcaaaaggcgaggaggatttcatacacgttacgacattttacaaaaaaggaacatatctagatcgagcatcttttctccatattcaaaacatatcctgagacctctaaaaatccaataggataaatggaagaatgagtgaaggaatcaaacaaaaaggcttgaccattctcaaaaggaaagtgaatttgcctctagaaaaaccaagggccaccggtcac

SEQ ID NO: 2540 - DNA, 3169 bp, Setaria italica
ctcggctgctcgctgccccatctccgtcatttgagatccgcagcctgtgactttcttgccccactccgcatcgtgccgcacgagtggacaaactgaaacacgatccctatcaatccggagcccgattcggtgcccacctccaatttcaccagtaactaaccccagaggcaataggaattgctctgctaagttatcttcgagcttaatctgatcgtgttggtcgggctcagaacttcgatttgtggtgttgcgggagagagatggcgcagagcaaggaggagttcttggagcagttcggcggggactacggctacccggacgctcccaggggaatcgacgagctgcgggccgccgatttcaagcggctggaagggatggtttacctggatcatgctggtgcggcgctgtactcagaggcacagatggcgaatgttgccaaagaccttatgtcgaatgtctatggaaatcctcatagccagagtgattcaagcatggctacaagtgatcttgttacttctgtgcggcatcaggtcctaaaatacttcaacgcatctccaagggactacaaatgtatatttacctctggggcaacagcagctctaaaacttgttggcgaatgttttccatggagtagagaaagctgctacatgtacacaatggaaaatcacaatagtgtgcttgggataagagagtatgctctgagcaaaggagctactgtatcggcagttgatgttgaagaggttactgatccatcaaagaatcttggaagtgatagtttgtttaacatttcaaaacactcaaaccaaagaagaggtgatgatgtgcttttgcataactatcagaatggaagcctgacagctatttcaggaaacaatttaaatctatttgcattcccttcagagtgcaatttctcaggacacaagttcaatctaagcttggtcaagctcatcaaggaaaggaaatttttgagtgcatcacagcaacagggccgctggatggttttgatagatgctgcaaaaggatgtacaactgaaccaccaaacttaaccgtgtgtcctgctgattttgttgtctgttcgttctacaagatatttggctacccaactggtcttggtgccttaattgtaaaaaatgaggctgctagtttactgaacaagacatacttcagtggaggaacggtggctgcttcaattgctgacattgactttgttcagaaaagaaaaagcattgaacaagttcttgaggatggaacaatctcattcttgagcatatcctctcttcgatatggatttgagataattgatatgctaactatctcagctattgcacggcatactgcatctcttgctacttatgtgagaaagaaaatgatggatttgaagcacagcaatgagaaaaatgtttgcataatctacggacaacaagcttctaaggtgaaagatctgaagatgggtcctacaatcacattcaatttgaaaagagaagatggcacctggtttggatatcgcgaggtggagaagcttgcttccttgtcaggaattcatttacgtacaggctgcttctgtaatcctggtgcatgtgctaagtaccttggcttgtcacactcagatctagtttctaattttgaggctgggcatgtttgttgggatgataatgacataataaatggaaaaccaactggtgctgtgaggatatcatttggctacatgtccacatatgaagatgcagaggaatttcttaagttcctgcaatcatcttttgtgtccaaagctgtaggattgaccaatggctacatggtgaacatggatattcctaattttgtagatgattggagccaacaagctatttcagatatccgtttaaaatccataactatatatcctgtgaaatcttgccaaggatttagtgtgcagggttggccactgacaattggtggtttaaaatatgatagagagtggcttctccaaggatcaggtggtgaaattttgacacagaaaaaggtgccagagttgagttctatccgcacattgattgacctggaacttgggaaactcttcttagagtcgccaaaacgcaaggataaattgcaaatatctgttctagagaattggactcatctaagtgcagaagtagatgtttatggtcaaaggtacgaggtgcaaacttatggtgacaaggtaaacttctggttcagcgatgctattggacgtccttgtacctttatgagatgcttgagctccaagtaccgttcctgcacaattaacggcaggagagatcgcctatgtagagatactcaaagcaaacttagttttgtcaatgaaggacaactgctacttgtttccgaagcaagcataactgatctcaacagccggttaagttctggtaatggaaatggtaagcaacgggtgtttgttgacgcaatgagatttcgtccaaatattgttgtctctgggtccacaccatacaacgaggataactggaaaaggcttaacattggggaggcgtattttacttctatgggaggatgtaaccgctgtcagatgatcaacctgtaccagagctcagggcaggtgatcaagtcgaaagaaccactggcaactttagcatcatatagacgacaaaagggtaagattttgtttggcatcctgctgaactatgaagacagtacggatggagaagatgagaccattgtagagagatggatcaaagtggggcaagaggtgtatccttctaccgaatgacgtgtacagaggtcaacacaaaggtttcacttgcctaagaagtggattggtaacagtcgttacaaatacgtcaaaaatacagagacatccagatatagttgtatgtaatagttgtttttcatgcctgcatgtaacacctaagggcttgaagcctgtgttccgacaaaaaagaaatatagagaaaatgaatataatacgaagaaaaaaatgtatagcctgaaatggttcagattttgtagttcttcgatgaattgcacctcgaatgacttaatactccctccgtcccaaattactattcgttttggtttttataggtacataatttttactacgtatctagacataatatatatctagagctatgtatctagaaaagttaaaacgaattgtaatttaggacggaaatgaattgtaatttgggaaggagg

SEQ ID NO: 2541 - DNA, 3192 bp, Panicum virgatum
cgggctgtgcagaggcgaggggaggagagatggggcacggccgcacggccgcacgcagcgagccagcgagcggtctccggacgccattgctgacggttgcagaagctccccgtgcgacgagaaatttccatgcgtccaatttccccggaccgtggaggcgttgaatcgtgcgtgagccattacgtagcgtcgacaacccccactcagctgcccgccgtcccatcgccgtcgaagagatccccgcctctgactttcttgtttcactcagcatcgtcccgcacgggtggagaaactgaaacaccatcccaaccaatccggaacctgattcggtggtcacctccaatttcatcagtaccgaatcccagggccaataagaatcgctccttttaagttctctccgagcttaatctgatcgtgctgctcgggctccgaacttgagattgcgatttgaggagttgcgggagggagatggcgcagagcaaggaggagttcttggagcagttcggcggggactacggctacccggacgctcccaggggcatcgacgagctgcgcgccgccgatttcaagcggctggaagggatggtttacctggaccatgccggtgcaacactctactcagaggcacagatggcggatgttgccaaagaccttatgtcgaatgtctacggaaatccccatagccagagcgattcaagcatggctacaagcgaccttgtcacttctatgcggcatctggtcctaaaatacttcaatgcatctccaagggactataaatgtatatttacctccggagccacagcagctctgaaacttgtcggcgaatgttttccatggagtagagatagctgctacatgtacacaatggaaaatcataatagtgttcttgggataagagagtatgctctgagcaaaggagctactgtatcagcagttgatattgaagaggttgttgatccatcaaagaaccagggatgtgatagtttgtttaagatttcaaaacgctcaaaccaaagaagaggtgacgatgtgcttttgcataattatcagaatggaagcctgacagctatttcatgcaatttctcagggcataagttcaacctcagcttggtcaagctcatcaaggaagggaaattcatcggtacatcacagcaacagggccgctggatggttttgatagatgctgcaaaaggatgtacaactgaaccaccaaacttaactgtgtatcctgctgattttgttgtctgttcattctacaagatatttggctatccaactggtcttggtgccttaattgtaaaaaatgaggctgctggtttactgaacaagacgtacttcagtggaggaacggtggctgcttcaattgctgacattgactatgttcagaaaagaaagagcattgaaaatgttcttgaggatggaacaatctcattcttgagcatatcctctcttcgatatgggtttaagataatcgacatgctaactatttcagctattgcaaggcatactgcatctcttgctacttatgtgagaaggaaaatgatggacttgaagcacagcaatgagaaaaatgtttgcataatctacggacaacaagcttctaaggtgaaagatctgaagatgggtcctacaatcacattcaatttgaaaagagaagattgcacctggtttggataccgcgaagtggagaagcttgcttgcttgtcaggaattcatctgcgtacaggctgcttctgtaaccctggtgcatgtgctaagtaccttggcttgtcacactcagatctagtttctaattttgaggctgggcatgtttgctgggatgataatgacataataaacggaagaccaactggtgctgtgaggatatcatttggctacatgtccacatatgaagatgcagaggaatttcttaagtttctgcagtcatcttttgtgtccaaagctgtaggattgaacaatagctacatggtgaatatggatactcttaatttagtagatgattggagccaacaagctacttcagatatccgcttaaaatccataactatatatcctgtgaaatcttgccaaggatttagtgtgcagggttggccactgacaactggtggtttaaaatatgatagagaatggcttctccaaggatcaggtggtgaaattttgacacagaaaaaggtgccagagttgagttctatccgcacattgattgacctggaacttgggaaactcttcttagagtctccaaagcgcaaggataaattgcaaatatctgttctagagaatttgactcatataagtgcagaagtagatgtttatggtcaaaggtatgaggtgcaaacttacggtgacaaggtaaactcctggttcagtgatgctattggacgtccttgtacctttatgagatgcacaagctccaagcaccgttcctgcacaattaacggcaggagagatcgcctatgtagagatactcgaagcaaacttagttttgtcaacgaaggacagctgctacttgtttccgaagagagcatatctgatctcaacagccggttaagttcaggtaatgtaaatggtaagcaacagatgtttgttgacgcaatgaggtttcgtccaaatattgttgtctctgggtctgcatcatacgatgaggataactggaaaaggcttaacattggggaggcgtattttacttctatgggaggatgcaaccgttgtcaaatgatcaacctatatcagagctcagggcaggtgatcaagtcaaaagaaccactggcaactttagcatcatatagacgacaaaagggtaaaattttgtttggcatcctgctgaactatgaagacagtatgtatgaagaagatgatgccgttgtagagagatggattaaagtagggcaagaggtgtatccttctacagaatgacgtgggcagagatcagcacaaaggtttcacttgcacaagaagcggaatggtataggcattcggaatgtatagagttcttttaaaaaaagaatgtatagagactctcaggtataccatgtatgtaataatttccttttttttcatgcctgtatgtaacacaaaagggcttgaagcctgtgttccaatccaaaaaaatatagagggaaaatgaatgaatataatacgaaagaaaaaaatgtatatccagaaatggttcattttttgtagttcctcggtgaa

SEQ ID NO: 2542 - DNA, 3676 bp, Brachypodium distachyon
ttatcgtcctctcctcctcaaaacaaatacgcaaataatagaaggaaagaaaatgtgacgccattgatgcgtctgccgaagctccgtgtctcctccattgaccgcgggaagcagcagttcgtgcgtgagccattacgtccgctcgccgtcggcaccacacgccaaccatataatccctcctcgtcgtcgaggccatcgccgtctgacttcccttgctccactccgcatcttcttcccagtcccagcacgaggatagggtagaataatctaatcaaaccggagatcccccgcgaatcaggggagtccggttcagtgcccgccaccgctctaccagctccactcaccacctaatccgtcccagcgacagttaattcttggaggatcccctcggttccgctcgagctaatccgatcggccttgtcttatcccggctgcgatttgagctgagaggattccacccgactgagtggaaatagagagatatggatcggagcaaggaggaattcctggagcagttcggcgccgactacggctacccggccgcgcccaggggcgtcgacgagatgcgggcggcagatttcaagcggctcgaaggaacggtgtacctggaccatgccggcgcgacgctgtattcggaggcccagatggcgaatgtcgtcaaggaccttacttccaatgtctatggcaatcctcatagccaaagtgattcgagcatggccgcaaccgacctcgttactgctgcgcgccatcaggtcctaaaatacttcaatgcatctcctagagactacaaatgcatattcacctctggggcaacagcggctctgaaacttgttggtgaatgttttccatggagtagagaaagctgttacatgtacacaatggaaaatcataatagtgtacttgggataagagaatatgctttgaggaaaggagctactgtattggcggttgatgttgaagaggatggtgatcttgaaaataaccatggaagtcctagtccaagtatgtttaagatctcgagacactcaaaccaaagaagaggtgacaatgtgctttcacacagttgtcagaacggaagtctttcagccatttcaggcaacaattggaatctatttgcgttcccttccgagtgcaatttctcaggacagaaattcaaccttaacttggtcaagctcatcaaggaaggaaagattgtggagctcccttcatcacagcagggtcaatggatggttctgatagatgctgcgaaaggatgtgcaactgaaccaccaaatttaggtgtgtatcctgctgattttgttgtctgttcgttctacaagatatttggctatccaactggtcttggtgctctaattgtaaaaaatgaggctgctagcttgctgaacaagacatacttcagtggaggaacagtagctgcttcaattgctgacatcgactttgctaaacaaagaaagaacattgagcaagttcttgaggatggaacaatctcattcttgagcatagcttctctccgacatgggtttaagataattgacatgcttactacctctgctattgcacggcacactgcatctctagccacttatgtgagaaagaaaatgctggaaatgaagcacaacaataagaaaaatgtttgcataatctatggacagcaagcttctaaggtggcagatctgaagatgagccctacgatcacattcaatttgaaaagagaagatggcacctggtttggataccgggaggtggagaagctcgcttccttatcaggaattcatctgcgtacgggctgcttctgcaatcctggcgcgtgtgctaagtatcttggcttatcacactccgatctagtttctaattttgaggctgggcatgtttgttgggatgataatgatgtaataaaaggaaaaccaactggtgctgtcaggatatcatttgggtatatttccacttaccaagatgcagaggaatttctgaagttcctggaatcttcttttctgtccaaaccaatagcctccaacaatgggtacacgttgaatatgaacatgcttaacttagtagacaaccggagtcaacaagttgttccagatgttcgcttaaagtccataattatttaccctgtgaaatcttgccaaggatttagtgtgcagagttggccgctgaccactggtggtttaaagtatgacagagaatggcttctccaaggatcaggtggtgaaattttgacacaaaaaagggtaccagagttgggctctatccgtacgttgatcaacctggagcttgggaagctcttcgtagagtcacccaaacgcaaggataaattgcaaatttctcttctagagaatttgactcatctaaccgcagaagtagatgtatatggccaaaggtacgaggtagaaagttatgatgacaaggtaaacacatggttcagcgaagctattggacgtcactgtacatttgtgagatgttcaaactccaagaagcgttcctgcacatttgctggcaagaacggtcgtctatgcagggacactcgaagcaaacttagttttgtcaatgaaggacaactgctactaatatctgaacagagtgtctctgatctcaacagtcggctcagttcaagtaatggaaatggcaagcaacagatgcttgttgatgcaatgagatttcgtcccaacattgttatctctgggtcaatgccatacgacgaggacaactggaaagagctttgcattggggaggcctgttttacttccatgggaggatgtaaccgttgccagatgatcaacctacatcaaagctcagggcaggtgatcaagtcgaaggaaccattggcaactttagcctcatacagacgagaaaagggcaagattatgtttggtgtgttgtttaactatgaagatggcttggatggagaagaagagactgtcgcggagagatggctccaagtagggcaagaagtgcactcttccacatggtgattctctgtacatatattcgggccgggagctacatcagaaatatgcttgccattttggcaactgttgagttgttacatagctacataccgtaacatgtgggcacccagaagatttccaatacatcagctggagaaacttttacatgcacgatgtgtgtacattgtttttaaatgctctatgtaatattctttaaaacctagggctgttttacagcacgtaaaaataaactcaaggaaatggaaaatatagccagagatggttcagaacttgagatgttaataagagttcctcacactgctgtttctaacttctatcgacatttggtacacaactgaatgtgaaaaaaccaagcgtcatgatgatttatgaatgcatgataatcataactgaattgagcagtaactattagagcaagagaaaaagacactgaaacgctttggtgtgaatgtgagctcacaagcttgaacaatgttatgcagtatgaacagtacattttaagcctgtatcagcggtattcatagaagggtagcagatgttgtctctaccgtttgtatatgacatagcaccatggagtttgctatccagatcaactttgcgtagcttcgaaagttcaagtctggtttatccacattttggattgggaactctggcattgatattcagcgttctgacatttcctctacatggaacaagtttcctctggt

SEQ ID NO: 2543 - DNA, 2803 bp, Secale cereale
ggcatggagcagagcagggaggagttcttggagcagttcggcggcgactacggctacccggagcgccgaggagcgtcgacgagatgcgggccgccgacttcaagcgcctccaagggacgtgtacctggaccatgccggcgcggcgctctactcggagccgcagatggccgatgtcgtcaaggacctcacctccaatgtctatggcaaccctcatagccagagtgactcgagcatggccgcgaccgaccaagttactgctgcgcgccatcaggtacctaaaatactttaatgcatctccaagagactacaaatgcatattcacctccggggcaacagcggctctgaaacttgttggtgaatgttttccatggagcagagaaagctgttacatgtacacaatggaaaatcataatagtgtacttgggataagagaatatgctctgagcaaaggagcaactgcattggcggttgatattgaagaggacaagggtcttgaaaagaaccatggaagtcctagttccgatttgtttaagatctcaagacactcaaaccaaagaagaggtggagatgtccattcgcagaattgtcagaatggaagcctttcagcggcttcagaaaacaattggaatctgtttgcatttccttctgagtgcaatttctccggacagaaattcaaccttaacttggtcaagcttatcaaggaaggaaatcttgtggggctcccttcgccgcagcagcagggtcaatggatggttctgatagatgctgcaaaaggatgtgcaactgaaccaccaaatttagatgtgtatcctgctgattttgttgtctgttcgttctacaagatatttggctatccaactggtcttggtgctctaattataaaaaacgaggctgccagtttgctgaacaagacatacttcagtggaggaacggtagctgcttcaattgccgacattgactttgttcagaaaagaaagagcatcgaacaagttcttgaggatggaacaatctcgttcttaagcatagcttctcttcggcatggttttaagataattgagatgctgactacctccgccattgcacggcacacatcatctcttgctacttatgtgagaaagaaaatgctggacatgaagcacagaaataagaaaaatgtttgcataatctatggacaagaagcatctaaggtggcagatttgaagacgagccctacgatcacattcaatttgaaaagagaagatgacacctggtttggataccgtgaggtggagaagcttgcttccttatcaggaattcatctgcgtacgggctgcttctgtaaccctggcgcttgtgctaagtatcttggcttgtctcactcggatctagtttctaactttgaggcagggcatgtttgttgggatgataatgacgtaataaaaggaaaaccaactggcgctgtcagaatatcatttgggtacatttccacttatcaagatgcggaggaatttctgaagtttctgcagtcttcttttgtatctaaaccaatagcatccagtaatgggcacacgttgagtatgaacactcttaacttagtagacaatcagagtcagcaaggtgttccagatgttcgcttaaagtccataattatttatcctgtgaagtcttgccaagggttaagtgtgcagagttggccactggctgctggtggcttaaaatatgacagagaatggcttcttcaaggatcaggtggtgaaattttgactcaaaaaaaggtaccagagttggcctctatccgcacattgatcaacctggaacttgggaagctctttgtagagtcacctaaacgaaaggataaactgcagatttctcttctggagaatctgactcatctaactgcagaagtagatgtgtatggccaaaggtacgaggtagaaagctatgatgagaaggtgaacacatggttcagcgaagctattggacgccattgtagctttatgagatgttcaagctccaggagcagtttctgcacatctactggcaagaacggtcgtctatgcagggatactcgaagcaaacttagttttgtcaacgaaggacaattgctactaatatctgaagagagcgtctctgacctcaacagccggcttagttcaagcaatggaaatggtaagcagcacgttcttgttgatgcaatgagatttcgtcccaacattgttatctctgggtcgacgccatacagagaggacaactggaagaggcttcgcattggagatgcctattttacttccatgggaggatgcaaccgttgccagatgatcaacctacaccagaacgcggggcaggtgatcaagtcgaaggaaccgctggcaacgctggcctcctaccggcgagaaaagggcaagattttgtttggcgtcctgttgagctacgaagacggttcaagcggagaagaagaggccgtcgcagagagatggctccaagtagggcaagaagtgcacgcttcgacagagtgatttcgtgtacagatacagagccagcagtcacaccagaaaaaggtgcttggcaatgagttgtttaggactacacttctacacgcagtgcatgcaacaatttttgaaatgcatgtatgtaatatttttgtttacatacgacctgcctttcggagacgaaaaagaatttgaaacatgtgaaaaatgtatggttgtaaacggttcagatgccagagtcactcagaactgatgtttccatgaacatgagagttgtacatgccggttttgtatttgtaaccaaggaacttgatgattcatgagctcatgatgat

SEQ ID NO: 2544 - DNA, 2821 bp, Secale cereale
cggccgccgttggagctgaggggattgccgcgaagtgagaaggggggcgggcatggatcagagcagggaggagttcttggagcagttcggcggcgactacggctacccggacgcggccaggggcgtcgaccagatgcgggccgccgacttcaagcgcctccaagggacggtgtacctggaccatgccggcgcggcgctctactcggagccgcagatggccgatgtcgtcaaggacctcacctccaatgtctatggcaaccctcatagccagagtgactcgagcatggccgcgaccgaccaagttactgctgctcgccatcaggtcctaaaatactttaatgcatctccaagagactacaaatgcatattcacctccggggcaacagcagctctgaaacttgttggtgaatgttttccatggagcagagaaagctgttacatgtacacaatggaaaatcataatagtgtacttggaataagagaatatgctctgagcaaaggagcaactgcattggcggttgatattgaagaggacaagggtcttgaaaagaaccatggaagacctagttccgatttgtttaagatctcaagacgctcaaaccaaagaagagttggagatgtccattcgcagaattgtcagaatggaagcctttcagcggcttcagacaattggaatctgtttgcatttccttctgagtgcaatttctccggacagaaattcaaccttaacttggtcaagcttatcaaggaaggaaatcttgtggggctcccttcgccgcagcagcagggtcaatggatggttctgatagatgctgcaaaaggatgtgcaactgaaccaccaaatttagatgtgtatcctgctgattttgttgtctgttcgttctacaagatatttggctatccaactggtcttggtgctctaattataaaaaacgaggctgccagtttgctgaacaagacatacttcagtggaggaacggtagctgcttcaattgctgacattgactttgttcagaaagaaaaagcattgaacaagttcttgaggatggaacaatctcgttcttaagcatagcttctcttcggcatggtttcaagataattgagatgctaactacttccgccattgcacggcacacatcatctcttgctacttatgtgagaaagaaaatgctggacatgaagcacagaaataagaaaaatgtttgcataatctatggacaagaagcatctaaggtggcagatttgaagacgagccctacgatcacattcaatttgaaaagagaagatggcacctggtttggataccgtgaggtggagaagcttgcttccttatcaggaattcatctgcgtacgggctgcttctgtaaccctggcgcttgtgctaagtatcttggcttgtctcactcggatctagtttctaactttgaggctgggcatgtttgttgggatgataatgacgtaataaaaggaaaaccaactggtgctgtcagaatatcatttgggtacatttccacttatgaagatgcggaggaatttctgaagtttctgcagtcttgttttgtttctaaaccaatagcatccagtaatgggcacacgttgagtatgaacactcttaacttagtagataatcagagtcagcaagttgttccagatgttcgcttaaagtccataattatttatcctgtgaagtcttgccaaggatttagtgtgcagagttggccgctggccgctggtggcttaaaatatgacagagaatggcttcttcaaggatcaggtggtgaaattttgactcaaaaaaaggtaccagagttggcctctatccgcacattgatcaacctggaacttgggaagctctttgtagagtcacctaaacgaaaggataaattgcagatttctcttctggagaatctgactcatctaactgcagaagtagatgtgtatggccaaaggtatgaggtagaaagctatgatgagaaggtaaacacatggttcagcgaagctattggacgccattgtacctttatgagatgttcaagctccaacaacagttcctgcacatctactggcaagaacggtcgtctatgcagggatactcgaagcaaacttagttttgtcaacgaaggacaattgctgctaatatctgaagagagcgtcgctgacctcaacagccggcttagttcaagcaatggaagtggtaagcagcacattcttgttgatgcaatgagatttcgtcccaacattgttatctctgggtcgacgccatacagagaggacaactggaagaggcttcacattggagatgcctattttacttctatgggaggatgcaaccgttgccagatgatcaacctacaccagaacgcggggcaggtgatcaagtcgaaggaaccgctggcaacgctggcctcctaccgacgagaaaagggcaagattttgtttggtgtcctgttgagctacgaagacggtttgagcggagaagaagagaccgtcacagagagatggctccaagtagggcaagaagtgcacgcttcgacagagtgatttcgtgtacagatacagagccagcagtcacaccagaaaaggtgcttggcagtgagttgtttaggactacacttctacacgcagtgcatgcaacaatttttgaaatgcatgtatgcaatatttttgtttacatacgacctgcctttcggagaccaaaaagaatttgaaacatgtgaaaaatgtatagttgtaaacggttcagatgccagagtcactcagaactgatgtttccatgaacatgagagttgtacatgccggttttgtatttgtaaccaaggaa

SEQ ID NO: 2545 - DNA, 2840 bp, Triticum aestivum
gggggggcgagggtgggacggagggaggcatggaccagagcagggaggagttcttggagcagttcggcggcgactacggctacccggacgcgcccaggggcgtcgaccagatgcgggccgccgacttcaagcgcctccaagggacggtgtacctggaccatgccggtgcggcgctgtactcggagccgcagatggccgatgtcgtcaaggacctcacttccaatttctatggcaaccctcatagccagagtgactcgagcatggccgcgactgaccaagttactgctgcgcgccatcaggtcctaaaatacttcaatgcatctccaagagactacaaatgcatattcacctccggggcaacagcggctctgaaacttgttggtgaatgttttccatggagtagagaaagctgttacatgtacacaatggagaatcataatagtgtacttgggataagagaatatgctttgagcaaaggagcaactgcattggcagttgatattgaagaggataagggtcttgaaaagaaccatggaagtcctagttccggtttgtttaagatctcgagacactcaaaccaaagaagaggtggagatgtcctttcgcagaattgtcagaatggaagcctttcaacggtttcagaaaacaattggaatctgtttgcatttccttctgagtgcaatttctccggacagaaattcaaccttaacttggtcaagcttatcaaggaaggaaatcttgtggggctcccttcgcagcagcagcagggtcaatggatggttctgatagatgctgcaaaaggatgtgcaactgaaccaccaaatttagatgtgtatcctgctgattttgttgtctgttcgttctacaagatatttggctatccaactggtcttggtgctctaattataaaaaacgaggctgccagtttgctcaacaagacatacttcagtggaggaacggtagctgcttcaattgctgacattgactttgttcagaaaagaaagaacatcgaacaagttcttgaggatggaacaatctcgttcttaagcatagcttctcttcggcatggttttaagataattgagatgctaactacctctgccattgcacggcacacatcatctcttgctacatatgtgagaaagaaaatgctggacatgaagcacagaaataagaaaaatgtttgcataatctatggactagaaccatctaaggtggcagatttaaagacgagccctacaatcacattcaatttgaaaagagaagatggcacctggtttggataccgtgaggtggagaagcttgcttccttgtcaggaattcatctgcgtacgggctgcttctgtaaccctggcgcttgtgctaagtatcttggcttgtctcactcggatctagtttctaactttgaggctgggcatgtttgttgggatgataatgacgtaataaaaggaaaaccaactggtgctgtcagaatatcatttgggtacatttccacttatcaagatgcggaggaatttctgaagtttctgcagtcttcttttgtgtctaaaccaatagcatccagtaatgggcacgcgttgagtatgaacactcttaacttagtagacaatcagagtcagcaagttgttccagatgttcgcttaaagtccataattatttatcctgtgaagtcttgccaaggatttagcatgcagagttggccgctggccgctggtggcttaaaatatgacagagaatggcttcttcaaggatcaggtggtgaaattttgactcaaaaaaggtaccagagttggcctctatccgcacattgatcaacctggagcttgggaagctctttgtagagtcacctaaacgaaaggataaattgcagatttctcttctggaaaatctgattcatctaactgcagaagtagatgtgtatggccaaaggtacgaggtagaaagttatgatgagaaggtaaacacatggttcagtgaagctattggacgccattgtacctttatgagatgttcaagctccaagaacagtttctgcacatctactggcaagaacggtcgtctatgcagggatactcgaagcaaacttaattttgtcaacgaaggacaattgctgctaatatctgaagagagcgtctctgacctcaacagtcggcttagttcaagcaatggaaatggtaagcagcacgatcttgttgatgcaatgagatttcgtcccaacatcgttatctctggctcgacgccatacagagaggataactggaagaggcttcacattggagatgcctattttacttccatgggaggatgcaaccgttgccagatgatcaacctacatcagaacgcggggcaggtgatcaagtccaaggaaccgctggcaacgctggcctcctaccgacgagaaaagggcaagattttgtttggtgtcctgttgaactatgaagacggcttgagcggacaagaagagaccgtcacagagagatggctccaagtagggcaagaagtgcacgcttcgacagagtgatttcgtgtacagatacagagccagcacccacaccagaaaaggtgcttggcaatgagttgtttaggactacacttctacacgcagtgtgtgcaacaatttttttaatgcctgtatgtaatatttttgtatacatacgacctgccttttggagaggaaaaagaagttgaaacatgtgaaaaatgtatagttgtaaacggttcagatgccagagttacacagaactgatgttcctatgaccatgacatttgtataacagcatgccagttttgtatttgtaaccatggaacacagccgagtattttaaaaccgaggaacatga

SEQ ID NO: 2546 - DNA, 3971 bp, Oryza sativa
gaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcagtcgagggggggagggatggaggtgagcaaggaggagttcttgaggcagttcggtggcgactatggctacccgggcgcgcccaagggcgtcgacgagatgcgcgccgccgagttcaagcggcttgaagggatggcttacctggaccatgccggtgcgacgctgtattcagaggcgcagatggcggatgtcttgaaagaccttgcatccaatgtatatgggaacccacatagtcagagtgattcaagcatggctgcgagtgacctcgttactgctgcacgccatcaggttttaaaatacttcaatgcatctcccagagaatacaagtgcatatttacctctggggcaacagcagctctgaaacttgttggtgaatgttttccatggagtagagaaagctgttacatgtacacgatggagaatcacaatagtgtgcttgggataagagaatatgctctgagtaaaggagctactgtgttggccgttgatgttgaggagggtgctgatctggcaaaagacaatggaagttatagtttgtataagatttcaagacgcacaaaccaaagaagaagcaaagatgtgctttcacacaattgtcagaacggaagtctttcagatatttcagggaacaattggaatatatttgcattcccgtcagaatgcaatttttcaggacaaaagttcagtctgagcttggttaagctcatcaaggaaggaaaaatcccattgcagcagcagggtaaatggatggttctgatagatgctgcaaaaggatgtgccactgaaccaccgaatttaactgtgtatcctgctgattttgttgtatgttccttctacaagatatttggctatccaactggccttggtgctctaattgtaaaaaatgaggctgctaatctgttgaacaagacatattttagtggaggaaccgtagctgcttcaattgctgacatcgactttgttcaaaaaagaaagaatatcgaacaggttctagaggatggaacaatctcgttcttgaacatagcttctctccgacatgggtttaagatcattgaaatgctcactacctctgcaattgaacggcatactacatcccttgctacttatgtgagaaacaaaatgctggacctgaagcacagtaatgagataaatgtttgcacaatatatggacaacagtattccaaggtggaaggtctgaaaatgggccctacaatcacattcaatttgaaaagagaagatggctcttggtttggataccgtgaggtggagaagcttgcttccttgtttggaatacatttgcgtactggctgcttctgtaaccctggcgcttgtgctaagtatcttggactgtcccattcagatttagtttctaattttgaggctgggcatgtttgctgggatgataatgacataataaatggaaagccaactggtgctgtcaggatatcatttgggtacatgtccacatttgaagatgcagagaaattcctgaagttcctgcagtcctcttttgtatccctaccagtacaattcaacaacgggtacatgttgaatctgaacagtcttaacttaatagataattcgagtcaaaaggctgtttcagatattcacttaaaatccataattatttatcctgtgaaatcatgccaaggatttagtgtaaagagttggccactaaccactggtggcctaatgtatgatagagaatggcttctccaagggtcaggaggtgaaattttgacacagaaaaaggtgccagagttgggctcaatccgcacattgatagacctggaacttgggaaactcttcatagagtctcccacacgcagggataaattgcaactctctcttcttgagagtttggctgatctaagtgaagaagtagatgtatttggtcagaggtatgaggtgcaaagttacgatgatagggtaaacacatggttcagtgaagctattggacgtccttgtaccttggtgagatgctcaagctccaagtaccgttcctgcacatatactggcttgagagatcgtccatgtagagatactcaaagcaaacttaattttgttaatgaaggacaactactactaatatcagaagaaagcatctctgacctcaatagtcggctaaattcaggcaaaggggactgtaagcaaaagttgcctgttgatgcaatgagattccgtcccaaccttgttatctctgggtcgagtccatacagtgaggataactggaaaaaacttcgtatcggagaggcctgttttacgtccatgggaggatgcaatcgctgtcagatgatcaatctacaccaggactccgggcaggtgctcaaatcaaaggaaccattggccactttagcgtcatacagacgaaaaaagggcaagattttgttcggcatcctattaaactatgaagacattatggaaggggaaaatgagaccattgcagggagatggctccaagtggggcaacaagtgtacccttccacagaatgacttgatgatgaagtagctgtggacatatcacttgagtacatatatggaattgcaagttgcatcagcagcgaccttggtgatgatgaagtgatgattgttacgtatacaaaacacgtcggcatacaaagcattttcgtaattttccaatacgcataagatgaaacaagtttagttaggtgaaaacagaatataccttcacatgtatcacatatatactatagttctcaaaatgcttttatataacacacaaggggctctaagcctaagccctagctcaaacaaaacgaaatgattgtgaagaaaaatgtacagacggaaatggttcatatttcagagttctcatgattacggtttctgtgcacaggttatcagtcatattagcaatcttggtacactattgaatactatttgaaaaccaggtgtggtatcaggacttaagaattacgcaaatgattacatattaagtggatatgacagtatctattaacaaggagaggtgagggcatgttgcatacacgatgaaatgccttaactagaaggtcagattgctctatgctatacgacgccatttgaatttgatcccttgtacctgaaggggaaatggctctagaaactagaggacagctaagtaaaaacacttacattgtcaacctaaaggtctagaagtagaagcagttaagaaatcatagcaggtatagcccataccatatgtacagagcatcacgtctcgtaacaacagggagcaagcaaaagcacagtggcaggtatatgatgatgatgcaagagaaaacgcagtactgtaagttgtgtttcagtccactttgtgcaatgacatgctggtccacatttgagagtgcacaacttcagagttcgatgatacgatttcatccacgtttgaactcaaatatcgccacaacactctttcttcaggctcaaactctttcctcaagatagagaagccttccagggacaagtttcctgtgttgaaacatatgatttcacaattagtaccatgtatgacaggttctgtaaaagatgggtagacaaatttcctactccatccgtttcacaatgtaagactttctaacattgcccac

SEQ ID NO: 2547 - DNA, 3006 bp, Zea mays
ggccttcctccccctccgcctcctctcctcggccgcgccttggacgcgtccgacgccgagccttcctttcgttcctctccaatcgagccaaaaggactcccgtctctttccctcctcctttctcgcctcgccccccttttccagcctaaaccccctcgcccccgcacctctttcttccccatatggccatactatcacactagactcctctcctctccgctccgcgccggcatggcctcctgttcccagcgcctctcacctaccgtgtgccagtccccctcacgcgccacgccccccctcggataactactagttgccgtaccgtgggagcgccgcctcgagtctcaccaacaacacctgctggtgcgtagccgcgcccgcgcccccgccgcggctctctggttggattcccgtgcgggatcggcgggcgaacctccgactcaccgccgcgaccgttcccgcattacaggggcgtccgtgcgtgcgtgctccggatgggggcgtcccacgacgacgaggcggggccgctggcgagcctcctggcggcgcgccgcgcgctgcgggccggcctggacaagtcgcgcgcgctgagccgcgcgctggcgccccggctggaggggatccaggcgcggctgccggccatggaggcgtcagtgcgcccgatccgcgcgccgccggaggcgctcgccacggcggggcccaacatcgaccgcgccgtgggccccgccgccgccgtgctcaaggtgttcgacgccgtgcacggcctcgagccgccgctcctcgaccgcgccgccgccgccgccgacctcccgggctacctcgccgtgctcgcgcagctcgaggccgcgctccgcctcctctccgacaactgcggcctcgccacgcagtggctggccgacatcgtcgcctacctcggggagcgcaggctcgccgacgcccgcttcgtggccggcctcgccgccgcgctcgaccgcctcagggacgacgcctccgccggcctcgacgccgggctgctcgccgccgcgcttgacatgctccaggctgagttccgccggctcctcaaggaccactccgcgccgcttgctatgaaggaccccgacggctctggctccgatccgccccccgtcgtcccttctcggatccctgccgcagtcgtgcacaagctcagcctcatccttgaccgcctcgctgccaacggccggcttgaccactgctcctcggcgtatggggacgcgcgaggggataccgtgtgcgccagcctccgcgcgctcggccttgattacctcaaggagacgtcgggggacgcgcaggcgctcagcccgagcgtcgagcgctgggcccggcatctggagtttgcggtgcaccacctccttgaagctgagagaaagctctgtgtcgcggtgtttgaacggcggcctgaggccgcgcccttgtgctttgctgagattgcagctcgtgctggcattcttgatttcctcgactttggccgtgccctggctgatgccaggaaggaccccatcaagctattgcggctgctcgatgtgttccattgtttgaacaagctgaggctggatttcaaccgtttgttcggtggaaaggcctgcgtagagatccaaagcaggactagggagctcgtcaagagggtcgtggatggtgctgttgagatctttgaggaattgcttgttcaggttgagctgcagcgcactataccgccaccagttgacggcggggtgccacgcctagtgagctttgtcgctaagtactgcaatcagcttcttggggagcagtatcgatctgtgctaacacaggtgatcaccatccaccgcagctggcgcaaagaagtgtttaatgacaagatgcttgttgatgcggtgcttaatatcgttaagacacttgagctcaactttgatacatggtcaaaggcttatggagatacaacactgtcgtctctcttcatgatgaacatacactggcacttcttcaaacacctaaagggtactaagctgggcgagctgttaggtgatccatggctccgggagcatgaacagtacaaggattactactcagcgatgtttctgagggagagctggggaacacttgcacccctgttgagcagggagggcctgatcatgttttccaagggccgggctactgcaagagatttagtgaaacagaggctcaaatcattcaatgctagcttcgacgagatgtttcaaaagcagtctaaatgggtgatatcggatagggatttgcagcagaagacatgccacctcgtggtgcaggccgtagtgcctgtttacaggagcttcatgcagaattatgggccgcttgttgagcaggacgttagtgcgagcaggtatgtgaagtacagcgccgaggatctggataagatgctcaacacgctcttcctgtccaagccaggcaggccaatgagagctggaagcttccaaatcaaaaattcgaatgacaagattaccagtgcaatgacaggattgtatcggagtgcttctactctgaagtagcttcagtggcagttgggaaatactgaatgcacaatttgtgcaataagccaataacttcgtaggcaaaggtggttcgggccagtaagtcaagatccccacttatgtggggggtgcaataatggttccatgattagagcagctggagcataagatgaacataaaactcttccagaactgatattgtgggggagaaagatgacaggagtgtttcctcagcgggtctccttcctgtcgatcatcttttcaccttctattgcattcttatctgtagcaagtatactcaattcattttaggaacttgtgtgggagcagaggatgtgtaatcagttatctggtacatggtagaagattggttgtattataggaggtgttaagttgttgcatatggttatggtatactatgttttagatctcatgaacatgcagtgaattatatggagtacattataactggtggcgaatggtaattacagcagttaattat

SEQ ID NO: 2548 - DNA, 3309 bp, Setaria italica
gggagcgccgagcgcctcccatcctcttttcccttccctttctctcctcgccccccttttccaacctaaaccccctctcctcctcgccggcatggccgccccttcccagcgccagtcaccaacccgcccccctcttcccctcctcccgtcggataagtagccgtagcgtcgaagcggcgcctcaggtgaggtctcaccaacagcacctaccgcaggctgcttcctctccgcgcaggatttcccgtcgcgattcccgggtgggaaaaactcgcggtcccggctccctcgagggttcggcattggaggaacgacgcgcgtgcggggtgactgaggcgcgcgcggatgggggcggcggcggacaaccagcagcaaccggaggaggcggaggagggtcgccggatggcggcgctgctggcggcgcgccaggcgctgcggtccggggtggagcggtcgcgtgcgctgggccgcgcgctggcgcgggagtcgtccccgcggctggaggagatccagtcccggctccccgcgatggaggcgtcggtgcggccgatccgcgcgccggcggaggccctcgcgtccgcgggggggaacatcgaccgcgcgctcggccccgccgccgcggtcctcaaggtgttcgacgccgtgcacgggctggagcccacgctcctggcgcgggactccctggccgacgacgtcccggggtacctcgccgtgctcgcgcagctcgagggcgcgctcaggctgctcgccgacaactgcggcctcgccgcgcagtggctggccgacatcgtcgcgtacctcggggaccgcagcctcgccgacccgcgcttcctctccggcctcgcggggcagctggacaacctcaagggccgcgccgccgctgacctcgacgcgggcctcctggcggccgccctcggcatgctcgaggccgagttccgtcggctcctcgcggagcactccgcgccgcttgctatgagggagcggggcgacagctccaccccggcgtccatcgtgccttctcggatccctccctccgtcgtgcacaagctcagcctaatccttgaccggctcgccgcgaacgggcggcttgaccgctgctccgccgcgtacgccgacgcgcgaggggataccgtgggagccagcctccgcgcgctggggctcgattacttgaaggagacatcggaggacgcgcaggtgctcagcccgagcgtcgagcgctggggtcggcatctggagtttgcggtgcaccacctcctggaagctgagaggaagctctgcgtggcggtgtttgagcggcggccagaggccatgccgtcgtgctttgctgaggtcgcggctcgtgctggcattctcgatttcctcaagtttggccgcgccctggctgataccaggaaagaccccatcaagctgttgcggttgcttgacgtgtttgatgctctgaataagctgaggctggacttcaaccgtttgttcggtggaaaggcttgtgcggagatccagacccggactagggagcttgtcaagatggtggtggatggtgctgttgagatttttgaggaattgctcgtgcaggttgagctgcagcgcaatatgcctccaccagttgatggtggagtgccgcgcctggtgagctttgttgccaagtactgcaaccagctccttggggagccgtatcggtctgtgctgacacaggtggtcaccatccaccgcagctggcgcaaagaggtgttcaatgataagatgctggtagacgcggtgcttaatatcgttaagacgcttgagatcaacttcgagacatggtcaaaggcttatggagatacgacgctgtcgtgcctcttcatgatgaacatacactggcacttcttcaagcacctgaagggtactaagctgggtgagctcttaggcgatgcatggctcagggagcatgagcagtacaaggattactactcggcagtatttctgagggagagctggggaacacttgcgcccctgctgagcagggaggggctgatcatgttctccaagggccaggctaccgctagagatttagtgaagcagaggctcaaatcgttcaatgctaagtttgatgagatgtttcaaaagcagtctacatgggtgatatcagatagggatttgcagcagaagacatgccaccttgtggtgcaggctatagtgcctatttaccggagcttcatgcagaactatgggccgctcgttgagcaggacatcagtgcgagcaagtatgttaagtacagtgccgaagatctggataagatgctcaacacactcttcctgcccaagccaggcaggccaaggagaaccggaagtttccagatcagacattcaggtgacaagattaccagcgcaatgacaggattgtatcggagtgcttccactctgaagtagcttctgtgggagtttggaaagattggatgcacaatttgtgcaataggtcaataacttggtaggcaaggatgatttgctttgggccagtcggtcgagatccccacttgtttgggggggggggggggggggggcacttaataatggcctgatgattagaaacagctggagcataagaagaacataaactcctccagaactgacatagcgggggagaagatgactggagtgtttactcagagcatagctatgaggtccccttcctgtcgaatatcttttcaccttctattgcattcttatctgtagcaagtatactcaattcattttaggaacttgtgtggggagcagaggaggtgtaatcagttgtctggtacatgttagaagattggttgtattataggagggtgttaagttgtttcatatggttatggtatactatgttttagatttcatgaatatgcagggaattatatggagtacattatatgtggtggcaaaaaatgacagtgattaactggtcgccgtctagactcaattattttcttccttccaaatctctgtgcccacactgttatatctaacttcatattttctgcaatggtttactttttgatgtgctgatgtacagaagcatgcagtcctattaggcttgacctgaagatgtgttttctctcagtgcatttctgcttggttaatgatcctatcagttgggcgcaatatatgcatacattgtactgactactgaatcccaaagctacagctcatgattactgaataagcatacatgctacagcttggttattggtcctatcagttggccgccatacatgtatacgttgtactgactactgaatacctatgctacagctcatgattactgaataagcataaccctgtgctatgaaagtg

SEQ ID NO: 2549 - DNA, 1359 bp, Glycine max
gaacaccggttcgatcaattttcccacgcactgttactcgaagttctgcgccaactgaaacgcagatcgaactccgccgtagccatcatcaccgatcgaacttcgcaagacagagatcaaattctgattccgacacagtaacagtatgagcgtcatcgacattctaacccgagtcgattccatttgcaagaagtacgacaaatacgacgtcgataagcaccgcgatgctaatgtctctggcgacgatgcctttgccagactctacgcctccgtcgacgccgacatcgaggccctacttcagaaagcagaaagtgcttccaaggagaaaggtaaggcatcagctgtagcgatcaatgcagagattcgtcgtactaaggctcggttgctggaggaggttcccaagttgcagagattagctgtgaaaaaggtaaaggggctttcatcacaagaatttgctgcccgtaatgatttggttcttgcattgccggatagaatccaagcaataccagatggggctcctcctgtgccaaaacaaactggaggctgggcagcttctgcttcacgtcctgaaattaagtttgattcagatgggcgatttgatgatgaatacttccaacaaagtgaacaatcaaatcaatttaggcaggaatatgaaatgcgtagaatgaaacaggcaagtaacttaaagcagttgcgagtggatcaaggtttggatgtgattgctgaaggattggatacattgaaaaacatggcacatgatatgaatgaggaactggatagacaagttccactgatggatgagattgacactaaggtggacaaggcatcctctgaccttaagaatacaaatgttagacttaaagacacagtgaaccagcttcgatccagtcgaaacttctgtattgatattgttttgttgattataattttgggaattgctgcctacttatacaacgtactaaagaaatgatgtgtacaaaggctgatggatgttcgaatggtttgccttgtattttgaggatatcttctgatttttttattttatttctaccattgtgaaaatttcctgcgacttgagaggcgtgcccttgtgctttataagcagtcctgtgtaatgtgtatgcagtcatgtcagataccattagtatgtgtatgttaaatagttgctgcttattttatacacttgttttggtatatgttatagtattataaattgacgctgatgaattaggaaggatgctttgattgaaattaggaattctagctggagttagctagctacaagcacgacgaaaagataagtatggggacccgcttaataattgaaagaaaattatattcgactaattattttgttgt

SEQ ID NO: 2550 - DNA, 1414 bp, Glycine max
tttttaattttttaatttttaaaaaattgtttcaccatgttcattacaactgttaactttcccctttgaaatcctttctcagttctgcgccaactgaaacgcagatcgaactccgccgtagccatcatcaccgatcgaacttcgcaagacagagatcaaattctgattccgacacagtaacagtatgagcgtcatcgacattctaacccgagtcgattccatttgcaagaagtacgacaaatacgacgtcgataagcaccgcgatgctaatgtctctggcgacgatgcctttgccagactctacgcctccgtcgacgccgacatcgaggccctacttcagaaagcagaaagtgcttccaaggagaaaggtaaggcatcagctgtagcgatcaatgcagagattcgtcgtactaaggctcggttgctggaggaggttcccaagttgcagagattagctgtgaaaaaggtaaaggggctttcatcacaagaatttgctgcccgtaatgatttggttcttgcattgccggatagaatccaagcaataccagatggggctcctcctgtgccaaaacaaactggaggctgggcagcttctgcttcacgtcctgaaattaagtttgattcagatgggcgatttgatgatgaatacttccaacaaagtgaacaatcaaatcaatttaggcaggaatatgaaatgcgtagaatgaaacaggatcaaggtttggatgtgattgctgaaggattggatacattgaaaaacatggcacatgatatgaatgaggaactggatagacaagttccactgatggatgagattgacactaaggtggacaaggcatcctctgaccttaagaatacaaatgttagacttaaagacacagtgaaccagcttcgatccagtcgaaacttctgtattgatattgttttgttgattataattttgggaattgctgcctacttatacaacgtactaaagaaatgatgtgtacaaaggctgatggatgttcgaatggtttgccttgtattttgaggatatcttctgatttttttattttatttctaccattgtgaaaatttcctgcgacttgagaggcgtgcccttgtgctttataagcagtcctgtgtaatgtgtatgcagtcatgtcagataccattagtatgtgtatgttaaatagttgctgcttattttatacacttgttttggtatatgttatagtattataaattgacgctgatgaattaggaaggatgctttgattgaaattaggaattctagctggagttagctagctacaagcacgacgaaaagataagtatggggacccgcttaataattgaaagaaaattatattcgactaattattttgttgtttcttgacttgcaaatctgtttttagttttaaacatctcgtga

SEQ ID NO: 2551 - DNA, 1265 bp, Vigna unguiculata
agttctgcgccaactgaaactaccagatcgaactccgcttcaacggtcatcggttggttgttgtcggcaacaaccgtcgcaagtcagagatctgtgtttgattccgaaaccgccacaatatgagtgtcatcgaaattctcaccagagtcgattccatttgcaagaagtacgacaaatacgacgtcgagaagcaccgcgatgctaatgtcgctggcgatgatgcctttgccagactctacgcctccgtcgacgctgacatcgaggcattgcttcagaaagcagaaacggcttccaaggagaaaggtaaggcatctgctgtagcgatcaatgcggagattcgtcgtactaaggctcggttgctggaggaggttcccaagttgcagagactggctgtgaaaaaggtcaagggtttatcttcacaagaatttgctgcccgtaacgatttggctctttcattgccagatagaatccaagccatcccagatgggtctcctcctgtgccaaaacaatccggaggctgggcttcttctgcctcacgtcctgaaattaagtttgattcagatgggcaatttgatgatgattactttcaacagtctgagcaatcaagccaattcaggcaagaatatgaaatgcgtagaatgaaacaggatcaaggtttggatgtgattgctgaaggattggatacattgaaaaacatggcacatgatatgaatgaggaactggatcgacaagttcctctcatggatgagattgacactaaggtggacaaggcatcctctgaccttaagaatacaaatgtcagacttaaacacacagtgaaccagcttcgatccagtcgaaacttctgtattgatattgttttgttgattataattttgggaattgctgcctacttatacaacgtactaaagaaatgatatgtacaaaggctgatggatgttcgaagatttgcctttacttgtattttgagaacaacgtttcgtttcatttttttttatttcttccttcttgctacttgtgagatgtgcgcttctttataaccagtcctgtgtatgcagtcatgttagtatcttaaatagttgttgctgcttatttgctatatatctttgatatattaaatatattatagcttgacgctgatgatttaagaaggatgttctttgagtggtgtggaattctagttggagttagctagctataaacacaatgataaaaaatatggggacccgcgtaatgaatgagaaaaatattgtgatttgtgactc

SEQ ID NO: 2552 - DNA, 1347 bp, Cajanus cajan
tttcatttgatgttcatcgttgtctggatccagctgtctttcccctttgaagggccttttcagttctgcgccaacggaaacaaccaaccagatccaactcaccattaatcgcttgttgacgacgataccattcgccacacgcagatcgggaatttgattccaaaacactatgagcgtcatcgacattcttaccagagttgactccatttgcaagaagtacgacaaatacgacgtcgaaaagcagagggactccaatatctccggcgatgatgccttcgccagactctacgcctccgtcgactccgacatcgaggccctaattcagaaagcagaaaccgcttccaaggagaaaggtaaggcatctgctgtagccatcaatgccgagattcgtcgtaccaaggctcggttgctggaggaggttcccaaattgcagagattggctgtgaaaaaggtaaaggggctttcatcacaagaatttgctgcccgtaatgatttggttcttgcattgccggatagaattcaagctatcccagatgggactcctcctgcaccaaaacaatctggaggctgggcagcttctgcctcacgtcctgaaattaagtttgattcagatgggcgatttgatgatgaatacttccaacaaactgagcaatccagtcagtttaggcaggaatatgaaatgcgtagaattaaacaggatcaaggtttggatgtgattgctgaaggattggatacattgaaaaacatggcacatgatatgaatgaggaaatggacagacaagttccactgatggatgagattgacactaaggtggacaaggcatcctctgaccttaagaatacaaatgttagacttaaagacacagtgaaccagcttcgatccagtcgaaacttctgtatcgatattgttttgttgatcataattttgggaattgctgcctacttatacaatgtactaaagaaatgatatgtacacaaggctgatggatgttctcgaagggtttgcctttatttcttgtattttgagaatattgtgtctgattttcttttaatattttttattttatttctaccattgtgaaaattccccggtactggagagatgtgcgcttgtgctttataagcagtcttgtgtatgcagttatgtcacatcccattaggatgttaaatagttgtctcgtactctttatacttgtttaggtatgttatattatattattgatgctgataaattaggaacgatgctttgcttggtgtgtaattctagctggagttagctacaaacacgacgaaaaaaaaattgtgggtaaccgcttaaaaatgaaattattcaactaatttttcgtt

SEQ ID NO: 2553 - DNA, 1344 bp, Phaseolus vulgaris
ttcatgttcatcgctgtcttgatacagctgtgcattctttgaaatcctctctcagttctgcgccaactgaaacaaccagatcgaactcctcaaccgtcatcgattggttgttgtcgacagcaaccgtcgcaagtcagagatctgtgtttgattccaaaatctccacagtatgagtgtcatcgatattctcaccagagtcgattccatttgcaagaagtacgacaaatacgacgtcgagaagcaccgcgattctaatatttctggcgacgatgcctttgccaaactctacgcctccgtcgacgccgacatcgaggcattgctccagaaagcagaaacggcttccaaggagaaaggtaaggcgtctgctgtagcgatcaatgcggagattcgtcgtactaaggctcggttgctggaggaggttcccaagttgcagagactggctgtgaaaaaggtcaagggtctttcttcgcaagaatttgctgcccgtaatgatttggctcttacattgccagatagaatccaagccatcccagatgggtctcctgctgtgcctaaacaaactggaggctgggctgcttctgcctcacgtcctgaaattaagtttgattcagatgggcaatttgatgatgaatacttccaaccttctgagcaagcaaaccaatttaagcaggaatttgaaatgcgtagaatgaaacaggatcaaggtttggatgtgattgctgaaggattggatacattgaaaaacatggcacatgatatgaatgaggaactggatcgacaagttccgctgatggatgagattgacactaaggtggacaaggcatcctctgaccttaagaatacaaatgttagacttaaagacacagtgaaccagcttcggtccagtcgaaacttctgtatcgatattgttttgttgattataattttgggaattgctgcctacttatacaacgtactaaagaaatgatatatgcacaaaggcttggacgttcagagatttgcctttacttgtattttgagaataacgtttcttttaatttttttttatttatttcttccattgtgaaaatttcctgttacttgtgagatgtgcgcttctgctttttaaccagtcctgtgtatgcatgcagtcatgtcacataataccattagtatcttaaaaatagtcgttgctgcttattttctgtacgtttggtatattaaatatattgtatcttgacgctgatgatttaggaaggatgttctttgagtggtgtgaaattctagctggagttagctagctacaaaaacgatgataaaaagtatggggatccccttaatgaatgagaaaaaatgattcaaata

SEQ ID NO: 2554 - DNA, 1355 bp, Phaseolus vulgaris
tttcatgttcatcgctgtcttgatacagctgtgcattctttgaaatcctctctcagttctgcgccaactgaaacaaccagatcgaactcctcaaccgtcatcgattggttgttgtcgacagcaaccgtcgcaagtcagagatctgtgtttgattccaaaatctccacagtatgagtgtcatcgatattctcaccagagtcgattccatttgcaagaagtacgacaaatacgacgtcgagaagcaccgcgattctaatatttctggcgacgatgcctttgccaaactctacgcctccgtcgacgccgacatcgaggcattgctccagaaagcagaaacggcttccaaggagaaaggtaaggcgtctgctgtagcgatcaatgcggagattcgtcgtactaaggctcggttgctggaggaggttcccaagttgcagagactggctgtgaaaaaggtcaagggtctttcttcgcaagaatttgctgcccgtaatgatttggctcttacattgccagatagaatccaagccatcccagatgggtctcctgctgtgcctaaacaaactggaggctgggctgcttctgcctcacgtcctgaaattaagtttgattcagatgggcaatttgatgatgaatacttccaaccttctgagcaagcaaaccaatttaagcaggaatttgaaatgcgtagaatgaaacaggatcaaggtttggatgtgattgctgaaggattggatacattgaaaaacatggcacatgatatgaatgaggaactggatcgacaagttccgctgatggatgagattgacactaaggtggacaaggcatcctctgaccttaagaatacaaatgttagacttaaagacacagtgaaccagcttcggtccagtcgaaacttctgtatcgatattgttttgttgattataattttgggaattgctgcctacttatacaacgtactaaagaaatgatatgcacaaaggcttggacgttcagagatttgcctttacttgtattttgagaataacgtttcttttaatttttttttatttatttcttccattgtgaaaatttcctgttacttgtgagatgtgcgcttctgctttttaaccagtcctgtgtatgcatgcagtcatgtcacataataccattagtatcttaaaaatagtcgttgctgcttattttctgtacgtttggtatattaaatatattgtatcttgacgctgatgatttaggaaggatgttctttgagtgatgtgaaattctagctggagttagctagctactaaaacgatgataaaaagtatggggatccccttaatgaatgagaaaaaatgattcaaatagttatttgttgt

SEQ ID NO: 2555 - DNA, 1376 bp, Arachis hypogaea
cggaggaaaaaaaagagaaaaacgcaagagtgaaatgagctctaaacaatttcgggggaaaaaaaattgtattcacagttgccacaggctggatcgcaaaccccttcttcttcctttctcagttctccgaatgctaacatccccgtccagctattctgcatccaccgagtataactactgacgccatttccaggaactcagatcggaatttgatctgccaatagtggaaaggaaacatcatcaacagcaacagcagccatgagcgtcatcgacctcctcaccagagtcgactccatttgcaagaagtacgacaagtacgacgtcgacaggcagaaggacgccaacatctccggtgacgatgccttcgccaggctctacgccgtcgtcgacgctgacatcgaggctgcgcttcagaaagcagaacaagcttcgaaggagaaaggtaaggcatctgctgtagcgattaatgcggagattcgtcgtaccaaggctagattactggaagaggtccctaaactgcagaggctggctatgaaaaaggtaaaggggctttcatcgcaagaatttgctgcccgtaatgatctagttcttgcattgccagagaggatacaagctatcccagacgggacccctgcagcacccaagcaaactggtggttggacagcttctgcatcacgtcctgaaatcaaattcgattctgatgggcgatttgatgatgagtacttccaacaaactgaggaatctagccgatttaggcaggagtatgaaatgcgtagaatgaaacaggatcaaggtttggatgtgatagcagaaggattggataccttgaaaaacatggcatctgatatgaacgaggaactggatagacaagttcctctgatggatgagattgatactaaggtggacaaagcatcttctgaccttaagaataccaatgttagacttaaagacacagtgatgcagcttcgttccagtcgaaacttctgtattgatattgttttgttgattataattttggggatagctgcctatctctataacgtgctaaagaagtgattctgcaaaccaaggaaaacggatttattcgcatgggttacctgctttcatgtattttcttgagaatatcgtgtctgatttgttattattttttgtgaattcttcgtgccacttgtgaattctgtatgccgttatgctatatgtgaaatagttgcggattgttgtgtataattctggaatctgacattgtgcgtggctggctgattggcccttggtatttccccaacttgtgacaattccaatatttacttaattcttttaatgaatatcgaaaaacaaaaatcgtgctggaaaatcccgtcaaaaaagaaaaaacaaaa

SEQ ID NO: 2556 - DNA, 1257 bp, Cicer arietinum
ctagtctctctctctctctcgactccttagaaatccattgttgagttcagcctcaactgaacacaatcagatccaaatttactataacccctaataaatcacttgttgttaactttagtaaagatcggattttgatcccaaaacaacaacagtatgagcgtaatcgacattctaacccgagttgattctatttgcaaaaagtacgacaaatacgacctcgaaaagaacaaggatgccaatgtctcaggcgatgatgccttcgtcagactctacgcctctgttgactccgacatcgactccctactccagaaagcagaaactgcttccaaggatagagggaaggcatctgctgtagcgattaatgcggagattcgtcgtactaaggctcggttgcttgaagaggttcccaagttgcagaggttggctatcaaaaaggtaaaagggctttcgtcgcaagaatttgctgcccgtaatgatctggttcttgcgttgccagaaagaatccaagctatcccagatgggactcctgctgcgccaaaacaaactggtggctgggcagcttctgcctcacgtgctgaaattaaatttgattcagatgggcggtttgatgatgaatacttccagtcaactgagcaatcaagtcaattcaggcaggaatatgaaatgcgtagaataagacaggatcaaggtttagatgtgattgcagaaggattggatactttgaaagacatggcacatgatatgaatgaggaactggatagacaagttcccctgatggacgagattgacagtaaggtcgacaaggcgtcctctgatcttaagaatactaatgttagacttaaacacaccgtgaatcagcttcgatccagccgaaacttctgtattgatattgttttattgattataattttgggaattgctgcctacttatacaatgtgctaaagaaatgatgatgatacacgaagactatgaatgtattcccatggtttgcttgtgttcaagaataatattgtgtctgatttaattttttatttttatcactgaaaatttccatccccttgagagatatactgggctattgtccttcacgagcagccctgtgcatgctgttatgtaacccaccatttgtatgttaaatagtcgcgacttgttttatgtacttgttcgtcgtcatcttggtgagttgatgcaagatagatatcctcatgtttattttatgtaacatcatacttgtttatagtatcctcatggtttgt

SEQ ID NO: 2557 - DNA, 1656 bp, Cicer arietinum
aaaaactgcttcatgtttgtagtcggtactttactacagccaatagctgtccatggtctctctctctctctcgctccttagaaatccattgttgagttcagcctcaactgaacacaatcagatccaaatttactataacccctaataaatcacttgttgttaactttagtaaagatcggattttgatcccaaaacaacaacagtatgagcgtaatcgacattctaacccgagttgattctatttgcaaaaagtacgacaaatacgacctcgaaaagaacaaggatgccaatgtctcaggcgatgatgccttcgtcagactctacgcctctgttgactccgacatcgactccctactccagaaagcagaaactgcttccaaggatagagggaaggcatctgctgtagcgattaatgcggagattcgtcgtactaaggctcggttgcttgaagaggttcccaagttgcagaggttggctatcaaaaaggtaaaagggctttcgtcgcaagaatttgctgcccgtaatgatctggttcttgcgttgccagaaagaatccaagctatcccagatgggactcctgctgcgccaaaacaaactggtggctgggcagcttctgcctcacgtgctgaaattaaatttgattcagatgggcggtttgatgatgaatacttccagtcaactgagcaatcaagtcaattcaggcaggaatatgaaatgcgtagaataagacaggatcaaggtttagatgtgattgcagaaggattggatactttgaaagacatggcacatgatatgaatgaggaactggatagacaagttcccctgatggacgagattgacagtaaggtcgacaaggcgtcctctgatcttaagaatactaatgttagacttaaacacaccgtgaatcagcttcgatccagccgaaacttctgtattgatattgttttattgattataattttgggaattgctgcctacttatacaatgtgctaaagaaatgatgatgatacacgaagactatgaatgtattcccatggtttgcttgtgttcaagaataatattgtgtctgatttaatttttttatttttatcactgaaaatttccatccccttgagagatatactgggctattgtccttcacgagcagccctgtgcatgctgttatgtaacccaccatttgtatgttaaatagtcgcgacttgttttatgtacttgttcgtcgtcatcttggtgagttgatgcaagatagatatcctcatgttttattttatgtaacatcatacttgttttatagtatcctcatggtttgtgcataattggtctaactgcgttgaagttgacttaagtttatgaaaagtgttggaagtttagcattgacacaattagaggattgttttcatgttgagctttagtaatataagttaaaaggtttattagaccttttgtatcatgaacctcctagcgtagactactaaagactaacatgtaaagcactcttcaattggagaatgaattctaaaatttcaacacgataccaattaagtttttattttagatgtaattagtatatacaaaatcaacttctaagatgaatgatgtatctttttaataggatccatgtaatattccaacatatatatcataataaaaaagag

SEQ ID NO: 2558 - DNA, 1326 bp, Glycine max
caaaaacaaaacacgatcatggctgaagcaagcaagaaagaagctgttggagttcatagttgttacaggctggacggtgtaagagtcttgtgtgttcagtttaacaaaccgatcaagctgtcgtgtggtgtacccactgatctgtaaccgtggtctcgacaacaacaacaacaacaacactattgttcagaacataaaagatcccaaataacaagaccacacaccatgagtgtcatcgacattctcaccagagttgattccatttgcaaaaagtacgacaaatacgacgtcgaaaagcaaagggactccaatctctccgccgacgatgcattcgccaaactctacgcctccgtcgacgccgacatcgaggccttacttcagaaagcagaaaccgctgacaaggagaaaagtaaggcatccactgtagcgatcaatgccgagattcgtcgaaccaaggctagattgttggaggaggttcccaagttgcagagattggctatgaaaaaggtaaaggggctttcatcacaagaatttgctgcccgaaatgatttggctcttgcattgccggataggattcaagctatcccagatggggcccctgcagcacccaaacaaactggaagttgggcagcttcagcttcacgtcctggaattaaatttgattcagatgggaaatttgatgatgaatacttccaacaaactgaagaatcaagtcgattcaggcaagagtacgaaatgcgtaaaatgaaacaggatcaaggtttggatatgattgcagaaggattggatactttgaaaaacatggcacatgatatgaatgaggaactggatagacaagttccactgatggatgagatcgatactaaggtggacagggcatcttctgaccttaaaaataccaatgttagacttagagacacagtgaaccagcttcgatccagtcggaacttttgtattgatattgttttgttgattataattttgggaattgctgcttatttgtacaatgtgctaaagaaatgatacggcatagaagaccatgggatcaatttgtatggcttatctgtatttcttgtattttcttcgtaatatagtggtgtagctcgcgtctgatttttttaaaactatattttggaacttgtcttgctacttgagagatgcacttgtcctttataaaccgactctatatgccgctatattatgtcaaactgtatagatttgtacttgtgtaacatactaattcaatgtttgccttgaggatatttcaagtaatctattttcatttatcctgtgtttgaatcaggaattttaaaattttaaggaatt

SEQ ID NO: 2559 - DNA, 1271 bp, Cajanus cajan
gaaataatgaataaacacagatacttggaatttgtgagaaatttatgcattactcacaaaagacgatgatgggcggtgtagaggaagcaagaaagaaaggagttggtagtgttgacagttgttacaggctggagggtgtaacagtctgtgactgtgtgcgttcagtttaacaaacggatcaagctgtaacagtggactccacaacaacacaatgagtgtcatcgacattctcaccagagttgattccatttgccaaaagtacgacaaatacgacgtcgcaaagcagagggattccaatatctccgccgacgatgcattcgccaaactctacgcctccgtcgacgccgatatcgaagccttacttcagaaagcggaaaccgctcccaaggagaaaactaaggcatctacggtagcgatcaatgccgagattcgtcgaaccaaggctaggttgttggaggaggttcccaagttgcagagattggctatgaaaaaggtaaagggcctttcatcacaagaatttgctgctcgtaatgatttggttcttgcattgccggataggattcaagatatcccagatgggacccctgcaccacccaaacgaactggaggctgggcagcttcagcctcacgtcctggaattaaatttgattcagatggccgatatgatgatgaatacttccaacaaactgaagaatcaagtcgattcaggcaggagtatgaaatgcgtaaaatgaaacaggatcaaggtttggatatgatcgcagaaggattggatactttgaaaaacatggcacacgatatgaatgaggaattggatagacaagttccactgatggatgaaattgatactaaggtggataaggcatcttctgaccttaaaaataccaatgttagacttagagatacagtgaaccagcttcgatccagtcgaaacttttgtattgatattgttttgttgattataattttgggaattgctgcctatttgtacaatgtgctaaagaaatgacacggcatataaggctattggatcaatttgtatggcttatctgtatttcgtacattttcttggtaatatcgtgtctaattgtttttaaaaaattatatttttggactcgttcctgcttcttgcgagatgcacttgtccttaataaacagactgtatattccgttttgctatgtgaaatcaggattttgtattgacactagtgtaacatacgaattcaatgtttgccttgaggatatctcaatttatttctgtttaatcattt

SEQ ID NO: 2560 - DNA, 1240 bp, Glycine max
gcaagcaagaaagaagctgttggagttcatagttgttacaggctggacggtgtaagagtcttgtgtgttcagtttaacaaaccgatcaagctgtcgtgtggtgtacccactgatctgtaaccgtggtctcgacaacaacaacaacaacaacactattgttcagaacataaaagatcccaaataacaagaccacacaccatgagtgtcatcgacattctcaccagagttgattccatttgcaaaaagtacgacaaatacgacgtcgaaaagcaaagggactccaatctctccgccgacgatgcattcgccaaactctacgcctccgtcgacgccgacatcgaggccttacttcagaaagcagaaaccgctgacaaggagaaaagtaaggcatccactgtagcgatcaatgccgagattcgtcgaaccaaggctagattgttggaggaggttcccaagttgcagagattggctatgaaaaaggtaaaggggctttcatcacaagaatttgctgcccgaaatgatttggctcttgcattgccggataggattcaagctatcccagatggggcccctgcagcacccaaacaaactggaagttgggcagcttcagcttcacgtcctggaattaaatttgattcagatgggaaatttgatgatgaatacttccaacaaactgaagaatcaagtcgattcaggcaagagtacgaaatgcgtaaaatgaaacaggcaagtttggatatgattgcagaaggattggatactttgaaaaacatggcacatgatatgaatgaggaactggatagacaagttccactgatggatgagatcgatactaaggtggacagggcatcttctgaccttaaaaataccaatgttagacttagagacacagtgaaccagcttcgatccagtcggaacttttgtattgatattgttttgttgattataattttgggaattgctgcttatttgtacaatgtgctaaagaaatgatacggcatagaagaccatgggatcaatttgtatggcttatctgtatttcttgtattttcttcgtaatatagtggtgtagctcgcgtctgatttttttaaaactatattttggaacttgtcttgctacttgagagatgcacttgtcctttataaaccgactctatatgccgctatattatgtcaaactgtatagatttgtacttgtgtaacatactaattcaatgtttgccttgaggatatttcaagt

SEQ ID NO: 2561 - DNA, 1341 bp, Medicago truncatula
ggttcatgtttgtattgctacagctgtgtcgtgtccctgatatctctctctctcttttgaaacctttgtcgagttcagccacaactaaaaacacaacagatccaactccaaattcatcacagttcctgttgactctagtcaaaatcaaatttcaatccaaaacaacactatgagcgtaatcgatcttcttacacgagtcgattcaatctgcaaaaaatacgataaatacgacctcgacaagcagaacaatgccaatgtctccggcgacgatgcttttgtccgtctctacgcctccgtcgactccgacatcgaagcccttcttcaaaaagcagaaaaagcttctaatgaaagagggaaggcatctgctgtagcgatcaatgcggagattcgtcgtactaaggccaggttgttggaggaagttcctaagttgcagaggttggctctcaaaaaggtaaaaggccttgagtcgcaagaatttgctgcccgtaatgatttggttcttgcactgccagaaagaatccaagctatcccagatgggactcctgttgcgccaaaacaaactggtggctgggcatcttctgcctcacgccctgaaattaaatttgattcggatggccgatttgacgacgagtacttccaatctactgagcaatcaaatcaattcaagcaggaatatgaaatgcgtagaatcaaacaggatcaaggtttggatatgattgcagaaggattggatactttgaaagacatggcgcatgacatgaatgaggaactggatagacaagttcccctaatggatgagattgacgctaaggtggacaaagcatcctctgatcttaagaatactaatgttagacttaaggacacagttaatcagcttcgatccagtcgaaacttctgtattgatattgttttgctgattataattctgggaattgctgcctacttatacaatgtgctaaagaaatgatatgatacaggaagactgtcaatgtattcccatgatgcctgtattaatttgacaatattgtgtctgatttatttttttaatcttatcattgtgaaaatttccacccatcttgagagatactgtcctttacttacagccctgtgcatgctgttatggttttttttttttttttttttttttttttttttttaaccctaagtatgttaaatagctgcggcttgttttatgtacttgtccagtgtcgtacttggtgaattaatgagagatatccttgtgttttatataacactattgcttgctttatagatactgttgaattaggttgctttaactggaacaaagaaaaagaaaagtgaaagaactatgaaagttcc

SEQ ID NO: 2562 - DNA, 1213 bp, Trigonella foenum-graecum
aacagtacataaaaaattcggttcatgtttgtattgccacagctgtctctctctctctctctctctcttgaaattctgtattgagttgagccgcaaccgaaagaaacaacagatccaactccgctaattcagttgactctagtcaaaatccaattttgatatcaaaactacaacaacaacaacatgagcgtgatcgatcttctaacacgagtcgattcaatctgcaaaaaatacgataaatacgacctcgacaagcagaacaatgccaatgtctccggcgacgatgctttcgtcagactctacgcctccgtcgattccgacatcgaatccctacttcagaaagcagaaaaagcttccaatgaaagaggcaaagcatctgctgtagcaatcaatgcggagattcgtcgtactaaggcgaggttgttggaggaagttcctaagttgcagaggttggctctcagaaaggtaaaaggcctcgagtcacaagaatttgctgcgcgtaatgatctggttcttgcattgccagaaagaatccaagctatcccagatgggactcctgttgcgccaaaacaaactggtggctgggcatcttctgcctcacgccctgaaattaaatttgattcggatggccgatttgatgatgaatacttccaatcaactgagcaatcaaatcaattcaagcaggaatatgaaatgcgtagaataaaacaggatcaaggtttggatatgattgcagaaggattggatactttgaaagacatggcacatgatatgaatgaggaactggacagacaagttcccctaatggatgagattgacactaaggtggacaaggcatcctctgatcttaagaatactaatgttagacttaaagacacagtgaatcagcttcgatccagtcgaaacttctgtattgatattgttttgttgattataattctgggaattgctgcttatttatacaatgtgctaaagaaatgatatgtatgatacacgaagactatcaatgtattcctatgatgcctgcattaatttgacaatattgtgtctgatttttttttaaatctttatcattgtgaaaatttccacccagcttgagagatttgatgtcctttgcaagcagccctgtgcagctgttatgttacacaccctaagtttgttaaatagttgcggcttgttttatgtccttgtgttttatataacattttatttt

SEQ ID NO: 2563 - DNA, 1241 bp, Glycine max
ggtgttcatagacatagttgttacaggctggacggtgtaacagtctgtgtctgtgtgtgtgttcagtttaacaaatggatcaagctgtccactgatctgtaaccgtggtggactcgacaagacaacaacaatattcagaacattaacaagaccacaccacaccatgagcgtcatcgacattctcaccagagttgattccatttgcaaaaagtacgacaaatacgacgtccaaagccaaagggactctaatctctcctccgacgatgcattcgccaaactctacgcctccgtcgacgccgacattgaggccttacttcagaaagcagataccgcttccaaggagaaaagtaaggcatccactgtggcgatcaatgccgagattcgtcgaaccaaggctaggttgttggaggaggttcccaagttgcagagattggctatgaaaaaggtaaaggggctttcatcacaagaatttgctgcccgtaatgatttggctcttgcattgccggataggattcaagctatcccagatgggacccctgcagcatccaaacaaagtggaagttgggcagcttcagcctcacgtcctggaattaaatttgattcagatgggaaattcgatgatgaatacttccaacaaactgaagaatcaagtggattcaggaaagagtacgaaatgcgtaaaatgaaacaggatcaaggtttggatatgatcgcagaaggattggatactttgaaaaacatggcacatgatatgaatgaggaactggatagacaagttccactgatggacgagattgatactaaggtggacagggcatcttctgaccttaaaaataccaatgttagacttagagatacagtgaaccagcttcgatccagtcgaaacttttgtattgatattgttttgttgattataattttgggaattgctgcttatttgtacaacgtgctaaagaaatgatacggcatagaagaccattagatcaatttgtatggcttatcagtatttcttgtattttcttggtaatatcgtggtgtgactcgtgtctgcttctttttaaaacaatatttttggacttgttcctgcaacttgagagatgcacttgtcctttatcaacagatctatatgtcgccgtattatgtcaaacagtgtagatttgtatttatacttgtgtaatatactaattcaatgtttgccttgaggatatttcaagtaatctattttcatttagagcggaaga

SEQ ID NO: 2564 - DNA, 1285 bp, Glycine max
caacaaggaagaaagaagttggtgttcatagacatagttgttacaggctggacggtgtaacagtctgtgtctgtgtgtgtgttcagtttaacaaatggatcaagctgtccactgatctgtaaccgtggtggactcgacaagacaacaacaatattcagaacattaacaagaccacaccacaccatgagcgtcatcgacattctcaccagagttgattccatttgcaaaaagtacgacaaatacgacgtccaaagccaaagggactctaatctctcctccgacgatgcattcgccaaactctacgcctccgtcgacgccgacattgaggccttacttcagaaagcagataccgcttccaaggagaaaagtaaggcatccactgtggcgatcaatgccgagattcgtcgaaccaaggctaggttgttggaggaggttcccaagttgcagagattggctatgaaaaaggtaaaggggctttcatcacaagaatttgctgcccgtaatgatttggctcttgcattgccggataggattcaagctatcccagatgggacccctgcagcatccaaacaaagtggaagttgggcagcttcagcctcacgtcctggaattaaatttgattcagatgggaaattcgatgatgaatacttccaacaaactgaagaatcaagtggattcaggaaagagtacgaaatgcgtaaaatgaaacaggatcaaggtttggatatgatcgcagaaggattggatactttgaaaaacatggcacatgatatgaatgaggaactggatagacaagttccactgatggacgagattgatactaaggtggacagggcatcttctgaccttaaaaataccaatgttagacttagagatacagtgaaccagcttcgatccagtcgaaacttttgtattgatattgttttgttgattataattttgggaattgctgcttatttgtacaacgtgctaaagaaatgatacggcatagaagaccattagatcaatttgtatggcttatcagtatttcttgtattttcttggtaatatcgtggtgtgactcgtgtctgcttctttttaaaacaatatttttggacttgttcctgcaacttgagagatgcacttgtcctttatcaacagatctatatgtcgccgtattatgtcaaacagtgtagatttgtatttatacttgtgtaatatactaattcaatgtttgccttgaggatatttcaagtaatctattttcatttagagcggaagacagaaggggattccagaggtggaa

SEQ ID NO: 2565 - DNA, 1333 bp, Lotus japonicus
atgttcattgttgctactttgatacagctgtctacagtctctttcctttgcaagttctgctgaaacaagaaccagatcgaactccaccatccccaaattcagttattgttgacttcgtgaaaataagattccattgttgactccaccaccacacaccatgagcgtcatcgaccttctaaccagagttgacaccatttgcaacaagtacgacaaatacgacgtcgaacgccaccgtgaatccaacctctccggcgacgatgcatttgccagactctacgccaccgtcgacgccgacatcgaggcactcaatcagaaagctgaaactgcttctaaggagaaaggtaaggcttctgctgtagcgatcaatgcggagattcgtcgaaccaaggctaggttgcttgaagaagttcccaagttgcagaaattggctgtcaaaaaggtaaaggggctttcatcgcaagaatttgctgcccgtaatgatttggttcttgcattgccggagagaatccaagctatcccagatgggactcctgctgcgccaaaacaaactggaggctgggcatcttcgggctcacgtccggatattaagtttgattctgatgggcgatttgatgacgaatacttcccacaaactgaggaatcaagtcgattcaggaacgaatatgaaatgcgtagaataaaacaggcaagtatctttagcagttgtttggatgtgattgcagaagggttggatacattgaaagacatggcacatgatatgaatgaggaactggatagacaagttccactgatggatgagattgacactaaggtggaccaggcagcatctgaccttaagaataccaatgttagacttaaagacacagttatccagcttcggtccagtcgaaatttctgcatcgatattgttttgttgattataattctgggaattgctgcctacttatacaatgtattaaagaaatgaatagatgcacaagaccacggatgtgttcgaatggtttccttataattcttgtatcacaagaatatcgtatcaattttttttttttcaattttttttttctatctttgtgaaaaattctactatctgagagttatactgtcctttatataagcagtcttgcgtctgcagttatgctccataacattagtatgtttagtagttgcggcttgttttgtatatttgattaggtatattatgtttatacattatggatactgatgaatctggaagagtgctttgacttgtgttgaattcttcaagttgaagttagctacgaacatgagggggaaaaaagagatccgcttaatgaaagaagtaattcgagtt

SEQ ID NO: 2566 - DNA, 1235 bp, Populus trichocarpa
actgggaaaccgtttcgtgctaaattattatccaaagcctcaaaattgaaacgattcaactcaaaattcttctcttctctcttccattcgttcaaacctccaccaacattcagtaatttgaacaacagctaataattagatataataataataaaaaatgagcgtgattgacatcttaactcgcgtagacgcgatctgcaacaaatacgacaaatacgacgtcgagaagcaaaaagatctcaatgtctccggcgacgacgccttcgctcgcctctacgccgccgtcgatgctgacattgaagccgctcttcagaaagcagagcttgcgtccaaggagaaaagtaaggcctctgctgttgcaataaacgcagagcttcgtcgaactaaagctagattgcttgaggaagtccctaagttgcagaggttagcaataaagaaggttaaagggctctctatagaagaacttgctgcacgaaatgatttggtccatgcattgccagataggattcaagctataccagatggaagttcagctgcactcaaacaaactggaggttgggggtcttcggctccccgaaccgaaatcaaatttgattcagatgggcagtttgataatgaatactttcaagaaagtgagacatctagtcaattcaggcaggagtatgaaatgcgtaaaatgaagcaggcaagactgataaagtggcactctgatcaaggtttgagtatgatttcagaaggtttggacactctgaagaatatggctcatgacatgaatgaggagttggacaggcaagttcctttgatggatgaaattgacactaaggtggacaaggcagctgctgaccttaagaataccaatgttagacttaaagacactgttaaccagttgagatctagtcggaatttctgtattgatattgttttgttgatcataatcctcggaatagctgcctacttgtacaatgtgctgaagaagtgaagaacatgaaaaatctaccctaatctatttccatggtgtgttagtgttggcattttctgtataattttgtattttgaggacttcatatggtgcttgcttttgcatttgatttgtttctcatgctgggagtaacttctcacacatggaaatggatgtttgtcgttcatgtatcttgcaatggtcagtcaattgtttgggtccaaaaaaaatggcatattaagattggacccaagtacatataaatcaaattttacaa

SEQ ID NO: 2567 - DNA, 1348 bp, Nicotiana benthamiana
agcaatgtcttcccctgttttaaaaaataaaactcccaactcataccaaaacatttccttctcttccaatcccatcttggtcattttctttttgcattttttgatctgactattctctgtccccatttgagataagcctgaaatctgagcagaagaaagatccaaaatgagtgtaatcgacattcttactcgcgtcgattccatttgcaagaagtacgacaggtacgatatcgataagcagaaagactccaatatctccggcgacgacgccttcgctcgcctttacgctgcggtcgatgccgacattgaagctgctcttcagaaagcagagacagcttcgaaggagaaaaatagagcgtctgctgtggcgatcaatgcggagattcgaaggactaaggctagattagtagaggaggttcccaaattgcagagattggctatgaagaaggttaaggggctttcaagcgaagaatttgctgcacgtaatgatttggtgcttgcattacctgataggataaatgcaattccagatggtgcagcagctgcacccaaacaatcaggagggtggggaggttcaggttctcgtgcagaaattaaatttgattcagatggacgttttgacgatgagtactttcaacaaactgaagaagcaagtcaattccgacaagagtatgaaatgcgcaaaatgaaacaggaccaaggtttggaggtcatatcagaaggtctggatactttgaaaaacatggccagtgatatgaatgaggagttggataggcaagtccctctgatggatgagattgacactaagatcgacaaggcttcatctgaccttaagaacacaaatgttaggcttaaggacacagttaaccagctaagatctagtcgaaacttctgcattgacatcattttactgatcataattctcggaattgcagcctatttgtataatgtattgaagaagtaagttttcatctgcgggcattcccactttcctaaaatggaggatctgattggatttggttgtagaaatttgtgtgcttgtgtatacaccttgatgatttgcttcttttcttctgccttctattgtcgaggcatcagacgtgtctggatactatctattcattttcttcttgcattggttgagaaagaccttactattctttgtctcccaaactctgtatcccccccttccccggcctccatcccaaaggactagttttttgtttttcaaaaacaaggatcaatagatttccagtcgtatttgtggtagcttttcaatgtattacactatccgttctactattatgaacaaatgagccaaaattaccgattacaagatttgtaagtc

SEQ ID NO: 2568 - DNA, 2108 bp, Theobroma cacao
accgccagttgttaccgcgaaagtaaaatcttaaaaccccgaagaaaagaagaaaaacaaaattacaaaagagagagaaaaaaaaagaacgccttacacttacaggctgtagtttagtatgtttctgaaaccgtttattctttgaatctggagttggttcccacaccaacatcaacgggggaaacaaacagaaacaaagaaaatcgtactttttattttctctcccaattttctttccttccaaacagctacattgactgatctgtaaactcaaaacagatcaggaataaaaatgagtgtgatcgatatattgacaagagtagatgtgatctgcaagaggtacgacaaatacgacgtcgaaaagcagcgagaccaaaatgtctccggcgacgatgcctttgctcgcttatacgccgccgttgaagccgacattgaatctgctcttcagaaaggggagcttgcttcgaaggagaaaagtaaggcatctgctgttgcagtgaatgctgagattcgtcgaaccaaggctcgattgcttgaggaagtccctaagctgcagagattggctgttaagaaggttaaagggatttcaacagaagagctggctgctcgtaacgatctggtccttgcattgccagacaggattcaagctatacccgatggaacttctgctcctaaacaaaccggaggctggatgtcttcagcaccttcagcttctcgtaatgaaattaagtttgattcagatggaagatttgataatgaatactttcaagaatctgagcagtcaagccaattcaggcaggagtatgaaatgcggagaatgaaacaggcaacaatgtttcacttatttgttttgacttccctacaggaccaaggtttggatatgatttcagaaggtttggatactttaaagaacatggctcatgatatgaatgaggaattggataggcaagttcctttgatggatgaaattgacaccaaggtggacaaggctgctgctgaccttaagaataccaatgttagacttaaagatactgtcaatcagttgaggtccagccgaaatttctgtattgatatcgtcttgttgtgcatagttctgggaattgctgcctatttatacaatgttctgaagaagtgaagtgataaaaggatgcattgatgcgtttcacttttatgctgtcggccttttttggttttgtctttcatttggaggacttgctctcgtgcttgatcttgtatttgatttgtttcttatgtgggagtcattgttcacacagttaaaatgtgagtttatctttctatacaaaattcaagaacttcaatctttgtatatgatgtaagttgcagagatttgatcacattagtttgaggtgtttcttctgccttaatgtcccttctttacgatacatcattacaattctgccacatacgcagacaatttaaggatttgatattatgacctaatctctcactgatatacaactgctttgaaccctctgctgtatgtgcctttggaatctaatttctgtacagagatagagaggtaagtaagaacggaaaaactcatgagtattttcagggtagtggcactatacagcagaatgggaaataaatattgttgttaacccctgttagttttcctaggtatcacatgagttgactattaagtaatatagtcttatgatatgttcttgaggaggtcatattcttacgtacatgtctcatttaggtcgagcttattgtaattcttggattagaagaatcgcagcaaggggtagagagagagcacatggttttatcatttatgctagggtgttgccatgttacactgtttcgttgttggaataatctttgctgtgttgcacatgattttctttcttttttgttgataagccttgtatgcaagtgccagtttcgaacttgtaggcatcacttattgtccattcctagtgcatgcttggttccctgtcttcgggaatgtttctcttcattaggagcggctctgttttattcttgaacggtaatactttaagaaccgaacattatttttatgctaacagtttgtaaattacagcgacaatgctttaaccaaattaatgtcaaaagaacac

SEQ ID NO: 2569 - DNA, 1390 bp, Vitis vinifera
gaaatttcccttgtaaagacaattttttttcttactttagatttgaaaaaggaaaaaaaaaaaaaaaggggaaaaaaaataggagtaagtgtgccgaacggaaaataaagaagcggaaaacacctttgcatacaggctgtatcttctatgtgaatttgaaaccgttgtgcgtgtgctggcggacgaactctaaagcctctctccagtaattcttttcctttccccacgttcttagagcggttcgcaagaaacagaagatgaccgtgatcgacattctcaccagagtcgacgcgatctgcaagaaatacgacaagtacgacatcgacaagcagaaggatctcaatgtctccggcgatgatgccttcgctcgtctttacgccgtcgttgaagccgacatcgaggccgctcttcagaaagcagatactgcatctaacgagaaaaatagagcgtctgcggttgctttgaacgccgagattcgtcggaccaaggctcgattgctggaggaggtccctaagttgcagagactggctataaagaaggttaaagggctttcaacagaagaacttgctgctcgtaatgatttggtccttgcattgccggataggatccaagcaataccagatggggctgcaactgcacccaaacaaactggaggttgggcagcttcagcttctcgtacagaaatcaaatttgattcagatggacgatttgacagtgaatacttccaacaaactgaagagtctagtcagttcaggcaagagtatgaaatgcggaaaatgaaccaagaccaaggtttggatgtgatagcagaaggtttggacacattgaaaaacatggcccatgatatgaatgaggaattggatcggcaagttcctttgatggatgagatcgacaccaaggtggacaaagcaacagctgacctcaagaatactaatgttagacttaaggacactgttaaccagctgaggtccagtcgaaatttctgcattgatattattttgttgtgtataattctgggaattgctgcctatctatataatgtattgaagaagtgaactgatgcaaaggcctacttatatcagttcatatggtgtttcgtttgtgtgtttagctttgtttgaggacttggtatgctgcttgattctggattagatttttttcttttttttttttccttttcatgtttgaaggttttttgtttacacttggaaattgtacttctctcggatgcaaatttgggtacattaaatatttctctatcaatattgttgttttttgttgcaattcctatttcatctgccttctctaagatgatattgtatgcaggttatagatatttggaatactgtaaactacaattcatatatgcagttaaacaccattgatagta

SEQ ID NO: 2570 - DNA, 1330 bp, Nicotiana benthamiana
  misc_feature (1142)..(1142): n is a, c, g, or t
tttaaaaaataaaactcccaactcataccaaaacatttccttctcttccaatcccatcttggtcattttctttttgcattttttgatctgactattctctgtccccatttgagataagcctgaaatctgagcagaagaaagatccaaaatgagtgtaatcgacattcttactcgcgtcgattccatttgcaagaagtacgacaggtacgatatcgataagcagaaagactccaatatctccggcgacgacgccttcgctcgcctttacgctgcggtcgatgccgacattgaagctgctcttcagaaagcagagacagcttcgaaggagaaaaatagagcgtctgctgtggcgatcaatgcggagattcgaaggactaaggctagattagtagaggaggttcccaaattgcagagattggctatgaagaaggttaaggggctttcaagcgaagaatttgctgcacgtaatgatttggtgcttgcattacctgataggataaatgcaattccagatggtgcagcagctgcacccaaacaatcaggagggtggggaggttcaggttctcgtgcagaaattaaatttgattcagatggacgttttgacgatgagtactttcaacaaactgaagaagcaagtcaattccgacaagagtatgaaatgcgcaaaatgaaacaggaccaaggtttggaggtcatatcagaaggtctggatactttgaaaaacatggccagtgatatgaatgaggagttggataggcaagtccctctgatggatgagattgacactaagatcgacaaggcttcatctgaccttaagaacacaaatgttaggcttaaggacacagttaaccagctaagatctagtcgaaacttctgcattgacatcattttactgatcataattctcggaattgcagcctatttgtataatgtattgaagaagtaagttttcatctgcgggcattcccactttcctaaaatggaggatctgattggatttggttgtagaaatttgtgtgcttgtgtatacaccttgatgatttgcttcttttcttctgccttctattgtcgaggcatcagacgtgtctggatactatctattcattttcttcttgcattggttgagaaagaccttactattntttgtctcccaaactctgtatcccccccttccccggcctccatcccaaaggactagttttttgtttttcaaaaacaaggatcaatagatttccagtcgtatttgtggtagcttttcaatgtattacactatccgttctactattatgaacaaatgagccaaaattaccgattacaagatttgtaagtc

SEQ ID NO: 2571 - DNA, 1229 bp, Populus trichocarpa
actgggaaaccgtttcgtgctaaattattatccaaagcctcaaaattgaaacgattcaactcaaaattcttctcttctctcttccattcgttcaaacctccaccaacattcagtaatttgaacaacagctaataattagatataataataataaaaaatgagcgtgattgacatcttaactcgcgtagacgcgatctgcaacaaatacgacaaatacgacgtcgagaagcaaaaagatctcaatgtctccggcgacgacgccttcgctcgcctctacgccgccgtcgatgctgacattgaagccgctcttcagaaagcagagcttgcgtccaaggagaaaagtaaggcctctgctgttgcaataaacgcagagcttcgtcgaactaaagctagattgcttgaggaagtccctaagttgcagaggttagcaataaagaaggttaaagggctctctatagaagaacttgctgcacgaaatgatttggtccatgcattgccagataggattcaagctataccagatggaagttcagctgcactcaaacaaactggaggttgggggtcttcggctccccgaaccgaaatcaaatttgattcagatgggcagtttgataatgaatactttcaagaaagtgagacatctagtcaattcaggcaggagtatgaaatgcgtaaaatgaagcaggatcaaggtttgagtatgatttcagaaggtttggacactctgaagaatatggctcatgacatgaatgaggagttggacaggcaagttcctttgatggatgaaattgacactaaggtggacaaggcagctgctgaccttaagaataccaatgttagacttaaagacactgttaaccagttgagatctagtcggaatttctgtattgatattgttttgttgatcataatcctcggaatagctgcctacttgtacaatgtgctgaagaagtgaagaacatgaaaaatctaccctaatctatttccatggtgtgttagtgttggcattttctgtataattttgtattttgaggacttcatatggtgcttgcttttgcatttgatttgtttctcatgctgggagtaacttctcacacatggaaatggatgtttgtcgttcatgtatcttgcaatggtcagtcaattgtttgggtccaaaaaaaatggcatattaagattggacccaagtacatataaatcaaattttacaagttttttttttttttttt

SEQ ID NO: 2572 - DNA, 1208 bp, Catharanthus roseus
accatctctctctgaaattccaatttggagatttttttcttgctttagtgatctgtgtcacaagaatcaatcgcaggaaaagagagaagaaagccggtgaaagatgagcgttattgacattctcactcgcgtcgatgcgatctgtaagaaatatgataaatacgacgtcgagaagcagaaggattccaatgttaccggcgatgatgcctttgctcgcctttattcctccatcgaagaggatatcgaggccgcacttcagaaagctgagactgctgggaaggagaagaatagggcctcagctgttgcgatcaacgctgagatccgtcgcaccaaggcaaggttgctagaggaagttcccaaattgcagagattagctatcaagaaggttaaaggactgtcaacagaggaacttgctgcacgtaatgatcttgtccttgcactccctgataggattcaagctataccagatggcgccgctgctccacccaagcaatcaggaggctgggcagcttctgcttctcgtacagaaattagatttgattcagatggacggtttgacgatgaatattttcaacaaactgaagagtccggtaaattcaggcaagagtatgaaatgcgaaaaatgaaacaggatcaaggcttggaggtcatagctgaaggtctggatacattaaagaatatggcccatgatatgaatgaggaattggataggcaagttcccttaatggatgagattgacagcaaggttgacaaggctacctccgatctgaagaataccaatgtcagacttaaggacacggttaatcagctgagatctagtcggaatttctgcattgatatcattttgttgtgcattatattgggaattgcagcttacttatacaatgtgctgaagaagtgaaaagaatttgaagagccgttggttatgaccttgtacaatgctggtttttggtatttccttgcatcagttgggttctttggttgtgccttattgtagagttggtttgtttaatgcttgcacttgcttcctgagaaggatgtcattgttggctgccggatacagatttcagcatagcctttccttgtattcatatggttttacctatttactttacatcatcttcttctttcctcccttttgatacagtcgtgtctataacccttgtgaattttacgattaatgaattactgtttttcagatttcaaaa

SEQ ID NO: 2573 - DNA, 1205 bp, Malus domestica
agatttttgtagttcgtacaggctgtagtttgctgctactttgaaaccgctcacacgctcaaaagattaaaaaccagagcttttcaactctctgtaattgatcgaagggtaaggtggttgttaggagaagatgagcgtcatcgaaatcttgaccagagtagatgcgatctgccagaagtacgaccgatacgacgtcgaaaagcagaaggatctcaatgtctccggcgacgacgcctttgctcgcctctacgcctccgtcgaatccgatattgaagccgccctccagaaagcggagattgcttcgaaagagaaaaatagggcatctgctgttgcactgaatgctgagattcgtaggaccaaggctcgattactcgaggaggttcccaaattgcagagattggctgtaaagaaggttaaagggctttcatcccaagattttgctgctcgtaatgatttggtccatgcattgccagataggatccaggacatcccagatgggactccagctgcacccaaacaaactggaggaggttgggcagcttcagcttctcgtacagaaatcaaattcgattctgagggacggtttgataatgaattcttccaacagtctgagtcgtcgagtaatttcaggcaagagtatgaaatgcggaaaatgaagcaggatcaaggtttggatgtgatatcagatggtttggatacgttgaaaaatatggctcaggatatgaacgaggaattcgataggcaagttcctttgatggatgagattgactctaaggtggacaaggcatctgcggaccttaagaataccaatgttagactgaaggacacagtcaaccagctgaggtccagccgaaatttctgtattgatattgtattgctgtgtataattttgggcatcgctgcgtatttgtacaatgtactgaagaagtgaggtggtataaagggtggtttgatcagttcgagagtattatcggcttgttcggttatcgttttcattttgaggactcactttggtacttgatgcatggtatttgattgtttatttcatgtttaagagtgcgtatcatactagcatgaatgtatttcttttgtacttgtccagttcatcatcagtcttgtctgtattattatacttaatgtgaagttgattgtgtcctctaatttccgtttattgctaatctacgagactctttgaattcatcaaa

SEQ ID NO: 2574 - DNA, 1167 bp, Castanea mollissima
ccagacctgacctgaacaacagaagcagaaagtcagaactctaaaataaatttgaaactctttcaatttcttctttctttctctactccgatccaagttaaactgtaaaaagtaaaaaaagcaaaaagtagcagaagatgagcgtgatcgacatcttgaccagagtcgacgcgatctgcaagaagtacgacaaatacgacgtcgaaaagcagaaggatctcaatgtcaccggcgacgacgccttcgctcgcctctacgccgccgtcgaagccgacctcgaatctgctcttcagaaagcggagtctgtttcgaaggagaagaataaagcatcggcggttgcgttgaatgcggaggttcgtcggaccaaagctagattgctagaggaggtccctaagttgcagagattggctgtgaaaaaggtgaaagggctttcgggggaggagcttgctgctcgtaatgatttggtgcttgcattgccggataggatccaagctataccagatgggagtgctcctgcagccaaacaaagtggaggttgggcggcttcagcttctcgtaccgagatcaaatttgattcagatggtcggtttgatgatgaatactttcaacaaactgaggagtcgagcggattcaggcaggagtttgaaatgcggaaaataaagcaggatcaaggcttagatgtgatatccgaaggtttggatacactgaaaaacatggcttctgatatgaatgaggaattagataggcaagttcctttgatggatgagattgacaccaaggtggacaaggcagcagctgaccttaagaatactaatgttagacttaaagacacagtgaatcagctgagatcgagtcggaatttctgtattgatattattttgttgtgtataattctgggaattgctgcatatttgtacaatgtactgaagaagtgagatgaactaaagagccatttgacctgtttgtatgatgtggtttgtctggtatttccttgcatatggagcagcttgttgtgtttgatttattatttttattgtttctctcatgtattagggttcttgctttcttctcatgtgtttgaacctttgcttaatatatataacatcattcgtacacaaatgcgagcacattggtcatgtccgtattaataatattggctttgttgca

SEQ ID NO: 2575 - DNA, 1524 bp, Ricinus communis
caatttttgttgacacttgccaaaataaagaaggaaaaaacaaaagttcttgagttaaatttgtcatccaaaaatctagctgcaagaagaactttcttttttatttcttatttttgaatttgtttttaatttcttttttgtgcttacaggctggtagttagttcacctttttagttcaaaccttaaccggcaacgccaaaaaacccacaccgagacgaaactaatcggaatcaaatcgctcctcaacagctagattttttcaccgattcattaactgaaaccagtaaatagccttgagaagaaatgagcgtgatcgacatcttaacaagagtagatgcgatctgtcagaagtacgacaggtacgacgtcgaaaagcaaaaagatctaaatgtctccggtgacgatgccttcgctcgcctttacgccgtcgttgaggccgacattgaatccgctcttcagaaagcagaggttgcttcaaaagagaaaaataaggcatctgctgttgctttaaacgcggagattcgtcgaacaaaggcaaaattgttagaggaggttcctaagttacagaggttggctgttaagaaggttaaagggctttcaacggaagagcttactgcccgtaatgatttggtccttgcattgccagataggattcaagctatccctgatggaaatgcagctgctcctaaacaaactgggggttggggggctccttcagcatcccgaaccgaaatcaaatttgattcagatggtcgttttgataatgaatactttcaagaaaatgagacatcaagtcaattcaggcaggagtatgagatgcgtagaatgaagcaggatcaaggtttggacatgatttccaaaggattagatactctgaaagacatggctcatgacatgaatgaggagttagataggcaagtacctttgatggatgagattgatacaaaggtggacaaggcaacagctgacctgaaaaataccaatgttagacttaaagacactgttaaccagttgagatctagcagaaatttctgcattgatattgttttgttgtgcataattctgggaattgcagcctatttatacaatgtgctaaagaagtgatgcagcagaagtaatgtgcttttcgacttatttcttggtgttgttgtgttggccttttctggcatttatttgtatgaggagaacttcttatggtgcgtgcatttgtgtcgtggttggaaatagattctcgtcattcctgtaaagatttaaaaaatcagtcatgtattattttatcgcttccaaacagtcctgtaattctttttattttcctaacttgctctgattctgagctttctttctctcaagttcctctcgtactctctctcagctctacgagttagcacttagccattgtcgttctgaaaattaattctggtggttatgttgctttttagtcatcaaagatcactaaataaattcccctgaaaaataaaaagagtattgaataaacaaatatttactgattgtttgagattttac

SEQ ID NO: 2576 - DNA, 1264 bp, Citrus clementina
tagtatgtagtgtaggctcaggcaagttctctcacttccggtgttggttacccccgcacttgcaaatactaactgcgactaaaaaaaaaaaaaaaattaaattaaattaattgaactcaaatccttctcttccctttttgaattattccttctcatcctcaccatttttgaagtgatttattcaaaatgagcgtgatcgacatattaacgagagtagactcgatctgcaagaagtacgacaaatacgacgtcgaaaagcagagggagaccaatgtctccggagacgatgcctttgctcgcctatacggtgccgttgaggccgacatcgaagcagctcttcagaaggcggagtctgcttctaatgaaaaaaacagggcatctgtggtggctttgaacgctgaaattcgtaggactaaggctcgattgttagaagaggtccccaagttgcagagactggccataaagaaggttaaagggctttcaacagaagagttagttgctcgcaatgacttggtacttgcattgcctgataggatccaagctataccagatgggactgctgctgcaccaaaacaaagtggaggttggggggcttccgcttcccgtactgagatcaagtttgattcagatgggcggtttgatgatgaatactttcaacaaactgaggagtcgagtcaattcaggcaagagtatgagatgcgtaaaatgaagcaggatcaaggtttggatatgatttcagaaggcctggatactttgaagaatatggcccatgatatgaacgaggaagtggatagacaagttcctttgatggatgaaattgacactaaggtggaccgggctacagctgaccttaagaatactaatgttagacttaaacacactgttactcaattgaggtctagccgaaatttctgtattgacatagttttgctgtgtattattctgggaattgctgcttatttatacaatgtgctgaagaagtgaaatgatatgaaagctacttcgctgatttccctcactttggcttttgcttttggtattattttttgccttttgtggacgatttttggtgcttgattttctatttggtttgtctctcttatatttgggattactgctcacatttgaaaaatgtatggttgtcttttatgtgctaattcacttgtctatgtccatgtgaataacttttcgctcttgtgtagtgtaccttatatccatagtctaagccaatattctttctctggattccgactttaatatatta

SEQ ID NO: 2577 - DNA, 1346 bp, Quercus alba
acaggctgtagttcgaaagtccacatttgctctagaaaccgcgccgctactgtgctggttgagtggtgaccagacctgaacaacagaagcagatagtcagaactcttcaatttcttcttcttctctaattttttttactactcctgctttctttctctactccgatccaagttaaactgtaaaaagtaaaaaacaaaaagtagcagaagatgagcgtgatcgacatcttgaccagagtcgacgcgatctgcaagaagtacgacaaatacgacgtcgaaaagcagaaggatctcaatgtcgccggcgacgacgccttcgctcgcctctacgccgccgtcgaatccgacctcgaatctgctcttcagaaagcggagtctgcttcgaaggagaagaataaagcatcggcggttgcgatgaatgcggaggttcgtcggaccaaggctagattgctagaggaggttcctaagttgcagagattggctgtgaaaaaggtgaaagggctttcgggggaggagcttgctgctcgtaatgatttggtgcttgcattgccggataggatccaagctataccagatgggagtgctcctgcagccaaacaaagtggaggttgggcagcttcggcttctcgtactgagatcaaatttgattcagatggtcggtttgatgatgaatactttcaacaaactgaggaatcgagcggattcaggcaggaatttgaaatgcggaaaataaagcaggatcaaggcttagatatgatatccgaaggtttggatacactgaaaaacatggcttctgatatgaatgaggaattagataggcaagttcctttgatggatgagatcgacaccaaggtggacaaggcagcagctgacctcaagaatactaatgttagacttaaagacacagtgaatcagctgagatcgagtcggaatttctgtattgatattattttgttgtgtataattctgggaattgctgcatatttgtacaatgtactgaagaagtgagatgaactaaagagccatttgacctgtttgtatgatgtggtttgtctggcattttcttgcatatggagcggcttgttgtgcttgatttattatttttattgtttctctcatgtattagggttcttgctttcttctcatgtgttagaacctttgcttaatatataataacatcatttgtacacaaatgtgagcacattggtcatgtctttattaataatattggcttagttgcagtcattctatagtcttgtttttggctgaagatgaaatcgtatctccttgtacaagatatttccacactgaatacttatcacttacaaaattgagcatcagtcacca

SEQ ID NO: 2578 - DNA, 1262 bp, Citrus sinensis
tagtatgtagtgtaggctcaggcaagttctctcacttccggtgttggttacccccgcacttgcaaatactaactgcgactaaaaaaaaaaaaaaattaaattaaattaattgaactcaaatccttctcttccctttttgaattattccttctcatcctcaccatttttgaagtgatttattcaaaatgagcgtgatcgacatattaacgagagtagactcgatctgcaagaagtacgacaaatacgacgtcgaaaagcagagggagaccaatgtctccggagacgatgcctttgctcgcctatacggtgccgttgaggccgacatcgaagcagctcttcagaaggcggagtctgcttctaatgaaaaaaacagggcatctgtggtggctttgaacgctgaaattcgtaggactaaggctcgattgttagaagaggtccccaagttgcagagactggccataaagaaggttaaagggctttcaacagaagagttagttgctcgcaatgacttggtacttgcattgcctgataggatccaagctataccagatgggactgctgctgcaccaaaacaaagtggaggttggggggcttccgcttcccgtaccgagatcaagtttgattcagatgggcggtttgatgatgaatactttcaacaaactgaggagtcaagtcaattcaggcaagagtatgagatgcgtaaaatgaagcaggatcagggtttggatatgatttcagaaggcctggatactttgaagaatatggcccatgatatgaacgaggaagtggatagacaagttcctttgatggatgaaattgacactaaggtggaccgggctacagctgaccttaagaatactaatgttagactaaaacacactgttactcaattgaggtctagccgaaatttctgtattgacatagttttgctgtgtattattctgggaattgctgcttatttatacaatgtgctgaagaagtgaaatgatatgaaagctacttcgctgatttccctcactttggcttttgcttttggtattattttttgccttttgtggacgatttttggtgcttgattttctatttggtttgtctctcttatatttgggattactgctcacatttgaaaaatgtatggttgtcttttatgtgctaattcacttgtctatgtccatgtgaataacttttcgctcttgtgagtgtaccttatatccatagtctaagccaatattctttctctggattccgactttaatctatta

SEQ ID NO: 2579 - DNA, 922 bp, Scabiosa columbaria
gattaaaatatgaagcaagcaactgttcttacagcatggtagctttcctctttcaaacccaaaactgatctctttgtgatctcattcaatcccacaccagagaagaaatagcaagaacataaacatgagcgtcatcgatattctaacacgagtcgattcgatctgcaagaagtacgacaagtacgatatcgacaagcagaaggatctcaatgttgctggtgatgatgcatttgctcgtctctacgcttccgttgaatccgacatcgaatcagcttatcagaaagcggagtctgcttcgtctgagaaaagtagggcttctgctgtagcgataaatgcggagattcgtcgtacgaaagctcggttgttagaggaagttcctaaattgcagagattagctgtgaagaaggtaaaaggactttcatctgaagaatatgctgcccggaatgatttggcccttgcactgcctgataggattcaagctataccagacggtgctgctgctccacccaaacaaactggaggctgggcttcttcaacttctcgtgcagaaattaaatttgattctgatggacgttttgacagtgaatacttccagcaaactgaagaatcaagtaatttcaggcaagaatatgaaatgcggaaagtgaagcaggaccaagggttggaagtgatatccgaaggattagacacactgaaaaacatggccagcgatatgaacgaggaaatagacaggcaagttcctttgatggatgagattgacactaaggttgacaaagcaacatctgatctcaagaataccaatgttagacttaaggacaccgtaaaccagctgaggtctagtagaaatttctgcatcgatattattttgttgtgcataattcttggaattgcagcctatttatacaatgtattgaagaaataa

SEQ ID NO: 2580 - DNA, 1235 bp, Fagus grandifolia
ggctgtagttcgaaagtcctgaaatcgaatcctcttgaaaccgcttactgtgctggtgacctggttccctcacattatctgacatcactaaaaagagaagcagaagtcagaacccaagaaattgaactattcatccttcttcctctctaaattttacttctctactctgatccaagtctaaagggtcaaagacaaagaagagagatagcagaagatgagcgtgatcgacattttgaccagagtagactcgatctgcaagaaatacgacaaatacgacgtcgaaaagcagaaggatctcaatgtcgccggcgacgatgccttcgctcgcctctatgccgtcgttgaagccgacatcgaatctgctcttcagaaagcggaggctgcatccaaggagaagaataaagcatctgcggttgcgatgaatgcggagattcgtcgaaccaaggctagattgcttgacgaggtccctaagttgcagagactggctagtaaaaaggtgaaagggcgtttacgggggaagaggcttggtggctcgcaatgatttggtgcttgcattaccggataggatccaagctatatcggatgggactgctcctgcacccaaacaaactggaggttgggcggcttcagcttctcgtactgagatcaaatttgattcagatggtcggcttgatgatgaatactttcaacaaaccgaggagtcaagcggattcaggcaggagtttgaaatgcggagagtgaagcaggatcaaggtttagatatgatatcagaaggtttggatacactgaaaaacatggctcatgatatgaatgaggaattagataggcaagttcctttgatggatgagattgacaccaaggtggacaaggcagcagctgaccttaagaatactaatgttagacttaaagacacagtgaatcagctgaggtcgagtcggaatttctgtattgatattattttgttgtgtataattctgggaattgctgcatatttatacaatgtactgaagaagtgagatgaactaaggggccatttgacctgtttgtatggtgtggtttgtctggtattttcttgcatatggagcgacttgttgtgcttgtattttatttattttgtatttgtttctctcatgtattaggaattcttgctctcttctcttgtgttaggacctttgcttacacttggaatatatataatatacatgtgtctttcgtacacaaatgacaagcgctat

SEQ ID NO: 2581 - DNA, 1343 bp, Prunus mume
ctgttggctgttgcttctttgaaaccgctttctttactggttctccacccacacacacaaacattcaaaaaaaaataaaaaaaattcgaacttaatcttctggtcctggattttggacttattttcaactctgcaatcgaaaaaggaaggtagggggagggagacgaagcagagaagaagatgagcgtcatcgaaatcttgacaagagtagaggcgatctgccagaagtacgacagatacgacgtcgaaaagcagaaggatctcaacgtctccggcgacgatgcctttgctcgcctatacgcctccgtagacgccgacattgaagcccttcttcagaaagcggaaattgcttcgaaagagaaaaataaggcgtctgctgttgcgctgaatgctgagattcggaggaccaaggctcgattgcttgaggaggttcccaagttgcagaggttggctgtaaagaaggtgaaagggctttcaacccaagattttgcggctcgtaatgacttggtccatgcattgccagataggatccagggtataccagatgggactcctgctgcacccaaacaaactggaggcggctgggcagcttcagcttctcgtactgaaatcaaatttgattcggaggggcggttggataatgaattcttccaacaatctgaggagtcgagtcaattcaggcaagagtttgaaatgcggaaaattaagcaggatcaaggtttggatatgatatcagacggtttggatacattgaaaaatatggctcaggatatgaatgaggaattcgataggcaagttcctttgatggatgagattgactcaaaggtggacaaggcatctgctgaccttaagaataccaatgtcagactgaaagacacagtcaaccagctgaggtccagccgaaatttctgcattgatattatattgctgtgtataattttgggcattgctgcgtatttgtacaatgtactgaagaagtgaggtggcataccccccccccccccccccccctttgatcagttccaagagttgttggcttgtccggtattgttttgcattttgaggactcagtttggtgcttgatatatgttatttgattgtttattttatgttgaagagtgtctgttcatactaccatgaatgtatttttcaagtacatgagtcagttttacgtcgcaggtggttgtcctctaatttgcttttgttggtactctgtgaggctgtatctgaatccatacttcaatttattaaacctttgtggacccatagttaatagattggattggcagcttcctttggattttatatgaaacttcttagggaactaatgcattctttctggg

SEQ ID NO: 2582 - DNA, 1000 bp, Nicotiana benthamiana
gtctactccagcccgtcacccacagcagcaatgtcttcccctgttttaaaaaataaaactcccaactcataccaaaactgtttccttttcttccaatcccttcttggtcattttctttttgcattttttggtctgccagttctctgtccccatttgagataagcctgaaatctgagcagcataaagatccaaaatgagtgtaatcgacattcttactcgcgtcgattccatttgcaagaagtacgacaggtacgatatcgataagcagaaagactccaacatttccggtgatgatgccttcgctcgcctttacgccgccgtcgatgcggacattgaagcttctcttcagaaagcagagacagcttcgaaggagaaaaatagagcgtctgctgtggcgatcaatgctgagattcgaagaactaaggctagattattagaggaggttcccatattgcagagattggctatgaagaaggttaaggggctttcaagtgaagaatttgctgcacgtaatgatttggtccttgcactacctgataggataagttcaattccagacggtgcagcagctgcacccaaacaatcaggagggtggggagtttcaggttctcgtgcagaaattaaattcgattcagatggacgttttgacaatgagtactttcaacaaactgaagaatcaagtcaattccgacaagagtacgaaatgcgcaaaatgaaacaggcatgtgaccaaggtttggaggtcatatcagaaggtttggatactttgaaaaacatggccagtgacatgaatgaggagttggataggcaagtccccctgatggatgagattgacactaagatcgacaaggcttcatctgaccttaagaatacgaatgttaggctgaaggacacggttaaccagctgaggtctagtcgaaacttctgcattgacatcattttactgatcataattcttggaattgcagcctatttgtataagtaagttctcattatagca

SEQ ID NO: 2583 - DNA, 1082 bp, Olea europaea
agggaaaaaatgagtgtgatcgacattttgactcgggtggatgcgatctgcaagaagtatgacaaatatgacattgaaaagcagaaggattccaacgttgccggcgatgacgcattcgctcgcctttacgccgccgtagactccgacatcgaggctgctcttcagaaagcggagactgctgcgcaggagaagagtagggcgtcagctgtggcgatcaatgcggagattcggagaacgaaggccaggttgttggaggaggtccccaaactgcagagattagctgtcaagaaggttaagggactttcaacagaagaaattgctgcccgtaacgatttggcacttgcattgcctgataggattcaagcgataccagatggtggtgcagctgcacccaagcaaccaggaggttggggaacttcagctccccgtaaagaaattaaattcgattcagatggacggttcgacagtgaatattttcagcaaactgaagactcaagtcagttcagacaagagtatgaaatgcggaaaatgcgacaggaccaaggtttggatgtcataggagaaggtttggatactttaaaaaacatggcccatgacatgaatgaggaattggacaggcaagttcctctgatggatgagattgacaccaaggtggaccaggcaacatctgaccttaaaaataccaatgttagacttaaggacactgttaaccagctgcgatctagtcgaaatttttgtatcgacatcattttgctctgcattattcttggcattgcagcctatttatacaatgtattgaagaagtaaaaagtggtttcaagtgcttacagatggtaccgtttgacttttttgtattggtttcaagagcttccaaatggtaccgtacaatgatttcaatttcttctgcattttgagatgttgctgtgtgcttggttgtatatttttattagattataatgttcatgagttttcgtgtgtaaaacatgccttctgctttggaaatactagataattcgttgtgtattacagtgacatttcttgattctcctttcgctctatatcgatacttgtattcaaatgtg

SEQ ID NO: 2584 - DNA, 1048 bp, Amsonia hubrichtii
tcccactatatttgatcgcaagaaaagagaaaaggagatcagaacaagcagaaatatgagcgtaattgacattctcactcgtgtcgacgcgatctgtaagaaatatgataagtacgatatcgagaagcagaaggattccaatgtctccggcgacgatgctttcgctcgtctctatgcctccgtcgaagaggacatcgaatcagcgcttcagaaagcagaaactgcggggaaggagaagaatagggcctcggctgtagcgatcaatgccgagattcgtcgtaccaaggccaggctgctagaggaggttcccaaattgcagagattagctattaagaaggttaaaggactatcaacagaagaacttgctgcgcgcaatgatctggtccttgcactgcctgataggattcaagccataccagatggtgctgctgctccacccaagcaatctggaggctggggagcttctgcctctcgtacagaaattaaatttgattcagatggacggtttgacagtgaatattttcagcatactgaagagtcgagtcaattcaggcaagagtatgaaatgcgaaaaattagacaggatcaaggcttggaggtcatatctgaaggtttggatacattgaagaacatggcccatgatatgaatgaggaagtggataggcaagttcccttaatggatgagattgacagcaaggttgacaaggctacatctgatctgaagaacaccaatgtcagacttaaggacactgttaatcagctgagatctagtcggaatttctgcattgatatcattttgttgtgcattatattgggaattgcagcttacttatacaatgtactgaagaagtgaaaagtttgaagcaccgttggatgtactagtatgatgctgatctttgctatttccttgcatcagttgaggtctctggttatggtttattgtagagttggtttgatttagtgcttgcacttgtaattgttggctgtcagatactgagatacatatttcaacatagcacttctttgtattcctatggtttttacctat

SEQ ID NO: 2585 - DNA, 928 bp, Glycyrrhiza uralensis
gaaagggatcatcattctctgctatacgcactgatctgtcactgttgacaaccaacaatattcagaaaaagaacattgaaattaaataagaccagattttgatcccaaagtaagtaacaacaacaacaacaacaacaacaacaacagcatgagcgtcatcgacattctcacccgagtcgattcgatctgtaagaagtacgacagatacgacgtcgacaagcaaaagagttccaatttctccgccgccgacgccttcgccaaactctacgccctcgtcgacgccgacatcgacgccgcgcttcagaaagcagaaaccgcttcgaaggagaaaagcagggcttcaaccgtagcgatcaatgccgagattcgtcgtattaaggctaagttactggaagaggtccccaagttgcagagattggctgtaaaaaaggtaaagggtctttcatcacaagaatttgctgcccgtaatgatctggttcttgcattgccagagaggatccaagcaatcccagatgggacccctgctgcacccaaacaaactggactttggggagctcctgcctcacgtcctgaaattaaatttggttcagatgggcgatttgatgatgaatacttccaacaaactgaagaatcaagtcgattcaggcaggaatatgaaatgcgtaaaatgaaacaggatcaaggcttggatgtaatcgcagaaggattagatacgttgaaaaacatggcgcacgatatgaatgaagaaatggatagacaagttccgctgatggatgagattgatactaaggtggacaaggcatcctctgaccttaagaatacaaatgttagacttaaagacacagtgacccagcttcgatccagtcgaaacttctgtattgatattgttttgttgattataattttgggaattgctgcgtatttgtac

SEQ ID NO: 2586 - DNA, 1471 bp, Populus trichocarpa
ctttctttactagctaatgaaagagagagaatatcaagtaataaaaaagtgttgcattacaggctgttgttgttcaccttactcggagtcggagagttgaaaattggaaccggaaaaccgcttcttgctaaattattcccttcaaatcaccaccataagctcaaaaccaaagaaattcaactcaaaatccttctcttctctctttcatttcttctaaccgataataataataaaaacttataaaatgagcgtgattgacatattaactcgagtagacgcgatctgcaacaaatacgacaaatacgacattgaaaagcaaaaagatctcaatgtctccggcgacgatgcctttgctcgcctctacgccgccattgattctgacattgaagcggctcaccagaaagccgagcttgcttccaaggagaaaagtaaggcctctgctgttgctataaacgcagagcttcgtagaactaaggctagattgcttgaggaagtccctaaactgcagagattagccgtaaagaaggttaaaggactttctacagaagaacttgctgcacgaaatgatttggtccttgcattgccagataggattcaagctataccagatggaactgcagctgcgcccaaacaaactggaggttgggggacttcagctccccgtgctgaaatcaaatttgattcagatgggcagtttgataatgaatactttcaagaaactgagacgtctagtcaattcaggcaagagtatgaaatgcgtaaaatgaagcaggatcaagggttggatatgatttcagatggtttggacacgctgaagaatatggctcatgacatgaatgaggagattgacagacaagttcctttgatggatgaaattgacactaaggtggacaaggcggctgctgaccttaagaataccaatgttagacttaaagacactgttaaccagttgagatctagtcggaatttctgtattgatattgttttgttgatcataatccttggaatagctgcctacttgtacaatgtgctgaagaagtgaagaaaatgaagactctaccccatctacttccatggtacggcagtgttggcttttttctggtataatcttgtatttgaggacttcaatggcgcttgtgttttcatttgatttgttatcgtgctgggagtaacttctcacacttgaaaatgtatgtttgtcattcatgtacttttatcatatcttaatatcttgcaatttgtttctctcagtttgggtatttacgtgctgaatctgacccatagaaatcatcccaaagtttgtaatagcagacttgtctcacattgccatgcctaaatctaggagtatatttttggtttgttgtagaaagaagttggcgtaggtgtgactgggcaatgtgcctgtatggaaaataaattagtgttttgggaattagtgtggatttaaggattgacgttttgacagctgttt

SEQ ID NO: 2587 - DNA, 1476 bp, Populus trichocarpa
aatcctttctttactagctaatgaaagagagagaatatcaagtaataaaaaagtgttgcattacaggctgttgttgttcaccttacttggagtcggagagttgaaaattggaaccggaaaaccgcttcttgctaaattattcccttcaaatcaccaccataagctcaaaaccaaagaaattcaactcaaaatccttctcttctctctttcatttcttctaaccgataataataataaaaacttataaaatgagcgtgattgacatattaactcgagtagacgcgatctgcaacaaatacgacaaatacgacattgaaaagcaaaaagatctcaatgtctccggcgacgatgcctttgctcgcctctacgccgccattgattctgacattgaagccgctctccagaaagccgagcttgcttccaaggagaaaagtaaggcctctgctgttgctataaacgcagagcttcgtagaactaaggctagattgcttgaggaagtccctaaactgcagagattagctgtaaagaaggttaaaggactttctacagaagaacttgctgcacgaaatgatttggtccttgcattgccagataggattcaagctataccagatggaactgcagctgcgcccaaacaaactggaggttgggggacttcagctccccgtgctgaaatcaaatttgattcagatgggcagtttgataatgaatactttcaagaaactgagacgtctagtcaattcaggcaggagtatgaaatgcgtaaaatgaagcaggatcaagggttggatatgatttcagatggtttggacacgctgaagaatatggctcatgacatgaatgaggagattgacagacaagttcctttgatggatgaaattgacactaaggtggacaaggcggctgctgaccttaagaataccaatgttagacttaaagacactgttaaccagttgagatctagtcggaatttctgtattgatattgttttgttgatcataatcctcggaatagctgcctacttgtacaatgtgctgaagtgaagaaaatgaagactctacccaatctatttccatggtacggcagtggtggcttttttctggtataatcttgtatttgaggacttcaatggcgcttgtgttttcctttgatttgttatcgtgctgggagtaacttctcacacttgaaaatgtatgtttgtcattcatgtacttttatcatatcttaatatcttgcaatttgtttctctcagtttgggtatttacgtgctgaatctgacccatagaaatcatcccaaagtttgtaatagcagacttgtctcacattgccatgcctaaatctaggagtgtatttttggtttgttgtagaaagaagttggcgtaggtgtgactgggcaatgtgcctatatggaaaatatattagtgttttgggaattagtgttgatttaaggattgacgttttgacagctgtttctta

SEQ ID NO: 2588 - DNA, 1243 bp, Tabernaemontana elegans
agtttaactgtaaacgcatccttcctcgcttatgaattgaacccccttcccaaatacagagggttttggtcaactcaattccacatttgtccctgttagtgatcttccaccacatttgatcgcaagaaaaaggggaaaaggggggggaccaaatctagcagaaaaatgagcgtgattgacattctcactcgtgtcgatgcgatctgcaagaagtatgataagtacgatgtcgataagcagaaggactccattgtctccggcgacgatgcctttgctcgcctatatgcctctgtcgaagaggacatcgaagcggcacttcagaaagcagaaactgctgggaaggagaagaacagggcgtcagctgtggcgatcaatgccgagattcgtcgaaccaagaccaggttgctagaggaggttcccaaattgcagagattagctatcaagaaggttaaaggactgtcaacagaagaacttgcagcacgtaatgatctggtccttgcactgcctgataggattcaagccataccagatggtgctgccgctccacccaagcaatctggtggttgggcatcttctgcctctcgtacagaaattagatttgattcagatggacggtttgaaagcgaatattttcagcaaactgaagagtcaagtcaattcaggcaagagtatgaaatgcgaaaaatgagacaggatcaaggcttggaggtcatatcagaaggtttggatacattgaagaacatggcccatgatatgaatgaggaatttgataggcaagttcccttgatggatgagattgacaccaaggttgacaaggctacctctgatctgaagaataccaatgtcagactcaaggacactgttaatcagctgagatctagtcggaatttctgcattgatatcattttgttgtgcattatattgggaattgcagcttacttatacaatgtactgaagaagtgaagaagtttgaagagatgtaggatgtacttgtatcatgctggtctatgttatttccttgcatcagttgaggtctttggttgtgctttactgtagagttggtttggtttagtgcttgcattcacttgcgctcctatgtaattgttggctgtcaaatacacatttttaacatagcacatccttgtattcatatggtttccctattttcgtgcttgtctcgtatgcttccttgttatactgttatttcatcaatctttgtgaattgacaattatgagttgagtt

SEQ ID NO: 2589 - DNA, 1265 bp, Fragaria vesca
cacagcctgttttgctactctgttgcttctttgaaaccgctttctcttctggtcacccacccattgaaaaaccaaacccatccatcttctccttcccaatttctcacttccttcaaatctgtaattcaaagctagggcaagcaagctagagttggacaaagatgagcgtcatcgagcttctgacgagagtcgaggcgatctgcaacaagtacgaccgatacgacatcgagaagcacaaggactccaacgtctccggcgacgatgcctttgctcgcctctacgcctccgtcgattccgacattgaagccgctcttcagaaagcggagcttgcttcgaaagagaagagcagggcatctgcagttgctctgaatgccgagattcgacggaccaaggctcgattattggaagaggttccaaagttgcagaggttggctctaaagaaggttaaggggctttcatctgaagagtttgcagctcgtaatgatttggctcatgcattgacagataggatccaggatataccagatggcactccggctgctccaaaacaaagtggaggaggttggacagcttcagcttctcgtactgaaatcaagtttgattcctctgatggacggtttgataatgaattctttcaacaaactgaggagtccagtcaattcaggaatgagtatgaaatgcggagaatgaagcaggatcaaggtttggatgtgatatcagaaggtttggatacgttgaaaaatatggctggtgatatgaacgaggaatttgatcggcaagttcctttgatggatgagattgacagtaaggtggacaaggcatcttctgaccttaagaatactaatgttagattgaaagacactgtcaaccagctgaggtccagccggaatttttgcattgatattgtattgctgattatcattttgggcattgctgcctatttgtacaatgttttgaagaagtgagatggcagtttaacctgttcaggagttaatggttgtgtggcattgttgcacatgaggactcgctttggtgtttgttatatatagcatttgatgttcagtcatgcttaaagtctttatagactctagtacgaatgaatgttgtgttttttaagtacatcagtcatgtttgtaacttttactgcagcttattgtgcgccctaccccgagtctgttcttactctttctgattcctcgagttcaattcttttaaaacctttgttaaccctgttaatagtttggaatgacatctttgcttcaact

SEQ ID NO: 2590 - DNA, 1210 bp, Nicotiana benthamiana
ctatgcttttaggaaaaaagaaaagagaaaaataactccagtctgtattttggagagtgttttctccgtctgcaaagtgaaaatcccccgttcgtatttatttcgtgatctccacaaattctgatagaagaagaagaagaagtgcagtggaataatcagaagtaaaatgagcgtaatagatatactgacacgtgttgactcaatctgtaagaaatatgacaagtacgacatcgacaagcacaaggattccaacgttgccggcgacgatgccttcgctcgtctctattcttccgttgaatccgacatcgtagcttctcttcagaaagcggaaactgctgctaatgagaaaaatagggcatctgttgtggcgatcaacgctgaaattcggagaactaaagccaagttactcgaggaggttccgaaattgcagaggttggctgtaaggaaggtcaaaggtctgtcgggtgaagaacttgctgcccgtaatgatttggttcttgcactaccagatagaataaatgccataccagatggctctgcagctccacccaaacaatctggaggatggagagcttcaggttctcgcacggaaattaaatttgattcagatggacaatttgacaatgaatattttcaacaaactgaagagtcaagtcaattcaggcaagagtatgaaatgcggaaaatgagacaggaccaaggtttggaggtcatagcagaaggcttggatactttgaaaaacatggccagtgatatgaacgaggagttggatagacaagttcctctgatggatgagattgacacaaaggtggacaaggcaacctcagacttgaagaataccaacgtgaggcttaaggatacagttaaccagttgagatctagtcgaaacttttgtatcgatatcattttgctgatcatcattcttgggattgcagcctatttgtacaatgtcttgaagaagtaaaacaccgttaaagtgcatgttggatcgacttgtatgttggccttcacgatctgtttatttatcattatttttttttaaaaatgtttttgtgtgtgcatgtaaaaaaaatgttaatatggatggttaagcctagcattcgtattctacttgcttgtggtttgagattgaggtgtagtaattgtttatttttatctttggacaatgtattgtcggttttacggataagggttgtttatttttcagtaa

SEQ ID NO: 2591 - DNA, 1190 bp, Vaccinium corymbosum
aaagatgagtgtgatcgacattctgaccagagtcgacgcgatctgtcagaaatacgacaagtacgacattgaaaagcagaaagatctcaacaacgtctccggcgacgacgccttcgcccgcctctatgccgccgttgagtccgacatcgacgccgccctccagaaagcggaagcggcatcgaaggagaaaagcagggcgtctgtggttgctataaatgctgagattcgacgcaccaaagctcgattgcttgaggaggtccctaaattgcagaggttggccgtgaagaaggttaaggggctttcgacagaagaatatgttgcccgtaatgatttggtccttgccctaccagataggattgaagccataccagatgggactgcagctgcacccaaacaaagtggtggctggttagctcctgcttctcgtgcagaaatcaagtttgattcaactggacgttttgatgatgagtacttccagcaaacagaagagtccagccaattcaggcaggagtatgaaatgcgcaaaatgaagcaggaccaaggactggatgttatagcagaaggtttggatacattaaaaaatatggcccatgacatgaatgaggaatttgataggcaagttcccttaatggatgagattgatgctaaggtggacaaggcaacatctgaccttaagaataccaatgtgagacttaagcacactgttaaccagctaaggtcaagccgaaatttctgcattgacataatactgctgtgtataattctcgggattgctgcctacctttacaatgtattgaagaagtaagacgatacgaaggcactgtttctactcgtattttattggctttctctggtattctcttgcattcattgaggccttgctatgttcttgacgtggggtttgagttgttttcctaatgtttctatctcttttgtttgtatgtcttttgcttgtacttggaacaacgaactgtctttcaaatgcaacactggatgcatccgatgtttctgtatcaatgatttgtaatttgttgaattatcactctctccttaattgaaaggcttcgtctttgtgcatatgattaatcttgcaattcctgtaaacatcatggtaaatccagataatgttccggcaaaacaaaatatatccagatagtgataccttcacaaagaaacagaacaaagacaaa

SEQ ID NO: 2592 - DNA, 1268 bp, Eucalyptus grandis
ccagcatcgccttccccgcgtcaaatcctctctctctctctctctccctctctctgcattttctcgctcctcctcttcactgcagactacgcacctcgccgacgagacaccggaaccccgccggccgccggtggtccagccggaggagcgacgatgagcgtgatcgacatcttgactcgggtggactcgatctgcaagaagtacgacaagtacgacgtcgagaagcacaaggacgccagcaatgtcgccggcgaggacgccttcgcccgcctctacgccgccgtcgaggccgacgtcgaggccgccgagcagaaagcggaggccgctgccaccgagaagagtagggcgtctgcggtcgctctgaatgcggagattcggcgaaccaaggcccggttactcgaggaagtgcctaagctgcaaagattggctatgaagaaggtgaaaggactttcatctgaagaatttgctgcccgtaatgatttagcccttgcactgccggacagaattgagaacataccggatggaactgcacctgcacctaaaaaggctggaggttggacaacttctgcatcacgcgcagaaataaagtttgattcagatggaaggatggacagtgactatttccaacaaaccgaagggtcaagccaatttaggcaagagtatgaaatgcggaaactgaagcaggaccaaggtctggatgtgatagccgagggtttggatacattgaaaaatatggcgcatgatatgaacgaggaattggacaggcaggtccctttgatggacgagattgacaccaaggtggacaaggcagcttcagacttaaaaaatacaaatgtcaggcttaaggatacggttactcagctgaggtctagccggaatttctgtatcgatatagttcttttgtgcataattctgggtattgctgcctatttatacaatgtattgaaaaagtgaaagcggcaccttcctacagagttgggttttctgcttgtttcgtactttgaggacttgttgtggtgcttgtattgattctttttctcagtgtatatctgtggtgctctcccccgactcagcaaaggaattcttatttctgtagacgaatttgttgaagctatcgacattattttctgtcgtgtatacccttcatttaatggcaccctgatgttttaacagtttcctggatatatatgttcatgagtaacatgcatcgacttgacaaaaaaatctgttgcatgttcatgaatagattccacggtcatcttcatagc

SEQ ID NO: 2593 - DNA, 846 bp, Lotus japonicus
caaaactcgaaccgagatcgcattctgattccagaacaacatcaccatgagcgtcatcgacattctcaccagagttgattccattgttaacaagtacgacaaatacgacatcgataagcaaaaagattccaatgtctccggcgacgatcccttcgccaaactctacgccgccgtcgacgccgacattgacgccgcacttcagaaagcagaaaccgcttccaatgggaaaaatagggcatcaactgtagcgatcaatgctgagattcgtcgcactaaggctaggttgctggatgaggtgcccaaattgcagaggttggctgtaaaaaaggtaaaagggctttcgtcacaagaatttgctgcccgtaatgatttagttcttgcattgccggagaggatccaagcgattccagatgggacccctgctgcacccaaacaagctggaggctgggcagcttcaggctcacgccctgaaattaaatttgattcgaatgggcgatttgatgatgaatacttccaacaaacagaagaatcaagtcaattcaggcaggagtatgaaatgcgtaaaatgaaacaggcaagtttggacgtgatcgcagaaggattagatacattgaaaaacatggcccatgatatgaatgaggaatttgatagacaagttccactgatggatgagattgatactaaggtggacaaggcatcatctgaccttaagaataccaatgttagacttaaacatacagtgacccagcttcgatccagtcgaaacttctgtatcgatattgttttgttgattatcattttgggaattgctgcctatttgtacaagtaaggctcctttctcttttc

SEQ ID NO: 2594 - DNA, 1242 bp, Prunus persica
cgctttctttactggttctccacccacacacaaacattcaaaaaaaaaaaaaattatcgaacttaatcttctggtcctggattttggacttattttcaactctgcaatcgaaaaaggaaggtaggaggagggagacgaaccagagaagaagatgagcgtcatcgaaatcttgacaagagtagaggcgatctgccagaagtacgacagatacgacgtcgaaaagcagaaggatctcaacgtctccggcgacgatgcctttgctcgcctctacgcctccgtagacgccgacattgaagcccttcgtcagaaagcggaaattgcttcgaaagagaaaaataaggcatctgctgttgcgctgaatgctgagattcggaggaccaaggctcgattgcttgaggaggttcccaagttgcagaggttggctgtaaagaaggtgaaagggctttcaacccaagattttgctgctcgtaatgacttggtccatgcattgccagataggatccaggatataccagatgggactcctgctgcacccaaacaaactggaggcggctgggcagcttcagcttctcgtactgaaatcaaatttgattcggaggggcggttggataatgaattcttccaacaatctgaggagtcgagtcaattcaggcaagagtttgaaatgcggaaaattaagcaggcaagttatagatattgtgatcaaggtttggatatgatatcagacggtttggatacattgaaaaatatggctcaggatatgaatgaggaattcgataggcaagttcctttgatggatgaaattgactctaaggtggacaaggcatctgctgaccttaagaataccaatgtcagactgaaagacacagtcaaccagctgaggtccagccgaaatttctgtattgatattatattgctgtgtgtaattttgggcattgctgcgtatttgtacaatgtactgaagaattgaggtggcataaagagcggtttgaccagttccaagagtcgttggcttgtccggtattgttttgcattttgaggactcagtttggtgcttgctatatgttatttgattgtttattttatgttgaagagtgtctgttcatactaccatgaatgtatttttcaagtacatgagtcagttttacgttgcagttggttgtgtcctctaatttgcttttgttggtactctgtgaggcggtatctgaatccatacttcaatttattaaacctttgttgacc

SEQ ID NO: 2595 - DNA, 1184 bp, Nicotiana tabacum
  misc_feature (251)..(251): n is a, c, g, or t
ggtattttgaagagtgtgttctccgtcttcaaagtaaaaatctcccgttcgtatttatttcgtgatctccacaaattgtgagagaagaagaagaagtgcagtggaataatcagaaggaaaatgagcgtaatagatatactgacacgggttgactcaatctgtaagaaatatgacaagtacgacatcgacaagcacaaggattccaacgttgccggcgacgacgccttcgctcgtctctattcttccgttgnatccgacatcgaagcttctcttcagaaagcggaaacagctgctaatgagaaaaatagggcatctgttgtggcgatcaacgctgaaattcggagaactaaagccaagttactcgaggaggttccaaaattgcagaggttggctgtaaggaaggtcaaaggtctgtcgggtgaagaacttgctgcccgtaatgatttggttcttgcactaccagatagaataaatgccataccagatggctctgcagctccacccaaacaatctggaggatggagagcttcaggttctcgcacagaaattaaatttgattcagatggacaatttgacaatgaatattttcaacaaactgaagagtcaagtcaattcaggcaagagtatgaaatgcggaaaatgagacaggaccaaggtttggaggtcatagcagaaggcttggatactttgaaaaacatggccagtgatatgaacgaggagttggatagacaagttcctctgatggatgagattgacacaaaggtggacaaggcaacctcagacttgaagaataccaacgttaggctcaaggatacagttaaccagctgagatctagtcgaaacttttgtatcgacatcattttgctgatcatcattcttgggattgcagcctatttgtacaatgtcttgaagaagtaaaactccgttaaagtgcatgttggatcgacgtgtatgttggccttcacgatccatttatttatcattaatttgtttatatttttgtttgtgtgtgtgcatttaaaaaaaagaaaaagttaatatggatggttaagcctagcatgcgtattctacttgcttgtgtgtttaattagtttgagattgaggtgtagtaattgttgtttttatctttggacaatgtatttccggttttagtggagaagggttgtttatttttcagtaatgcc

SEQ ID NO: 2596 - DNA, 879 bp, Tripterygium wilfordii
gatcgacattttaactagagtagacgcgatctgcaagaagtacgacaagtatgacatcgaaaagcagaaggattctaatgtttccggcgaggatgccttcgcccgtctctacgcctccgtcgaagctgacattgaagccgctctgcagaaagcagagttagcttcaaacgagaagaatagggcatctgcagttgctctgaatgccgagattcggaggatcaaggctcgattgctggaggaggtcccaaaattgcagcggctggcgctaaaaaaggtcaaagggctttcctcagaagagtttgctgctcgtaatgatttggtccttgcattgccagataggattcaagcaataccagatggaacgacaggagcacccaaacaaggtgggggctggacatcttctgcctctcgtgctgaagtcaagtttgattcagatggacagtttgatgatgagtactttcaacattcggagtcatcaagtcaatttaggcaggagtatgagatgaggaaaattaagcaggatcaaggtctggatatgatttcagaaggtttggatacactgaaaaacatggctcaagatatggatgaggaattggatagacaagtgccgttgatggatgaaattgataccaaggttgacaaggccacttctgaccttaagaataccaatgttagacttaaagacactgttaaccagctgagatccagccggaatttctgtattgatattgttttgttgtgtataattttgggaattgctgcctacttgtacaatgtgctgaagaagtgaaacgatacaaatgattacttcactcgtctttccggtgtggtgttagaattctacttccatcaatattcattttgaggagttgtcttggt

SEQ ID NO: 2597 - DNA, 1249 bp, Momordica charantia
gaaggaagacaatcggaggaaattttgttctgacagcggtggatgctactggcacagtttctgaagagaccgtaggtcaccggaaaaccggccggagcacggaggcgaagaatcaagatgagcgtgatcgaccttttgaccagagtagacgcgatctgccagaagtatgacaagtacgatgtagagaagcagagggatctcaatgtctccggcgacgacgccttcgctcgactctatgcaaccgtcgaagccgacattgaagccgctctccagaaagcggaggatgcttccaaagagaagaatagggcatcggtggtggcgttgaatgcggagattcgtcgtactaaggctcgattactggaggaggtccccaagttgcagagattggccgtgaagagggtaaaagggctatcaacggaagatcttactactcgaaatgatttggtgcttgcattgccggataggattcaagctataccagatgggactaccactgcaaccaagaagactgggggttggacatcctcagcttcacgtactgatataaaatttgactcagatggacgattcgatgatgaatacttccaacacaccgaggagtcaagtcagttcaggcaagagtatgaaatgcggaaaatgaaacaggatcaaggattggacatgatatcagaagggttggatactctgaagaacatggctcatgatatgaatgaggaaatagataggcaagttcctttgatggacgagattgacactaaggtggacaaggctgcatctgaccttaagaacaccaatgttagattaaagcacacagttaatcagctaaggtccagcagaaatttctgtattgatattgttttgttgtgtataatcttgggtattgctgcctatctatacaatgtgttgaagaagtgatcagacaatggggaaaatcttcttgttttgtggaatatctgtatttagcaacattatctggttctgcccttggaggagaatgtatgtcatattcattttacactcaacttattctgtgttgtcatatcctggttatgttgcttgattttttttaatgacatccatgagtgtcgaggcctgcttgcacgaacctttttcatgcgttatgttgcttgattcttgaatgttgcattcgtgcattgttaaaatttgaacactggatattttagctcctatgtacgagttagactctgatcagatacggatcggatagaatactttttccttctatacc

SEQ ID NO: 2598 - DNA, 1247 bp, Tropaeolum majus
gtctcttccctcttgaaaccgctatctggatcttggaaatcttgatatcttttttctattctgaaattattcttctcaagaactcatcagtttttagtcagtaacaggattgattgaaggaaaagaaaccaaggagaagcagatcccaaaatgagtgtcatcgatatattgactagagtagacgccatctgccagaagtacgacaaatacgacattgaaaagcagagggaggccaatgtctccggcgcagatgcgttcgctcggctctactcctctgtcgaggctgacattgaggctgctcttgagaaagcggaggtcgcatcaaaggagaaaaataaggcatctgctgtggcaatgaatgcagaaattcgcagaaccaaggcccgattgttagaggaagtccccaagttgcagaggttggccgtcaagaaggttaaagggatttcaacagaagagcttgctgctcgcaacgatttggtccttgcattgccagataggattggagctataccagatgggactctgaatgctcctaaacaaactggaggttggaatacatcagctcctcggactgaaatcaaatttgattcaggtggtcaatttaatgatgagtattttcaacaaagtgaagggtcaagtcagtttaggcaagagtatgaaatgcgtaaaataaaccaggatcaaggtttggaaatgatatcagaaggtctagatacattgaaaaacatggctcatgatatgaatgaggaattcgatagacaagttcccttgatggatgaaattgactctaaagtggacaaggcatcatctgaccttaagaatacaaatgttagacttaaacataccgttaaccagctgaggtccagccgaaacttctgtatagatattgttttattgtgcataatattgggtattgctgcctatttatacaacgtgttgaagaagtaaggccgtgactgaattacttgtccattactcaatgttggcttttctggtgtattttgaggacttgtgtggttagttttgcatttgatatactatatgtgctttaattgttttcagaatgggaaacaaaaacttgaaattgtctttttaaaacaaatttatgacgttgtaactgctgtttcaatttgtatcaattttttcatccccttggttttaagcatctttgcgtaatttgaatcccttatcttgtatcaaaaacctatggcaaaagttctctaatttaatgagaagtataggaaagg

SEQ ID NO: 2599 - DNA, 1050 bp, Cleome spinosa
aaatattcgaacatgaccagcagagatccaaaactcgcgtaatcagatacgctgaagattttctctcagaagttggtttgttcctcgaatcagagattctccctccctagatctgagcattgcgcgggtatattcggaggaagatgagtgtgatcgatattctgactagagttgacgcgatctgcaagaagtatgacaagtacgatgtcgagaagcagagggaagcaaatgtctccggtgacgatgccttcgctcgtctctatgcctccgttgagaatgatatcgagaccgctctcgagaaagcggaacttgcttctaaggagaagagtagggcttctgctgttgcaatgaatgcagagattcgccggacccaagctcgcttgcttgaggaggttccaaagttgcagagactggctgtaaagcgggttaaaggcctttcaacagaggagcttgctgccagaaatgatttggtcctcgctcttccggacaggatagaagctatacccgatgggactgcgggtggtcctaagaaaactagtgcttggtctgcatcagcatctcgtgctgagatcaaatttgattcagatgggcattttgatgatgattacttccaagaatcaaaggaatctagccaatacaggcaggagtatgagatgcgaaagatgaagcaggatcaaggtctggatatgatttccgaaggtttggatactttgaagaacatggcacatgatatgaatgaggaattagataggcaagttcctctgatggatgaaatcgacactaaggttgacaagcaacagcagaccttaagaacaccaatgtcaggcttaaagacactgtcaaccagctaagatcaagccggaatttctgtatcgatatcgtattgctgtgcattattctgggaatcgctgcgtatttgtacaatgtactgaagaagtgagaagagcgaaaaaggtcacttgggtataacatatctcccccgtaaaatgtgaaatttctttcatccccgaaccgattcattggtaccactgtgctgtgtgtgtatacctg

SEQ ID NO: 2600 - DNA, 1244 bp, Gossypium hirsutum
atggggggttgactcctagtgtttaattattgtatactgtttattcttcgaatcttggagttagttcggtgaacgacgtttacaggggaaacaaaaagaagctaagaaattccaactcttttttccctcaatttttttcccacatccaaacagctacattgattgaattttaaactcaaaagaaaaacaaaatgagtgtaatcgatattttgacaagagtagatgtgatctgcaagaggtacgataaatacgacgtcgaaaagcagcgtgaccaaaatgtctccggcgacgatgcttttgctcgcgcttacgcagcagtcgaagccgacattgaatccgctctagagaaagtggaacttgcttccaaggagaaaagtaaggcatctgctgttgcagtcaatgctgagattcgtcgaaccaaggctcgattgcttgaggaggtccctaagctgcagagattggctgttaagaaggttaaagggatttcaactgaagagatggctgctcgtaatgatctggtccttgcattgccggacaggattcaagctatacctgatggaactgctgatactaaacaaactggaggctggatgtcttcagcaccttcagcttctcgtactgcaattaagtttgattcagatgagcgatttgacaacgaatactttcaagaatctgagcagtcaagtcagttcgggcaggagtatgaaatgaggaaaatgaagcaggaccaaggtttggatatgatttcagaaggtttggatactttaaagaacatggctcatgatatgaatgaggaactagataggcaagttcctttgatggatgaaattgacaccaaggtggacaaggcagctgctgaccttaagaataccaatgttagacttaaagatactgtcacacagttgaggtccagccgaaatttctgtattgatatcgtattgctgtgcatagttctgggaatagctgcctatttgtacaatgttctgaagaagtgaagtgataaaaggataaatctatgagtttcccttgtatgttatcggctttttctggtaatgtctttcatttggaggggcttgttctcgtgcttgatattgtatttgatttgtttcattagtgggaatcattgtttgctctgggaaaacttgagtgtatctatctctacaaattcaagacaaccgtaaaatgtttgtatatcatggagtttgtaaaggtttgaccatatttgtttaaaaggaggtacttct

SEQ ID NO: 2601 - DNA, 1168 bp, Olea europaea
gaaactccatttactctgttgcacccggtatagttctgctgaacctcgtcgcaatcgatttgccccaattttcatatccttaattcattaaacctctcggcaaaaggaaaagataaaaatgagcgtgatcgatctattgactcgcgtggacgcgatctgcaagaagtatgataaatacgatatagagaaacagaaggattccaacgtatctggggatgatgccttcgctcgtctctatgccgccgttgagtcagacatagaggaggcactacagaaagcggagaaggcttcaggagaaagtaatcgggcatcggccgttgcgataaatgcagagattcggagaaccaaggccagattgattgaagaggtccccaaattgcagaggctggccgtgaagaaggttaaaggactttcagcagaagaacttgccgctcgtaatgatttggtacttgcattacctgataggattcaagccataccagacggtgctgcagctgcacccacaaaatctggtggctggggatcttcggctcctcgtaaagaaatcaaatttgattcagatggacggtttgacagtgaatactttcaacaaactgaagggtcaagtcaattcaggcaagagtatgaaatgcggaaaatgaaacaggaccaaggtttggacacgatagcagaaggtttagatactttaaaaaacatggcacatgacatgaatgaggaatttgatcggcaggttcctcttatggatgagattgacaccaaggtggacagagcaacagctgaccttaagaataccaatgtccgactgaaggacactgttaatcagctgagatctagtcgaaatttctgtattgacatcattttgctgtgtataattctgggaattgctgcttatttgtacaatgtgttgaagaagtagaagtggttgggagagtgccgggtgtgactgtatggagtctttggtattgtttccactgagtgagttgtagccatgtggttctttgtataattagtttgattttcatgctggcataacttgtttaaaactctgcttctttttaaagtttcttttggtaacattaaggcctctatttgaccttccatgtaatggtttgatagtaactcagattagtgtgtttcttcctcccctgtgggtaataatggccagttt

SEQ ID NO: 2602 - DNA, 999 bp, Valeriana officinalis
agttgaaaatcaaactttctgctgattcaaatcaattcaaagaaactagtgcgagaaattgaagcacaaatatgagtgtgatcgacattctaacgagagttgattcgatctgtaagaagtatgacaaatacgacatcgataagcagaaggatctcaatgttgcaggtgacgatgcatttgctcgtttatacgccgccgtcgaatctgacatcgagtcagcttatcagaaagcggagactgcttcgacagagaaaaatagggctgctgctgtagcaattaacgcggagattcgtcgtacaaaggctcgtttgctggaggaagtccctaaattgcagagattggctatgaagaaggtgaaggggctttcttctgaagaatatgccgcgcgtaatgatttggccattgcactgccagacaggattcaagatataccagatggtggtgctcctgctcccaaacaaactggaggctgggcttcttcagcctctcgagctgaaattaagtttgattcagatggacgttttgacgatgaatactttcagcaaagtgaggagtctagtaacttcaggcaagaatacgaaatgcgaaaagtgaagcaggaccaaggattagaggtgatatcagaaggtctgagcacactaaaaaacatggccagcgacatgaatgaggaactggatagacaagttcctttgatggacgaaattgactctaaggttgacaaagcaacatctgatcttaagaataccaatgttagacttaaggataccgtacaccagctgaggtctagtagaaatttctgtatcgatattattttgttgtgcataattctcggtattgcagcgtatttatacaacgtattgaagaaataaaaaaaaactagataagagggttcatttggatatgtaagatcgttatatattgtctatgtatggtatctattatcttgcactggctgccgttatctatgtttgatgtgtttttttttcctaagattccatt

SEQ ID NO: 2603 - DNA, 1129 bp, Citrullus lanatus
agtttagttataagatatattcggacatcacaagcgcacgacttctgtagatattcacggaaccacttttactgccgtacgtcaccggaaaacctaccggggcgcggaggcgaagaatcaaagatgagcgtgatcgaccttttgaccagagtagatgcgatttgccagaagtacgacaaatatgacgttgaaaagcagagagatctcaatgtttccggcgacgatgccttcgctcgactctacgccactgtcgaagctgacattgaagccgctctccagaaagcggaggatgcttctaaagagaagaatagggcatcggtggtggcgttgaatgcggagattcgtcgtaccaaggcgcggttactggaggaggtccccaagttgcagagattggctgtaaagagggttaaagggctatcaaccgaagatcttaccacccgaaatgatttggtgcttgcattgccagagaggattcaagctataccagatggaactgcgacttccacgaagaataatgggggttggacatcctcagcttcgcgtgctgaaatcaaatttgactcagatgggcgattcgatgatgagtacttccaacacactgaggagtcaagtcagttcaggcaagagtatgaaatgcggaaaatgaagcaggatcaaggattggacatgatatcagaagggttagatactctgaagaacatggcacatgatatgaatgaggaaatagataggcaagtccctttgatggacgagattgacactaaggtggacaaggctgcatctgaccttaagaacaccaatgttagattaaaagacacagttaaccagctaaggtccagcagaaatttctgtattgatatcattctgttgtgtataatcttggggattgctgcctatctatacaatgtgttgaagaagtgagctaagcaagggggaattcttcatgttcttgtggaatatttgtgtcaagcttggtaagatgagtatctgtatctagtacatagtctgattttgtttgtgtttacaaatatttgtatgccatattcttttacacaactcgctctgttactactcttggttatgctgcttgattcttgaatgttgcacttgtgcaacctctctttgcttt

SEQ ID NO: 2604 - DNA, 1834 bp, Gossypium raimondii
ggtcgggccaggccgggccgggctcaggcttatgaatgtttttccggcccaagtctggacaaaatttcaggcctataattcgggtcgacccgaacttaggacccgggctgaaattttttctgggctggacccaaactcggcacggctatgagcatctctagttgactgctaatgtttaattattgatactgtttattctttgaatctggagttcgttcggtgaacgacgtttacaggggaaacaaacagaaacgaagaaattccaactctttattctctcaattttttcccacatccaaacagctacattgattgaatttgaaactcaaaagaaaaacaaaatgagtgtaatcgatatattgacaagagtagatgtgatctgcaagaggtacgataaatacgacgtcgaaaagcagcgtgaccaaaatgtctccggcggtgatgcttttgctcgcgcttacgccgcagtcgaagccgacattgaatccgctcttgagaaagtggaacttgcttccaaggagaaaagtaaggcatctgctgttgcagtcaatgctgagattcgtcgaaccaaggctcgattgcttgaggaggtccctacgctgcagagattggctgttaagaaggttaaagggatttcaactgaagagatggctgctcgtaatgatctggtccttgcattgccggacaggattcaagctatacctgatggaactgctgctactaaacaaactgggggctggatgtcttcagcaccttcagcttctcgtactgcaattaagtttgattcagatgagcgatttgacaacgaatactttcaagaatctgagcagtcaagtcagttcaggcaggagtatgaaatgaggaaaatgaagcaggaccaaggtttggatatgatttcagaaggtttggatactttaaagaacatggctcatgatatgaatgaggaactagataggcaagttcctttgatggatgaaattgacaccaaggtggacaaggcagctgctgaccttaagaataccaatgttagacttaaagatactgtcacacagttgaggtccagccgaaatttctgtattgatatcgtattgctgtgcatagttctgggaatagctgcctatttgtacaatgttctgaagaagtgaagtgataaaaggataaatctatgagtttcccttatatgttatcggctttttctggtaatgtctttcatttggaggggcttgttctcgtgcttgatcttgtatttgatttgtttcattagtgggaatcattgtttgctctgggaaaaattgagtttatctatctctacaaattcaagacaaccgtaaaatgtttgtatatcatggagtttgtaaaggtttgaccatatttgtttaaaaggaggtacttctgccttcatggctcttctttacaatacatagctaacagatcaatcgttaccacataagcagacaatttcaggttaagacaaaagttgtgttgcgtagacagatacacaaatgctttgaaccctctgcggtgcatgcctcggaaaccatttcggaatggagatggaggtaagtaaaagaaaagaaaaaagaagaaaaaacttgtagtatatttaaagtggcagtactatacagctgaataggaaataaacgtagttgctagatttcctaggtaatttagtgttagatgtgcttaaggaggtgtaatcgaactttatctcaagcattttcatactcaatttcaaggtagattcttttttatgttgaaacttttcataattagaaaacaaaaagctttgttccaaaaggggaaaaagaaagaaaagcttgattaagctagcatg

SEQ ID NO: 2605 - DNA, 1098 bp, Euonymus alatus
ttactactcgttatgagaaagatgttaaagataaaaagaaaagggtggttgttacaggctctgtcttgaaactgcttcatgcctggcgattttaagtcaatgccaattcaagctgaattagagaaatcgagctagaatccccgcaagtcctctcaagtcttgacaatatcattgaattcaaagcttcaataggaagcctaagatgaccgtgatcgacattttaactagagtagacgcgatctgcaagaagtacgacaagtatgacgtcgaaaagctgaaggagtctaatgtttccggcgaggatgccttcgcacgcctctacgccgccgtcgaagccgacattgaagccgctctgcagaaagcagagaaagcttcaaacgagaagaatagggcatccttagttgctttgaatgccgagattcggaggatcaaggctcgattgctggaggaggtcccaaaattgcagcggctggcactaaagaaggtcaaagggctttcctcagaagagtttgcggctcgtaatgatttggtccttgcattgccagataggattcaagcaataccggatggaactacaggtgcacccaaacaaggtgggggctggacatcttctgcctctcgcgctgaaatcaagtttgattcagtagatgggcagtttgatgatgagtacttccaacgttcagaatcgtcagatcaatttaggcaggagtatgagatgaggaaaattaaacaggatcaaggtctggatatgatttcagaaggtttggatacactgaaaaacatggctcaagatatggacgaggaattcgatagacaagtgccgttgatggatgaaattgataccaaggtcgacaaggcaacttctgaccttaagaataccaatgttagacttaaacatactgttaaccagctgagatctagccggaatttctgtattgatattgttttgttgtgtataattttgggaattgctgcctacttatacaatgtgctgaaaaagtgaaacgatatgaagggttacttcacctgtctctctggtgtggtgtaagaattctacttccatcattattcattctgaggagttttcttggagcctgg

SEQ ID NO: 2606 - DNA, 947 bp, Euonymus alatus
ttgaaactgcttcatgcctggcgattttaagtcaatgccaattcaagctgaattagagaaatcgagctagaatccccgcaagtcctctcaagtcttcaataggaagcctaagatgaccgtgatcgacattttaactagagtagacgcgatctgcaagaagtacgacaagtatgacgtcgaaaagctgaaggagtctaatgtttccggcgaggatgccttcgcacgcctctacgccgccgtcgaagccgacattgaagccgctctgcagaaagcagagaaagcttcaaacgagaaaaatagggcatccttagttgctttgaatgccgagattcggaggatcaaggctcgattgctggaggaggtcccaaaattgcagcggctggcgctaaagaaggtcaaagggctttcctcagaagagtttgctgctcgtaatgatttggtccttgcattgccagataggattcaagcaataccggatggaactacaggtgcacccaaacaaggtgggggctggacatcttctgcctctcgcgctgaaatcaagtttgattcagtagatgggcagtttgatgatgagtacttccaacattcagaatcgtcagatcaatttaggcaggagtatgagatgaggaaaattaaacaggatcaaggtctggatatgatttcagaaggtttggatacactgaaaaacatggctcaagatatggatgaggaattcgatagacaagtgccgttgatggatgaaattgataccaaggtcgacaaggccacttctgaccttaagaataccaatgttagacttaaacatactgttaaccagctgagatccagtcggaatttctgtattgatattgttttgttgtgtataattttgggaattgctgcctacttatacaatgtgctgaaaaagtgaaacgatatgaagggttacttcacctgtctctctg

SEQ ID NO: 2607 - DNA, 1168 bp, Triphysaria pusilla
cgattattagcaccacttcctttctgttcaaagaacagcctcttcaagtctttaacctctgttaatttccaagctccgatgactattttttctaataattccaagctatattcaaagtgagttccaaaaaattgcaaggtgaaagatgagcgtgatcgatctattgactcgcgtcgacgcgatctgcaagaagtacgacaagtacgacatcgcggcgaaggaccccaatatctccggcgacgatgccttcgcacgcctctacgcctccgttgagtctgacattgaatccctccttcagaaagcggaggcggcttcaagtgaaaagagtagggcgtccgctgtggcgattaatgccgagattcggagaactaaggctagattggctgaagagatccccaaattgcagagattagccgttaagaaggttaaagggctttcaacagaagaatttgctgtccgcaatgatcttgtccttgcattgcctgctcggattcaggccatacccgatggctctgctgctgcacctaaatcatccgggggctggggtggaacttcagctcctcgaaatgaaatcaaatttgattcagatggacggttcgacgatgaatactttcagaagactgaagagtcgagccagtttaggcaagagtatgaaatgcggaaaatgaaacaggaccaaggattagacgtcatagcagaaggtttggatactttgaaaaacatggctcacgacatgaatgaggaattggaccggcaagttccacttatggatgagattgacactaaggtggacaaggcaacatctgaccttaaaaataccaatgtcagactgaaggacactgttaatcagttgagatctagtcggaatttctgcatcgacattattttgctgtgtgtaattcttggaattgcagcctatctgtacaatgtgttgaggaaataaatgcagttagcacagtatgatggatgaaactccatgacttattcggtattctcttgctccaagtggatcggtttatatatttggttgtataatttgttcttgctatgtgtgtttgtgttctgttgagaaatatgattaactgcattgagtgatttacttatttgagttaaggaacatctgtaacacaagtttataatttattttccttgatcttatttacttaag

SEQ ID NO: 2608 - DNA, 805 bp, Manihot esculenta
atctctcaccgattcacaacatgagcgtgatcgacattttaaccagagttgatgtgatctgcaagaagtacgacaagtacgacctcgaaaagcacaaggatctcaatgtctctggcgacgatgcctttgctcgtctctacgccgttgttgagtctgatatcgaagccgctcttcagaaagcagaccttgcttcaaaagagaaaaataaagcatctgcagttgctttgaacgcggagattcgtcgaacaaaggctaaattgctggaggagatccctaagttgcagagattggccataaagaaggttaaagggctctcaacggaagagcttgctgcccgtaatgatttggtccttgcattaccagataggattcaagctatacctgatggaactgcagctgcttccaaacaaactggaggctggggagcttcagcatcccgtactgaaatcaaatttgattcagatggtcattttgatagtgaatactttcaagaaaatgagacatctagtcaattcaggcaggaatatgaaatgcgtaggatgaagcaggatcaaggtttagatatgatttcagaaggtttggatactctgaaaaacatggctcatgacatgaatgaggaattggataagcaagttcctttgatggatgaaattgacacaaaggtggataaagcaacagctgacctcaaaaataccaatgttaggctcaaggacactgttaaccagttgagatctagcagaaacttctgcattgatattattttgttgtgcataattctgggaattgctgcctatctatacaagta

SEQ ID NO: 2609 - DNA, 1082 bp, Actinidia deliciosa
ctgcgcgggtgcggaggatggcaaccatcagctagcaaacgagagagagagagagagagagagtgcagagatgagcgtgatcgacattctaacgagagtagacgccatctgtcagagatacgacaagtacgacatcgacaagcagaaagacctcaacgtctccggcgacgacgccttcgctcgcctctacgccgccgtcgaggccgacatcgacgtcgcccttcagaaatcggatgcggtatcaaacgagaaaaatagggcctctgcggttgctatcaacgccgagattcgacgcaccaaagctcgattgcttgaggaggtccctaaattgcagagactggcggtaaagaaggttaaggggctttcaacagaagaacttgctgcccgtaatgatttggtccttgccttgccagatagaattgaagccataccagatgggacttcatctgcaactaaacaaactggacgttgggtagcttcagcttctcgcacagaaatcaaatttgattcagatggacggtttgacaacgaatacttccagcaaacagaagagtccagccaattcaggcaagagtatgaaatgcgtaaaatgaagcaggaccaaggactggaagttatagcagaaggtttggatacattgaaaaatatggcacatgatatgaatgaggaaatggataggcaagttcctctaatggatgagattgatgctaaggtggacaaggcagcgtctgaccttaagaatactaatgtgagacttaaggacactgttaaccagctgaggtccagtcgaaacttctgcatcgatattatactgttgtgtataattcttgggattgctgcctatctgtacaatgtattgaagtaagacaataggacggctgctgtttctgcttgtatgattctggctttgtctggtggtgttttatatttattgaagccctgctgtgtgtttgattttcgatttgatttattttcctgatgttataaacctttgctcgtatttggaaccctcaaatgcaacattagacacacggacattttcatactagtaatgcattactatcgtttgcgtaaaaaaaaaa

SEQ ID NO: 2610 - DNA, 1225 bp, Solanum phureja
cctgtaataatatatttttttcaaaatctccagtctgtattatgaagtgttgttttctccatctgcaaagtaaaattcctcttctgtattatttcttgatcggagaaaactgtaatcttcatagaggttgaagaagaagaagaagaacaatgagtgtaattgatattctcacaagggtagactcgatctgtaagaaatacgacaagtacgacatcgataagcaaaaggattccaacgttgccggcgacgatgccttcgctcgtctctattcttcagttgaatccgacatagaaacggctcttcagaaagcggaaacagcttctaatgagaaaaatagggcatctgttgtggcgatcaatgctgagattcggagaactaaagcgaggttactcgaggaggttccgaaattgcagagattggctgtgagaaaggtcaaaggtctttcgggtgaagaacttgctgcccgtaatgatttggttcttgcactgccagatagaataaatgccataccagatggctctgcagctccacccaaacaatctggaggatggagggcttcaggttctcgcacggaaattaaatttgattcagatggacaatttgacaatgaatatttccaacaaactgaagagtcaagtcaattcaagcaagagtatgaaatgcgaaaaatgagacaggcatgtgaccaaggtttggatgtcatagcagaaggattggatactttgaagaacatggccagcgatatgaatgaggagttggatagacaagttcctctgatggatgagattgacgcaaaggtggacagagctaccgcggacttgaagaataccaacgttaggcttaagcatacagttaaccagctgagatctagtcgcaacttttgcattgacatcattttgttgtgcatcattcttggaattgcagcatatttgtacaatgtcttgaagaagtaaaactccgctttagtgcctgttggatcgacttgtatgttggccttcatgattcattttagtttttttcggtgtgtatgcatgtataacaagttattatcggtgattaagcctagcatttgtattctacttgtttgtgtgttttactcgtttgagattgagatgaagttattgttgttttctatctttggacaatgaatttccggttttctatttgtgtacacatattttaatcctacctttatatatgtcactactacattttttaaagactt

SEQ ID NO: 2611 - DNA, 1358 bp, Gossypium hirsutum
atctggagttagttcggtgaacgacgtttacaggggaaacaaacagaaacgaagaaattccaactctttattctctcaattttttcccacatccaaacagctacattgattgaatttgaaactcaaaagaaaaacaaaatgagtgtaatcgatatattgacaagagtagatgtgatctgcaagaggtacgataaatacgacgtcgaaaagcagcgtgaccaaaatgtctccggcggtgatgcttttgctcgcgcttacgccgcagtcgaagccgacattgaatccgctcttgagaaagtggaacttgcttccaaggagaaaagtaaggcatctgctgttgcagtcaatgctgagattcgtcgaaccaaggctcgattgcttgaggaggtccctacgctgcagagattggctgttaagaaggttaaagggatttcaactgaagagatggctactcgtaatgatctggtccttgcattgccggacaggattcaagctatacctgatggaactgctgctactaaacaaactgggggctggatgtcttcagcatcttcagcttctcgtactgcaattaagtttgattcagatgagcgatttgacaacgaatactttcaagaatctgagcagtcaagtcagttcaggcaggagtatgaaatgaggaaaatgaagcaggaccaaggtttggatatgatttcagaaggtttggatactttaaagaacatggctcatgatatgaatgaggaactagataggcaagttcctttgatggatgaaattgacaccaaggtggacaaggcagctgctgaccttaagaataccaatgttagacttaaagatactgtcacacagttgaggtccagccgaaatttctgtattgatatcgtattgctgtgcatagttctgggaatagctgcctatttgtacaatgttctgaagaagtgaagtgataaaaggataaatctatgagtttcccttatatgttatcggctttttctggtaatgtctttcatttggaggggcttgttctcgtgcttgatcttgtatttgatttgtttcattagtgggaatcattgtttgctctgggaaaaattgagtttatctatctctacaaattcaagacaaccgtaaaatgtttgtatatcatggagtttgtaaaggtttgaccatatttgtttaaaaggaggtacttctgccttcatggctcttctttacaatacatagctaacagatcaatcattaccacataagcagacaatttcaggttaagacaaaagttgtgttgcgtagacagatacacaaatgctttgaaccctctgcggtggatgcctcggaaaccatttcggaatggagatggaggt

SEQ ID NO: 2612 - DNA, 1208 bp, Gossypium raimondii
gcaggctgtagttcattttcattgtctttttattttttatgaaactgttttaatttttgaatctctggagtctggaggttggttcagttaccaatattaacggcggaaaaaaagaaatcaaattcttttcttttcttttcttttcatccaaacagctacatttatcggtagactcatcgaagctaattagacaaaagaagaagaagaagaggaagaagaagaaaatgactgtcattgatatattgaccagagtagatgtgatctgtaagaagtacgacaaatacgacgtcgaaaagcagcgagaccaaaatatctccggcgacgatgcctttgctcgccaatacgctgctattgaagccgacattgaatccgctcttcaaaaagcggagcttgtttccaaggagaaaagtaaggcatctgctgttgcggtgaatgctgagattcgtcgaaccaaggctcgattgcttgaggaggtccctaaactgcagaggttggctgttaagaaggttaaagggatttcaaccgaagagatgactgctcgtagtgatctggtcctcgcattgccggataggattcaagctatacctgatggaactgctgctcctaaaactggaggctggatgtcttcagcaccttcagcttctcgtactgaaattaagtttgactcagatgggcgatttgataatgaatactttcaagaatctgagcagtcaagtcaattcaggcaggagtatgaaatgcgaagaataaagcaggaccaaggtttagatatgatttcagaaggtttggatactttaaagaacatggctcatgatatgaatgaggaattggataggcaagttcctttgatggatgaaattgaaaccaaggtggataaggcagctggtgacctaaagaataccaatgtcagacttaaacacactgtcactcagctgagatccagccgaaatttctgcatcgatattgtcttattatgcatagttttgggaattgctgcctatttatacaatgttttgaagaaatgaagcgataaaaggataagtcgatcctttcccttatgtgctgtcatcttttcttgcattgtcttccatcttgagggcttgctaaggtggtcgatctcgtatttgatttgtttcttttgtgggaatcattggtcacactggcataatgtgagtttatctttctatataaattcgacaaccgtaaaa

SEQ ID NO: 2613 - DNA, 952 bp, Medicago truncatula
gttggtattgttaccgtcgacagttgttccttcgatgaggctggacgatgtttctatgttgatagtaacaacaatgacgacgttatcaacctctacgcactcatctcttactgttagaggatcgcatttcgatcccaaagtaacaacaacagcatgagcgttatcgaaattctaacccgagtcgataccatttgtaaaaaatacgacagatacgacgtcgttaaacataacgatgccaatgtctccgccgacgacgcattcgccaaactctacgccattttcgacgccaacatcgaggccgcgctacagaaagcagaaactgcttcaaaggagaaaaatagggcttcaactgtagcgattaatgctgaaattcgtcgtactaaggctaggttactggaagagattcccaagttgcagaggttggctgtaaaaaaggtaaaggggctttcgttgcaagaattttccactcgtaatgatttggttctttcattgccggagagaatccaagcaatcccagatggcactcctgctgcacccaaacaaactggaggttggggagcttctgccacacgtcctgaaattaaatttgattcagatggccgactggatgatggatactttgaaccaaccaaagaatcaagtcagtttaggcaggagtatgaaatgcgtaaaatgaaacaggcaagtttggatgtgattgcagaaggattggatactttgaaaaacatggcacacgatatgaacgaggaatttgataggcaagttccactgatggatgagattgatactaaggtagacaaggcatcttctgaccttaagaataccaacgttagacttaaagacacagttacccagcttcgatccagtcgaaacttttgtattgatattgttttgttgattataattttgggaatcgctgcctatttgtacaagtaaggcttctttatctctt

SEQ ID NO: 2614 - DNA, 1249 bp, Solanum lycopersicum
acctgtaataattttttttttcaaaatctccagtctgtattatgaagtgttgttttttccatctgcaaagtaaaattcctcttccgtactatttcttgatcggagaaaactgcaatcttcacagaggttgaagaagaagaagaagaatgagtgtaattgatattctcacaagggtagactcgatctgtaagaaatacgacaagtacgacatcgacaagcagaaggattccaacgttgccggcgacgatgccttcgcacgtctctattcttctgttgaatccgacatagaaactgctcttcagaaagcggagacagcttctattgagaaaaatagggcatctattgtggcgatcaatgctgagattcggaggactaaagcgaggttacttgaagaggttccgaaattgcagagattggctgtgagaaaggtcaaaggtctttcgggtgaagaacttgctgcccgcaatgatttggttcttgcactgccagatagaataaatgccataccagatggctctgcagctccacccaaacaatctggaggatggagagcttcaggttctcgcacggaaattaaatttgattcagatggacaatttgacaatgaatatttccaacaaactgaagagtcaagtcaattcaggcaagagtatgaaatgcgaaaaatgagacaggaccaaggtttggatgtcatagcagaaggattggatactttgaagaacatggccagcgatatgaacgaggagttggatagacaagttcctctgatggatgagattgacgccaaggtggacagggctaccgcggacttgaagaataccaacgttaggcttaagcatacagttaaccagctgagatctagtcgcaacttttgcatcgacatcatcttgttgtgcatcattcttggaattgcagcatatttgtacaatgtcttgaagaagtaaaactccgctaaagtacctgttggatcgacttgtatgttggccttcatgattcatttttgttttttttgggtgtgtgtatgcatgtataacaagttattatcggtgattaagcctagcatttgttttctacttgcttgtgtgttttactagtttgagattgagacgaagttatcgttgttttctatctttagacaacgaattttctggtttctacccaatgttaatgtacacatattttaaccatacctttatatatgtcactatttgactcttcaaagcaaagtagactttattcctatcttttt

SEQ ID NO: 2615 - DNA, 1223 bp, Vinca minor
tttccaaatttcaggttctttctaaaaactctttaaaatcccaacaactcaaaacattttgattttcttcttccattagtgatcttccaccacaatcagaatcaaaatcaagaacagaataaagaaggagaagaaaaaatgagcgttatagacatcctcactcgtgtagattcgatctgtaagaaatacgatcgatacgatattgataagcaaaaggattctaatatctccggtgatgatgcctttgctcgtctctattcctcaatcgaagaagatatcgaggccgcacttcagaaagcggaaacggctgggaatgagaagagtagggcatcagctgtggcgatcaatgccgagattcgacgtactaaggccaggttgttagaggaacttccaaaattgcagagattagctattaagaaggttaaaggactgtcaacagaagaacttgttgcacgtaatgatcttgtccttgcactgcctgataggattcaagccatcccagatggtgctgctgctccacccaagcaaacaggaggttggggagcttctgcttctcgtcaagaaattagatttgattcagatggacggtttgacggtgaatactttcagcaaactgaagagtccagtaatttcaagcaagagtatgaaatgcgaaaaattagacaggatcaaggcttagaggtcataggagaaggtctggatacattgaagaacatggcccatgatatgaacgaggaattggatagacaagttccattaatggatgaaattgacaccaaggttgacaaggctacctcggacctgaagaataccaatgtcaggcttaagcacactgttaatcagctgagatctagtcgaaatttctgtattgatatcatcttgttgtgcattatattgggaattgcagcttacttatacaatgtattgaagaagtgaaaagaatttgaagagatgttgatgtactttgtatgatgctggtcttttggtattgctttctttgtatcaattgaggtctttggttatgctttattgtggagttggtttgttaagtgcttgaattgcttatccgataatgaatgtaattgagacggctgtgggataacagatttcaacatagcacatccttgtattcgtattcatatggtgttctacccatttacgtgtttgcctcgtttgctgctgttatactgttgcaaattatcattatgatttttttacaatta

SEQ ID NO: 2616 - DNA, 1078 bp, Ambrosia trifida
aggaacactagctatctccaacactcaacaggctggtctacttttttcacaaacaatatattcccaaattcaaacaatttccagtgcttaaattcgaattgaagtaaagaagaaatcacagtaacaatgagtgtgatcgaactattaacacgagtcgacgcaatatgcaagaagtacgacaaatacgacgtcgaaaagcagagagatctcaacatctccggtgacgacgcctttgctaggctctacgccgccgtagagtccgacattgaatccgctcttcagaaagctgagacagctaagaatgagaaaaatagggcttctgtggtggcgattaatgcggagatacgacgcaccaaggctaagttactggaagagattcctaagttgcagcgattggctatgaagaaggtaaaaggacttgcaccggaagagtttgcagcccgtaatgatttggttcaggcacttcctgataggattcaagcaatacctgatggtggtgctgctgcacctaaacagaccggaggttgggccgcttcagcatctcgtacgaataatatcaagtttgattcagatggacgatttgacgatgaatacttccagcaaagtgaagagtcgagccagttcaggaacgaatatgaaatgagaaagatgaagcaggatcaaggcttggatgtgatatcagaaggtctagacactttgaaaaacatggcacaagatatgaatgaggaagtagacaggcaggttccattaatggatgaaatagatgacaaggtggataaagcgacttcagaccttcggaatacaaatgttagactcaagcacactgttaatcagctgaggtctagtcgaaacttctgtattgatattatattactgtgtataattctgggaattgcagcctacttatacaatgttttgaagtgaaagtttgtgaagataatgaagtctgcattcagtttacccttgtgataatcagcttctggtgtgttcgttattgtgctttatatgtttattaatatacaacttatttctataattttcaagtataataacatgtttcttttccactaaaaaagaa

SEQ ID NO: 2617 - DNA, 1290 bp, Gossypium hirsutum
ggttggttccgttaccaatattaacggcgaaagaaaagaaatcagattcttttcttttcttttcttttcttttcatccaaacagctacatttatcggtagactcatcgaagctaattagacaaaagaagaagaagaagaaaatgactgtcattgatatattgaccagagtagatgtgatctgtaagaagtacgacaaatacgacgtcgaaaagcagcgagaccaaaatatctccggcgacgatgcctttgctcgccaatacgctgctattgaagccgacattgaatccgctcttcaaaaagcggagcttgtttccaaggagaaaagtaaggcatctgctgttgcggtgaatgctgagattcgtcgaaccaaggctcgattgcttgaggaggtccctaaactgcagaggttggctgttaagaaggttaaagggatttcaaccgaagagatgactgctcgtagtgatctggtcctcgcattgccggataggattcaagctatacctgatggaactgctgctcctaaaactggaggcgggatgtcttcagcaccttcagcttctcgtactgaaattaagttcgactcagatgggcgatttgataatgaatactttcaagaatctgagcagtcaagtcaattcaggcaggagtatgaaatgcgaagaataaagcaggaccaaggtttagatatgatttcagaaggtttggatactttaaagaacatggctcatgatatgaatgaggaattggataggcaagttcctttgatggatgaaattgaaaccaaggtggataaggcagctggtgacctaaagaataccaatgtcagacttaaacacactgtcactcagctgagatccagccgaaatttctgcatcgatattgtcttattatgcatagttttgggaattgctgcctatttatacaatgttttgaagaaatgaagcgataaaaggataagtcgatccgttcccttatgttctgtcatcttttcttgcattgtcttccatcttgagggcttgctaaggtggtcgatctcgtatttgatttgtttcttttgtgggaatcattggtcacactggcataatgtgagtttatctatatattatgtgatttacagagatggattatcacattattttaaaatgatacttctgctttcattgctcttcatccagatatggacattgttatcatactctggaaagatcatatagtgcattgttttgtgtatttcttcatccagatatggggcattgttaacgttatttaaattggcctatatatatata

SEQ ID NO: 2618 - DNA, 1125 bp, Guizotia abyssinica
gacatatgcccgggcaattcggcccttacggccgggggtccagattctttcataaacgagatcttcccaaattcaaacagttttcattgcaatcttcaaaatcaaccttgcgaaatccgaattgaagtaagaacttatcacaggaaggatgagcgtaatcgaaattttaactcgagttgatgcaatttgcaagaagtacgacaaatacgatatcgagaagcagagagatcttaatgtcgccggtgacgacgcctttgctaggctctatgccgccgtagaatctgacatcgagactgctcttcagaaagcggagacagctaagaatgagaaaaatagggcttcggtggtggcgattaatgctgagatacgtcgcaccaaggctaagttactggaagaagtccctaagttgcagcgattggctatgaagaaggtgaaaggacttgctccggaagagtttgcagctcgtaatgatttggttcaggcacttcctgataggattcaagcaatacctgatgggggtgctgctgcacccaaacagactggaggttgggcagcttcagcatctcgtacaaataatatcaagtttgattcagatggacgatttgatgatgaatacttccagcaaagcgaagagtcaagccaattcaggaatgaatatgaaatgagaaagataaagcaggatcaaggcttggatgtgatagcagaaggtctagatactttgaagaacatggcgcaagatatgaatgaggaaatagacaggcaagttccattgatggatgaaatagatgacaaggtggataaggcgacttcagaccttaggaatacaaatgttagacttaagcacactgttcatcagctgaggtctagtcgaaacttctgtattgatatcatattactgtgtataattctgggaattgcagcctatctgtacaatgttttgaagtgagagtttgtgaacataatgaaatctgcattcaatgtactcttgtgatgatcaacttctggtgtgttttctagttatgcatgccttaaatgtttactatgcgacatatttctttctttttttaaagataactacgtattttgtttccactggcttattaatataatggaaaaaaaaaggcc

SEQ ID NO: 2619 - DNA, 1127 bp, Helianthus annuus
ccctattgatacggcacacgtatttctcattcgtaaacatgaggggttatttttgaacaacttttacagttgaaatcgaacccaaaaactggctatcaacaggctggtctagctatttcccaagatctcctcaaattcaaacatcttcagtgatttcttcaaatcaaactcacgaaactcgaattgaactaagaacaaatcacaggaacaatgagtgtaatcgaaattctaactcgagttgatgcaatttgcaagaaatacgacaaatacgacgtcgaaaagcaaagagatctcaacatctccggtgacgacgccttcgctaggctctacgccaccgtagaatccgacattgaaaccgctcttcagaaagcggagacagctaagaatgagaaaaatagagcttctgtggtggcgattaatgcggagatacgacgcactaaggctaagttactggaagaagttcctaagttgcagcgattggctatgaagaaggtgaaaggacttgctccggaagagtttgcagctcgtaatgatttggttcaggcacttcctgataggattcaggcaatacctgatgggggtgctgctgcacccaaacagaccggaggttgggctgcgtcagcatctcgtacgaataatatcaagtttgattcagatggacgatttgacgatgaatacttccagcaaagtgaagagtcaagccagttcaggaatgaatatgaaatgagaaagatgaagcaggatcaaggcttggatatgatatcagaaggtctagatactttgaaaaacatggcacaggatatgaacgaggaagtagacagacaggttccattgatggatgaaatagatgacaaggtggataaggcgacttcagaccttaggaatacgaatgttagacttaagcacactgttcatcagctgaggtctagtcgaaacttctgtattgatattatattactgtgtataattctgggaattgcagcctacttatacaacgttttgaagtgaaaatttgtgaaggtaatgaaatttgcattcaatgtacacctttgatgatcaacttatgctttatatgttcattacacaacttatttctatcattttcaagtataataacatatatcgtt

SEQ ID NO: 2620 - DNA, 1214 bp, Coffea canephora
cggccgggggctctctctctaactctaacttcaatcctgacactagttcttcgtcggtgatcttatcagaagaaaaggggaaaagagccaaaaacaattttgattgttagaagatgagtgtgattgaaattctcactcgcgtcgacgcgatctgtaagaagtatgacaagtacgacatcgacaagcagaaggacgccaacatcgccggcgacgatgccttcgctcgcctctactctgccatccaatctgacatcgaagccgctcttcagaaagctgaaacagctgccaacgagaagaatagggcatcggcagtagccatcaatgctgagattcgtcgaaccaaggcgaagttactggaggaggttcccaaactccagagattggctgtcaagaaggttaaggggctttcgggtgaagaacttgctgctcgtaatgatctggtacttgctcttccagataggattcaagccataccagatggtgctgctgcagcacccaagcaatctggaggctggggagcttctgcttctcgtacagaaataaaattcgattcagatgggcgttttgatagtgattattttcaacaaactgatgaatcaaacaacttcagacaagagtatgaaatgcggaaagtgagacaggatcaaggtttggaagtcatatcagaaggtttggatacactgaaaaacatggcccacgatatgaatgaggagttggatagacaagttcctttaatggatgagattgacaccaaggtagataaagcgacatctgacctgaagaatacaaatgtcagacttaaggatactgtaaatcagctgagatctagtcgaaatttctgtattgatatcattttgttgtgcattattttgggaattgcagcctacttatacaatgtactaaagaagtgaaagtgcttgaaaagtttggacgctaatgtataatgttggtctttggatttcccttgcatcaattggaggtgtttttgcttcagcttggttgtagagttggaaatattttttaagctttttatgtttgcttttaatgcatttgttggctgttgcatattgatttcggcatagagattaattgtaatagcctataatacctactaaggctctagtctttctacttgaagtttatttcctgacttgtatgttcttaaaatttatgaattctgacaaacatgagttgagctggttcaaaatttatga

SEQ ID NO: 2621 - DNA, 1142 bp, Cucurbita pepo
ataattggaagaaattctgtttagacagcttctggagatatctctcaccgatctcaccgctgtaagtcaaccgaaagcctaccggagcacggaggcgaagaatccaagatgagcgtcatcgaccttttgaccagagtagacgcgatctgccagaagtatgacaaatacgacgtagagaagcagagggatctcaatgtctccggcgatgatgcctttgctcgactttatgctactgtcgaagccgacattgaagctgccctccagaaagcggaggatgcttccagagaaaagaatagggcgtcggtggtggcgttgaatgcggagattcgtcgtactaaggctcgattactggaggagatccccaagttgcagagattggctctaaagagggtgaaggggctatcaactgaagatctcaccactcgaaatgatttggtgcttgcattgcccgataggattcaagccataccagatgggactgctacttccacgaagaagaatgggggttggacatcctctgcttcacgcactgaaataaaatttgactcagacgggcgatttgatgatgagtacttccaacacactgaggagtcgagtcagttcaggcaagagtatgaaatgcggaaaatgaagcaggatcaaggattggacatgatatcagaagggttggacactctgaagaacatggctcatgatatgaatgaggaaatagacaggcaagttcctttgatggacgagatcgacactaaggtggacaaggctgcatctgatcttaagaataccaacgtcagattaaagcacacagttaaccagctaaggtccagcagaaatttctgtattgatatcattttattgtgcataatcttgggcattgctgcctacctatacaatgtgttgaagaaatgagccaacagagggaaaatcttcttgctaagatgagtatcaatattttagcacattatctgatggtgtttgtgatgtttactaatatttgtatgcatattctttttaaaacaagtcgctgcattggcaaatctttgttatcatgcttgattattgaatgttgcactcatcaaatcaacctctcattactttggtacttagaaatgtgagctctggtctccatgatggattatttagct

SEQ ID NO: 2622 - DNA, 945 bp, Cucumis sativus
acttgcccttgaaacggacgccctccttgtcgtccgccttcccgccacactttggatttggtgttgaacttgttttctgcttatattttgagattgtcggaaccactttcaccgccgttagtcaccggaaacctaccggagcgcggaagctaaggatcgaagatgagcgtgatcgaccttttgaccagagtagatgcgatctgccagaagtacgacaaatatgacatagaaaagcagagagatctcaatgtctccggcgacgatgccttcgctcgtctctacgccaccgttgaagctgacattgaagccgctctacagaaagcggaggatgcttctaaagagaagaatagggcatccgtggtggcgttgaatgcggagattcgtcgtacgaaggctcgattactggaggaagttcccaagttgcaaaggttggctgtaaagagggttaaagggctatcaactgaagatcttaccactcgaaatgatttggtgcttgcattaccggatagaattcaagctataccagatggaactgtgactaccacgaagaataatgggggctggacatcctcagcttcacggactgaaatcaaatttgactcagatgggcggtttgatgatgagtacttccaacacaccgagcagtccagtcagttcaggcaggagtatgaaatgaggaaaatgaagcaggatcaaggattggacatgatatcagaagggttagatactctgaagaatatggcacatgatatgaatgaggaaatagacaggcaagtccctttgatggacgagattgacactaaggtggacaaggctgcatctgaccttaagaacaccaacgttagattaaaggacacagttaaccagctaaggtccagcagaaatttctgtattgatatcattttgttgtgtataatcttggggattgctgcctatctatacaag

SEQ ID NO: 2623 - DNA, 1221 bp, Helianthus annuus
taaaactagtaacaacttatatacaggctggtccagttactaacgaacataccatcattcttccccaaattcaaaccctaatttgcactttcttcgaaatcaaacttgtgaaattcgaatcgaagtgaagatcaatcaaataaacgatgagtgtaatcgaaatattgactcgagtcgatgcaatctgcaagaagtacgacaaatacgacgtcgaaaagcagagagatctcaacatttccggtgaagatgcttttgcgaggctgtacgctacagtagaatctgacattgagactgctcttcagaaagctgagacggctaaaaatgagaagaatagggcttcggttgtggcaattaatgctgagattcgacggactaaggcgaagttgctggaagaagttcctaagttgcagagattggctatgaagaaggtaaaagggctttctccagaagagtttgcagctcgtaacgatctggttcaggcacttcccgataggattcaagcgatacctgacgggggtgctgctgcaccaaaacagactggaggctgggcagcttcagcctctcgtacaaataataatatcaagtttgattcagatggtcgatttgatgatgaatacttccagcaaagtgaagagtcgagccagttcaggaatgagtatgaaatgagaaaaatgaaacaggatcaaggtttggatatgatatcggaaggtctagatactttaaaaaacatggcacaagatatgaacgaggaagtagacaggcaagttccattgatggatgaaatcgacgacaaggtggataaggcgacttctgaccttaggaataccaatgttagacttaagcacactgttcatcagctgaggtcgagcaggaacttctgtattgatattatattactgtgcataattctgggaattgcagcctacttatacaatgttttgaagtgaggattttgaacataagaaatctgcatatggtttgctcttgtgatgattgacttctggtgtggtagctagttatgtatgttcttgcacttacaacttgaagttatgtttattacgcgacatatttctatctttttttaacataactacatatttcattgagaatctaccaagcactatgtgtatgtataatatgcgtttctcgtgattcttttatttaaaactggtttcttgtgattctttatgtataatataccatgaacatgcctttgcaaat

SEQ ID NO: 2624 - DNA, 1097 bp, Cynara scolymus
gggaagagagataccatcattcttctcaattcaacagttttctgcggtctcttcaaaatcgaacttgcgaaatctcaattggagtaagaactgatcacaggaaagatgagcgtgatcgaaattttaactcgagttgatgcaatttgcaagaagtacgacaagtacgatgtcgaaaagcagagagatcttaatgtatctggtgacgacgcctttgctcggctctacgccgcagtagaatctgacattgagagtgctctccagaaagcggagactgctagcaatgagaaaaatagggcttcggtggtggcgattaacgctgagatacgacgcaccaaagccaagttactggaagaaatccctaagttgcagcgattagctatgaagaaggtaaaaggacttgctccagaagagtttgcagctcgtaatgacttggttctcgcacttccggataggattcaagcaatacctgatgggggtgctgctgcacccaaacagtctggaggctgggcagcttcagcatctcgtacacaaatcaaatttgactcatcagatggacgatttgatgatgaatacttccagcaaaccgaagagtctagccaattcaggaatgaatatgaaatgagaaaaatgaagcaggatcaaggcttggaaatgatatcagaaggtctagatacattgaaaaacatggcgcaagatatgaacgaggaagtagacaggcaggttcctttgatggatgaaatagatgacaaggtggataaggcaacttcagaccttaggaataccaatgttagacttaaacacactgttaatcagctgagatctagtcggaatttctgtattgacattatattgctgtgtgtaattctgggaattgcagcctacttatacaatgtgttgaagtgaaaatttgaacataatggaatctcatctggtttgctcatgtgatgatggactggtttcctctgagttatgtatgttcttgcatttagatttgaacttctcttgtcattttcatttatgctttgtatgtctattatgcgatatatttctatcattgttcaaatataactacgtatgccatttttactttcttattg

SEQ ID NO: 2625 - DNA, 937 bp, Solanum lycopersicum
ctttaatctcaaacctcaaatttaactaaacactttcccatggctcctgctccatctgagacaataactaccgatgtatcatcggaaaacaataatgttaccatcactgggaagatatacacacgagttcgtcttgctacgaaatctgatttgtctcatatatacaaattgttttaccaaatccatgaataccataacttcactcatttatacaaagctactgagtcctccttagccaacttgctctttaaagaaaaccctcttccacttttctacggtccatccgtacttctacttgaagtctctccaacaccttttgacgaacctaaaaatactacagacgaagggttcaagcctatccttacaacgtttgaccttaaattcccagtcgtagaaggagaagttgaggaattccgatccaaatatgatgataagagtgatgcttacattgcaggatatgctttcttttacgcgaattattcgtgtttcaatgacaaacctggattctattttgaaagtctttacttcagggagagttataggaagttgggaatggggaaattgttgtttggaactgttgcatccattgctgccaacaatggattcgtatcagtagagggaataatcgcagtatggaataagaagtcatatgatttttacataaatatgggagttgaagtatttgatgagtttaggtatggcaaattgcatggtgaaaatcttcaaaagtatgctcataactaggacataaataacgaaggcagctgttagctactgtgtgttttcttttaataaaaatagtgaaagttcaattcatacatttcttatttgtaattttgtaaaagcagaatgctcattaaatttgtatttgaaaattttaaattgataattatcacattaaacccctctattcaatttacatgatcttcttcttctt

SEQ ID NO: 2626 - DNA, 927 bp, Solanum lycopersicum
acacaatattatcccattactaaacctttcaacatttcttttatcttaaatttcaatcctctcaaatttaactaaacactttctcatggctcctgctcttcaacaatcaataaccagcgatgcatcatcggacgttaccatcactggaaagatatacacacgagtccgtcttgctacaaaatctgatctttctcatatatacaaattgttttaccaaatccatgtataccataactatactcatttatacaaagctactgagtcttccttagccaatttgctctttaaggaaaaccctcttccacttttctacggtccatcagtacttctacttgaagtctctccaaccccttttgacgaacctaaaaatactactgacgaagggttcaagcctgtccttacaacgtttgaccttaaattcccagtcgtagagggagaagttgaggaattccgatccaaatatgatgataagagtgatgcttacattgcaggatatgctttcttttacgcgaattattcatgtttcaatgacaagccaggattttattttgaaagtctttacttcagagagagttatagaaagttgggaatggggaaattgttgtttggaacagtttcgtccattgctgcggacaatgggttcgtatcagtcgatggaatagtagcagtttggaataagaagtcatatgatttttacataaatatgggagttgaaatatttgatgagtttagatatgggaagttgcatggtgaaaatcttcaaaagtatgctcataacaagggggaaattgaggaagagacctgttagtggtgttgttttattcttaaagaaattgtgtaatttatcaatttcttcatattttcttttattaaaagaagttgtaatatctttgtggttgaaaaatattaaaattgattatgtattgt

SEQ ID NO: 2627 - DNA, 939 bp, Solanum lycopersicum
acacacaatattatcccattactaaacctttcaacatttcttttatcttaaatttcaatcctctcaaatttaactaaacactttctcatggctcctgctcttcaacaatcaataaccagcgatgcatcatcggacgttaccatcactggaaagatatacacacgagtccgtcttgctacaaaatctgatctttctcatatatacaaattgttttaccaaatccatgtataccataactatactcatttatacaaagctactgagtcttccttagccaatttgctctttaaggaaaaccctcttccacttttctacggtccatcagtacttctacttgaagtctctccaaccccttttgacgaacctaaaaatactactgacgaagggttcaagcctgtccttacaacgtttgaccttaaattcccagtcgtagagggagaagttgaggaattccgatccaaatatgatgataagagtgatgcttacattgcaggatatgctttcttttacgcgaattattcatgtttcaatgacaagccaggattttattttgaaagtctttacttcagagagagttatagaaagttgggaatggggaaattgttgtttggaacagtttcgtccattgctgcggacaatgggttcgtatcagtcgatggaatagtagcagtttggaataagaagtcatatgatttttacataaatatgggagttgaaatatttgatgagtttagatatgggaagttgcatggtgaaaatcttcaaaagtatgctcataacaagggggaaattgaggaagagacctgttagtggtgttgttttattcttaaagaaattgtgtaatttatcaatttcttcatattttcttttattaaaagaagttgtaatatctttgtggttgaaaaatattaaaattgattatgtattgtactatagtgt

SEQ ID NO: 2628 - DNA, 913 bp, Solanum phureja
atcatacaataaatatcccattactaaaatacttcatctcactcctttcgccttaaacaactatggctcctgctcttcaacaatctgaagcaataattaccaccaactcatcatcggaaaacaacaacgttaccatcactggaaagatatacacacgagttcgtcttgctacgaaatctgatctatctcatatataccaattgttttaccaaatccatgaatatcataactatactcatttatacaaagctattgggtcccccttagctaacttgctctttaaagaaaaccctcttccacttttctacggtccatccgtacttctactcgaagtctctccaaccccttttaacgaacccaaaaataccacggacaaagggttcaagcctgtccttacaacgttcgaccttaaattccctgtcgttgaaggacaagttgaggagttcaggtccaaatatgatgataagagtgatgcttacatagcgggatatgctttcttttacgcgaattattcgtgcttttatgacaagcctggattttattttgaaagtctttacttcagagagatttatagaaagttgggaatggggagtttgttgtttgggacagttgcatctatttattgctgcaaacaatgggttcgtatcggtagagggaatagtagcagtttggaacaagaaatcatatgatttttacataaatatgggagttgaaatatttgatgagtttaggtatggaaaattgcacggtgaaaatcttcaaaagtatgccgataagaaggagaaaaatgaagaaggaagttgttagtgtgtttttcttttatatgttgaaagttcaattcatacatttctatttgtaatcttgtaaaagcagaatgctcattacatttgtattaattctaaattggttatca

SEQ ID NO: 2629 - DNA, 1175 bp, Solanum lycopersicum
acatgcacatttgagttgatctccagcaaccaaacaaataattacgaaggggacgaaatctccactataaataaccattactattatctttacattcaatagtatcccattacaaataaaaccgtcaccctaatcctttgccttaatatttcatctaattcaccacacgaccatgactccttctcttcaacagccaattccatctgactcactaatcaccgatgcatcatcgaacgttaccatcactggaaagatatacacacgagttcgtcttgctacgaaatctgatctttctcatatatacaaatgattttaccaaatccatgaataccataactatactcatctatacaaagccactgagtcttccttagccaatttgctctttaaagaaaatcctcttccacttttctatggtccatccgtacttctacttgaagtctctccaaccccttttgacgaacccacaaacgaagggttcaagcctgtccttacaacgtttgaccttaaatttcccgtggtggaaggacaagttgaggagtttcggtccaaatatgatgataagagtgatgcttacatcgcgggatatgctttcttttacgcgaattattcatgtttcaatgacaaacctggattttattttgagagtctttactttagggagagttatagaaagttgggaatgggaaaattgttgtttggaacagtttcgtccattgctgcggacaatgggttcgtatcggtcgatggaatagtagcagtttggaataagaaatcatatgatttttacataaatatgggagttgaaatatttgatgaatttaggtatggcaaattgcatggtgaaaaccttcaaaagtatgctcataacaaggacaaaaatgacgaagaaagctgttagcaatagtgaaagttcaatccatacatttctattcgtaattttgtaaaagcaggatgctgatcatcatttatcagtctgtatttgaaaattttaaattgattatcacattaaaataatctctatgattcatttaatttcatgtgacacaaaggaaaatcgcggaagagagtatgttttgtcaaaacctattgtaaagtccaaattcatacgtaagtcgtaatgacgtccatactcgtattcttatccaatttaatacacacaaatgtctctattt

SEQ ID NO: 2630 - DNA, 944 bp, Solanum phureja
aaaaccttcttcatagtcctttcaatatttcctacactcttttcttacctagctcttcaagcttgcctcattaccatggcttcatctctatctgaaacaataaccaccgacgatgcatcatcggaaaacaacaacgttaccatcaccggaaagatatacacaagacttcgtctcgctacgaaatccgatctgtctcatatataccaattattttaccaaatccatgcataccataagaacactcatttatacaaagctaccgagtcctccttagctaacttgctctttaaagaaaaccctcttccacttttctacgggccatctgtacttctactcgaagtctctccaacaccttttaacgaaccacggacgaagggttcaagcccgtccttacaacgttcgaccttaaattccctgtggtggaaggacaagttgaggagttccaatcaaaatatgatgataagagtgatgtttacatagcgggatatgctttcttttacgcgaattattcgtgcttttatgacaagcctggattttattttgaaagtctttacttcagagagatttatagaaagttgggaatggggagtttgttgtttgggacagttgcatctattgctgccaacaatgggttcgtatcggtagagggaatagtagcagtttggaataagaagtcatatgatttttacataaatatgggagttgaaatttttgatgagtttagatatggcagttgcatggtgaaaatcttcaaaagtatgctgataacaaggacaaaaatgatggaggaaactgataaggagaaggtggaatttatcatattgtatttgtaatgttttaaaagcagaatatgctcattatcactgtgtattaatttgtatttgatttagttaatttcacactaaaaagcacctccatacgccgtgcaaactccaaaaaaaaaa

SEQ ID NO: 2631 - DNA, 988 bp, Solanum phureja
atatatatatatatatatatggttatcttattttaggatatatagcaagtagcagcccctaataatgataactagaatgcacacttgagtttcctccaccaaccccactaactaaataagttttataaaataattttaaaaaccactactccactataaataaccattatatatcctaaaatctttttaaacaatatcccattaattacaaaaccttcttcatagtcctttcaatatttcctacactcttttcttacctagctcttcaagcttgcctcattaccatggcttcatctctatctgaaacaataaccaccgacgatgcatcatcggaaaacaacaacgttaccatcaccggaaagatatacacaagacttcgtctcgctacgaaatccgatctgtctcatatataccaattattttaccaaatccatgcataccataagaacactcatttatacaaagctaccgagtcctccttagctaacttgctctttaaagaaaaccctcttccacttttctacgggccatctgtacttctactcgaagtctctccaacaccttttaacgaaccacggacgaagggttcaagcccgtccttacaacgttcgaccttaaattccctgtggtggaaggacaagttgaggagttccaatcaaaatatgatgataagagtgatgtttacatagcgggatatgctttcttttacgcgaattattcgtgcttttatgacaagcctggattttattttgaaagtctttacttcagagagatttatagaaagttgggaatggggagtttgttgtttgggacagttgcatctattgctgccaacaatgggttcgtatcggtagagggaatagtagcagtttggaataagaagtcatatgatttttacataaatatgggagttgaaatttttgatgagtttagatatggcagttgcatggtgaaaatcttcaaaagtatgctgataacaaggacaaaa

SEQ ID NO: 2632 - DNA, 923 bp, Solanum phureja
aaaaacttcatcctactcctttcaacaatatctcttttgccttaaaacaactatggctcctgctcttcaacaaccaactccatctgaaacaataaccatcgatgcatcatcggaatccaacaatgttaccatcactggaaagatatacacaagagtccgtctggctacgaaatctgatctgtctcatatataccaattgttttaccaaatccatgaataccataactatactcatttatacaaatctaccgagtcctccttagccaatttgctttttaaagaaaatcctcttccacttttctacggtccatcggtacttctacttgaagtctctccaaccccttttaacgaacccaaaaataccacaaatgaagggttcaagcctgtccttacaacgtttgaccttaaattccctgtggtggaaggacaagttgaggagttccgatcaaaatatgatgataagagtgatgcttacattgcaggatatgctttcttttacgctaattattcatgtttctatgacaagccaggattctattttgagagtctctacttcagagagagttatagaaagttgggaatggggaaattgttgtttggaacagttgcatccattgctgccaacaatgggttcgtatcggtagagggaataatcgcagtttggaataagaagtcatatgatttttacataaatatgggagttgaaatttttgatgagtttaggtatggcaagttgcatggtgaaaatcttcaaaagtatgctgataacaagggggaaattaaggaagcgaactgttagttttttttttctttccctttttagtgctttgttgtgcaatttatcaatttctatttgtaattttgtaaaagcagaaagcttattacatttgtatttgaaaattttaaattggtaattatcacat

SEQ ID NO: 2633 - DNA, 959 bp, Solanum lycopersicum
tgtctcattaattacaaaaccttcttcatagtcctttcaatatttcctacactctttattttttccctagttcttcaagcttgccttattaccatggcttcatctttatctgaaacaataaccaccgatgcatcatcggaaaacaacaacgttaccatcactggaaagatatacacaagacttcgtctcgctacaaaatctgatctttctcatatataccaattgttttaccaaatccatgcataccataacaacactcatttatacaaagctactgagtcttccttagccaatttgctctttaaggaaaaccctcttccacttttttacggtccatccgtacttctacttgaagtctctccaaccccttttaacgaacccacaaacgaagggttcaagcctgtacttacaacgttcgaccttaaattccccgtggtggaaggacaagttgaggagttccgatccaaatatgatgataagagtgatgtttacatcgcggggtatgctttcttctacgtgaattattcgtgcttttctgataaacctggattctattttgaaagtctttactttagggagagttatagaaagttgggaatggggagtttgttgtttggaactgtcgcgtctattgctgccaacaatggattcgtatcggtagagggaatagtagcagtttggaataagaaatcatatgatttttacgtaaatatgggagttgaaatatttgatgagtttaggtatggaaaattgcatggtgaaaatcttcaaaagtatgctaatgataaggagaaaaatgatggaggaaactgataaggagaaggtggaatttatcatattgtatttgtaatgttttaaaagcagaatatgctcattatcactgtgtattaatttgtatttgatttagttaatttcacactaaaaagcacctccatacgccgtgcaaacttcaaatgaac

SEQ ID NO: 2634 - DNA, 920 bp, Solanum tuberosum
caggtacgcgggacacaatatcccattactagtcctttcaacatttcctttatctccaaatttaactaaatactttcccatggctcctgctactcaacaactaactccatctccatctgaaataataaccaccgatgcatcatccggaaaacaacaacgttaccatcactgggaaagatatacacacgagttcgtcttgctacgaaatctgatctatctcatatataccaattgttttaccaaatccatgaataccataattacactcacttatacaaagctaccgagtcctccttagagggcttgctttttaaagaaaatcctcttccacttttctacgggccatccgtacttctacttgaagtctctccaaccccttttaacgaacccaaaaataccacggacgaagggttcaaccccgtccttacaacgttcgaccttaaattccctgtggtagaaggacaagttgaggagttcaggtccaaatatgacgataagagtgatgcttacattgcaggatatgctttcttttacgctaattattcatgtttcaatgacaagcctggattttattttgagagtctctacttcagagagagttatagaaagttgggaatggggaaattgttgtttggaacagtttcgtccattgctgccaacaatgggttcgtatcggtggatggaataatcgcagtttggaataagaagtcatatgatttttacataaatatgggagttgaagtttttgatgagtttaggtatggaaaattgcatggagaaaatcttcaaaagtatgctgataataaggggaaaactgaggaatagagctgttaatttttattttttattttttgcttaattgtgtaatttatcaatttcttggtatttcctttttctaaaagcagttgtattatctttgt

SEQ ID NO: 2635 - DNA, 955 bp, Solanum phureja
acacaatatcccattactagtcctttcaacatttcctttatctccaaatttaactaaatactttcccatggctcctgctactcaacaaccaactccatctccatctgaaataataaccacagatgcatcatcggaaaacaacaacgttaccatcactggaaagatatatacacgagttcgtcttgctacgaaatctgatctatctcatatataccaattgttttaccaaatccatgaataccacaattacactcatttatacaaagctaccgagtcctccttagagggcttgctttttaaagaaaatcctcttccacttttctacgggccatccgtacttctacttgaagtctctccaaccccttttaacgaacccaaaaacaccaccaacgaagggttcaccccgtccttacaacgttcgaccttaaattccctgtggtagaaggacaagttgaggagttcaggtccaaatatgaccataagaatgatgcttacattgcaggatatgctttcttttacgctaattattcatgtttcaatgacaagcctggattttattttgagagtctctacttcagagagagttatagaaagttgggaatgggaaaattgttgtttggaacagtttcgtccattgctgccaacaatgggttcgtatcggtggatggaataatcgcagtttggaataagaagtcatatgatttttacataaatatgggagttgaagtttttgatgagtttaggtatggaaaattgcatggagaaaatcttcaaaagtatgctgataataaggggaaaactgaggaagagagctgttaattttttatttttattttttgcttaattgtgtaatttatcaatttcttcgtatttcctttttctaaaagcagttgtattatctttgtggttgaaaaatataagtaaataataaaatatttatgaaaataaattgaga

SEQ ID NO: 2636 - DNA, 856 bp, Solanum phureja
attgtggacaattaatcttggacaacaacgttgccatcactggaaagatatacacacgagttcgtcttgctacgaaatctgatctatctcatatataccaattgttttaccaaatacatgaataccataattacactcatttatacaaagcgacagagtcctccttagagggcttgctttttaaagaaaatcctcttccacttttctacgggccatccgtacttctacttgaagtctctccaaccccttttaacgaacccaaaaacaccaccaacgaagggttcaagcctgtccttacaacgtttgaccttaaattccctgtggtggaaggacaagttgaggagttcaggtccaaatatgaccataagaatgatgcttacattgcaggatatgctttcttttacgctaattattcatgcttctatgacaagccaggattctattttgagagtctctacttcagagagagttatagaaagttgggaatggggaaattgttgtttggaacagttgcatccattgctgccaacaatgggttcgtatcggtagaggcgcagtttggaataagaagtcatatttttacataaatatgggagttgaaatttttgatgagtttaggtatggcaaaattgcatggtgaaaatcttcaaaagtatgctgataacaaggacaaaaatgaccaaggaagctgttagctattgtgtgctttcttttaaatgttgaaagttcaattcatacatttctatttgtaattttgtaaaagcagaatgctcattacatttgtattttaaaattttaaattggtaattatcacattaaacccctctattcaatttacatgatcttcttcttcttt

SEQ ID NO: 2637 - DNA, 931 bp, Solanum tuberosum
caaatttaactaaacactttcccatggctcctgctcctcaactttctactccatctgaaacaataactaccgatgcatcatcggaaaacaataatgttaccatcaccgaaaagatatacacaagagtccgtctcgctacaaaatctgatctgtctcatatataccaattgttttaccaaatccatgtataccataactatactcatttatacaaagctactgagtcctccttagaaggcttgctttttaaagaaaatcctcttccacttttctacggtccatccgtacttctacttgaagtctctccaaccccttttaacgaacccaaaaataccacgaacgaagggttcaagcctgtccttacaacgtttgaccttaaattccctgtcgtggaaggacaagttgaggagttcaggtccaaatatgacgataagagtgatgcttatattgcaggatatgctttcttttacgcgaattattcgtgcttctatgacaagcctggattttattttgagagtctttacttcagagagagttatagaaagttgggaatggggaaattgttgtttggcacagttgcatccattgctgccaacaatgggttcgtatctgtagagggaataatcgcagtttggaataagaagtcatatgatttttacataaatatgggagttgaaatatttgatgagtttaggtatgggaaattgcatggtgaaaatcttcaaaagtatgctgataacaaggacaaaaatgaccgaggaagctgttagctattgcgtgctttcttttaaatgttgaaagttctattcatacatttcgatttgtaattttgtaaaagcagaatgctcattacatttgtattttaaaattttaaattggtaattatcacattaaaccgctctattcaatttacatgatcttcttcttcttt

SEQ ID NO: 2638 - DNA, 729 bp, Solanum tuberosum
cttcttcatagtcctttcaatatttccctactcttcaagtttgccctcattaccatggcttcatcagcaacaataaccaccgatacatcatcggaaaacaacaacattaccatcaccggagagatatacacaagactgcgtctcgctacaaaatctgatttgtaccatatataccaattattttaccaaatccatgcataccataagaacactcatttatacaaagctaccgagtcctctttagagaacttgctctttaaagaaaatcctcttccacttttctacgggccatcagtacttctacttgaagtctctcccaccccttttaacgaacctaaaaataccacggacgaagggttcaagcccgtccttacaacgttcgaccttaaattccctgtcgtggaaggacaagttgaggagttcaggtccaaatatgacgataagagtgatgcttatattgcaggatatgctttcttttacgcgaattattcgtgcttctatgacaagcctggattttattttgagagtctttacttcagagagagttatagaaagttgggaatggggagtttgttgtttggaacagttgcatctattgctgccaacaatgggttcgtatcggtagagggaatagtagcagtttggaataaggaagtcatatgatttttacataaatatgggagttgaaatttttgatgagtttaggtatggcaaattgcatggtgaaaa

SEQ ID NO: 2639 - DNA, 947 bp, Solanum phureja
acacaatattatcccattattactaaacctttcaacatttcttttatcttaaaccacaatattcctctcaaacttagctaaacaatatctcatggctcctgctcctcaacaaccaactccatctgaaacaataatcaccgatgcatcatcggaaaacaataacgttaccatcaccggaaagataaacacacgagtccgtcttgctacaaaatctgatctgtctcatatataccaattgttttaccaaatccatgaataccataactatactcatttatacaaagctaccgagtcctccttagccaatttgctttttaaagaaaatcctcttccacttttctacggtccatccgtacttctacttgaagtctctccaaccccttttaacgaacccaaaaataccacaaacgaagggttcaagcctgtccttacaacgtttgaccttaaattccctgtcattgaaggagaagttgaggagttcaggtccaaatatgatgataagagtgatgcttacatagcgggatatgctttcttctacgcgaattattcttgcttcaatgacaagccaggattttattttgagagtctttacttcagagagagttatagaaagttgggaatgggaaaattgttgtttggaacagtttcgtccattgctgcggacaatgggttcgtatcggtggatggaatagtagcagtttggaataagaagtcatatgatttttacataaatatgggagttgaaatatttgatgaatttagatatgggaagttgcatggtgaaaatcttcaaaagtatgctgataaggggaaaattgaggaagagacctgttagtagtgttgttttattcttataataattgtgtaatttatcaatttcttcatatttgcttttactaaaagcagttgtattatctttgtgattgaaatttattaaattgattatg

SEQ ID NO: 2640 - DNA, 935 bp, Solanum phureja
cctttcaacatttcttttatctaaaacctcattcttctcaaacccatggctcctgctcctcaacttcctacaccatctgaaacaataaccaccgatgcttcatcggaaaacaacaacgttaccatcactggaaagatatacacaagagtccgtctggctacgaaatctgatctgtctcatatataccaattgttttaccaaatccatgaataccataactatactcatttatacaaagctaccgagtcctccttagctaacttgctctttaaagaaaatcctcttccacttttctacgggccatccgtacttctacttgaagtctctccaaccccttttaacgaacccaaaaataccacaaatgaagggctcaagcctgtccttaaaaccttcgaccttaaattccctgtggtggaaggacaagttgaggaattcagatccaaatatgatgatgggaacgataagagtgatgtttacatcgcgggatatgctttcttttacgcgaattattcgtgcttctatgacaagcctggattttattttgagagtctttacttcagggagagttatagaaagttgggaatggggagtttgttgtttggaacagttgcgtctattgctgccaacaatgggttcgtatcggtagagggaatagtggcagtttggaataagaagtcatatgatttttacataaatatgggagttgaaatttttgatgaattcaggtatggaaagttgcatggtgaaaatcttcaaaagtatgctgataacaaggacgaaaacggcgaagggagctgttagtagagaatggctttttgtgtgcttaattgtgcaatttattagtatctatttgtaataatattgtaaaaccagaatgctcattatatttgtaatttgaaaaaaaataaaattggtaattgtgatattatattaaa

SEQ ID NO: 2641 - DNA, 972 bp, Solanum melongena
atctgaaacctcatttctctcaaatttaacttaacaatatcccatggctccttcttctcaacaaccaactctatctgaaacaataaccaccgatgtcgatgcatcatcggaaaataacaacgttaccatcactggaaagatatacacaagagttcgtctcgccacgaaacctgatctttcccatatatacaagttgttttatcaaatccatgaataccataacttcacacatttatacaaagctactgagtcctccttaggcaacttactctttaaggaaaatcctcttccacttttctacgggccatccgtactgttattagaagtctcccccacaccttttgacgaacccaaaaataacacggacgaagggttcaagcccgtccttacaaccttcgaccttaaattccctgtcgtggaaggacaagttgaggagttcaggtccaaatatgatgataagagtgatgcttacatcgcgggatacgcattcttctacgcgaattattcttgcttctatgacaagccaggattctatttcgagagtctctacttcagggagagttatagaaagttgggaatggggaaattgttgtttggaaccgttgcatccatagctgcaaacaatgggttcgtttcggtggaggggatagtagcagtatggaataagaagtcatacgatttttacatagataggggtgtggaaatatttgacgagtttaggtatggaaaattgcatggtgaaaatcttcaaaagtatgctgatagcaaggacaaaaatggaggagggagctgttaattactttctttttgtttgcgcacttgattgtgtaatttatcaatttcttcttatttgatttttctaaaagcagttatattatctttgtgattgaaaaaaatataaaattgattatgtattatattatactgtccctatttgtaataataatatataatatcttgagtgtaatttcg

SEQ ID NO: 2642 - DNA, 911 bp, Solanum tuberosum
ttcctctcaaacttagctaaacaatatctcatggctcctgctcctcaacaaccaactccatctgaaacaataatcaccgatgcatcatcggaaaacaataacgttaccatcaccggaaagatatacacacgagtccgtctcgctacaaaatctgatctgtctcatatataccaattgttttaccaaattcatgtctaccataatttcactcatttatacaaagctacagagtcctccttagagggcttgctttttaaagaaaatcctcttccacttttctacgggccatccgtacttctactcgaagtctctccaaccccttttaacgaaaccaaaaataccacgaacgaagggttcaagcccgtccttacaacgttcgaccttaaattccctgtgatagaaggagaagttgaggagttcaggtccaaatatgatgataagagtgatgcttacatagcaggatatgctttcttctacgcgaattattcatgcttcaatgacaagcccggattttattttgagagtctttacttcagagagagttatagaaaattgggaatgggaaaattgttgtttggaacagtttcgtccattgctgcggacaatggattcgtatcggtggatggaatagtagcagtttggaataagaagtcatatgatttttacataaatatgggagttgaaatttttgatgagtttaggtatggcaaattgcatggtgaaaatcttcaaaagtatgctgataaggggaaaattgaggaagagacatgttagtatatagtgttgttttattcttataataattgtgtaatttatcaatttcttcatatttgcttttactaaaagcagttgtattatctttgtaattgaaatttattaaattgattatgtattaaaaaaaaaaaaaaaaa

SEQ ID NO: 2643 - DNA, 783 bp, Solanum lycopersicum
tatcccattacaaaaaaaccgtcaccctaatcctttgccttaatatttcatctaattcaccacacgaccatgactccttctcttcaacaaccaattccatctgaatcaataaccagcgatgcatcatcggacgttaccatcactggaaagatatacacacgagttcgtcttgctacgaaatctaatctgtcccatatttacaaattattttaccaaattcatgaataccataactatattcatttatacagagcttctgagtcttccttagccaacttgctctttaaagaaaatcctcttccacttttctatgggccatccgtacttctacttgaagtctctcaaaccccttttaaagaacccacaaacgaagggtttaaacctgtccttacaactttcgaccttaaattccctgtggtggaaggagaagttgaggaattcagatccaaatatgatgataagagtgatgcttacatcgcgggatatgctttcttttacgcgaattattcatgcttcaatgacaagcccgggttatatttggagagtctttacttaagagaaagttatagaaacttgggaatggggaaattgttgtttggaacagttgcatccattgctgccaacaatggattcgtatcggtagaggaaatagtagcagtttggaataagaaggcatatgatctttacataaatatggggcttgaaatatttgatgagtttaggtatgggaagttgcatggtgaaaatattaaaatgtatgctgataaaaatgtaggcaactga

SEQ ID NO: 2644 - DNA, 1057 bp, Nicotiana benthamiana
taactgattaacaccatggcctcaactatatcagaaacaatcaccaactccacaccggaaaataacgttatgatcactgagaaaatctacactagagttcgtctcgctacgaaagctgacctctaccatatataccaactgttttaccaaatccatgcataccataacaatactcatctttataaagcgactgagtcctccttagaaaacttgctcttcaaagaaaattctcttccactctattacggaccatctgttcttctacttgaagtttctccaaccccttttaccgaatccaagcataccacgaaccaagggttcaagcccgttcttaaaacattcgaccttaaatttcccgttgtggaaggagaagcagatgagttcaggtccaagtatgatgatggaaatgataaacgtgacgtattcatcgcgggatatgcattcttttatgcgaactattcgtgcttctatgacaaacctggattctatttcgagagcctttacttccgggaaagttacaggaagttgggaatggggagattgttgtttggaactgttgcatccattgctgcaaacaatgggttcgtttcagtagaagggatagttgcagtttggaataagaagtcttatgatttttacattgaaatgggggttgaaatatttgatgagtttaggtatgggaaattgcatggtgacgctcttcaaaagtatgctgataaggagaaaaatggtgaagggagctgttagtttttaaaaaaattttgcttttgcttaatcgtgtaatttatcaatttcttcttcttgttctacatttgtgtttgaaaaaattaaattggtgaccatatatattacacttgatatagtacttttttccgttttaatatctatgcaaaaagaatattgacatctttctatgtttgacattttttcaactttgaatttcattttactttgacatgcttagaattacaaactacaaggatatgatgacatgaaggatagatatgcaggagtgtgtccttcctctcttaggtttcgtggaaatcttttttgtaca

SEQ ID NO: 2645 - DNA, 937 bp, Solanum lycopersicum
cacacaatatcccattactaaacttttctcctactcctttaattttatctcattcccatggctcctacttctcaacaaccaactccatctccatctctatctgactcactaaccaccgatgcatcatcggacgttaccatcactggaaagatatacacacgagttcgtctcgcaacaaaatctgatctatctcatatatacaaattgttttaccaaatccatgaataccataacttcactcatttatacaaagctactgagtcctccttagagggcttgctttttaaagaaaatcctcttccacttttctatgggccatccgtacttctacttgaagtctctccaaccccttttaacgaacccactaaccaagcgttcaagcccgtccttacaacgtttgatcttaaattccccgtggtggaaggacaagttgaggaattccgatccaaacatgatgataagagtgatgcttacattgcaggatatgctttcttttacgcgaattattcatgtttcaatgacaagccaggattttattttgaaagtctttacttcagggagagttatagaaagttgggaatggggaaattgttgtttggaacagtttcgtccattgctgcgaacaatgggttcgtatcggtcgatggaataatcgcagtttggaataagaagtcatatgatttttacataaatatgggagttgaaatttttgacgagtttaggtatggaaagttgcacggtgaaaatcttcaaaagtatgcacataataaggggaaaactgaggaagagacctgttaattttttatttttttttaattttttgcttaattgtgtaatttatcaatttcctttttctaaaagcagttgtattatctttgtgcttgaaaaatattagtaaataataaaatatttgtcaaaataaattgagagggacaaa

SEQ ID NO: 2646 - DNA, 1034 bp, Capsicum annuum
cctagtccctgcaacatttcccaattctttttccttcttcaagtttgccatggcttcagctatatctgaaacaataaccaccaacggatcatccgaaaataacaaccttacgatcaccggaaagatacatactcgagtccgcctcgctacgaaatctgatctgcaccatatataccaattattttaccaaatccatgcataccataatttcactcatttatacaaaaccaccgagtcctccttaggggacttacttttcaaagaaaatcctcttccgctgttctacgggccatccgtacttttactcgaagtctccccaacgccttttacccaacccaaaaataacaaggacgaattagggttcaagcccgtccttacaacgttcgaccttaaattcccagttgtggaaggacaagttgaggagtttcagtccatatacgatgatgggaatgataagcgtgatgttttcatagcgggatacgctttcttttatgcgaattattcatgcttctatgataaaccggggttctatttcgagagcctttacttcagggagagttatcgtaagttgggaatggggagattgttgttcggaacagttgcgtctatagctgcaaacaatgggttcgtatcagtggagggaatagtagcagtttggaataagaagtcgtatgatttttacatagatatgggggttgaaatatttgatgagtttagatatggcaaattgcatggtgaaaatcttcaaaagtatgctgataagcagaaaaatgaaggaggaaactgttaatttatttatttattttaattaccttaagatttccttgatactgcaattatgattttctacttatttactttctgtgaaagcagaatgcttagtgtgtattactcacatttgtgtttgaaaatttatattttgtcgattcaatttaaaagtcataccatgttcttttttaatttattccataaagatcaatattcttctatagttaaatttaaaaaatttcattgacattgtatgttagtcacaa

SEQ ID NO: 2647 - DNA, 1767 bp, Nicotiana benthamiana
tcatacccttatatcctttttgataaaataattaaaaaatcatagttatctggtctttatataacagaaattagttacccttaaatttaatgtgtagtttcttgaagttttgagattgggattgaaattaaagaaaataaaaagatggggttggaaagtatgaagaaattgaagcctttgctgcatttgctgttgccactatgtgttcattggattgctgaagagatgacagtttctgtgcttgttgatgttacaactagtgctctttgtcctggcaattccacttgttctgaagctatttacatcaatggtgttcaacaaacagttgtcggaatattcaagatgctggtccttcctatcctaggtcagctttcagatgagtatggacgtaaaccacttcttctcctcaccatatctacaacaattattccttttggtttactcaccatcaataagtcaaagggatttgtctatgcttattatgtcctgcggacaatttcttatatcataagtcaagggagcattttctgcatctctgttgcttatgcggcagatgttgttgatgagagtagtagagctgcagtttttagttggattacaggacttttttctgcatcacatgttatggggaatgtcctagcgcgttttcttcctgtaggctacattttccaggtttcaatagttctcttgatctttgttccggtttatatgatactgtttctagaagagactgtaagtccacaaacagaggtggaccaaagctcaacggtaaagagcaaggcattgaaggttgttcaggaacgatataattcgatgagatatgctgcaaatattgtcactagcagtccaacactgaagtgcatttctcttgtttctttcttctatgagttgggaatgtccggcatcagcagcgttttactgtactatctgaaatcagctttcggcttcaacaagaatcagttctcagaaattttaatgatggtgggagtaggttctatagtctcacagattgtggtgcttcctcttataaatcctctttttggggagaaagtgatactttgcatggccttgctttcatcaatagcctatgcaatgctttatggattagcatgggcaccttgggttccatatttaagtgcttcttttggggtcatctacatccttgttaaaccctctacttatgctgttatatccaaagcggcactttcagcagatcagggcaaagcacagggatttgttgctggcgttcaatcagttgcaagtttgttatctccaattgtgatgagtccattgacatcgtggtttttgtcacgtgatgcaccttttaactgcaaaggattcagtatactttgtgcttctttatgcatggtggtttcactgtattatgcgtgtgtgctaaaagtagaggctccattgaagaagaccttcgacgaaaatgcagagaatattgaagcaccacttttggcatgatacttgagacatatgtgaccattataccaaaattttcccagctatagtccacgaaggctgcgcttacaatgacgattagtccgatcttcctatgatagagctgtaaatcttttgaatgaagctaagtctaatctaggttagaagaggtgtattagtcttgtaatctaatttgttctctgtttagttattcttcaatgcatcacttcatttttttttgtctcaattaaattgttggcttgtactttgtactctgaactttacatggaaatgggataatggatatattggtaaattcaa

SEQ ID NO: 2648 - DNA, 677 bp, Solanum phureja
gaaaaccatctgaacaccaaacaccaaaattttcaaatatgcagaggtcaacaaaacttagtgatgaacaagagttttcaatcatggttaatgctttaaccaatgtgattacagtgccgcaatttcattaccttctacgagcattgagcctcccctgtttcgtgtaccggcagaaccagagcgttgtcaattctgcaaaataaatggttgtttaggttgcaattattttgcaacctcatcagctggcaacaacaacaaggctttaaagattgttgcgaagaagaaaaagaagaattacagaggagtgagacagagaccatggggaaaatgggctgcagaaattagagatccaagaagagcagccagagtatggcttggaacatttactacagctgaggacgtagctagagcttatgacagagcagctattgaatttagaggtccaagagctaagcttaatttctcattttcagattacacatcaattcaacaacacaacaatacacccctgcaactgcaacaacaacaatcaccgccctcgcagttacaacagggaattaacacagaagaagaagagttctgggatcaattgatgaattcagacaatgaaattcaacattactttaatagagaatcatctgattctgctaatggctatattgcgcatagcttctgat

SEQ ID NO: 2649 - DNA, 1275 bp, Solanum phureja
acataatcaagaacaaacagcttcaatgaacaaacaaccaaaatttagtgatgaacaagagttttcaatcatcgttgctgctttaacgaatgtgattacaggtactactcatacttccgtcagtgccacaatttcattaccttgtacgagtatgtcttattctattgagccgcccttgtttcacttaccggaagaaacagaggcttgtcaattctgcaaaataaatggttgtttaggttgcaattattttgcaacctcatcagctggcaacaacaacaaggctttaaagattgttgcgaagaagaaaaagaagaattacagaggagtgagacaaagaccatggggaaaatgggctgcggaaattagagacccgagaagggcagccagagtatggcttggaacatttactacagcagaagatgtagctagagcttatgacagagcagctattgaatttagaggtccaagagctaagcttaatttctcattttcagattacacatcaattcaacaacacaacaatacacccctgcaagtgcaacaacaacaatcaccgccctcgcagttacaacagggaatgaacacagaagaagaagagttctgggatcaattgatgaattcagacaatgaaattcaacattactttaatagagaatcatctgattctgctaatggctatattgctcatagcttctgatcatttcctattttagtaggacgcatgcccatttaccgcctttgtttcacttaccggaagaaacagaggcttgtcaattctgcaaaataaatggttgtttaggctgcaactattttgcaacctcatcaactggcaacaacaacaagacattaaagattaatgttgcgaagaagaagaagaattacagaggagtaagacagagaccatggggaaaatgggctgcagaaattagagatccaagaagagcagccagagtatggcttggaacatttactacagctgaggacgtagctagagcttatgacagagcagctattgaatttagaggtccaagagctaagcttaatttctcatttgcagattacacatcaattcaacaacacaataataataataataataatacttcttcttcacccctgcaagtgcaacaacaacagggaactaatacagaagaacaattctgggatcaattgatgatttcgaacaatgaaatacaagactttttcaatggagaatcttctgattttgctaatagcttctgatcactatccattaaacacaagaattgtaaagga

SEQ ID NO: 2650 - DNA, 1158 bp, Pseudoroegneria spicata
  misc_feature (86)..(86): n is a, c, g, or t
  misc_feature (943)..(943): n is a, c, g, or t
ctattggcatgatggaggcgaggatgccgccggggttccggttccacccacgggacgaggagctggtcctcgactacctcctccanaagctcaccggccggcgcgcatacggtggcgtcgacatcgtggacgtcgacctcaacaagtgcgagccatgggaccttccagaggcggcgtgcgtgggcggcagggagtggtacttcttcagcctgcgcgaccgcaagtacgccaccggccagcgcaccaaccgcgccacgcgctccggctattggaaggccaccggcaaggaccgcgccatcctcgcccacggcgccggcgaggcgttggtggggatgcgcaagacgctcgtcttctaccagggcagggcccccaaggggacgaggacggagtgggtcatgcacgagttccgcctggaggaagaacgacagcaccagcagaagggcggcggcgccgccgccgccgaggcgaggtgccagctcaaggaagactgggtactatgcagggtgttctacaagagcagaacaaccagcccaaggccgccatctgaagaagcctgcacattcttcagcgagctggaccttccgactgtgccaccgccgctcgcgcccctcatcgacgcctacatcgcctttgacagcggcactgccatgaacaccatcgagcaagtgtcctgcttctccggcctgccggcactaccgctcaggggatcggtgagcttcggggacctgctgggctgggacaaccctgagaagaaggccatcaggacggctctgagcaacatgtcaagtaacagcaattccaagttggagttgactccaaactggagccaggagaatggcttgtcacagatgtggacacccctctgaatcttgatatgagactattgtgctgctagttgaagtgtggtggtgactagtaagtacagtaattagatgacatattntttctaatgatattggagcagtattgggctattggttgatgcagtgtctgttcctagggatttgatggaagtgtgtgttgatttacaaaccagtagattagtgaaatggcttgatatagcatctgtacataggaatgcttcctattttagttttaccctttctttctactctccaaatgtaatgtaacttcccactgaaagtaaatatgtggata

SEQ ID NO: 2651 - DNA, 1309 bp, Secale cereale
ggctaaggtagcggtgtagcgatccgatcgagaagatgagctctattggcatgatggaggcgaggatgccgccggggtttccgtttccacccacgggacgaggagctggtcctcgactacctcctccacaagctcaccggccggcgcgcatacggtggcgtcgacatcgtggacgtcgacctcaacaagtgcgagccatgggaccttccagaggcggcgtgcgtgggcggcagggagtggtacttcttcagcctgcgcgaccgcaagtacgccaccggccagcgcaccaaccgcgccacgcggtccggctactggaaggccaccggcaaggaccgcgccatcctcgccggcgaggcgttggtggggatgcgcaagacgctcgtcttctaccaggggagggcgcccaaggggacgaggacggagtgggtcatgcacgagttccgcctggaggaggaaccacaccaccagcacaaggtccgcgccgccaccgccaccgccaccgccgaggcggcgaggtgccagctcaaggaagactgggtgctatgcagggtgttctacaagagcagaacaaccagcccaaggccaccatctgaagaagcctgcacatttttcagcgagctgggccttccgactgtgccgccgccacttgcgcccctcatcgacgcctacatcgccttcgacagcggcaccgcgatgaacaccatcgagcaagtgtcctgcttctccggcctgccggcactaccgctcaggggatcggtgagcttcggggatctgctgggctgggacaaccctgagaagaaggccaccaggacagctctgagcaacatgtcaagtaacagcaattcaaagttggagttgcctccaaactggagccaggagaacggcttgtcacagatgtggacacccctctgaatctttgatatgagattacagtgctgctagttgaagtgtggtggtggctagtaagtaattagatgacttattctttctaatgatattggagtagtattggactattggttgatgcatgcagtgtctgttcctagggatttgatggaagtgtgtggtgatttacaaaccagtagattagtgaaatggcttgatatagcatctgtacataggaatgctaagaaatgccctattttagttctactttatttctactctccaaatgtaatgtaacctccagctgaaagtaaatatgtgaaactaacccttatttgtctaacttaaactttaaaaaaaaaaaaaaaaacaaaaaaaataaacgtactcgcgttgtacacgtacctagtcttcgttgacgact

SEQ ID NO: 2652 - DNA, 1188 bp, Leymus cinereus x Leymus triticoides
  misc_feature (769)..(769): n is a, c, g, or t
  misc_feature (783)..(783): n is a, c, g, or t
  misc_feature (803)..(803): n is a, c, g, or t
  misc_feature (851)..(852): n is a, c, g, or t
  misc_feature (950)..(950): n is a, c, g, or t
  misc_feature (968)..(968): n is a, c, g, or t
  misc_feature (1030)..(1030): n is a, c, g, or t
  misc_feature (1039)..(1040): n is a, c, g, or t
  misc_feature (1084)..(1084): n is a, c, g, or t
  misc_feature (1086)..(1086): n is a, c, g, or t
  misc_feature (1107)..(1107): n is a, c, g, or t
  misc_feature (1120)..(1120): n is a, c, g, or t
  misc_feature (1148)..(1148): n is a, c, g, or t
gcatgatggagacgaggatgccgccggggttccggttccacccacgggacgaggagctggtcctcgactacctcctccacaagctcaccggccggcgcgcatacggtggcgtcgacatcgtggacgtcgacctcaacaagtgcgagccatgggaccttccagaggcggcgtgcgtgggcggcagggagtggtacttcttcagcctgcgcgaccgcaagtacgccaccggccagcgcaccaaccgcgccacgcgctccggctactggaaggccaccggcaaggaccgcgccatcctcgcccacggcgccggcgaggcatcggcggctctggtggggatgcgcaagacgctcgtcttctaccagggcagggcccccaaggggacgaggacggagtgggtcatgcacgagttccgcctggaggaggaacgacaccactaccaccaccaggagcagcagaagggccgcgccgccaccgccgaggcgaggtgccagctcaaggaagactgggtgctatgcagggtgttctacaagagcagaacaaccagcccaaggccaccatctgaagaagcctgcacatttttcagcgagctggaccttccgactatgccgccgctcgcgcccctcatcgacgcctacatcgccttcgacagcggcaccacgatgaacaccatccagcaagtgtcctgcttctccggcctgccggcactaccgctcaggggatcggtgagcttcggggacctgctgggctgggacaaccctgacaagaaggncatcaggacagctntgagcaacatgtcaagtaanagcaattccaagttggagttgcctccaaactggagccaggagaacggnntgtcacagatgtggacacccctctgaatcttgatatgagattactgtgctgctagttgaagtgtggtggtggctagtaattagatgacatattctttntaatgatattggagtagnattggactattggttgatgcagtgtctgttcctagggatttgatggaagtgtgtgttaattnacaaaccannagattagtgaaatggcttgatatagcatctgtacataggaatgntnagaaatgtcctattttagttntactctttctttntactctccaaatgtaatgtaacttcccnctgaaagtaaatatgtggataacccctatttgtcattttg

SEQ ID NO: 2653 - DNA, 1831 bp, Triticum aestivum
atcctccccgtcgtcaccaaccagcacctcctcctctgcacgctcctcatcggcaactccctcgccatggaggcgctccccatcttcctcgactccctcctcccctccttcggcgccatcctcatctccgtcaccctcatcctcgccttcggtgagatcatgccgcaggccatctgcacgcgctacggcctcagcatgggggccaaggcagcgcccatcgtccgggtgctcctcgtcgtcttcttcccggtggcataccccatcagcaagctgttggactggctattgggaaagggccatgttgcacttatgaggagagctgagctaaagacattggttgatatgcacggcgatgcggctggaaaaggtggagagctgactcatgatgaaactactatcattgcaggagcattggagatgactcaaaagactgcaaaagatgccatgactcccatatctgaaaccttctcacttgacataaatgccaagctggatgtgcatacggtgggtatgataatgaccaaagggcacagccgtattcctatatactctggaagaccaagcaatatcatcggtcttatattggtaaaaaacttgcttacttgccgacctgaggatgaggtgcccactagacatgttactatcagaaaaattccaagggtggctgatgatcttcctctctatgacattctaaatgagtttcagaaaggtcacagccacatggctgtggttgttaaacgcactaaagaaggagcatctgttgaaaagaataacagttttacagcagattataaaatgaccaatggacatgctcatgctgatggtctgggtctgtcaccctcacatgtcaacactcccggaagtcgtcgaaataacaatgacaaatacagtaagaaaattgaaagaaaacgggacaacattcttgattttaacaccgatccacttcctcactattcaatggatgaggaagcggtgggaataattacaatggaagatgtcatggagcagctgctgcaggaagatatcttggatgagacagatgagtatgttgatgtgcataacaagatcaaaataaacatgttaccgccaggcaaatcattgtcgcctcttatatctcctagtggtggacctctgtctcaaggactaagaaagacccctatggcttctccgctgtcgccataccataatggcggctccatcttacgttcccctgctgcaaaccatgctcgatcccctgggactttaccgacagccttttctcctgggaggtcaccggcatctcaaacccccgtgcgcagttcgccgacttcaagttgggtctcgaggaattcgtaccgaaatccgtagaaatggtggtgagagctaatgccaaagagctccaggggcaacaatcccagttgagatcactcccaagatcaaatgaaggcattgaagagtgtaggggtcaaagaatgaagaccccacagctctctgctttgttgctggtccttgtttatttatgactttcttgtacatatatatgtgtcccttagcatctgaacctgagtatggatgagctctcaccacctactgtagacgccctttttgccaaacttgtagcaaccattgcaaaagaagaaaactgcagagagaaacgacgtaaaagaaacgcattctgtatgtatcgcgcatctgcgcatctgtgctggtattcttgtttgtcagccgccattgtactcactcaaactcaagtaaagcagctgttggtgctagtactgctggtggctgccccccactagccttattgtttcttaatgagtttctacagcaataacgcatttttctttttcgt

SEQ ID NO: 2654 - DNA, 2460 bp, Oryza sativa
gggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggagatgtcgcagcatgcggtgtgctgcggggcgatgttctgggtgtacctgatgtcgtgcgtggggctggtgatgttcgccgggctcatgtcggggctcaccctcggcctcatgtcgctcagcctcgtcgacctcgaggtcctcgccaaggccggcaccccgacggacaaggacaacgccgccaggatcctgccggtcgtcaagaaccagcacttgctcctctgcaccctcctcatcggcaactccctcgccatggaggcgctgccgatatttctggactcgctcgtcccgtccttcggcgccatcctcatctccgtcacgctcatcctcgccttcggtgagatcatgccgcaggccatctgcacgcgctacgggctcagcgtcggggccaaggcggcgcccgttgtccgggtactcctcatcgtcttcttcccggtcgcctacccaatcagcaagttgttggattgggtactcggaaagggccatgttgcacttatgaggagagctgagctaaagactttagtcgatatgcatggtaatgaggctggcaaaggtggagagctgactcatgatgaaaccactatcattacaggagctttggagatgactcaaaagactgcaaaagatgccatgactcccatatctgaaaccttctcacttgatataaacgctaagctggacctgcacacaatgggtatgataatgaccaaagggcatagtcgtgttccaatatactctgggactccaaacaatattattggccttatattggttaaaaacttaattacttgccaacctgaggatgaagtgcccattcgaaatgttactatcagaaaaatcccaagggtgtctgatgatcttcctctctacgacattctaaacgagtttcagaaaggtcacagtcacatggctgtggtggtcagacgcataaaagaaccaggagcatccattgaaaagacttatagtgacagatcagattacaaaactaacagcgacagatcagattacaaaattaaccacagagatgcccatgctgatggtttgtcaccctctcgtgtcagcattgctggaagtcgtcgaagtaacattgaaaagaatggagaggtgcgcttatataagaaatcagaaaaaaagcgggacaatattcttgattttaatagcggtccacttccaagctattcattggatcaagaagcagtggggataatcacaatggaagatgttatggaacaattgctacaggaagatatcttggatgaaacagatgaatatgttgatgtacataacaagattaaaataaacatgctacctctgggcaaatcattatcaccaactatatctccaagtaatgggccccattcccaaggactcaggaggacccctatgacttctccattgtcatcataccatcatggtggctccatcttacgttcccctgcttcaaacaatcctcagtctcctgggactttgccgacaataatttctcctgaaagatcgcctgcttctcaagcaccttcgcgtagttcacctaattcaactcaggtctcaaggaattcgtaaaacggcgttgagagctaaagagctctaaggacaacgtttcctgagaaatggtaaaatgtcaacataaacagattaagacattttgagcttaggactgaattatacagatcagcatatctcttgtactgttgatgcttatttgttgattacatgcttgtatatacgtatggcttagcatctggacatcgctatagatggaagtctcactacctactgtagatgtatttttgtcagcttgcaattaccattgcagaggaaagcttgaagataaaaatgtaaaaggaatgcactagtatgcatttgtgctgttcttgtatgcatgcccccatcattttaatgatcagcaagcagatgttggtgcattcactgatggctatccacaccatttaagcactgtacaagtcctctcatattgtatcagaaattcagattagtgataaggcgcaagcttatgtttgtgatgctagtttggtgatattgagcagagtgttgtgactaaagtcaaagttacataatgagatcagatcataagattgcaaagggcaaacctcataattatcgagtgggccatcaagagagaagctagtggatcagccggac

SEQ ID NO: 2655 - DNA, 2336 bp, Sorghum bicolor
ctcgcgagtcaggaggcggcgaggcggtagccaagccagccggccccggcctcccataaaggagcgaggccgaggccgtcgactgccctcgagccgagggggaggggcagccgagcgcccgagccaagcagacagaacacgcgacgcttgctgctgccacggcaagccgggacacgcgacctgacctcccaagctatagctagtgtactagctaccagccgcctgcgaggcacaggcagcgcggcacgcgctccagcagtgagggagggagggaggccctgcctgccacccgtgccgtcccgccgcgcccccgcggcggccgagagagagagagagagagcgccgagcccgcccgcctgcccgccggcgccgagcgattcgccgatgcccagccatgaggcctgctgcggcaccatgttctgggtgtacctcatgtcctgcttcgggctcgtcatgttcgccggcctcatgtcgggcctcaccctcggactcatgtccctcagcctcgtcgacctcgaggtgctgtccaaggccggcacgcccaaggacaagcgcaacgccgccaggatcctacccgtcgtgaagaaccagcacctgctcctctgcacgctcctcatcggcaactcgctcgccatggaagcgctgcccatattcctcgacacgcttgtgccgccctacgtcgccatcctcatctccgtcacgctcatcctcgcgttcggcgagatcatcccgcaagccatctgcacgcgctacgggctcagcgtgggggccaaggcggcgcccgtggtccgcgtactgctcatccttttcttccctgtcgcctacccgatcagtaagttgttggactcgctactgggaaagggacattttgcactaatgagaagagctgagctaaagacattagttgatatgcatggcaatgaggctggaaaaggtggagagctgactcatgatgaaaccactatcattacaggagctctggagctgactcaaaagattgcaaaagatgccatgactcctatatctgagacattctcacttgacataaatgctaagctggacttacacacgatgggtatgataatgactagagggcatagtcgtgttcctatatactctgggattccaagcaatattatcggccttatattggtaaaaaacttgattacttgccgagctgaggatgaagtgcccattcgtaatgttactatcagaaaaattccaagggtggctgatgatcttcctctctatgacattctaaatgagttccagaaaggtcacagccacatggctgtggtagttaaacgaacaaaggaatcaggagcatccactgaaaagcaaaagagcacaactgcagattataaaataaaccccaaagatgctcttgctgatggctcatccccctcttctgctagtgctgccggaagtcgtagaattaacatagagaagcatggagacgggcgctcatataataagaaatcagaaaggaagcgggaaaacattcttgattttaacaccgatccacttccatgctattcaatggatgaggaggcagtcggaataatcacaatggaagatgtcatggaagaactgctacaggaagaaatctatgatgaaacagacgagtatgttgatgtacataacaagatcaggataaacatgttacctccaggcaaatcactgtcacctactatatctcctggtggtggacccttatctcaggggcttcgaaggactcctatggcatctccgttctcaccataccaccatggtagttctgtcttacgttccccagcttcgaaccatggtcagtcacctgggattttaccgacaatactttctcctggaagatcacctactgcacaaacacctgggcaaagttcaccaagtggaagtcaggtttcaataaattccaacggtcaacataaaaaggacggtgagagctaacatcccagaagattgtttttcagacgaaggcctcgtctcaagagtcaagatggcatgcatgatcaaattatgacattgctagcgtaggattaagctgcgaatataagtagcacagctctcttgtatggttattagcccatatttattgattgcttgcctgtatatatatgcttcagcatccggacctcagtatggcctaatcctcagtatgtattgtagaggtcttcctaaggactctctccttttgttgtcgtcttgtagttatccggagaggggacaaaaggtaagcgttggactgaatatatttaagcaaatatcaagccgattttgcgacttgccctggccccctcgtctcagctgactttgcattgttttcatggactcgggag

SEQ ID NO: 2656 - DNA, 2332 bp, Zea mays
agggggctgcttaggggcggcgttgcagttagtctaagcaggagcaggcaggaggccgcgcggcgcgcgggcagggtgctgcggcaacagagccacagcgggcaacgacaagggaacgggaaaagccagccagatgcgacggcaaaacggcacgagggaggaagaagggcactggggacagtgggacatgatggactcgggaggcgccgccgtccataaaatggagggagagaggccgtcgactcaactgacgggcctcaggccgagccaagcagaccacgcgaccccagctagctactccagttaccaggcacagcacaggcgcccacgcgctccagcagtgagggagggaggccctgccacccgtgcgtgccgtgccgtcctggtcccgcccctcccctgcggccaagagagagagagagagcgccgagcccgccccgccagcgccgcgcgattcgccgatggccagccatgaggcgtgctgcggcaccatgttctgggtgtacctcatgtcctgcgtcggcctcgtcatgttcgccggcctcatgtcggggctcaccctcggcctcatgtccctcagcctcgtcgacctcgaggtgctcgccaaggccggcacgcccaaggacaagctcaacgccgccaggatcctcccggtcgtcaagaaccagcacctgctcctctgcacgctcctcatcggcaactcgctcgccatggaggcgctgcccatattcctcgacacgctcgtgccgccctacgtcgccgtcctcatctccgtcacgctcatcctcgccttcggggagatcatgccgcaagccatctgcacgcgctacgggctcagcgtgggggccaaggcggcgcccgtggtccggctgctgctcatcctcttcttccccgtcgcctacccgatcagcaagttattggactggctcctgggaaagggacattttgcactaatgagaagagctgagctaaagacgttagttgatatgcatggcaatgaggctggaaaaggtggagagctgactcatgatgaaaccactatcattacaggagctctggagctgactcaaaagattgcaaaagatgccatgactgctatatctgaaacattctcacttgacataaatgctaagctggacttacacacaatgggcatgataatgactagagggcatagtcgtgttcctatatactctgggatgccaagcaatattatcggccttatattggtaaaaaacttgattacttgccgcgctgaagatgaagtgcccattcgtaatcttactatcagaaaaattccaagggtggctgatgatcttcctctctatgacattctaaatgagttccagaaaggtcacagccacatggctgtggtaattaaacgaacaaaggaagcaggagtatccactgaaaagcaaaagagcacaactgccgattataaaataaaccccaaagatgctcgtgctgatggctcatccccttcttatggtagcactgccgtaagtcgtagaattaacatagagaagcatggagatgggcgcccatacaataagaaatcagaaaggaagcgggaaaacattcttgattttaacaacgatccacttccaagctattcaatggatgaggaggcagtgggaataatcacaatggaagatgtcatggaagaacttctacaggaagaaatctatgatgaaacagatgagtatgttgatgtacataacaagatcaggataaacatgttgactccaggcaaatcgctgtcacctgctatatctcctggtggtgggcccttatctcaggggtttcgaaggactcctatggcatctccgttctcaccataccaccatggtagttctgtcttgcgttccccggcttcgaaccatggtcagtcacctgggactttaccgacaatactgtcccctggaagatcacctactgcacagacacctgggcaaagttcaccaaacggaagtcaggtttcaataaactccaacggtcaacataaaaaggacggtgagagctaacatcccagaagattggttctcggatgaaggtctcgtctcaagacggcatgcgtgatcaaattatgacattgctagcgtaggattaagctgcgagtataagtagcacagctctcttggcccatagttttgatcgcttgcctgtacatatatgcttcagcatccggacctttagtatgtcctaatcctcgctctgtattgtagaggtcacatcttatatagttataatatatctggtgagggggaaaagagctaagcgttggactgaatatattaaagaaaaaatcaagctgattttgcgacttgtgatc

SEQ ID NO: 2657 - DNA, 953 bp, Triticum aestivum
attcggcacgaggcacgtacgcaccaacaatctcatcggctctttgaaaagaaaacgtctcgttggcaatggcgcgctccagagtctcgatcatgtcatcgcgggtgctcctgttgatcgtggccgtcgccgcgctcgtgtccgcgtgcgcggcggacccggagccggtgcaggacttctgcgtggcggcggccaccaacggctcggccgaccacccgtcgtacccggggttcccgtgcaagccagcgtcggcggtggtctccgacgacttcttcttcgcggggctggcgcgctcgggcgccgccgacgcggccgagagcccgttcgggtccagcgtgacgtcgggcaacgtggcggccttcccggggctcaacacgctcggcgtctccatcaaccgcgtcgacctcgcccccggcggcgtcaacccgctgcacagccacccgcgcgccgccgagctcgtgcacgtcgtctccggccagatgctcgtgggcttcgtcagcaccgccggcactttctactccaaggtggtgcgggagggggagagcttcgtcattccgcgcggcatggtgcacttccagttcaacaccggcaaggagtccgccagggccgtcaccgtgttcaacagccagctccccggagttgtcctcgccgcgccgtcgctcttcggcgctgacccggagatccccgacgccgtcctctccaagagcttccaggtcgacggcgagatcatcaagctcctcaagtccaagttccggacttaaaaaacgacgcacgcttaattttgattggtttattgttattatacactgtacaccagtaaatacaaacacctaaagttgttcactgtttcatgtaattttgattggatattaaatgcgtcaataaaatttaagttcaaattctgttcaatttaaaatcaaacttttacctcttgctgacgggggctattttta

SEQ ID NO: 2658 - DNA, 909 bp, Secale cereale
tcaggacaacacctacgcgccaacaatcaaacaatctcgtcaccaatggcgcgctccagagccccgatcatgccgtcgccggtgctcctcctgctggccgccgtgttcgtctcggcgtgcgtggcggacccggagccggtgcaggacttctgcgtggcggcggtgaccaacggctcggccgaccatccgtcgtacccggggttcccgtgcaagccggcgtcggcggtggtctccgacgacttcttcttcgcggggctggcgcgctcgggcgccgccgacgcggccgagagcccgttcgggtccagcgtgacgtcgggcaacgtggcggccttcccggggctcaacacgctcggcgtctccatcaaccgcgtcgacctcgcccccggcggcgtcaacccgctgcacagccacccgcgcgccgccgagctcgtgcacgtcgtcacgggccagatgctcgtcggcttcgtcagcaccgccggcaccttctactccaaggtggtgcgggagggggagagcttcgtcatcccgcgcggcatggtgcacttccagttcaacaccggcagggaggccgccagggccgtcaccgtgttcaacagccagctccccggcgtcgtcctcgccgcgccgtcgctgtttggtgctgatcccgagatccccgacgccgtcctcgccaagagcttccaggtcgacggcgagatcatcaagctcctcaagtccaagttccgggattagttgacaacggcatcatggatagcgcgcgaagcttcacggtcgaagctgcctattgatttattgctatactatatactacactgtttctacacgagtaaatacggacacctaaagttgttcactgtttcatgtaattttgattggatattaaatgggtcaataaatttaagtttaaat

SEQ ID NO: 2659 - DNA, 1056 bp, Triticum aestivum
agccatggccgtgaacgacaccaagctggccgacgccgagaacccgggcgcgatgtgccgcggcggcggcggcggcatcgactccgactccgacgtggacttcgcgggccgcgccaactggctgcgcgcggcggtgctgggcgccaacgacgggctggtgtccacggcgtcgctgatgctgggcgtgggcgcggtgaagcacgaggtgcgcgccatggtgatctccgggttcgcgggcctgctggcgggggcgtgcagcatggccatcggggagttcgtgtccgtctgctcccagcgcgacgtggagatcgcgcagctcgaccgcgacggcaagcgcggcggcgacgaggagagggcgctgcccagcccggtgcaggccgcggcggcctcggccctcgccttctccgtcggcgcgctgctgccgctgctggcggcggggttcatcgtggggtacaagctgcgggtggccgtggtggtggccgtggcgacgctggcgctggcggcgttcggggtcgtcggggccgtgctggggagggcgcccgtggtgaggtcctccgcccgggtcgtcgtcggcgggctggccgccatggggctcaccttcggcctcatgcggctcttccgggccagcggcatatgacgtgcgatcggtggacgaggtttttttgttgccgtcaccgatcgtcgtctcgtccatgctttcctcgtgatcctacctacgtacgtggtgccaacgtcttcttccccggccggctgatggtctgacgtccgtgcatggaatgtgcatgcccggccgtgcgtctcttccctagttaattctctctgtctctactgctatttgctagtctttgcatgcatatgcatgccatggcggcctgccccgctgatgtaacattggccagctgcatgcatgctatagtatttttacttgcaccgtgtaacgttactagtagtgattgggaggtggaagaaggtgacaaggttgttgcaagaaaggcaggctatatatttaagctaattaatttgaatttctcatgcaagtcaagccgtatgcatatg

SEQ ID NO: 2660 - DNA, 1027 bp, Secale cereale
gactccgacgtggacttggcgggccgcgccaactggctgcgcgcggcggtgctgggcgccaacgacgggctggtgtccacggcgtcgctcatgctgggcgtgggcgccgtgaagcacgaggtgcgcgccatggtgatctccgggttcgcgggcctgctggcggggcctgcagcatggccatcggggagttcgtgtccgtctgctcccagcgcgacgtggagatcgcgcagctcgaccgcgacggcaagcgcggcggcgacgaggagagggcgctgcccagccccgtccaggccgccgcggcctcggccctcgccttctccgtcggcgcgctgctgccgctgctggcggccgggttcatcgtgggctacaagctgcgggtggccgtggtggtggccgtggcgacgctggcgctggcggcgttcggggtcgtcggggccgtgctggggagggcgcccgtggtgaggtcctccgcccgggtcgtcgtcggcgggctggccgccatggggctcaccttcggcctcatgcggctcttccgggccagcggcatatgacgtgacgaggtttttttggttgccgtcaccgatcgtcgtgtcgcccatgctttcctcgtgatcctacctacgtacgtgcgtggtgccaacgtcttcttcttccccggccggctgatgacctgacgtccgtgcatggaatgtgcatgcccggccgtgcgtctcttctctagctgcttaatcctctctctactgctatcactagtctttgcatgcatgccacgctagctgatgtaacattggccagctgcatgcatgctatagtatttttactgcaccatgtaacgttactaagtactagtacttgattgggaggtggaagaaggtgaccaaggttgttgcaagaaaaggcgagctatatatataagctaattgattttaatatcccatgcaagtcaagccgtatatatgcatatgttcaatgttcaactaagcttgattatatatatatattgagaacaatattaccaaaaaaagtc

SEQ ID NO: 2661 - DNA, 855 bp, Triticum aestivum
catcactgccatctccatccatctcactagctgccagtcgccatggccgtgaacaacaccaagctggccgccgtggcggacgccgagaacccggccgtggtgtgcggcgacgtcgacgactccgagtcgtccatcgacttcgccgggcgcgccaactggctgcgcgcggcggtgctgggcgccaacgacgggctggtctccacggcctccctcatgctcggcgtcagcgccgtcaagcccgaggcgcgggccatggtcgtgtccgggttcgcgggactactggccggggcgtgcagcatggccatcggagagtacgtgtccgtctgctcccagcgcgacgtggagatcgcggagctggaccaggccggaaagcgtggcggcgacgaggagaaggcactgccaagcccggcacaggccgccgcggcctccgcgctggctttctccgtcggggcgctcctaccgctgctggccgccgggttcatcgtgggctacaacctgcgggtggccgtggtggtcgtcgtggcgacgttggcgctggccgcgttcggatgcgtgggcgccgtgctggggcgggcccccgtggcgaggtcgtgcgcgcgggtggtggtgggcggactggctgccatggccgtcacctttgggttcatgaggctcttccgagccagcggcgtatgagaaactacatggtcttcgtcgccgtcctcgcgtgcgtaggtcatgtgcgggcatcgtccatactcttttcggaataaagtacccagtactagccaccgtacttgcacctacggctgacttattttcttccttgtaatagtaatcaaacggcaaatgaaaacgtttaaacccgtactatag

SEQ ID NO: 2662 - DNA, 678 bp, Festuca arundinacea
  misc_feature (259)..(259): n is a, c, g, or t
  misc_feature (455)..(455): n is a, c, g, or t
ggcacgaggtaaacaccaccatctccatcactcaatcgatctcatttgagctgccatggccgtgagcgacaccaagctggccgatgcagagaaccctacggccacaaagttcggcgatgactccgacgtaaacttcgcgggccgcgccaactggctgcgggcggcggtgctgggggccaacgacggcctggtctccacggcctcgctcatgctgggcgtgagcgcggtgaagcacgatgtgcgggcgatggtggtgtcngggttcgcgggcctgctggcgggagcgtgcagcatggccatcggggagtacgtctccgtctgctcccagcgggacgtggagctcgcgcagctggaccgcgacggcaagcgcggaggcgatgaggagagggcgctgcccaaccctgtacaggctgccgtggcgtccgcgctcgcgttctcggtcggcgccttgctgncgctgccggcggccgggttcatcgtcgggtacaggctgcgggtggccgtagtggtcgccgtggcgaccatggcgctggcggcgtttggatacgtcggtgatgtgctcggctgggcgccaataaccaggtcctgcgcgagggttgtggtgggcgggttcgccgccatgggcgtcaccttcggcctcatgaggctcttccgtgagctggccgagtagccttcgca

SEQ ID NO: 2663 - DNA, 812 bp, Secale cereale
tcagctgccactgcataataccactagtgccgtctccatccgtctcactagctgccagtcgtcatggccatgaacaacaccaagctggccgccgtggctgacgccgagaacccggccgtggtgtgcggcgacgtggacgactccgagtcgtccatcgacttcgccgggcgcgcaaactggctgcgcgcggcggtgctgggcgccaacgacgggctggtctccacggcctccctcatgctcggcgtcagcgccgtcaagcccgacgcgcgcgccatggtcgtgtccgggttcgccggcctcctggcgggggcgtgcagcatggccatcggcgagtacgtgtccgtctgctcccagcgcgacgtggagatcgcgcagctggaccaggccggcaagcgtggcggcgacgaggagaaggaactgcccagcccggcccaggccgccgcggcctccgcgctggctttctccgtcggggcgctcctaccgctgctggccgccgggttcatcgtgagctacaacctacgggtcgccgtggtggtcctcgtggcgacgttggcgctggccgcgttcggatgcgtgggcgccgtgctcgggcgggcccccgttgcgaggtcgtgcgcgcgggtggtggtgtgcgggctggccgccatggccgtcacctttgggttcatgaggctcttccgagccagcggcgtatgagagactgacaaggccttcgtcgccgtccttgcggacgtacgtcatgtacgggcatcgtccatagtcctctcggaataaaatacacagtactagccaccgtacctgtacctgggctg

SEQ ID NO: 2664 - DNA, 719 bp, Secale cereale
gtggctgacgccgagaacccggccgtggtgtgcggcgatgtggacgactccgagtcgtccatcgacttcgccgggcgcgcaaactggctgcgcgcggcggtgctgggcgccaacgacgggctggtatccacggcctcgctcatgctcggcgtcagcgccgtcaagcccgacgcgcgcgccatggtcgtctccgggttcgcgggactcctggcgggggcgtgcagcatggccatcggggagtacgtgtccgtctgctcccaacgcgacgtggagatcgcgcagctggaccaggccggcaagcgtggcggcgacgaggagaaggaactgcccagcccggcccaggccgccgcggcctccgcgctggctttctccgtcggggcgctcctaccactgctggccgccgggttcatcgtgggctacaacctacgggtcgccgtggtggtcctcgtggcgacgttggcgctggccgcgttcggatgcgtgggcgccgtgctcgggcgggcccccgttgcgaggtcgtgcgcgcgggtggtcgtgggcgggctggccgccatggccgtcaccttcgggttcatgaggctcttccgagccagcggcgtatgagagactgacaaggccttcgtcgccgtccttgcggacgtacgtcatgtacgggcatcgtccatagtcttctcggaataaaatacacagtactagccaccgtacctgtacctgggctg

SEQ ID NO: 2665 - DNA, 797 bp, Lolium multiflorum
acgcctgcaggtacccgggaattcggccattacggccgggggcaggaagaggcggagatgcaggaggaggggattcgctgcctcgcagggcgtggaagcagtacctgctccagctccagctccagctccaccctctccgcaccaagatgatcacggcgcggtgcctcgccggcgtcagtgactccgtcgcgcagaagctctccggctaccagacgatcgagaagcgccgcctcctgctcaagatgatgtttggattcgcgcatggaggcccatttgggcatttcctgcataaagtgttggattatatctttaaaggaaagaaggatagcagaactgttgctaagaaggtcttgctggagcagatcacctcctctccctggaacaatctactttcttattctattatggatatgttgtcgagaagaggcctttcaaggaggtgaaggctagggtcaggaaacaatatccttcagtgcagttgtctgcttggatgttttggccaatagttggctggataaaccatcagtatgtgccactccagttccgggtgattgtccacagcttcgtcgcatgttgttgggggatatttctcaacctccgcgccagggcggcttctttgaagcagtcatagactggtttagaagcaagattgtggctcggctccgacatggagtaacaacgatgctaagcttgatattgtgtactgctggtagttcagtgtattttaagttgtttgaggatttaagcaagattgtggctcggctctgttattcatgctctgggaaaaagagggctct

SEQ ID NO: 2666 - DNA, 2713 bp, Sorghum bicolor
tctacagcggcgctcccaactatggcggcacgtacggaggccacggcggtccgccaccgttcggcacgtccgacagccagggcggccaaccgccctttggctatgatccccaggtcaagttctacaagttggaattcccaacgtacgatggcaccgtcgacccactgaactggctcaatcagtgcgaccagttcttctgcggacagcgcacgccggcgtccaaccgtacctggctggtgtcctaccatcttcgagggggcgcgcagacctggtactatgccttggagcaagacgagggcatgccgccgtgggagcgcttccgcgatttatgtcgccttcgctttggtccgccgctgcatggcagtcggctggctgagctcgggcggctgcctttcgccacttctgtccaggagttcgccgatcggtttcaggctctcgcctgccatgcaccggacgtctcgacacgtcagcgggctgagctctttgtcggcggccttccggagtatatccgggtggatgttgagatgcaccacccgcaggacctgcaagtagccatatactacgcacgtgccttcgagcgacgggcagctgcgacccctccggtgccccctgcccgcccgaccagaccagcgcagcggccgggccttccagcagcacgtgcgccaggcgcagggccggctgccgttcccccagcagcaggtgctggcgccccaggcgggcgcgcgttccgacgcctaacaccggcagagcagcaagagcgtcgccgccaggggctctgctacaactgcgatgaactctacaccccgggccatatgtgccagcgccttctctatctggcagccgacgactacattgaggaagctgtgcagccacaaggagatgcggccgcgccagctctgcaggaggccgccgccccggaagaagaggttgctaacgtcctggcagtttccctccatgcttttgcaggtattcggacgacgaacaccatgttgctgccagtgctaatcaaaggggagtgcgtgctggcgttgctcgacacgggctccacccacaacttcctcagtggagcgattatggagcgccttggcttggttccggatggcggggaccaactgcgcgtcacggtggccaatggggacaaactacgctgcgccggcatcgcccggaacgtccccatctccatcgagggcgagactttcgccatcacgtgcgccggcatcgacttgggctgtttcgacttcatcctcggctacgacttcctgcgcacgctcggccccatcacgtgggacttggaggccaagaccatggcgttctggcgtggcggacgcgggatccagtggcagggcgtgggcggggctgacacccctgcgccccccagcaggccacggcggctgctctagccgcccagcagcccctgctggacaccctcctcgagcagcatgcagccatcttcgaggagccgcgcggtcttcccccggcgaggccgtacgaccaccgcatccacctgctgccggacacgccgccggtcgccgttcgaccatatcgatacccccagctgcagaaggacgagctggagcgccagtgcgaggccatgctcgcccagggcatcatccggccaagcacttcaccgttctccgcaccggtgttgttggtccggaaggcggacgcgtcgtggcggttctgcatcgactatcgtgccctcaacgccaagacgtccaaggacaaattcccgatcccggtggtggacgagctcctcgacgagctccatggggcgcgtttcttcactaagctcgacttgcggtcgggctaccaccaggtgcggatgcaccccgatgacgtcgccaagacggccttccgcacgcaccatggccactacgagttcctggtcatgccgttcgggctctccaacgcgccggcaacgtttcaggcgctgatgaacgacgtgttgcgctcctacttgtggagctctttggttttgcatatggtggcccatttggacatttcttacacaaaattttggattatattttccaagggaagaaggataccaaaaccatagcaaagaaggtgttgctggagcaagtgacatcttctccatggaataacatattgttcttgttctattatggatatgttgttgagaggaggcctttgaaggaggtgacgaccagggtcaagaaacaatatccttctgtgcaattgagcgcttggatgttttggccgatagttggttggataaaccatcagtacatgcctttacagttccgtgtgatcttccacagcgttgtcgcatgctgttgggggatatttctgaaccttcgtgcaagggccatgtctctgaagcaggcgtagatggtttagaaggaagaaatagcagcatagctccaacccggtaccagatgaaatgattatcaaggaagctggatgctgttatcctgtagtgttctgcacccaaatcgttgctgaatccattcaagtagttgggtttttttttactattaattatctggtactggtagtagatttatttgattgtcaacgcgtgcaaagacagatgacccttacgtggattgtgaattgtgatggaagcaaagtatggcgaattcggcaacctctgagaaccagtgttcaattttcagctataaatagtcattgactcatgagattgttccagcatccaccgttcttgctggtaaatcaaacctgtttgcct

SEQ ID NO: 2667 - DNA, 1817 bp, Secale cereale
ttcctctgcgcggactgcgacagcgggtgcgagggcgcggcgcgcgtgccgtggaggggttcgccggctgccccgcagcgtccgagctcgccgcgtcgtggggcgtcgacctcctccctggcggcggtggcgctgccgcgttcggttgcggcctcggcggcggcggcgaccaagacgatgaggacgccttcttcttctcgtccctggactactccatgctggttgacccggagatgcgcgacctctacgtgccctgcaacccgccggaagtggccgtctctgcaggcggtggtcggcccctcaagggggaagcgctgtgccaccagctcgcggagatggcgcggcgagagacggagacgtcgcagccgcaggggtactcggatctgagccccaggactcctcgccggtcctccgcggggctagcgggcgcttgcctgacaagcaagctcccccaccgctgcctcctgctccggaggtgccgtgtccgtacacatccctgctgatgatgccgtcagctaactgcgccgagcttatcggcaacgaccgtctccgtgatgacgacgaagaacaacttcgatgggagttcgccccaccctcatcagtgccacccacccagatatgggatttcaatttaggaagatcaaggaaccacaatgaaaagtctgcacatgaagttggatttggttcaaacaatggaggctttatgatcaagagttacagtgacatgctcaaggaaatttcttgtgggacaacaaaagatctggaagatatttatgactcaggatacggtgcagctgctgaagatatcatgtcaactaatatctgccaggtgccatccaaaaatgttagcacagcgagcaacaagcgaatgaaggtaagctcatgcacctcgaccatggatggcccaacaacctccgggagccatgtgcctgcttcggggaccttggggagctcttcccatgacagaggagcagctcccgctagggagatctcctttggtgatcaaacaatcgtcccgactggagctgagaggcctgccgcaaggatcgacagcgagacactcgcgctaaacagggatagcgcgatgcagcggtacaaagagaagaggaagaatcgcaggtacgagaagcacatccggtatgagtcccggaagctgagggcggatacccggaagcgggtgaaaggccgttttgtcaagtcgaatgaagcgctcaatgccggcagcaatggcggatgagctagccttctttcttgctcgcagcatggagatgacatcttgcgccgcacctaagcatgatgccgtgcattgctcagctattttttgtgtcatcattttcagcatcgtgatcaagaggatcatattcacggtgtttttttccttgtaaaagacctctccttttctcttcagaacacataaatagccagcttgattttacactatggtaaaaaaaaaaaaaaaaaagaggaggagggaggagtgaggacgaggaggggacggaagaaggggcgggaggacggtaggagggaaggaagaggacggaggagtgagaagaagatggcgaggaagaggagggagagtgagatgaggaggaggtgacgaggcgtgagaacgaacggaggagggtaggcgacggacggcggaacggacgtgggggcggccgagaaagggcggtggccacggaacaagtctgccctcgcgaacggacgaggaaaggaacgacgaagagagtgcgacgtcggtagggagacgaacctggaatacgtggtcgtcggtccgtaaggtttcggccggccggttctttcggcgtggtctttac

SEQ ID NO: 2668 - DNA, 1439 bp, Triticum aestivum
tgcggcctcggcggcggcggcgaccaagaggatgaggacgccttcttcttctcgtccttggactactccatgctggttgaccccgagatgcgcgacctctacgtgccctgcaacccgccggaggtggctgtctcggcgggcggcggccggcccctcaagggggaagcgctgtgccaccagctcgccgagatggcgcggcgagagacggagacgtcgcagccgcaggggtactcggatctgagccccaggactcctcgtcggtcctccgccggggctagcgggcgcttgcctgacaagcaagctcccccaccgctgcctcctgctccggaggtgccgtgtccgtacacgtccctgctgatgatgccgtcagctcactgcgccgagcttatcggcaacgaccgcctccgtgatgatgacgaagagcaacttcgatgggagttcgccccaccctcatcagtgccacccacccagatatgggatttcaatttaggaagatcaaggaaccacaatgaaaaatctgcacatgagattggatttggttcaaacaatggaggctttatgatcaagagttacagtgacatgctcaaggagatttcttgtgggacaacgaaagatctggaagatatttatgactcaggatatggtgcagctgctgaagatatcatgtcaacaaatatttgccaagtgccatccaaaaatgttagcacagcgagcaacaagcgaatgaaggtaagctcatgcacctcgacgatggatggcccaacaacctccgggagccatgtgcctgcttctgggaccttggggagctcttcccatgacagaggagcagctcccgctagggagatctcctttggtgatcaaacaatcgtcccgactggacccgagaggcctgccgcaaggatcgacagcgagacgctcgcgctaaacagggacagcgcgatgcagcggtacaaagagaagaggaagaatcgcaggtacgagaagcacatccggtatgagtcccggaagctgagggcggatacccggaagcgggtgaaaggccgttttgtcaagtcgaatgaagcgctcaatgccggcagcaatggcggatgagctagccttcttccttgctcgcagcacggagatgacatcctgcgctgcacctaagcatgatgccgtgcattgctcagctattttttgtgtctcatcattttcagcatcgtgatccagaggatcatttcacggtgtgtttcttttgtaagagacctccccttttctcctcagaacacataaatagccagcttaattttacagtatggtatatacggtgcatatatgcgtctcatctttcatgctcatgattttatgaatggatactgctgcttaacctaccaactagtaattgagatccaaaaggacaaacaatgtactcccaagaactttacatgatctgatgataa

SEQ ID NO: 2669 - DNA, 2825 bp, Triticum aestivum
acgaggcacaacctctgtgtgccgccatggcgcccgccgcgaagaagcccccgctgaagtccagctcctcgcacaactccgccgcgggggatgccgccgggaagaccatcgaggagatgtaccagaagaagacacagctggagcacatcctgctgcgcccggacacctacgtcggctccgtccagaaccacacgcagacgctctgggtctacgaggacggcgccatggtgaatcggcctgtctcctacgtccccggcctctacaagatcttcgacgagatcctcgtcaacgccgcagacaacaagcagcgcgacccctccatggactccctcaaggtcgacatcgacgtcgaggggtgctgcatctccatctacaataacggagacggcgtgcccgtcgagatccaccaggaggagggcgtgtacgtgccggagctcatcttcggccatctcctcacaagcagcaactacgacgacaacgagcggaagaccactggcgggaggaacggctacggtgccaagctcgccaacatcttctccacggagttcgtcatcgagaccgctgatgggcaccggctgaagcggtacaggcaggttttctctgagaacatggggaagaagtcggagcctgagattaaaaagtgcaagcagtcagagaactggaccagggttaccttcaagcctgaccttgcaaagttcaacatgaccgagctcgaagctgatgttgtggcactcatgaggaagcgagtggttgatatggcaggcacccttggcaaaaccgtgaaggttgagttgaatggtgagaaggtggcagtaaaaagcttctctgattacgtgcaactgtatattaactctgcttccaaagaaggaatcgatctaccaagaatttaccaaaaaataaatgatcgttgggaggtgtgtgtgagtctaagtgaaggccagttccagcaggtcagttttgtaaatggaattgccaccataagaggtggaactcatgttgactatgttgcaaaccaagttgccagccatgtgatgggggttgtgaacaagaagaacaagcaggctaacatgaagttgcatacagtgaagggctacctatgggtatttgttaatgcgctcattgacaaccctgcatttgactcacagaccaaagagaccttgacaactcgtcaagcaagctttgggtccacgtgcgagctctctgacgaattccttaagaaggtctctagctcgggtgttgttaacaatctcctttcttgggccgagttcaaactaagcaaggaacttaaaaagactgatggaaccaagaagacaagtattgttggcatccctaagctggaggatgcaaatgacgctggtgggaagaactctgacaagtgcaccttgatccttactgaaggagattcagcaaaggctctagctatggctggcataggtgtagtaggaagggaccactatggcgtgtttcctctcaggggtaaattattaaatgtgagggaagcgagccataagcaattaatggagaatgcagagatccaaaatataaagaaaatattaggtctgcagcatgaaaaaagtatgatagcacgaaaggcttgagatatggccacctcatgatcatgacagatcaggaccatgatggttcccacatcaaagggttgctgatcaatttcattcacaaagagtggccatctctcctcaaagttccttctttcttggttgagttcatcactccaattatcaaggcaaccaagggcaaaactgtcaagccattttactcaatgccagactatgaagcatggaaagaggacttaggagcaagtgcaagttcgtggactataaagtactacaaggggctgggaaccagcacagctgaagaaggccgggattactttgaacaaatttcccttcacaagaaggattttgtctgggcggatgacaaagatggtgaagctattgagctagcgttcagcaagaaaaagatcactgagaggaaggattggctgaccaactaccagcctggtacttgccttgaccaacgtgagaaacgcatcaagtacagtgattttatcaacaaagagctgatactcttctcgatggcagaccttgaacggtcaataccttcaatggttgacggctttaaaccaggacagaggaagattttgttttgctcgttcaagaagaatttgcttaaagaatctaaggtggcacagtttattggttatgtgtcagaacactcagcataccaccatggtgagcagagtctagcaagcacaatcataggaatggctcaggattttgttggcagcaataatattaatcttttggagccccgtggccaatttggtaccagaaatgcggggggcaaagatgctgctagtgctaggtacatcttcaccagattacagcctgtcacccgtttaatttttccgaaggatgatgatgttcttctgaactatttgaatgaagacgggcagtcaattgaacccagctggtatatgccaatcattcccatggttttggtcaatggaagtgaaggcattggcactggatggagcacctatgtcccaaattacaatccaaaagacattattgctaatctgaaaaggttgctgaatggggagactattgtaccaatggttccttggtacagggggttcaagggctctttgaaggagacaagttcaaaggcaaccggtgtgacatataccatcactggtgttatagaggaagttgctgacaccaagcttaaaattactgagcttcccgtccgccgctggactacagattacaaagaatttcttgaatccatgtgtcctattccta

SEQ ID NO: 2670 - DNA, 4678 bp, Secale cereale
gactcccaaaaccaaaccccagccgctagctagcgcggacgccacctcagcgtgcgcccgccgccatggcgcccgccgcgaagaagccgccgctcaagtccagctcctcgcacaactccgccgcgggggacgccaccgccgccgccgcagccgccgccgggaagaccatcgaggagatgttccagaagaagacgcagctggagcacatcctgctgcgcccggacacctacgtcggctcggtccagaagcacacgcagccgctgtgggtctacgagggcggcgccatggtgcagcggcccgtctcctacgtccccggcctctacaagatcttcgacgagatcctcgtcaacgccgccgacaacaagcagcgtgatccctccatggactccctcaaggtcgacatcgacgtcggcggctgctgcatctccatctacaacaacggggacgcgtgcccgtcgagatccaccaggaggagcgcatctacgtccccgagctcatcttcggccacctcctcaccagcagcaactacgacgacaacgagcggaagaccaccggcgggaggaacggctacggcgccaagctcgccaacatcttctccacggagttcgtcatcgagaccgctgacgggcaccggcagaagaggtaccggcaggttttctctgataacatgggaaagaaatcggagcccgagattaagaagtgcaaacagtcagagaactggaccaaagttaccttcaagcctgaccttgcaaagttcaacatgaccgagctcgaagctgatgtcgtggcactcatgatgaagcgagtagttgatatggcgggcacccttggcaaaacggtgaaggttgagttgaatggcgagaaggtggcagtaaaaggcttctcagattatgtgcaactgtatatcgattctgcttccaaagaaggcatcgagctaccaagaatttaccaaaaggtaaatgatcgttgggaggtgtgtgtgagtctaagtgaaggccagttccagcaggtcagttttgtaaacggaattgcaaccataagaggtggaactcacgttgactatgtcacgaaccaaattgccagccatgtgatgggcgttgtgaacaagaagaacaagcaggctcacatgaagttgcatacagtgaagggctacctatgggtatttgttaatgcgctcattgacaaccctgcatttgattcacagaccaaagagaccttgacgactcgtcaagcaagctttgggtccacatgcgagctctctgaagagttccttaagaaagtctctagctcgggtgttgttaacaatctcctttcttgggccgagttcaaactaaacaaggagctaaagaagactgatggaaccaagaagacaagtattgttggcatccccaagctggaggatgcaaatgacgctggtgggaagaactctgacaagtgcaccttgatccttaccgagggagattcagcaaaggctctagcaatggctggtataggtgtagtaggaagggaccactatggtgtgtttcctctcagaggtaaattattaaatgtgagagaagcaagccataagcagctaatggagaatgcagagatccagaatataaagaaaatattaggtctgcagcatgaaaagaagtatgatagtacgaagggcttgagatacggccacctcatgataatgacagatcaggaccatgatggttcccacatcaaagggttgctgatcaatttcattcacaaagagtggccatctctcctcaaagttccttctttcttggttgagttcatcactccaattatcaaggcaaccaagggcaaagctgtcaaggcattttactctatgccagactatgaagcatggaaagagagcttaggtggaaatgcaagttcgtggactataaagtactacaaggggctgggaaccagcacagctcaagaaggtcgggattactttgaagatattacccatcacaagaaagattttgtctgggcagatgacaaagaagatggtgaggctattgaattagcattcagcaagaaaaagattgctgagaggaaggactggctgaccaactatcagcctggaacttgccttgaccaacgggagaagcgcatcaagtacagtgattttatcaacaaagagcttatactcttctcgatggcagaccttgaacggtcaataccttcaatggtcgacggctttaaaccaggacagaggaagattttgttttgctcattcaagaagaatttggttaaagaatcaaaggtggcacagtttattggttatgtgtcagagcactcagcataccaccatggtgagcagagtctagcaagcacaattataggaatggctcaggattttgttggcagcaataatattaatcttttggagccccgtggccagtttggtaccagaaatgcggggggcaaagacgctgctagtgctaggtacatcttcaccagattacaacctatcactcgcttaatttttccaaaggatgatgatgttcttctgaactatttgaatgaagacgggcagtcgattgaacccagttggtatatgccaatcattcccatggttttggtcaatggaagtgaaggcattggcactggatggagcacatatgtcccaaactacaatccaagagacattattgctaatctgaaaaggttgctaaataacgagactatcgtaccaatgattccttggtacagggggttcaagggctctttgaaggagacaagttcaaaggcaactggtgtgacatataccatcactggtgttatagaggaagttgctgacaccaggcttaaaattactgagcttcccgtccgccgctggactacagattacaaagagtttcttgaatccatgtgtcctattcctattaaggaaaaggaaaagagcaaggacaagaacaaggagaagaagaaggacaaggacaaggacaaggaaaaggaaaaggaaaagagcaaggaaccaccattgttagaggaaataaggtcgcagtgtgatcatgcggatgtagattttgagcttatcctgacagagcaaaacatgaatgtagctaagcaagaaggccttgagaagaaattcaagctgactaccacaataggaacaacaaacatgcacttgtttgactcaaatggtaaaatccgaaaatatgacaccccagaggacgtacttaaagagttctttgatttgaggcttgacttctatgtcagacgaaagaaagtaatgttggaaaacatggggattgagttgctgaagtataagaacaaagttaggtttattcttgctgttatttctggggacatcatagtcaataacaggaagagggcagagctattcctggagctgagggagaagaaatatgatcctttcccaaagaaaaaacccacgtccgagccagttgctgtaggatctacagaagtagatgaagaaaatgatgagagtcctgttgaagctgcagcaagtgactacgagtatcttctcgcaatgtcgattggtaccttgactatggagaaggtgaaagagctcatcgcacagcaggataaggtagaggatgatcttaaaatcctgagtaatacagagccagaaactctttggctgagagaccttgatgctcttgagaaggaactggatgtgcttgatgcaaaacttgaagctgaacagaaggacagatcatgcaagcgcgccaaaaacgcgaaggaatctaatgcagcagccaagagacagcctaagaaggctgcggccaagtctcagaaggctgggagcgacgatcaagatttcgaaccaccgaagccgaaacctgcagcacaaaagaagaaagcaccacccaagaaggcaagtgcaccggtgaaagatgacgaggacgacgaattggctaatctcaaagaccgtctggccgcttataatcttgacgactcctctccagaacctagtgccatggaaacagaagaacagcagaaggcaaagaaagggaggaacggagcaagcaaaagaggcgcagcaaagaaggccatgtcatccttagctgagtcctctgacgaagacatggcagagcccgaggatgggggttcttccatggaagttgagaagaagaccaaaggaagaaagcctgccgccgagaagccgaaggctaccaccatcaggaagagggcgccggctcagagcaaaggcatgaggcagaaggtgatggaggaaatactcaagcctaccgatgacagcaacctcagcgctccttctcccgagaagaaggtgcggaggatgagggactcccccttcaacaagaagagcggctcgcttctgcagagagcggcgggcgcttcgacgggggcggaagacgccgaggctcctcctccggcagctctgccgaggcagctgcaccgagaaggaccgcaagggagaggaaggtggcaatagcctacgtcgattccgggagcgacgacgatgagtccgaggatgaagatgcctcggagccgagcgaatctgactactccagtgaggactaggatggtaggactccttagctcagctgcccaaacagcgtgtggagtgcagtgtgattggtttctaagacatttggttagcttatctgaatgtgttggtgctttgctcaggtgcatttcttgtgcgtcttatgtttatgttagatgggtgtactgatatcacaat

SEQ ID NO: 2671 - DNA, 4775 bp, Brachypodium distachyon
cccaatcccgcaacctctcccatcccaaaccctagcgggcacacagcctctgtgccgccatggccgccgccgccaagaagcccccgctcaagtccagctcctcgcacaactccgtcgcgggcggcggcgccgggaagaccatcgaggagatgtaccagaagaagacgcagctggagcacatcctcctgcggccggacacgtacatcggctcggtggagaagcacacgcagccgctgtgggtctacgatgacggcgccatggtgcaccggcctgtcacctacgtccccggcctctacaagatcttcgacgagatcctcgtcaacgccgccgacaacaaacagcgcgaccccaaaatggactccctccgggtctttatcgacgtcgagggctgttgtgtctccgtatacaacaacggagacggcatacccgtcgagatccaccaggcggagggcgtctacgtgccggagatgatctttggccacctcctcactagcagcaactacaacgacaacgagcagaagacaacaggagggaggaacggctacggtgccaaactcaccaacatcttctcgacggagttcacgatcgagacagctgatgggcaccggcaaaagaagtacaagcaggttttctctgaaaacatggggaagaagtcggagcctgagatttcaaagtgcaagcagtcagagaactggaccagagttactttcaagcccgaccttgcgaaatttaacatggcccatctggaagatgatgtcgtggcactcatgaagaagcgagtagttgatatggcaggaacccttggcaaaaccgtgaaggttgagttaaatggccagaaagtgccagcaaagagcttcttggaatatgtgaatttgtatatagactcggcttccaaagatggagtcaagctccccagtatttaccaaaaagtaaatgatcggtgggaggtctgtgtgagtctaagcgaagggcagtttcagcaggtcagctttgtaaatggaattgcgaccataagaggtggaacacatgttgactatgttgctaaccaaatcgccacccatgtgatggccgttgtgaacaagaagaacaagcaagctaacatgaaattgcacacagtaaaggggtatttatgggtgtttgttaatgcgctcattgacaaccccgcctttgattcacagaccaaggagaccttgaccactcgtcagggaagctttgggtccaagtgtgatctctctgatgatttccttaagaaggttgctgactcaggtgttgtcagcaatctcctttcttgggctgatttcaaactaagcaaggaactcaagaagactgatgggagcaagaggtcaaatgtactcggcatccctaaacttgaggatgcaaatgacgctggtgggagggactctgataagtgcaccttgatccttactgaaggagattcagcaaaggctcttgctatggctggcagaggtattgtaggaaatgatcactacggtgtgtttcctctcaggggtaaattattaaatgtgagagaagcaacccataagcagatgatggagaatgcagagatccaaaatattaagaaaataattggtctgcagcatggaaaggagtacaatagcacaaaagacttgagatatggccatctcatgataatgacagatcaggaccacgatggttcacacatcaaaggcttgctgatcaatttcattcactcatcctggccatctctcctaaaagtcccatctttcttggttgagttcatcacaccaattatcaaggcaaccaataaaaggagcaaatctgtaatttcattttactcaatgccagactatgaagcatggaaggagaggctaggggcaaatgcaagtgcttggtctataaagtactacaaggggctgggaaccagcactgcagacgaaggccgcgagtactttgaaaagattgcgcatcacaggaaggattttgtctgggcggatgacaaggatggagatgctattgagttagcattcagcaagaaaaggattgctgataggaaagactggctaagcaattatcagcctggaacttgccttgatcaacgcgagaaacgcatcaagtacagtgattttatcaacaaagagctgatactcttctcgatggcagaccttgaacggtcaattccttcaatggttgacggccttaaaccaggccagaggaagattttgttttcctcattcaagagaaacttggttaaagaaattaaggtggcacaatttattggttatgtgtctgaacactcagcataccaccatggggagcagagtctagcaagtacgattctaggaatggctcaagattatgttggcagcaataatataagtctattggagccccgtggccaatttggcaccagaaattcggggggcaaagatgctgccagcgcgaggtacatctacaccagattgccttctatcactcgcataattttcccgaaggatgatgatgttcttctgaactatttgaatgaagatggacagtcaatcgaacccacctggtacatgccaatcattcccatggttttggtcaatggaagtgaaggcattggcactggatggagcacctataccccaaactataatccaagagatattgttgctaatctgaaacgattactaaatgatgatccgatcgtaccaatggatccttggtacaaggggttcaagggctcttttgagaagacaactacaaaggcagcaggtgtcacatataccatctctggtattatagaggcagccaatgacaccaagcttataattagtgagctccctgtccgccgctggactttagattacaaagaatttcttttgtccatgtgtcctcaaagtgtgaaggaaaaggaaaaagagaaggacaagaataagaacaagagcaaggataaggacaaggacaaggacaagaataaggaaaaggaaccaccatttcttgaggatcttaggtctcaatgcgatgattcctctgtatattttgaacttacattgagcgagaaaaacatggctatcgctatgcaagaaggccttgagaagaaattcaagctgacaaacacaatgggaacgacaaacatgcacttatttgactcgaatggtaaaatacgaaaatatgacacaccggaggaaatacttcaagagtttttcacactgaggctcgaattctatggccgaagaaagataacaatgttgaaaaatatgagggtggaattattgaagcttgagaacagagttcgttttattcgttctgttattagtggcgatataaaagtaaataacaggaagagggctgagctattcctggagcttaaggagaagaattttgatgctttcccgaagaaaaaaaataagacagagccagttgcagtaggagctgaagaagaagatgaagaaaatgaagagagtcctgctgaagatactgatggagttcttggaggtgattatgagtatcttctctcgatggcaatcggtactttgactctagagaaggtgaagcagctcatagcacaaaaggacaatctagtgaatgaagttgaaaggctgagtaaaacagatccaaaatctctctgggtgaaagaccttgatgctcttgagaaggaactggatgtgcttgatgctgaacttaaagctgctgaggagaagagaagactggcaagggaaaaatcgacaaaagatggtaaggcatctaaagcagcacccaagagacagccaaagaagactgcagccaagtctcagaaggcaaatttggctgggagcgatgatgaagattatgtagcagcaattcccaaaccggcagcacagaagaagaaaccagctaagaaggcaagtgcacaggtgaaagatgctgaggatgaaattcttgaactaaaagaccgccttgctgcttctaatcttgactcttctccagaacatattgacatggaaactgagactacagagggaccggagaaaggaaagaagggagtggatgaaccaagcaatagaggtgcagcaaaaaaggccatgtcatctttagcagactggtctgacgaagaagacttaacagcacccatccatgagagcgaggacgaagggtttgccatggaagaagtgcaagttgagaagaaaactagaggcagaaagcctgctgctgagaagtcaaagcctgccgtcaggaagagggcgccagctcagagcaagggcatgaggcagaaagtgatggaagaaatattcaaacctacagacgatagtaccacaagtgctccttctcctgtgaagaaagtgcgcaagatgagggcttcccccttcaacaagaagagcggctcggttttccaaagagttgcaggtgcttcaactggaacagaagatactgacgctccccagtctgggagctctgctgagccagttgcccctaggaggacagccagggagaggaaagcaaaagcaatatatatcgattctgccagcgacaatgatgactctgaggacgaagatgtgcaggatttgagcgatgaatctgacttcgatgaggacgaagactaaacccattcactctactgctgaactcaatttttgagaaattcggtagttcatttggttagtttataactctatatgttgcattgatgcatctcttgtgcgtcctgtgttgtcgagacattatgccatcgatctgaggctagtgcttgtgggatctctatgttgagttatgaaatcaatgaacttgaggcatttgatgcattgattagcttaattggtgaatgccgtggaatt

SEQ ID NO: 2672 - DNA, 2533 bp, Triticum aestivum
gacccctccatggactccctcaaggtcgacatcgacgtcggcggctgctgcatctccatctacaacaacggggacggcgtgcccgtcgagatccaccaggaggagggcatctacgtgcccgagctcatcttcggccacctcctcaccagcagcaactacgacgacaacgagcgcaagaccaccggcgggaggaacggctacggcgccaagctcgccaacatcttctccacggagttcgtcatcgagaccgccgatgggcaccggcagaagaggtacaggcaggttttctctgataacatggggaagaagacggagcccgagattaagaagtgcaagcagtcagagaactggaccaaagttaccttcaagcctgaccttgcaaagttcaacatgaccgagctcgaagctgatgtcgtggcactcatgatgaagcgagtagttgatatggccggcacccttggcaaaacggtgaaggttgagttgaatggcgagaaggtggcagtaaaaggcttctcagattatgtgcaactgtatatcgactctgcttccaaagaaggcatcgagttaccaagaatttaccaaaaggtaaatgatcgttgggaggtgtgtgtgagtctaagtgaaggccagttccagcaggtcagttttgtaaacggtattgcgaccataagaggtggaactcacgttgattacgtcgcaaaccaaattgccagccatgtgatgggcgttgtgaacaagaagaacaagcaggctaacatgaagttgcatacagtgaagggctacctatgggtatttgttaatgcgctcattgacaaccctgcatttgattcacagaccaaagagaccttgacgactcgtcaagcaagctttggttccacatgcgagctctctgaagagttccttaagaaggtctctagctcgggtgttgttagcaatctcctttcttgggccgagttcaaactaaataaggaactaaagaagactgatggaaccaagaagacaagtattgttggcatccctaagctggaggatgcaaatgacgctggtgggaagaactccgacaagtgcaccttgatccttactgaaggagattcagcaaaggctctagctatggctggtataggtgtagtgggaagggaccactatggcgtgtttcctctcaggggtaaattattaaatgtgagagaagcaagccataagcagctaatggagaatgcagagatccagaatataaagaaaattttaggtctgcagcatgataagaagtatgatagtacaaagggcttgagatacggccacctcatgataatgacagaccaggaccatgatggttcccacatcaaagggttgctgatcaatttcattcacaaagagtggccatctctccttaaagttccttctttcttggttgagttcatcactccaattattaaggcaaccaagggcaaagctgtcaagtcattttactctatgccagactatgaagcatggaaagagagcttagctggaaatgcaagttcgtggactataaagtactacaaggggctgggaaccagcacagctcaagaaggtcgggattactttgaagatattacccatcataagaaggattttgtctgggcagatgacaaagaagatggtgaggctattgagttagcattcagcaagaaaaagattgctgagaggaaggactggctgaccaactatcagcctggaacttgccttgaccaacgggagaaacgcatcaagtacagtgattttatcaacaaagagctgatactcttctcgatggcagaccttgaacggtcaataccttcaatggtcgacggctttaaaccaggacagaggaagattttgttttgctcgttcaagaagaatttggttaaagaatcaaaggtggcacagtttattggttatgtgtcagaacactcagcataccaccatggtgagcagagtctagcaagcacaattataggaatggctcaggattttgttggcagcaataatatcaatcttttggagccccgtggccagtttggtaccaggaatgcggggggcaaagatgctgctagtgctaggtacatcttcaccagattacaacctatcacccgcttaattttcccaaaggatgatgatgttcttctgaactatttgaatgaagatgggcagtcaattgaacccagttggtatatgccaatcattcccatggttttggtcaatggaagtgaaggcattggcactggatggagcacctatgtcccaaactacaatccaagagacattattgctaatctgaaaaggttgctaaataacgagactatcgtaccaatggttccttggtacagggggttcaagggctctttgaaggagacaagttcaaaggcaactggtgtgacatataccatcactggtgttatagaggaagttgctgacaccaggcttaaaattactgagcttcctgtccgccgctggactacagattacaaagagtttcttgaatccatgtgtcctattcctattaaggaaaaggaaa

SEQ ID NO: 2673 - DNA, 2459 bp, Triticum aestivum
acaacggggacggcgtgcccgtcgaaatccaccaggaggagaaaatctacgtgccggagctcatcttcggcaatctcctcacaagcagcaactacgacgataacgagcggaagaccaccggcgggaggaacggctacggtgccaaactcgccaacatcttctccacggagttcgtcatcgagaccgctgatgggcgccgacagaagaggtacaagcaggttttctccgagaacatgggcaagaagtcggagcctgagattaaaaagtgcaagcagtcggagaactggactaaagttaccttcaagcctgatcttgaaaagttcaaaatgactgagctcgaagcagatgttgtggcactcatgatgaagcgagtggttgacatggcgggcacccttggcaaaaccgtgaaggttgagttgaatggcgagaaggtggcagtaaaaagcttctcggattacgtgcaactgtatatcgactctgcttccaaagaaggaatcaagcttccaagaatttaccaaaaggtaaatgatcgctgggaggtgtgtgtgagtctaagtgaaggccagttccagcaggtcagttttgtaaatggaattgcgaccataaaaggtggaactcacgttgactacgttgcaagccaaattgccagccatgtgatgggtgttgtgaacaagaagaacaagcaggctaacatgaagttgcatatagtgaagggctacctatgggtatttgttaatgcgctcattgacaaccctgcatttgactcacagaccaaagagaccttgacgactcgtcaaggaagctttgggtccacgtgcgagctccctgaagatttccttaagaaggtctctagctcgggtgttgttgacagtctcctttcttgggctgagttcaaactaagcaaggaacttaagaagactgatggaaccaagaagacaagtattgttggcatccctaaactggaggatgcaaatgatgctggtgggaagaactctgaccagtgcaccttgatccttactgaaggagattcggcaaaggctttagctatggctggcataggtgtagtaggaagggatcactatggtgtgtttcctctcaggggtaaattattaaatgtgagggaagcaagccataagcagttgatggagaatgcggagatccaaaatataaagaaaatattaggtctgcagcatgaaaaaagtatgatagcacgaaaggcttgagatatggccacctcatgataatgacagatcaggaccatgatggttcccacatcaaagggttgctgatcaatttcattcacaaagagtggccatctctcctcaaagttccttctttcttggttgagttcatcactccaattatcaaggcaaccaagggcaaaactgtccgtccattttactcaatgccagattatgaagcatggaaagagtccttaggagcaagtgcaagttcgtggactataaagtactacaaggggctggggaccagcacagctgaagaaggccgggattactttgaacaaatttcccttcacaagaaggattttgtctgggcggatgacaaagatggtgaagctattgagctagcgttcagcaagaaaaagatcactgagaggaaggattggctgaccaactaccagcctggtacttgtcttgaccaacgtgagaaacgcatcaagtacagtgattttatcaacaaagagctgatactcttctcgatggcagaccttgaacggtcaataccttcaatggtcgacggctttaagccaggacagaggaagattttgttttgctcgttcaagaagaatttggttaaagaatctaaggtggcacaatttattggctatgtgtcagaacactcagcataccaccacggtgagcagagtctagcaagcacaattgtaggaatggctcaggattttgttggcagcaataatattaatcttttggaaccccgtggccaatttggtaccagaaatgcggggggcaaagatgctgctagtgctaggtacatcttcaccagattaaatcctatcacccgcttaatttttccgaaggatgatgatgttctgctgaactatttgaatgaagatgggcagtcaattgaacccagctggtatatgccaatcattcccatggttttggtcaatggaagtgaaggcattggcactggatggagcacctatgtcccaaactacaatccaagagacattattgctaatctgaaaaggttgctaaatggggagacaattgtaccaatggttccttggtacagggggttcaagggctctttgaaggagacaagtacaaaggcaactggtgtgacatataccatcactggtgttatagaggaagttgctgacaccaagcttaaaattactgagcttcccgtccgccgctggactacagattacaaagaatttcttgaatccatgtgtcctattcctataaaggaaa

SEQ ID NO: 2674 - DNA, 5392 bp, Oryza sativa
ccccagtccgccacgtgacccccacccaaaattcaaatttcgaactcgtcggcctcggcgcttcaacttaaaccccccccccccccccccccccgtatccccattctaaatccatccagatccccaattccccaatccgccatttccaccacccaaaccctagcggcgcacacaacctctgtgtgtcgccatggcggccgccgccgcgaggctcccgctccagtcgagctccggccacaacgccgccgcgggtgggggcggcggcaagaccatcgaggagatgtaccagaagaagacgcagctggagcacatcctcctgcggccggacacctacatcggctcggtggagaagcacaccgcgcagctctgggtgtacgaggacggcgccatggtgagccgcagcgtcacctacgtccccggcctctacaagatcttcgacgagatactcgtcaacgccgccgacaacaagcagcgcgacccctccatggactccctccgcgtcgagatcgacgccgacgagggccgcatctccgtctacaacaacggcgacggcatccccgtcgagatccaccaggaggagggcgtttacgtgccggagatgatattcggccacctcctcaccagtagcaattacgacgacaacgtgaagaagaccaccggcggaaggaatggttatggcgccaagctcaccaacatcttctcgacggagttcgtgattgagaccgccgatggacgtcggcagaagaagtacaagcaggttttctctgaaaacatgggaaagaagtctgaaccccagattaccaagtgcaaacaaggagagaactggaccagagtcacgttcaagcctgaccttgccaaattcaacatgacccatcttgaaaatgatgttgtagccctcatgaggaagagagtggttgatatggcaggcactcttggcaaaactgtgaaggttgagttggatcatcaaaaggtgcctgtacatagcttctctgattatgtgaaactgtatatcaagtctgcttccaaggacagagacgatgtcaatgaactcccaagtatttcacagaaagtaaatgatcggtgggaggtgtgtgtgagtcttagcgaagggcagtttcagcaggttagctttgtaaatagaattgcaaccataaaaggcggcactcatgtggactatgtcactaaccaaattgccacccatgtgatgaacattgttaataagaggaacaagaatgctcacatgaaagcacataatgtcaagagccatttatgggtctttgttaatgcactcattgacaacccagcttttgattcacaaaccaaagagaccttgactactcgtcaggcaagctttggatcaaagtgtgaactttctgatgatttccttaagaaggttggtagctcagctattgtcctcaatctcctttcttgggctgagttcaaactaagcaaggagctacagaagactgatggaagcaagcgatcaagacttaccggcatccccaagcttgaggatgcaaacggtgctggtgggaaggattctaataactgcacattaatcctgactgaaggagattcggctaaggctctagctatggctggtatttctgtggtaggaagagattactatggtgtgtttcctctcaggggaaaattattaaatgtgagagaagcaagtcataagcagatcatggagaatgcagagatccagaatataaagcaaatccttgggttgcaacacgggaagcagtatgatagcacaaaaggcttgagatatggccatctcatgataatgacagatcaggaccatgatggttcccacatcaaaggcctgttgatcaacttcattcactccttctggccttctcttattaaaattccttctttcttggttgagtttattactcctattatcaaggccaccaacaaaagggacaaaaagattgtcctgccattttactcaatgcctgagtacgaacaatggaaagagagccttggaggaaatgcaagtggttggtctataaagtactacaagggacttggaacaagcacttcctctgagggtcggcagtacttccaggatattgccaagcacaagaaggattttgtctggaagaatgaccaagatgacaacgatattgaattggcattcagcaagaaaagaattactgataggaaagagtggcttactaactttcagtctggaacccatcttgataccgaaggtaagtacatcaagtacagtgacttcatcaacaaggaactgatacaattctcgatggcggatctgctgcgctcaataccttcaatggtcgatggccttaaaccaggccagaggaagattttgttttgctcgttcaagaggaacttagttaaggaaattaaggtggcacagttttccggttatgtatcagaacactctgcgtaccaccatggtgagcagagtttagctagtaccattactggaatggctcaagattttgttggcagcaataacataaacctcttgcagcccaatggtcaatttggcaccagagatcagggaggcaaagatgctgctagtgctaggtacatcttcaccctgttgtcgcctatcactcgttcaattttccctaaggatgacgatattcttcttaactacttggatgaagatggacagtcaattgaacccacctggtatgtgccaatcctgcccatggttttggtaaatggaagtgaaggcattggcactggatggagcacctttatcccaaactataatccaagagatattgttgctaatctaagacggttgctaaatgatgagcctgttgaaccaatggacccatggtatagggggttcaagggctctattcagaagacaggcacaaaagcgggtggtgtcagctatactgtcactggtattattgaggttgttgatgacactacgctgagaattactgagctaccaatccgtcgctggtctcaggattacaaagagtttttaatatctattggtggaaccgacaagagcaaggacaaagacaaggataagggcaagggcaagggtaaggtcaaggagaaggaaaagaaggagaaggacatagaaccttttatcgaggcattcgatacttatagtgatgacaagaatgtggaatttctgattaccctgagtaaagaaaacatggctatagctctgcaagaagggctggagaagaagttcaagttgacaactacgattggtacaacaaatatgcacttatttgactctaatggaaaaattcggaagtacgatactccagaggacatacttaaagagttctttggactgaggctcgagttctacgagaaaagaaagcgagtattattggaaaatattgaactggagttaaagaagctttctaacaaagttagatttattcttgctgttgtcgaaggagatatcatagtgaataacaggaagagggcagagctgtttgtggagcttaagcagaagggatttgatcctttcccaaggaaaaaacagagggctgggccatccgctgttggagctattgaagaggatgaagagaatgaggagagccctgaagctgcaaatgttggttcaagtgattatgaatatctcctctcaatggcaattggtacattgactctggagagggtacaacagctcattgcagagaagggcagaatggagaatgaagtagctgaactgaagagaacaaggccaaaatcactttggatgagagaccttgatgcattcgagaaggaactggatgcgcttgatgagaaggacagcatggatgctgaggagagaagagctacgaggaatgctggaggtggcgctgcacctaataaagcagcgcccaagagacgacctagaaagacagcgactaatactcaggcggcagaaagctctgacgggaatgccgctgctccggcggttccaaaacctgcggcaccacgtaagaaaccagctggaaaggcaagtttggctgatagcgaggatgaagattatatagcagcaatcccgaaacctgccgcacagaagaagcagccagctaagaaggcaagcacccagttgagtgatgacgaggacgacgaagttcttgctctaaaagaccgattggctgcttacaatcttgatgaccattccgaagatactgctatggaaactgagactacagaagaacaggcaaaagggaagaaagggaggaaggaaccaagcaaaagaggagcagcaaagaaggccatatcatccctagctgtgatatctgatgacgaggaagacgaaacagtgcccatcgatgaggacgacgaggatgatttcgccatggaagaagtgccggtcaagaaaggtagaggaaagaagcccgccgctgagaagccgaaggctgcaaccaggaagagggcgccagctcaggggaagtccatgaggcagaaagtgatggaagaaatgttcaagcctacagaggacagcagcaccagcgctccatctcctgagaagaaggtgcgcaagatgagggcctctcccttccacaagaagagcggctctgtcttgcagagggcctcaacagcttccacgagcactgaagaaaccgagtcatcctccccatcaggtagctctgccgagccagtcgcagcgaggccgaaacggcaaacacgggggaacaagaagagttaccaggaggtgcaggagctgagcgatgatgacactgaggacgaagtgcaggatatcagcgatgattccgacttcgccggctctgactttggcgaggacgacgactgaatgtcccctgaatttaactactggaacaatgtaggatcaactccgtagcgagcggtgtgactgtctgcctgtttgctgagtcgttagattgattgacctgtctgttacattggtgatgcttgctgagatgcatctcttgtgcgtcgtgtgctctattcagttcatcagttgctgagacattgatccgtgtaacttacttgacacttgtgctttgtgtgatcagcatgggtttttcagctgtgtgtatacttgtgtacatgtgcttccagtgatcaccgatccttgtttcagcaaggattttcttctgtatacttgtgtttgagggctggccggctgggagctacaccgagcggctgcgcgctgcgcttcccacaagctgaagcagtcacggtgagttggtgaccagcgagcacggcggaaacaggtcaagtaaagtatggtgatgtatctaaattttagatacctatcaaattttacactagaacatatagtacatctaggtatctttttaaaaatagtataattatgcctttataatataaacagggcgtaggtgccggtgtgtgactggtgtgttacgtgctgttgtctatatttatgttctttaagcacattctagaatgc

SEQ ID NO: 2675 - DNA, 4534 bp, Zea mays
cttgaaagttgaaaccctagtgcaggcacacgacctccgtgtgcaacgcgtcgccgccatggcggcccccctgcactccagctccggccacaacgccgccgcaggcggcggggccaagaccatcgaggagatgtaccagaagaaaacgcagctggagcacatcctgctgcgccctgacacctacatcggctccgtggagaagcacacccaggcgctttggatatacgaggacggtgccatggtgaaccgctcggtcacctacgtccctggactctacaagatcttcgacgagatcctcgtcaacgccgccgacaacaagcagcgggatcccaagatggacgcgctccgcgtcgagattgacgtcgacagctgctgcatctccgtatacaacaacggcgacgggatccccgtcgaggtccaccaggaggagggcgtctacgtgccagagatgatattgggccacctcctcaccagtagcaactacaacgacaacgagaagaagaccaccggcgggaggaacggatacggcgccaaactcactaacatcttctccactgagttcgtcatcgagaccgccgatgggcgtcgccagaagaagtacaagcaggttttctatgagaacatggggaagaagtcagagccccagattaccaagtgcaagcagggcgagaactggaccagggtcactttcaagcctgatcttgccaagttcaacatgacccatctcgaagatgatgttgtagccctcatgaggaagagagttgttgatatggcaggcactctcggcaaaacggtgaaggtcgagttggatggccagagggtgcccataaagagcttctgtgactatgtcgacctgtatatgaagagtgctaactgcgacagacctgataatttcaaaaggatttatgagcaagtaaatgatcggtgggaagtgtgtgttagtcaaagtgaagggcaatttcagcaggtcagctttgtcaacagaattgcaaccatacgaggtggaagtcatgttgattatgttaccaaccaaattgccaaccatgtggtggccattgtgaataagaaaaacaagaatgcaaacatgaagctgcacaacgtgaagagccatctatgggtctttgttaatgcgctcattgacaatccggcttttgattcacaaaccaaggagaccttgaccactcgtcagggaagctttgggtcaaagtgtgagctttctagtgatttcctcaagaaagttgagaaatctggtgtaattgagaatgtcctctcttgggctgatttcaaacttagcaaagaattaaagaagactgatggaagcaaaaagtcaagaatttctggcatccctaagcttgaggatgcaaatgaagctggtgggaaggactctgacaagtgcactttgatcctgactgaaggcgactccgcaaaagcacttgctatgtctggcatagctgtcgtagggagagattactatggcgtatttcctctcaggggaaaactgttgaatgtcagagaggcaaaccacaagcaaataatggacaacgctgaaattcagcacataaagcaaatacttggtttgcagcatggaaagcagtatgagagcaccaaaggtttgagatatggtcatctcatgataatgacagatcaggatcatgatggctcccacattaaagggttgctgatcaacttcatccactcattctggccgtctcttcttaaagttccatcttttttggttgagttcattactccaatcatcaaggcaaccagaggtcaaactacgaaatcattttacacaatgccagagtatgaagaatggagaaagaatttaggagcaagtgcaagttcgtggactataaaatactacaaggggttggggacaagcacagccaaagaaggccggaagtactttgaagatattattgatcacaaaaaggattttgtctgggtagatgaccaagatggcaaccatattgagttagcattcagcaagaaacggattgctgataggaaacagtggcttacaaattttcagcctggaacatacatagaccaacgtgagaaacaagtcaagtatagtgatttcatcaacaaagagctgatactcttctcaatggcggacctgcagcgatcaataccttcaatggttgatggccttaaaccaggccagaggaagattctgttttgttcattcaagaggaattttgtcaaggaagctaaggtggctcagttctctggttatgtgtcagaacactccgcataccaccatggtgagcagagtttagcaagtacaattattggcatggcccagaattttgttggcagcaataacatcaaccttatgtcccctaatggtcagtttggcacaagagctcagggaggcaaggacgctgcaagtcctcggtatatcttcaccaagctgtctaatattacacgttcaattttcccgaaggatgacgatattcttcttaattatctgaatgaggatgggcagtcaattgaacccacctggtatatgccaatccttcccatggtattggtcaatggaagtgaaggaattggaactggatggagcacatatattccaaactacaatccaagagacattgttgctaacgtcaggcggttgttgaatgaagagtctactgtaccaatgcatccttggtataggggattcaaggggtctatagagaagacagtcaatacgaaggtagctggttccacgtataccgtcaccggaatcattgaggttgttgacaacactacactgaggatcactgagctgccaatccgccgatggactcaggattacaaagattttctcgaaagtttagctccagatcctaagaacaaggacaaagtaacattcatagaggatgtcacatcacaaggtgataatgaagacgtctacattcaactcaaattaagtgaggcaaatgtgaatgtagctaaggaagaaggactagtgaagaagtttaagttgacaacaacaattggtacaacaaacatgcacttgtttgattcagatggtaaaattcggaaatatgacactcctgagcaaatacttgaggaattctttcaattaaggcttgaattctattgtaagagaaaggaagcattgttgaagaatatcaagctggacttaaagaagcttgaaaacaaagttaggtttatccgctgtgttgttgataatgaaattatagttaacaacaggaaaagggcagatctatttttggagctccggcacaagaattttgaccctttcccaaagaaaaaaaagaaggctgaaccaactgctgtaggtgctatagaagaggaggaaaatgaagagtctcctgaaactgcagcaggagtggatcctagtgactatgagtatctcctctccatgtcaattggtaccttgactttggagaagatacaagagctcaatgctgagaaacaaaagttggtggacgatgttgtggaactgatgaacacatcgccaaaatcactttggttgaaagatcttgatgcttttgagaaagaactggatgtgcttgatcaaatggatctagcagaggaggtgcaaagggaaaagaggataaaggaaggcaaaaaaggcggatcaaaagctgcacccaagaaacaacctaaaaaggctgcacctataaagctggaaagcagtacagaagacaatgctgctgaaccagtagtcgcaaagcgtggagctcaacagaagaaagcacccaaaaaggctcccgtggacgaagaggaagttgatatgccttcactgaaagaccgtcttgctgcctttaatataaatgactcatctcctcctgatcactctgctatggaaactgaaacaacagaacagccggctcagaagaaagggagaggaaagaagcctgccgccgccgctgtgaagccgaaggctcctgccgccaggaaaagggcgccgactcaagggggcaaggcaacgcagaagaaaatagatgagatgctcaaggtcactgaggataacaccagcagtgctttgtcccctgagaagaaggtccggaagatgaggccctctcccttcaacaagaagagtggctcaatcttacagagaggctcgactgccgcttctgcaagctctgaaactatcgctgaagcttcaccaccctctggtagctctgaagagccagttgctgcagcaaaacctagaaggacagccagggctacgaagaaacatgtctatattagtgaaagcgatcctgaggatgaagtggtggagttgagtgatgattcggactttgatttggatgctgactctgactagtgagggtaactgtcatccgtagcatgtgctacctttattgatgatgcatttcttgtgcatgtgctactttaattgacgagtgcgggtaactgtcaatctgtcatccgtgttgttctgttgactgttgtatgtgtgttttctgttgactgttgtcgggaacccaagacattgtctggttaactgatttgtctgtctataattttggcattcaagtgtgcttgtggtatgctctgcagc

SEQ ID NO: 2676 - DNA, 4736 bp, Setaria italica
cccaccccgctcgccgccccacccgaaaccctagcgcaggcacacgacctccgtgtgctgcgcggcgccgccatgacgggccctctccactccagctccggccacaacgccgccgccggtgggggcggcggcggcaagaccatcgaggagatgtaccagaagaagacgcagctggagcacatcctgctgcgccccgacacctacatcggctcggtggagaagcacacccagacgctctgggtctacgagggcggcgccatggtgaaccgcgcggtcacctacgtcccaggcctctacaagatcttcgacgagatcctcgtcaacgccgccgacaacaagcagcgggacccccggatggattcgctcaaggtcgagatcgacgtcgagggctgctgcgtctccgtatacaacaacggcgacgggatccccgtcgaggtccaccaggaggagggcgtctacgtgccggagctgattttcggccatctcctcaccagcagcaactacaacgacaacgagaagaagaccaccggcgggcggaacggatacggcgccaagctcaccaatatcttttccacggagttcgtcatcgagaccgccgatgggcgtcgccagaagaagtacaagcaggttttctcagaaaacatggggaagaagtcagagccccagattacgaagtgcaagcagggggagaactggaccaggatcaccttcaagcctgatctggccaagttcaacatgacccatcttgaagatgatgtagtagcccttatgaggaaaagagttgttgacatggcaggaactcttggcaaaacggtgaaggttgaaatggatggccagaggttgcctgtaaagagcttctctgactatgtgaacctgtatatcaagtctactaatggtgacccaaaactaagggtttttgatcaagtaaatgatcggtgggaggtgtgtgttattccgagtgaaggacagtttcagcaggtcagcttcgtcaacagaattgcaacaataaggggtggaactcatgttgattatgtcaccaaccaagttgcaaaccatgtgatgaccgttgtgaataagaaaaacaagaatgcaaacatgaaactgcataatgtgaggaaccatctgtgggtctttgttaatgccctcattgacaaccccgccttcgactcacagaccaaggagaccttgaccactcgtcagggaagctttgggtcaaagtgtgagctttctaatgaattcctcaagggagtcgagaaatcaagtattgtcagcaatgtcctctcctgggccgatttcaaattaagcaaagaactaaagaagactgatggaagcaagaagtcaagaatttctggcataccaaagcttgaggatgcaaatgaagctggtgggaaggactccaacaagtgcacattgattctgactgaaggcgattcagccaaagctcttgctatggctggtatagctgtagttggtagagatcactatggcgtgtttcctctcaggggaaagctattaaatgttagagaagcaaatcacaagcaaattctggataacacagaaattcagaacataaagcaaattcttggtttgcagcatggaaagcagtatgatagcaccaaaggcttgagatacggccatctcatgataatgacagatcaggaccatgatggttcccacatcaaagggttgttgatcaacttcattcattctttctggccatctcttcttaaagttccatctttcttggttgagttcatcactccaattatcaaggcaactaagaaaaatgagaccaaatcattttacacaatgccagagtatgaagactggaaaaggaatttaggagcaagtgcaagttcatggaccataaaatactataaggggttgggaacaagcacatccaaagaaggcaaagattactttacaaatattgaccaacacaagaaggattttgtctgggtagatgatcaagatggcaatgaaatcgagttagcattcagcaaaaaaaggattgctgataggaaagagtggcttacaaactttcagcctggaacttaccttgaccaacgtgagaaagaaatcaagtaccgtgatttcatcaataaagagctgattctcttctcattggcggacctgcagcgatcaattccttcgatggtagatggttttaaaccaggtcagaggaagattctgttttgctcattcaagaggaaccttgttaaggaaaccaaggttgctcagttctctggttatgtgtcagaacactccgcataccaccatggtgagcagagtttagcaagtacaattgttggaatggctcagagttttgttggcagcaataacataaaccttttgtaccctggaggccagttcggtaccagatctcagggtggcaaagatgctgcgagtcctaggtacatcttcaccaaactatcacatatcacacgttcaattttcccaaaggatgatgatactcttcttaattatctgaatgaggatggacagttaattgaaccgagctggtatgtgccaatccttcccatggttttggtcaatggaagtgaaggaattggtactggatggagtacattcattccaaactacaatccaagagacattgctgctaacatcaggcggttgctgaatgatgaggctactgtaccaatgcacccgtggtacagggggttcaagggatccattcagaaggcaaataatgcaagggtagatggtgccacatataccatcactggtatcatagaggctgttgacagcactacattgaggattactgaactgccagtccgccgttggacgcaggattacaaagactttattgattctttgcgtccagacgaaaagaacaaggacaaggaagcatttattgaggactgcaccgcacaaggtgataatgacgatgtttactttgagctcaaactatctgagaagaatatgaatatcgccaaggaagaaggactgctgaagaaatttaagctgacaacaacaataggaacaacaaacatgcacttgtttgattcagatggtaaaatacggaagtatgacactcctgaacaaatacttgaagagttctttaaattaaggcttcaattctacttcaagagaaaggaagtattattgcaaaatatgaagctggacttgaagaagcttgaaaacaaagctaggtttatccgctgtgttgttaacaatgaaattgtagtcaataacaggaagagggcagatctttttttggagcttcgacagaagaattttgatcctttcccaaagaaaaagaagagagctgaaccagctgctgtaggagctacagaagaggaggaaaacgaagagagtcctgaagctgcaaacggagttgatcctagtgactatgagtatctcctatcaatggcaattggtaccttgactttggagaagatacaggagctcaatgctgagaaagagaaagtagtgaatgaagttgaggaactggaaaagaccacagaaaaatcgctttggctgagagaccttgacgcctttgagaaagacctggatgtgcttgatcaaatggatctagcagatgcgcaggaaaggaaaaggctaagggatgagaatgccaaaaaagcaggatcgaaagctgctcccaagaaacaacgtaaaaaaccggctgctaaacagccaaaagtggaaagtgatacagaaggagatgctgctgaaccagtggttgcaaagcgtggagctcaacggaaaaaaccagccaaggaaaatggtgctgggtctgatgacgaagattatgttgctgaaaaggcaaaagctgaacaacagaagaagaaacaatctaagaaggcaagtgctccacctgtggatgaagacgaagatgacttgcccacactaaaagaacgtcttgcagcttttaatctcaatgactcctctccggataattctgccatggaaactgaaacaacagaagagcagattggaggcaaggggaagaagggagtaagcaaaagaggtggaggaaagaaggcttcatcatccttggcagtgatacatgacgatgaggatgaggatgtcgatgtttccctggaagttccagaagaagtccaaggtccaaagaaaggtagaggacggaagcctgctgcccccgtgaagcccaaggctactgccaccaggaagagggcgccagctcagggcaaggccatgatgctcaagcccacagaggacagcaacaccagcgctccttctcctgagaaaaaggtccggaagatgagggagtctcccttcaacaagaagagtggctccatcttgcagagaggctcgatcgctgcctcgacaagctctgaatctactgctgaggcatcaccaccctctggcagctctgcagagccaattgctgccccgcaacctaggaggacagccagggctaccaccaagaagacgcctgtctacgaccttgaaagcgaggatgaagtggtggaggtaactgatgattctgacttcgacgtggatggtgactctgacgagtgagttcatggccttgctacgtcgaactaagttagccgtgtcccttgtgttgcgtgcgccagtatctagtatgtgggttgttacattagctactctgatgattcggtggtgtactctatgtgatgcatatcttgtgcgttgtatgtggtgtctgttggctttgctggtgtgaacagaggttgttctgagttctgcgtgtcaactttctaaggttcgagtggcca

SEQ ID NO: 2677 - DNA, 4732 bp, Sorghum bicolor
cttgggcttcgataaacccccccaaccccattcctttctccccagatccccaatccccaactccgcacactccacctgaaaccctagcgcaggcacacgacctccgtgtgcagcgcgtcgccgccatggcgggccctctccactccagctccggccacaacgccgccgccggcggcggaggcaagaccatcgaggagatgtatcagaagaagacgcagctggagcacatcctgctgcgccctgacacctacatcggctcggtggagaagcacacccagccgctctgggtcttcgaggacggtgccatggtgaaccgctcggtcacctacgtcccgggactctacaagatcttcgacgagatcctcgtcaacgccgccgacaacaagcagcgggatcccaagatggacgcgctccgcgtccagatcgacgtcgacggctgctgcatctccgtatacaacaacggcgacgggatccccgtcgagatccaccaggaggagcgcgtctacgtgccagaaatgattttcggccacctcctcaccagtagcaactacaacgacaacgagaagaagaccaccggcgggaggaacggatacggcgccaaactcactaacatcttctccacggagttcgtcatcgagaccgctgatgggcgtcgccagaagaagtataagcaggttttctctgagaacatggggaagaagtcagagccccagattaccaagtgcaagcagggcgagaactggaccagggtcaccttcaagcctgatcttgccaagttcaacatggctcatcttgaagaagatgttgtagccctcatgaggaagagagtggttgatatggccggcacgctcggcaaaacagtgaaggtcgagttggatggccagagggtgcccataaagagcttctcggactatgttaacctgtatatgaagagtgctaactgcgacagacctgataacttcaaaacgatttatgaaaacaatgatcggtgggaagtgtgtgtttgtcaaagtgaagggcagtttcagcaggtcagctttgtcaacagaattgcaaccataaggggtggaactcatgttgattatatcaccaaccaaattgcaaaccatgtgatgactgttgtgaacaagaaaaacaagaatgcgaacatgaagctgcacaatgtgaagagccatttgtgggtctttgttaatgcactaattgacaatccggcctttgattcacagaccaaggagaccttgaccactcgtcagggaagctttgggtcaaagtttgagctttctattgatttcctcaagaaagttgagaaatccagtataatagagaatgtcctatcctgggctgatttcaaacttagcaaagaattaaagaagactgatggaagcaagaagtcaagaatttctggcattcctaagcttgaggatgcaaatgaagctggtgggaaggactctgagaagtgcaccttgatcctgactgaaggcgactctgcaaaagctcttgctatgtctggcatagctgtcgtagggagagattactatggtgtatttcctctcaggggaaaactgttgaatgtcagagaggcaaaccacaagcagataatggagaatgctgaaattcagaacataaagcagatccttggtttgcagcatggaaagcagtatgcaagcgccaagggtttgagatatggccatctcatgataatgacagatcaggatcatgatggttcccatatcaaagggttgttgatcaacttcattcactcattttggccgtctcttcttaaagttgaatctttcttggttgagttcgtcactccaattatcaaggcaaccagaggtaaaactacaatatcattttacacaatgccagagtatgaagaatggagaacgaatttaggagcaagtgcaagttcatggactataaaatactacaaggggttgggaacaagcacagccaaagaaggccgggagtactttaaggatattactgatcacaaaaaggattttgtctgggaagatgaccaagatggtaatcatattgagttagcattcagcaagaaacggattgctgacaggaaactgtggcttacaaattttcagcctggaacgtatattgaccaacaagagaaaagagtcaggtatagtgatttcatcaacaaagagctgatactcttctcaatggcggacctgcagcgatccataccttcaatggttgatggccttaaaccaggtcagaggaagattctgttttgttcattcaagaggaattttgttaaggaagccaaggtggctcagttctctggttatgtgtcagaacactcagcataccaccatggcgagcagagtttagcaagtacaattattggaatggctcagaattttgttggcagcaataacatcaaccttatgttccctggtggtcagtttggcaccagagctcagggaggcaaggatgctgcgagtcctaggtacatcttcaccaagctgtcccatatcacacgttcaattttcccgaaggatgatgatattctacttaattatctgaatgaggatggacagtcaattgaacccacctggtatatgccaattcttcccatggtcttggtcaatggaagtgaaggaattggaactggatggagcacgtttattccaaactacaatccaagagacattgttgctaacctcaggcggttactgaatgaagagtctactgtaccaatgcatccatggtacaggggattcaaggggtctatagagaagacagtcaatacaaaggtagttggttccacgtataccgtcaccggaatcattgaggttgttgacaacagtagactcaggatcactgaactgccaatccgccgttggacgggggattacaaagaatttcttgaatctttaggtccagataagaacaaggacaaagtaccattcatagaggacgtcacagcgcaaggtgataatgaagacatttacattgagatccagttaagtgagggaaatatgaatatagctaaggaagaaggacttgtgaagaagtttaagctgacaacaacaattggaacatcaaacatgcacctgtttgattcaaatggtaaaatccggaagtacgacactcctgagcaaatacttgaggagttctttcaattaaggcttgaattctatgttaagagaaaggaagcattgttgaaaaatatcaagctggagttaaagaagcttgaaaacaaagttaggtttatccgctgtgttgttgataatgaaattatcgttaacaacaggaaaagggcagatctatttttggagctccggcagaagaattttgatcctttcccaaagaaaaaaaagagggctgaaccagctgctgcaggtgctttagaagaggaaaatgaagagaatcctgaagctgaagcagcggagcctagtgactatgagtatctcctcgcaatgccaatcggtaccttgactttggagaagatacaggagctcattgctgagaaacaaaaattagtcgatgacgttgaggaactgaaaaacacatcgccaaaatcactttggttgaaagatcttgatgcttttgagaaagaactggatctgcttgatcaaatggatctatcagaggaggagcaaagggaaaagaggataaaggatggcaaaaaagggagatcaaaagctgcacccaagaaacaacagaggggcaaaaaagcaggatcaaaggctgcagttaaaaaggagaaaagcgatacagaagacgatgatgcggctgaaccagtggtcccaaagcgtggaggtcaacagaagaaagcacccaagaaggctcctgtggatgaagaggaatttgacatacctgccctaaaagaccgtcttgctgattttaatatcaatgactcctctccggattattctgctatggaaactgaaataacagaagagcagaatgaaaaactagcgactaagggaccaagcaaaagaggtggtggaaagaaggctgtgtcgtcatccttggtgatgatacaatctgatgatgaggatgacgattttacactggaggaagtctcagaggtccaagctcagaagaaaggtagaggaaagaagcccgctgctgctgttaagccgaaggctcctgcccccaggaaaagggcaccggctcagggcaaggcaacgcagaagaaaatagatgagatgctccagggcattgaggataacaacaccagtcctgagaagaaggtccggaagatgaggccctctcccttcaacaagaagagtggctcaatcttacagagaggttcgactgctgcaagctctgaaactactgctgaagcttcaccaccctctggcagctctgcagagccagttggtgcagcacaacctagaaggacagccagggccaccaagaagcctgtctatgttactgatagtgatcccgaggatgaagttgtggagttgactgatgattctgactttgatgtcgatggtgactctgacgagtgaaggtagctgtcattcgtgtgctatgtgcaacagtatctagtttgtgtgtcgttgcatgtgctactttgatgatgcatttcttgttcgttgtatgtgttcattgtgttctgtggactgttgttgccaagaggcaagagcccaagacaataacctggttaactggtttgtctgtgttatttttgcatacaagtgttcctgtggtaactgagtttctttaacttctaatgctgctcggcacgggcgtccac

SEQ ID NO: 2678 - DNA, 4880 bp, Panicum virgatum
cccccacccgaaaccctaacgcaggcacacgacctccgtgtgcctgctcggcgccgccatgacgggccctctccactccagctccggccacaacgccgccgccggcgggggcggcggcaagaccatcgaggagatgtaccagaagaagtcgcagctggagcacatcctgctgcgcccagacacctacatcggctcggtggagaagcacacccagacgctctgggtctacgaggtcggcgccatggtgtaccgctcggtcacctacgtcccgggcctctacaagatcttcgacgagatcctcgtcaacgccgccgacaacaagcagcgggacccccggatggactcgctccgcgtcgagatcgacgtcgagggatgctgcatctctgtctacaacaacggcgacgggatccccgtcgaggtccaccaggaggagggtgtctacgtgccggagatgattttcggccacctcctcaccagcagcaactacaacgacaacgagaagaagaccaccggcgggcggaacggatacggagccaagctcaccaacatcttctccacggagttcgtcatagagacagccgacgggcgtcgccagaagaagtacaaacaggttttctctgaaaacatggggaagaagtcagagccccagattaccaagtgcaagcagggggagaactggaccagggtcaccttcaagcctgatcttgccaagttcaacatgacccatctcgaagatgatgttgtagccctcatgaggaagagagtagttgatatggcgggcactcttggcaacacggtgaaggttcaattggatggccagaagttgtcggtgaagagcttctctgactatgtggacctgtatatgaaatctgctaacagtgacagacctgacgctctcaaaaaggctcatgagtatgtaaatgagcggtgggaggtgtgtgttactcaaagtgaagggcagtttcagcaggtcagcttcgtcaacggaattgcaaccataaggggtggaacacatgttgattatatcgccaaccaaattgccaactatgtgatgaccattgtcaataagaaaaacaagcatgcaaacatgaaagcgcataatgtgaagagccatttgtgggtcttcgttaatgcgcttattgacaaccctgcattcgactcgcagaccaaggagaccttgacaactcgtcagggaagctttgggtcaaagtgcgagctttctcctaaattcttcaaggatgttgagaaaatcggtgttgtcagcaatgtcctttcctgggctgatttcaaattaagcaaagaacttaagaagactgatggaagtaagaagtcaagaatttctggactcacaaagcttgaagatgcaaatgaagctggtgggaaggactctgacaagtgcaccttgatcctgactgaaggagattcggcaaaagctcttgctatgtcgggcattgctgaagttgggagagatcactatggtgtgtttcctctcaggggaaagcttctaaatgtgagagaagcaagccacaagcaaataatggataacgctgaaattcagaacataaagcaaatacttggtttgcagcatgggaagcagtatgacagcaccaaaggcttgagatacggccatctcatgataatgacagatcaggaccatgatggttcccacatcaaagggttgttgatcaacttcattcactcattctggccatctcttcttaaagttccatctttcctggtagagttcaccactccaattatcaaggcaacaaaaaacaataagacccaagcattttacactataccagagtatgaagaatggaaaagaaaattaggagcaagtgcaagttcttggaccataaaatactataaggggttgggaacaagcacatccaaagaagctaaagaatacttttcagatatcggaaaccacaagaaggattttgtctgggtagatgatcaagatggcaatgaaattgagttggcattcagcaagaaaaggattgctgataggaaacagtggcttacgaactttcagcctggaacttaccttgaccacaaagagaaaaaaatcaagtaccgtgatttcatcaacaaagagctgattctcttctcgatggtggacctgcagcgatcaataccttcaatggtagatggctttaaaccaggtcagaggaagatccttttttgcgcattcaagaggaatcttgttaaggaaactaaggttgctcagttctctggttatgtgtcagaacactcagcataccaccatggcgagcagagtttagcaagcacaattgttggaatggctcagagttttgttggcagcaataacataaacctttttttccctggaggccagttcggtaccaggtgtcagggaggcaaagatgctgcgaatgctaggtacatcttcaccaaactgtcacatatcacacgttcgattttcccgaaggatgatgacattcttctcaactatctgaatgatgatgggcagtcagttgaacccagctggtatgtgccaatccttcccatggttttggtcaatggaagtgaaggaattggtactggatggagcacatatattccaaactacaatcctagagacattgttgctaacctcaggcggttactgaatgatgagtctactgtgccaatgcatccgtggtacagagggttcaagggttctattgtgaagtcacataatgcaaaggtagctggtgccacatataccatcaccggcatcatagaagctgttgacagcactacattgaggattaccgaactgccaattcgccgttggactcaggattacaaagactttatagactctgtgacttttgatccaaaggacaaagacaaggaaacatttatcgaggagttcacaatgcaaggtgatagtgacgatgtttactttgtgctcaaactaactgaagacaacatgaataaggttatggaagaaggactggtgaaaaaatttaagctgacaacaacaattggaacatcaaacatgcacttgtttgactcagatggcaaaattcggaagtatgacactcctgagcaaatacttgaagagttctataaattaaggcttgaattctatgttaacagaaagaaagcattattgcaaaatatcaagctggacttgaagaagcatgaaaacaaaataaggtttatccgctgtgttgttgacaatgaaattgtagtaaataacaggaagagggcagatctatttctggagcttcgggagaagaatttcgatcctttcccgaagaaaaagaagaaagctgaaccagctgctgtaggagctacagaagaggaggaaaatgaagaagagagtcctgaagctgcaaacggagttggtcctagtgattatgagtatctcctctcaatggcaatcggtactttaactttggagaagatacaggagctcaatgctgagagagagaaattgatgaaagatgttgaggaactggagaacactgcaccaaaatcgctttggttgagagaccttgacaccttagagaaagaactggatgtgcttgatcaaattgatctagcagatgaggaggaaaggagaaagaagagggaaaagaacactaataaaggactgaaagctgcccccaagaaacaacgcaagaatgctgcagttcaactgccaaaagtggaaagtgacacggaaggagatggtgctgaacctgtggttgcaaagcgtggagctcaacgaaaaaaaccagccaaaaaggtgaatggtgctgggtctgacgatgaagattatgtagctgaaaatgctaaaccggaacaccaaaagaagaaacaaactaagaaggcaagtgctcctgtggatgaagatgacatgcccacactaaaagatcgcatggccgcttttagtatcaatgacttctctccggatagttctgccttggaaactgaaactacagaagaccagaatgaagacaaagggccgaacggaccaagcagaagaggtagagtaaagaaggggttgtcatccttggcagtgatttctgatgatgaggatgacgatgttgactttgccatggaagtcccagaagtccaagttgagaagaaaggtagaggaaggaagactgatgctgctgctacaaagccgaaggctgctgccaccagaaagagggcgccagcgcagggcaaggccatgatgctcaagcccacagaggacagcaacaccagcgccccatctcctgagaagaaggtccggaagatgagggagtctccattcaacaaaaagagtggctcgatcttgcagagagcctctactgctgccgcatcaagctctgagactaccgctgaggcttcaccaccatctggcagctctgcagagccagctgctgccccgcaacccaggaggacagccagggccaccaccagtaagcctgtgtacatctccgagagcgacccagaggatgaagtggtggagttaactgatgattcagacttcgacgtggatggtgactctgatgacgagtgaactcgggtcctttacgtcggttcatgtgttgtgtgtgctatggtctagtttgttgttacatgctactctgatgcggtgcgttgtgtgtgtcttatggtctactttgtgctctggtgccgtgtggctgtaggtacttgatgtgatgcatatcttgtgcgttgtgtatgtggtgttatatgtcctgttgccaagacactgctcggttaactgatttggtcttttgtctgtaattctggcacccatctactgctctaagttatgttggctgagctggtgtgggtagaggtggttgagttctgtagtcacgcacacctgtcctctttccaaggttcgaggtgacaatggcaacaagttctcgtgatgttgcagggca

SEQ ID NO: 2679 - DNA, 1306 bp, Sorghum bicolor
cgttgattgtgttttcgcggggagccgcaggcatggcggacggcggcgtttgggctctacggcttcacccagttcaccaaatccggtttcctggagcatgcaaagaaattcagagaggaggatatgcagatccggttggatgggaaaaattgcctggtaactggagcgaattctggcattggttttgctacagctgagggtttggcttcacatggtgctaccgtctatatgctctgtcgtaacaaggagagaggggaggctgctcttgaccaaataagatccaaaactggcaatgcaaatgttcatctggagatatgtgacctttcatctatcaatgaagtaaaatcgtttgcaacaaagttcacttcaatggataaaccactccatgtcttggtaaacaatgctggcttactagagcacaagcgtgagactacagcagaagggttggagctcaattttgctgtcaatgtagctgcaacatacactttaacagagctagttatgccgttattggagaaagcagcaccagatgctcgtgtcatcacagttgcatcaggaggcatgtacaccgagccactgaacaaggacttacagttcaccgaaggcaccttcgatgggacacaacaatatgctcgaaacaaaagagttcaggtggcactcactgaatggtgggctgagaaatacggcaacaagggagttggtttctactccatgcatcctgggtgggctgatacgcctggcgtcgccaagagcttgcctggattgtcagaaaaattgtctggaaacctgagaacaaatgacgaaggagctgatacagtggtttggttggcgttgcaacctaaggagaagttagcctcaggagctttttactttgaccgtgctgaagcaccaaaacatttgaagtttgctgggactgcagcttcgcacgcccagataaactccatcgttcatagcattagatccatctgtggcttctctgttaaaggttgagctgttaatgccaaagtgtatatagttgaactgcaaagcaaaggtgatctatatagttgataataaaatgggagcatgattcataaaaccgcaaaaacataaaaagatgcaccagccgggaatcgaacccgggtctgtaccgtggcagggtactattctaccactagaccactggtgcttttgatgcaaaggttttggtaggttgcaaactattgttccgaaacaatcaaacgtggatatattttcccaatattcctatcacatatctcccactcctgtattacgatgtgtggagtaaatccaagtgaacgactgc

SEQ ID NO: 2680 - DNA, 2053 bp, Panicum virgatum
gccgatcaactggaccaggcagcttgacttgacccgggcacagaggccctgatcagatgtggggctgggaaattccatcgccttcgatggaaatccaacacaccaagcaggcccaatccaaaatctccaaaagctcggcccgcaccccttcgccagttgctttggcccagtgatgggcagcccggcctggcccaactgaaacgagacccccggcccatacggggccggtgtcagcgagagcagagcggcatcacggcacgcggccggagaccggaatgcggaggcgacgggctgggcggctggctgtgcaatctcgcgcggcgcaggatcggccaccgaggcgggttctttgaccctcctcctgcgtcctctcttcgagaaggctccacgacgaagaaggaagctgtggagtgcatagtgctgcaaagaacaagcgcctggcccgcccggggacaaagcggcgtttcttggcgcggaagaagagagggcgggaggaggagaggggaaggcgaacatgtttatccagaaggtgattactgcgcatccggtcgttgttaattctgcacataatgctggagcaggcatggattttgctccggttgcttgtatgggtggtgggtgattcgcgtggattgttttctttttcggggtgcgcaggcatggaggacggcgtcctttgggctctacggcttcacccagttcaccaaatccggtttcctggaacatgccaagaaattcagagaggaagatatgcagatccggttggatgggaaaaactgcctggtgactggagcaaattctggcataggttttgctacagctgagggtttggcttcacatggagctactgtctacatgctctgtcgtaacaaggagagaggagaggctgctctcaattaaataagatccaaaactggcaatgaaaatgttcatctggagatatgtgacctttcatctatcaatgaagtcaaatcatttgcaacaaagttcgcttcaatggataaaccactccatgtccttgtaaacaatgctggcttactggagcacaagcgtgagactacagcagaggggttggagctcaattttgctgtcaatgtggcagcaacatacactttaacagaactagtgatgccattattggggaaagcagcaccagatgctcgtgtcatcacagttgcatcaggaggcatgtacactgagccactgaacaaggacttacagttcagcgaaggaaacttcgacgggacactacaatatgctcgaaacaaaagaattcaggttgcactcactgaatggtgggcagagaaatacaacaacaagggggttggtttctactccatgcaccctggatgggctgatacacctggagtcgccaagagcttgctgggattttcagagaaattgtctggaaacctgagatcaaatgacgaaggagctgatacagtgctttggttggcgttgcaacctaaggagaagttatcacctggagctttctacttcgatcaagctgtagcaccaaaacatttgaagtttgctgggaccatgtcgtcacattcacagataaaatccattgttgatagcattaggtccatctgtggcctccctgcattgggatgagctgctttgtgaagtgacaagggtagcaacaacgatagctgataggtcttgaacatgagggagcgagcatgactcatgacgaccaagaggagcataaaaaaagttgcaccagccgggaatcgaacccgggtctgtaccgtggcagggtactattctaccactagaccactggtgcctcttggtgaaagggttccgatggttgcgctacttgtatgaattgtaaagatattcgtagatagcaataaatattttttggtgtaggaggctagccggctaggagcagtcagacgtgggtatttcttatattttccttaaccattctatacactggaactcatatatatgcatttaaataatcccaccaagaatataattggtggcgtctggatgaattgatcagttggacaacggtaattgtttattcagaaaatctaaa

SEQ ID NO: 2681 - DNA, 2457 bp, Oryza sativa
ggttttcttcccaacctcactccaaaaagtccaaatacacattcccacgctcaacctcaacccccgcctccgctcgccgcggcgcgccatggcgccgacgccgccgtctcgcccgcgcctccctctccgcccactcctcctctccctccctctcctctcgctcctcctcctcctcctcatccaccgtccccacccctccccgccgcctcccctcctcgccaccgccaccgccacgcggcgcgacgacgagccggcgccgcggcgagcggcgtcgtctttggcgcccaaggcgacgacgacgacgacgctggcgcacgtggtgttcggcatcgcctcctcccgccgcacgctgccgctccgcctcccgctgctccgcctctggctccgcccgcccgcgcgcgcgttcctcttcctcgacggcccggcgccggccgccgccgccgcgtccgagccattgccgcccaacctccgcttctgcgtctcctccaccgacgcctcccgcttcccgtacacgcacccgcgcgggctcccctccgccgtccgcgtcgcgcgcatcgccaaggagctcctgcagctcgacgaccaccaccacgcgacgccgcccccgccgcggtggctcgtgctcgccgacgacgacaccgcgttcgtcctcccgaacctcctgcacacgctctccaggtacgactggcgcgagccgtggtacctcggcgcgcgctccgagtccgcggcgcagaacgcctggcacggcttcgccatggcctacggcggcggcggcatcgccgtgagctggccgctcgccgcgcgcctcgcccgcgtcctcgactcctgcctcctcaggtacccgcatctctacggcagcgacgccaggatccacgcctgcctcgccgagctcggcgtcgagctcacccacgagccaggattccaccagatcgaccttcatggggacatatctggactcctaagagcgcatccgcttactcctttagtttcactgcaccaccttgatcatgtatatcctctttacccgggtatggaccgtgcaacagcggtgaagcatttcttcagagctgccaatgctgatccagcaaggatccttcagcagacagtgtgctatgaccattcgaaagcaattacagtgtcaatagcttgggggtattcagttcaggtgtacaaaggcaatgtgctgcttcctgacctccttgctgtgcagaaaacgtttgtgccgtggaaaaggggtcgcaatgctactgatgtttttatgtttgataccaagcattacccgagggatgagtgcaaaagagctgctcttttcttcctcaaaagtatttcttcaggtgaaggcaagatcaaaagcgattacactaggcagctgcctagaaaatgctcacctaacttgattccattgaggaatcttcaccaaataaaagtggcatctgagccattacatctggttcctgggaaggctttaagacggcattgctgtgatgttgtgtcttcctcatctgaaaccaacatggatgttaacatcaggaaatgcaaagaagacgaactgattgcgatgcattcttagtcacatcttcaatcgaactggatgcaatgctcttcctctgtagtaagttcctcctcacatccctttgtattttcacagaattttcctggacacacgcctcaatgttttatcacatgaaacatgcgtttccattttattttgggtcccaccaggtctgacataacttttctcgtagcaatttataattttcgtatgatctttgcagtaattccattgtactagcttcctagtacagaaagtgacaagacaagttaagcagactagcattgtaatagattctccatgaagtctcacattctgccgtttactttggtcaactggaatctcctttacaaaggagtggaggcaccataatctgtttgtgctatacaatgacctttttagcttgaagaaaaatgcatagtggacttgagtgcggccctccttttggtgatcaagacgacttctggtgacagtagtactactgaaactagaacagcatggatacatagatagatacttcctccgtttcacaatgtaagtcattctagcatttcccagatttatattgatgctaatgaatctagacatatatatttatctagattcattagcatcaatatgaatgtggaaaatgctaaaatgacttatattatgaaacggaggaagtagttgagatgttgaacaacacacttcattattattattttttaactttacctagcaaatgctcatatttatatatgatattttaccttgagcactttttgttgtggaactttgagtgtacattgggactgtctgtacatctcaatatctcatacagcaggagaaataatttcaggtcctgcttaggattacattgcaatcctgttctgttgaactgcttctgatatgcatggtttttg

SEQ ID NO: 2682 - DNA, 2397 bp, Brachypodium distachyon
aaaaaaatcagtaaaaaaagaagagagagttatggagttagtgataaatggcccgtcgtccctccacgaaaattatgatttgaactgaattccactcgttacgagcctagacggttggtttccttccctttcctttccttccttgtttgttccttccacctcgccgccggcgtccatggcgacgccgtcgcacgggctccccttcgcgcctctccgcgcgctgctgatcgccctcccgctcctctccctcctcctcctcctccaccaccacctcctcccttcgcgccacaccccgagcccgagtactccgcccccccttactccttccctcgccgtccacgcgccgctccgggccgcaatccatcgcgcggcgaaggcgggcggtccttcctcgtccccggcgacgaagaagacgacgctgtcgcacgtggtgttcggggtggcctcgtcccgccgcacgctgccgctgcgcctcccgctgctccgcctctggctccggcccccggcgcgggccttcctcttcctcgacgggcccccctccgccgcgcatccctcgcccctcccgcccaacctccacctccgcgtctcccgcgacgcctcccgcttcccctactcccacccgcgggggctcccatccgccgtccgcgtcgcccgcatcgccagcgacctcctcctcgacctcaagcaagggcaagggaactccccgccgccgaggtggctcgtgctggccgacgacgacaccgccttcgtgctccccaacctcctccacacgctcgccaagtacgactggcgcgagccctggtacctgggcgcccgctccgagtctgcggcgcagaacacctggcacggtttcgccatggcctacggcggcggcggcgtcgccgtcagctggcccctcgcggcccgcctcgcccgcgtcctcgactcctgcctcctcaggtacccgcacctctacggcagcgacgccaggatctacgcctgcctcgccgagctcggcgtcgagctcacacacgagccaggcttccaccagatcgaccttcatggggatatatctggactcctaagggcacatccacttgctcccttagtttcacttcaccatctcgatcatgtctatcctctttaccctggtatggatcgtgcaaaggcggtggagcatttcttcagagctgctaatgctgatccagcaaggatacttcaacaaacagtgtgctatgaccagtcaagatcacttaccgcttcagtagcatggggctactcggttcaggttttcagaggcaatgtactgcttcctgacctccttgctgtgcagaaaacttttgtgccatggaaaaggggtcgcaatgttacagatgtttttatgtttaacaccaagcattatccaagggatgagtgcaaaagagccgctcttttcttcctaaaaagtatttcttccggtgaaggaaagacggaaagcaattacagcaggcagctgcctagaaaatgcttaccacgcttgattccattgaggaatctacaccaaataaaagtgacatcagacctactgcatctggttcctgggaaggctctaaggcggcattgctgtgacatcataccttcacctgaaattaccatggacattaacatcaggaaatgcaaagataatgaattgatcgtgatgcattcatagtcgttcttgaatcatactgtatatccatctattgtacatgtcatccaccagtactgacatacttacacatagcaacttatgctttgtgtatcatcgaatcaaggcatcgagttttgccgtggagtgctgcatcagctagaatctccttttggactggagaatggagaccgtcgggattgcttcctgctacattacatgctgacatttggattatgaaaagcatagggaccatttgtgtggctacctctgcctgccggacaaggtggcttgcaatgacagggatacccaaaaacaacacaaagatatatttatatacaatgacagtgtcgtgtcttgcgaaaatacaatgacagtgtcatgtcttgtgaatttctacaggaatgtgagacacaagaaattgaagaagttgttgcttagatgccccacaggaatttgcaggaaactgtttcttgattggagggagaagaaagtagagaaagacacatcatgactagcacatcccacaggagttttaacatgaggttggacctctcagaatcctccgaaatgtgaagaaaaggaaagtttcctacttccaacaaaggaagtctcaactttgactaaatttgaatgcatctatacactaagtcatgtctacatacatccaaaatttgaaaaacttgagacatcttttgttggacggagggagtataagaatccataggttcattcctacaacccaaagaacc

SEQ ID NO: 2683 - DNA, 2002 bp, Secale cereale
acgcgcccctccggacgctcctgctcgcccttccgctcttgtcgctcatcctcctcctcacgctgcacctcccgccgcgccaccacccggcccctccggctcccctcatcctccccacgcccctccggaccaccgccaccgccgccgccgcccagcctaagcccagagcctacccctcctcctcgtcgccctcgccgacgacactctcgcacgtggtgttcggggtgcctcctcccgccgcacgctgccgctgcgcctcccgctcctccgcctctggctccgcccgcccgcgcgcgccttcctcttcctcgacgcgccgccccgcgccgcctccgccgtcccggcgaacctccacctccgcgtctcccgcgacgcctcccgcttcccctactcctaccggaagggcctcccctccgcggtccgcgtcgcgcgtatcgccaaggagctcctcctcgagctccgccagcagcagcagcaccagtcgccgccgccgaggtggctcgtgctcgccgatgatgacaccgccttcgtcctccccaacctccttcacaccctctccaagtacgactggcacgagccatggtacctcggcgcgccttccgagtccgccgcgcagaacgtctggcacggcttcagcatggcctatggcggcggcggcatcgccatcagctggcccctcgcagcgcgcctggcccgcgtgctcgactcctgcatcatcaggtacccccacctctacggcagcgactccaggatctacgcctgcctcgccgagcttggcgtcgagctcacccacgagccaggattccaccagatcgaccttcatggggatatatctggatttttaagagcacatccacttgctcctttagtttcacttcaccaccttgatcatgtctatcctctttaccctggtatggatcgtgcaaagtcgattgcgcatttgttccgagcagctaatgctgacccagcgaggatccttcaacaaacagtgtgctatgaccattcaagatcacttactgcttcagtagcatggggttattctgttcaggttttcaaaggcaatgtactgcttcctgacatccttgctgtgcaaaaaacctttgtgccatggagaagaggtcgcaatgttacggatgtttttatgtttagcaccaagcattatccaagggacgagtgcaaacgagctgctcttttcttcctaaaaagtatttcttccagcaaaggcaagacggaaagcaattacagtaggcagctcccccgaaaatgcttgccaaacttgattccattgaggaatatgcaacaagtaaaagtgcgatcagagctactgcatctggttcctgggaaggctttaagacgacactgctgtgacattgtaccttcttcatctgaaaccaccatggatattgatatcaggaaatgcaaagacgacgaattgattgcgatgcattcgtagtgattcttgaataatattggatactcatctggagtagataatttacagcatgttctcgaacacacctaatttgcttttgttatatacggaccacactgtcccacttcattttgggtctgtaggtctatgtagagttatagcaacatactgtgatgcatcattacccaaagtaatatagtgaatcattttatatactgtatttgacatgtgttgtagcttgcgatttatctagcatctattgaagtatgaaggctgcacgtcaaggacatctagaagatctccaactgaacacatatgctatagtagttgttagggagtagttagaggtttattctctgttgtaattctcctctatctcctcctgtaaatgttctcctcagttacaactgaaaccccactgtatgcagctatgggataagccccatcctgtcaatataagcccgtgcgggctgcggccctcttcggagggtgagacactccaacaacaaaaaaaaaaaaaactaacgaagacgtgcgaacggacgacacgaaggggaggtaggagccccc

SEQ ID NO: 2684 - DNA, 2009 bp, Triticum aestivum
gttgctgcacctcggcctccactttcccacctcgcggccgggccggcgtccatggcaacgccgtcgcactcgcacgggctcccgctcgcgcccctccggacgctcctgctcgccttgccgctcttgtcgctcatcctcctcctcacgctgcacctcccgccgcgccaccacccggcccctccgggccccctcatcctccccacgcccctccggaccaccgccgccgccgcccagcctaagcccaaggccgacccctcctcctcctcgtcgccctcgccgacgacgctctcgcacgtggtgttcggggtggcctcctcccgccgcacgctgccgctgcgcctcccgctcctccgcctctggctccacctgcccgcgcgcgccttcctcttcctcgacgcgccgccccgcgctgcctccgtcccggcgaacctccacctccgcgtctcccgcgacgcctcccgcttcccctactcctaccggaagggcctcccctccgcggtccgcgtcgcgcgtatcgccaaggagctcctcctcgagctccgccagcagcagcagcaccagtcgccgccgccgaggtggctcgtgctcgccgacgatgacaccgccttcgtcctccccaacctcctccacaccctctccaagtacgactggcacgagccatggtacctcggcgcgccttccgagtccgccgcgcagaacgtctggcacggcttcaacatggcctatggcggcggcggcatcgccatcagctggcccctcgcagcgcgcctggcccgcgtgctcgactcctgcatcatcaggtacccccacctctacggcagcgactccaggatctacgcctgcctcgccgagctcggcgtcgagctcacccacgagccaggattccaccagatcgaccttcatggggatatatctggatttctaagagcacatcctcttgctcctttagtgtcacttcaccaccttgatcatgtctatcctctttaccctggtatggatcgtgcaaaggcggttgagcatttgttccgagcagctaatgctgacccagcgaggatccttcaacaaacagtgtgctatgaccattcaagatcacttactgcttcagtagcatggggctattctgttcaggttttcaaaggcaatgtactgcttcctgacatccttgctgtgcaaaaaacctttgtgccatggagaagaggtcgcaatgttacggatgtttttatgtttagcaccaagcattatccaagggacgagtgcaaacgagctgctcttttcttcctaaaaagtatttcttccggcaaaggcaagacggaaagcaattacagtaggcagctgccccagaaatgcttgccaaacttgattcagttgaggaatatgcaacaaataaaagtgagatcagagctactgcatctggttcctgggaaggctttaagacgacactgctgtgacatcgtaccttcttcatctgaaaccaccatggatattgatatcaggaaatgcaaagatggtgaattgatcgcgatgcattcgtagtgattcttgaataatattggatactcatctggagtagataatttacagcatgttctcgaacacacctaatttgcttttgttatatacggaccacactgtcccacttcattttgggtctgtaggtctatgtagagttaaagcaacatactgtgatgcgtcattacccaaagtaatatagtgaatcattttatatactgtatttgacatgtgttctagcttgcgatttatctagcatctgttgaagtatgaaggctgcacgtcaaggacatctagaagatctccaactgaacacatatgatatagtagttgttagggagtagttagaggtttattctctgttgtaattctcctctatctcctcctgtaaatcttctccccagttacaactgaaaccccactgtatgcagctatgggataagccccatcctatcaatataagcccatgcgggctgcggccctcttcggagggtgggacg

SEQ ID NO: 2685 - DNA, 1952 bp, Panicum virgatum
tcttacacggctacatatgttcattcccaaatccactaccaaacaatggaaaagaagctcacctcacttcatctcgtctattaagaaacatgtgttacatcgaagagacagttttctcttgggtggtgattgattgcaatttggatggcagtgcttgcgccagattctaacaattacaatatcgagttatcaactatatttctttctcagattttgtctcgaaatttattgactgtaaaattggtataaaaataacttcatggaaataaatgatgacttgctttggtcaagagctaagaaaatggatagcaacggtatctgaatattaagccataatcaaggaaaaaaaacgtttgtatctatcataataaatgttatagcagtgtgtgtctaggccatatttctttattcctccagaaaattatgtaagatatttatgtcgagaaggttgtaccctagtacttatatcctgaatgatagttgttttcactctttttttttttgagagagaggagctgtatttcacttttgcacgtcaaaaatcccgctgatgcaatccatggagcccatcaaattgcgtttgccttcgaaattgcgtttgaaacgacaatccgggccggggctccgggcaggcggcccaatctttcctgggccaaacatatcgttcgcggggaagcgagggcaggggcagcagcttgccagattacgccatggccttctcttcactggcgcccttctccccgccttctggaaccttccgacaccatcccgccgggcggcccggggccgccgcgtccgggagtgtcgtggcgtgttcgccgcccccgcccgacgtcgtggtgacgcgcgagcgggggaagaacgccgagctcatcgccgcgctggaaaagcacaatatacactctctggaacttcctcttgttaagcatgttgaaggccctgatgcagataggctttcagatgtcttacgtgatgacaagtttgactggattattataacctctcctgaggcagccgcagtgttccttcagggatggaaggctgctggaagtcctaaggttcaagtagcagttgttggagcaggaactgctagggtttttgatgaagtattacagtctgaagatcgatctcttgatgttgcattttcaccttccaaagctatgggtaaagtcttggcgtcagagcttccaaaaagcagcaggaatacatgtaaagtgctgtatcctgcatctgcaaaggctgggcatgaaattcaggatggtttatcagaacgaggatttgatgtgacacgattgaatacatatacaactgtccctgtagatgtcgaaccactaacattaaatcttgctatatcagctccagttgtcgcagtagcttctccttctgcactgagggcttggttaaacctgattccaaaagtcgataattggaataactccattgcttgcatcggcgagaccactggctctgcagcgaagaaattgggcttgaagagtatatattgtccaacaacccctggacttgaagggtgggttgaaagcattcttgaagcgctcagagtccacaggcagttgaaagaggcccccaaaatgttgaacacgggcagccccgtgcaccggatgacggagcttcttgatgttggtgatcggctgtagattcaggaaactcataacctgtcggagatcgcgcgctggtggccttcctgccgtttagtttttttagtttaagtcataagtcctattacatcgcatgtttacacaccaattaagagtactaaatatagacttattacatcactataatttcataaggcgtgacttaatcacgagacgaatctattaataagcctaattagtccttagtttgaccactaattgatatagtaactctccactaattatgtattaattatacttaatagactcgtctagaatccgaattgcaacttatgc

SEQ ID NO: 2686 - DNA, 1041 bp, Setaria italica
gcccgctatcaacgccgagtgaaacggactgggagcgaccgcagaatcgcagacccagatccaggcgtggggcccgtgtccagagcgtcttcctctccggtctcctccacccacaagctccatgcggccatggccttctcttcttcgctggcgttccccttcccttccccaccttctggccaagcccgacccgcaggaaggctccgagccggcgccaccggtaggttcctggggtgctcctcgcccccgcccgacgtcgtggtgacccgcgagcgggggaagaacgccaagctcatcgccgcgctggaaaagcacaatatacaggctctggaacttcctcttattaagcatgttgatggccctgatacatataggcttccagatgtcttacgtaatgacaagtttgactggattactataagctctcctgaggcagctgcagtgttccttcagggatggaaggcagctggaagtcctaaggtgcgagtagcggttgttggagcaggaactgcaaaggtttttgatgaagtatcacagtctgatgatcaatctcttgaggttgcattttcaccttccaaagctatgggtaaagttttggcctcagagcttcccaggggcagtgagagtacatgtaaagtgttgtatcctgcatcagcaaaggcaagccatgaaattcaagatgggctatcagatcgaggatttcatgtgacaagactgaatacatatacaaccgtacctgttgaagatgtcgaaccactaactttaaagcttgctatttcagctccagttgttgcagtagcttctccttccgcattgaaggcttggttaaagctgatctcaaaagtcgataactggaataattccatcgcttgcattggtgagaccactggctctgcagcgaagaaattgggtctgaagagcatatattatcccacaacccctggacttgaagggtgggttgaaagcattcttgaagcgctcagaagccacaggcaattaaaagaggtttcttatcttatccttgcgtcctatcctgatttt

SEQ ID NO: 2687 - DNA, 1446 bp, Panicum virgatum
cccccagccctactcagttagcgtgcgaccccctcagccagccagggcagcagcttgccccattacgccatggccttctcttccttggcgcccttctccccgccttctggaaccttccgaccccatcccgcccggcggctccgggccgccgcgtccgggaccgggagtgtcgtggcgtgctcgccggccccgcccgacgtcgtggtgacgcgcgagcgggggaagaacgccgagctcatcgccgcgctggaaaagcgcaatataaactctctggaacttcctctcgttaagcatgttgaaggccctgatgcagataggctttcggatgtcttacgtgatgacaagtttgactggattgttataacctctcctgaggcagctgcagtgttccttcagggatggaaggctgctggaagtcctaaggttcaagtagcagttgttggagcaggaacggctagggtttttgatgaagtatcacaatctgaagttcgatctcttgaggttgcattttcaccttccaaagctatggtttaagtcttggcgtcggagcttccaaaaaacagcaggaatacatgtaaagtgatgtatcctgcatctgcaaaggctgggcatgaaatccaggatggtttatcagaacgaggatttgatgtgacacgattgaatacatatacaacagtccctgtagacgatgttgaaccactagcattaaatcttgctgtatcagctccagttgtcgcagtagcttctccttctgcactgagggcttggttaaagctgattccgaaagtcgataattggaataactccattgcttgcattggtgagaccactggctctgcagcgaagaaattgggcttgaagagtatatattgtccaacaacccctggacttgaagggtgggttgaaagcattcttcaagcgctcagagtccacaggcagttgaaagaggccccaacatgttaacacgggcaaccccgtgtaccagatgacagagcttcttgatattggtgaccagctgtagatttaggaattctttgcttctttgacctctccacgtcttctgttgttttgtcagcgcgactcgtggactgtgttgtggtgtaatatggtggtgtaatattgtttatttgtttcggggttcgtgctagttagtgagaatgatgatgatgaatcgttggggggcttggcgggccttctcgggttggttgtgttgacccatgatgtgactggatctgtttggcggcctgtcaaccgtttatttttcatgcggctccaatggagagaacatgggtcatgtgctctaagattttttcctcaaaattttctccattgattctatcatcttacttcaaacagcttgggagttgaacttgagagagatggtgcgctagaaattttcatctctgctatcaacgctgagtcggacaatgtaaagtcacacactta

SEQ ID NO: 2688 - DNA, 937 bp, Panicum virgatum
  misc_feature (823)..(823): n is a, c, g, or t
  misc_feature (863)..(863): n is a, c, g, or t
  misc_feature (879)..(879): n is a, c, g, or t
  misc_feature (887)..(887): n is a, c, g, or t
  misc_feature (891)..(891): n is a, c, g, or t
  misc_feature (898)..(898): n is a, c, g, or t
  misc_feature (911)..(911): n is a, c, g, or t
  misc_feature (919)..(919): n is a, c, g, or t
  misc_feature (921)..(921): n is a, c, g, or t
  misc_feature (932)..(932): n is a, c, g, or t
ttctccccgccttctggaaccttccgaccccatcccgcccggcggctccgggccgccgcgtccgggaccgggagtgtcgtggcgtgctcgccggccccgcccgacgtcgtggtgacgcgcgagcgggggaagaacgccgagctcatcgccgcgctggaaaagcgcaatataaactctctggaacttcctctcgttaagcatgttgaaggccctgatgcagataggctttcggatgtcttacgtgatgacaagtttgactggattgttataacctctcctgaggcagctgcagtgttccttcagggatggaaggctgctggaagtcctaaggttcaagtagcagttgttggagcaggaacggctagggtttttgatgaagtatcacaatctgaagttcgatctcttgaggttgcattttcaccttccaaagctatggtttaagtcttggcgtcggagcttccaaaaaacagcaggaatacatgtaaagtgatgtatcctgcatctgcaaaggctgggcatgaaatccaggatggtttatcagaacgaggatttgatgtgacacgattgaatacatatacaacagtccctgtagacgatgttgaaccactagcattaaatcttgctgtatcagctccagttgtcgcagtagcttctccttctgcactgagggcttggttaaagctgattccgaaagtcgataattggaataactccattgcttgcattggtgagaccactggctctgcagcgaagaaattgggcttgaagagtatatattgtccaacaacccctggacttgaagggtgggttgaaagcattcttnaagcgctcagagtccacaggcagttgaaagaggccccaanatgttaacacgggcanccccgtgnaccngatgacngagcttcttgatnttggtgancngctgtagattnaggaa

SEQ ID NO: 2689 - DNA, 1526 bp, Panicum virgatum
acagcccacaggccacaagctccaggcggccaggccatggccttctcttcttcgctggcgttccccttcccttccccgccttctggaaccttccaaacccgatccgcaggaaggctccgaactggcgccacccagagattcctggcgcgctcctcgcccccgcctgacgtcgtggtgacacgcgagctgggaaagaatgccaagctcatcgccgcgctgatgacaagtttgactggattactataacctctcctgaggcagctgcagtgttccttcggggatggaaggctgctggaagtcctaaggtgcgagtagcggttgttggagcaggaactgcaagggtttttgatgaagtatcacagtctgatgatcaatctcttgaggttgcattttcaccttcgaaagctatgggtgaagtcttagcctcagagctacccaggggtagtgagagcacatgtaaagtgttgtatcctgcatctgcaaaggctagtcgtgaaattcaagaggggctatcagaccgaggatttcatgtgacaagactgaatacatatacaaccgtacctgttgaagatgtcgaaccactaactttaaagcttgctatttcagctcctgttgttgcagtagcttctccctccacactgaaagcttggttaaagctgatttcaaaagtcgattgttggaataactccatagcttgcatcggtgagaccactggcactgcagcgaagaaattgggtctgaagagtgtatattatccaacgacccctggacttgaagggtgggttgaaagcgttcttgaggcgctcagagtccacaggcaattaaaagaggccccaaatgttgaacacgggtagcccctttgtgccggatgacggagcttgtttacgtcggtggccggctgtagaatcaggaattctttgcttctttgaccttaatcacgcctggcgttgttttatcagcgtgtcctgcatcgtcgctttcgcgtgacaagtgctgagtcacagtaccgtgagtcgtggacggtgtggtgcagatttcctgggccgaatgggcctcaaaatggctcagctcgctaacgctcgatgcatgggcgggctttcgttactagctcagtagcttgtttcccgggccgaaaggcccatttatgtacttgcgatttctttttcctgaggacgagtgagtacttcgtttacaccattgtaaagttgtaattgcatttttttatttcaaaaaaattgcaatcgcatcggtccttttcattgaggtttgaggaggttggcagtgccgtctttgtttggcaaattgcatcttgtcgtcacgctaagtgcagctccgttgtactttagggttggagcaattgataggagattctgaataccgcgaggctacggaatctccgcccggcgacgtcacaccaaagattcccctctcgcctttgaattttacacgaggacgccaatcatagcctgcaagaaaaccctgtattatgaaattgctagcccgcacgttagcgacacctccccgcg

SEQ ID NO: 2690 - DNA, 1267 bp, Panicum virgatum
  misc_feature (57)..(57): n is a, c, g, or t
  misc_feature (70)..(70): n is a, c, g, or t
  misc_feature (102)..(102): n is a, c, g, or t
  misc_feature (125)..(125): n is a, c, g, or t
  misc_feature (135)..(135): n is a, c, g, or t
  misc_feature (163)..(163): n is a, c, g, or t
  misc_feature (176)..(176): n is a, c, g, or t
  misc_feature (265)..(265): n is a, c, g, or t
  misc_feature (303)..(303): n is a, c, g, or t
  misc_feature (402)..(402): n is a, c, g, or t
  misc_feature (439)..(439): n is a, c, g, or t
  misc_feature (463)..(463): n is a, c, g, or t
  misc_feature (467)..(468): n is a, c, g, or t
  misc_feature (527)..(528): n is a, c, g, or t
  misc_feature (616)..(616): n is a, c, g, or t
taattcccttccccgccttctggataattccaaacccgatccgcaggaaggctccgnactggcgccaccnagagattcctggcgcgctcctcgcccccgccngacgtcgtggtgacacgcgagcngggaaagaangccaagctcatcgccgcgctggaaaaanacaatatacagtntctggaacttcctcttattaagcatgttgatggccctgatacagataggcttccagaagtcttaagtaatgacaagtttgactggattnctataacctctcctgaggcagctgcagtgttccttcgnggatggaaggctgctggaagtcctaaggtgcgagtagcggttgttggagcaggaactgcaagggtttttgatgaagtatcacagtctgatgatcaatcncttgaggttgcattttcaccttcgaaagctatgggtnaagtcttagcctcagagctacccngggnnagtgagagcacatgtaaagtgttgtatcctgcatctgcaaaggctagtcgtgaaattcnngaggggctatcagaccgagggatttcatgtgacaagactgaatacatatacacccgtacctgttgaagatgtcgaaccactaactttnaagcttgctatttcagctcctgttgttgcagtagcttctccttctgcactgaaagcttggttaaagctgatttcaaaagtcgattgttggaataactacatcgcttgcatcggtgagaccactggctctgcagcaaagaaattgggtctgaagagcgtatattatccaacaacccctggacttgaagggtgggttgaaagcgttcttgaggcgctcagagtccacaggcaattaaaagagggcccaaatgttgaacacgggtagccccttgtgccggatgacggagcttgttgacgtcggtggccggctgcagactcagaaattctttgcttctttgaccttaaatcacgcctggtgttgttttatcagcgtgtcctgtgcatcgtcgcggtcgcgtgacaagtgctgtggaccggtgtggtccagatttcctgggccgaatgggcctcaacttggctcagctcgctcgatgcattggctttcttgtactagcccagtagcttgtttcccgggccgaaaggcccatttctgtacttgcaatttctttttcctgagtagcgaggactgaggagcacttgtttacaccatattgacattttgtaaatttgtaattgcatcagtccttttcattgaggtttgaggaggttagca

SEQ ID NO: 2691 - DNA, 1987 bp, Panicum virgatum
aacaacccgcccaacaccgagtgaagcgggctgtggccgcagaaccgcaggcccaggtgtgggggaatggcgtggggcccatttccagagcgtcttcctctccctccaatccatttccctcgccagtcgccatcgccacccacagcccacagggccacaagctcctggcggccaggccatggccttctcttcttcgctggcgttccccttcccttccccgccttctggaaccttccaaacccgatccgcaggaaggctccggactggcgccaccgagagattcctggagcgctcctcgcccccgccagacgtcgtggtgacacgcgagcggggaaagaacgccaagctcatcgccgcgctggaaaaacacaatatacagtctctggaacttcctcttattaagcatgttgatggccctgatacagataggcttccagaagtcttaagtaatgacaagtttgactggattgctataacctctcctgaggcagctgcagtgttccttcgcggatggaaggctgctggaagtcctaaggtgcgagtagcggttgttggagcaggaactgcaagggtttttgatgaagtatcacagtctgatgatcaatcccttgaggttgcattttcaccttcgaaagctatgggtaaagtcttagcctcagagctacccagggtcagtgagagcacatgtaaagtgttgtatcctgcatctgcaaaggctagtcgtgaaattcgtgagtcagttttctgtttacaattagaatcttcttgctattttcttctgctttcactaaggccacatgtttctcacatttactgtgtcggtttcttcatgatgttgcatattgattttgatccagtcaattttctgttctctagttgaactttatggttatgagctcttaactgggcgtatgtgatctatggacttgatttaaccatttatttttttattcaggaactgtatacattatctgcatttacgtgtttttttttgtaatgcagaagaggggctatcagatcgaggatttcatgtgacaagactgaatacatatacaaccgtacctgttgaagatatcgaaccactaactttgaagcttgctatttcagctcctgttgttgcagtagcttctccttctgcactgaaagcttggttaaagctggtttcaaaagtcgattgttggaataactacatcgcttgcatcggtgagaccactggctctgcagcaaagaaattgggtctgaagagcatatattatccaacaacccctggacttgaagggtgggttgaaagcgttcttgaggcgctcagagtccacaggcaattaaaagagggcccaaatgttgaacacgggtagccccttgtgccggatgacgcagcttgttgacgtcggtggccggctgcagactcagaaattctttgcttctttgaccttaaatcacgcctggtgttgttttatcagcgtgtcctgtgcatcgtcgcggtcgcgtgacaagtgctgtggaccggtgtggtgcagatttcctgggccgaatgggcctcaacttggctcagctcgctcgatgatgcattggctttcttgtactagcccagtagcttgtttcccgggccgaaaggcccatttctgtacttgcaatttctttttcctgagtagcgaggactgaggagcacttgtttacaccatattgacattttgtaaatttgtaattgcatcagtccttttcattgaggtttgaggaggttagcagtgccgtctttgtttggcaaattgcatcttgtcgtcacgctaagtgcagctccgttgtacttgtgggttggagcaatgataggagattctggataccgcgaggctacggaatctccgcccggcgacctcaccccaagattccctctcgcctttgaattttacacgaggacgccaatcatagcctgcaagaaaaccctgtattatgaaattgctagcccgcacgttagcgacacctccccgcg

SEQ ID NO: 2692 - DNA, 975 bp, Pennisetum glaucum
ggcttccagatgtcttacgtaatgacaagtttgactggattacaataacctctcctgaggcagctgcagtgttccttcagggatggaaggctgctggaagtcctaaggtacgagtagctgttgttggagaagggactgcaagggtttttgatgaagtatcacagactgatgctcaatctcttgaggttgcattttcaccttccaaagctatgggtaaagttttggcctcagagcttcccaggggcagcgagagcacgtgtaaagtgttgtatcctgcatctgcaaaggctagctgcgaaattcaagaggggctatcagatcgaggatttcatgtgacaagactgaatacatatacaaccgtacctgttgaagatgttgaaccactaactttaaagcttgctatttcagctccagttgttgcagtggcttctccttccgcattcaaggcttggttaaagctgatttcaaaagttgataactggaataactccattgcttgcatcggtgagaccactggctctgcagcgatgaaattgggcctgaagaacatatattatccaacaacccctggacttgaagggtgggttgagagcattctggaagcgcttagagtccacaggcaattaaaagaggtgggttgaaagcatgcttgaagcgctcagagtccacaggaaattaaaagaggccccaaaatgttgaatactggcagcccccttgtacctgatggcgcgtgacggagcttcttgacgttggtggttgggtgtagacccaggaattctttgcttctttggcatcatcacgcctgctgtacagcctattgttgtttcgtcagtgaaactagatctccctgttgtgattaaacttgctgtaaattgtgtgagctgtacagggtagcatatgaacaagttcggttcagtggtgtaatgtggcgtcaagttgtgctgtttgttctaattctcatcacctaaacgagag

SEQ ID NO: 2693 - DNA, 2140 bp, Setaria italica
aaaaggaaaataaaaaaagaaaaagagattccaaaccctctcctcccaaaatcgcagcgtcgaccgcggcggcttatccccacctttgatcgactatttcgtccccatcaaatccctcgtagagccgctgaccttctctgggcgatccgatccagtcgtggtgccttgcggtgcggttttgtttccgaaattttgttggggaatttctgctgcgggcggcgccggcgccggaggcgaagatgatccgtcttcagacgtacgcggcgttcagcctgctggcgacggcgtcggcggtgtactacgccttcagcagccgggaccagttctacccggcgatggtctacctctccacctccaagatctgcttcgtgctgctcctcaacacgggcctcgtcgccatgtgcgtcgcctggcagctcgtcaagcgcatcttcctggggtcgctccgggaggccgaggtcgagcgcctcaacgagcagtcctggcgggaggtcgtcgagatcctcttcgcggtcaccatcttccgccaggacttctccgtctccttcctcgccatggtcgccgcgctgctcctcgttaaggcgctgcactggctggcagggaagagggtcgagtacatcgaaaccacgccttccgtgcccacgctatcgcacatcaggatcgtctccttcatggcgttcctgctcattgtcgactgcctcttcctgtccaactcgctcaggtcgctcatacagaagcgggaggcgtcagttgccatcttcttctcctttgagtatatgatactagcaacatccactgtgtcaacgtttgtgaagtatgtattctatgtcagtgacatgctaatggaaggtcaatgggagaagaaagcagtttatacattttacttggagctcatcagtgaccttgtgcacttgtcattatacatgctgttcttcatagctatcttcctgaactatggtgtcccactgcacttaattcgtgagctatatgagaccttccgcaacttcaaaattcgcatagcagattatgtgcgctacagaaagatcacttccaacatgaatgagcgctttccagatgctacaacagaagagctcaatgcgagcgatgctacatgtatcatttgccgtgaggagatgactacagcaaagaagctgctttgtgggcatctgttccatgtgcattgtctaaggtcatggctagagcgccaacacacttgccccacgtgcagagctccaatcattcccccagataatggacgtgcggcagcagcacgacaacatggagctcagcctggagttcagcctgctgcaggtactggtactcctgcctcagaaggagcatcaggtgagaacatgagcaggcgccaagcaaaacttgaagcagctgctgcagctgcttctttatatggaagatcttttgcttatcctccagcgaacaacctaaataggtcaggtcctccccagtctacatcaagtacaccacaagctgaagcaagtagctccaatcagtctcagaaagaccaagaactgcagttccaaaacaccagcaatggtttagcacctctgccttttaatgcacatggtgcgattggttcaggagcaagcaccagggatcttgaaaattcactgcagaaggcacaagaaaactttataaagagccagatagagatgttgcaaatccaattgcaaatggttcagcgtggcgctgctgcattggcaaataacaatgagaatgctgagcacacaaagaatgactgaagctgtaaataggtggagatgaggatgggataaacaaagacaagaattggcaatacctgaggggaaaaagttagatgatgccttgccttgattttggtaggcttgttcgtttaaacttccccgttagtttcttctctttgtgttgtggtttccgtagtctggatccatcaagcccgtataataccttttgatgagaggttgtcgtgttgtaacaatggctagtttcatagtaattatgagaataaacaaaatccatcgaaaatagaaatgacttttttttggcttatctatgctatatcggaagaaaagcttgctattgcagtgttgcttttatgttactagaatcaaattgtacatttaacttgggggtatgggtgctaaat

SEQ ID NO: 2694 - DNA, 2029 bp, Pennisetum glaucum
cgcagcggcgacttatccacctttgatcgaatcgaagccgctccgacatggcgtccccatcgaattcctcgtagagccgccgaccttctctggctgggcgatacgattcactcctggtgccttgggctgcggtattgtttctgaaattttgttggggggattttccgctgcgggcggcgccggcgccggaggcgaagatgatccgccttcagacgtacgcggcgttcagcctgctggcgacggcgtcggccgtgtactacgccttcagcagccgggaccagttctacccggcgatggtctacctctccacctccaagatctgcttcgtgctgctcctcaacacgggcctcgtcgccatgtgcgtcgcctggcagctcgtcaagcgcatcttcctggggtcgctccgggaggccgaggtcgagcgcctcaacgagcagtcctggcgggaggtcgtcgagatcctcttcgccgtcaccatcttccgacaggacttctccgtctccttcctcgccatggtcgccgcgctgctcctcgtcaaggcgctgcactggctggcggggaagagggtcgagtacatcgagaccacgccttccgtgcccatgctatcacacatcaggatcgtctccttcatggctttcctgctcatcgtcgactgcctcttcctgtccaactcgctcaggtcgctcattcagaagcgagaggcgtcagttgccatcttcttctcctttgagtatatgatactagcaacatccacagtgtcaacatttgtgaagtatgtattctatgtcagtgacatgctaatggaaggtcaatgggaaaagaaagcagtttatacattttacttggagctcatcagtgaccttgtgcacttgtcattatacatgctgttcttcatagctatcttcctgaactatggtgtcccactgcacttaattcgtgagctatatgagaccttccgcaacttcaaaattcgcatagcagattatgtgcgctacagaaagatcacttccaacatgaatgagcgttttccagatgctacaacagaagagctcaatgcgagtgatgctacatgtatcatttgccgtgaggagatgactacagcaaagaagctgctttgtgggcatctgttccatgtgcattgtctaaggtcatggctagagcgccaacacacttgccccacgtgcagagctccaatcattcccccagataatggacgtgctacagcagcacgacaacatggagctcagcctggagttcagcctgctgcaggtactggtattcctggctcagaaggagcatctgatggtgagaacatgagcaggcgccaagcaaaacttgaagcggctgctgcagctgcttctttatatggaagatcttttgcttatcctccagtgaacaacctaaatagatcagctcctccccagtctacatcaagtacaccacaagctgaagcaagttgctccaatcaatctcagaaagaccaagaactgcaatttcaacacacaagcaatggtttagcaccgctgccttttattgcacatggtgccattggttcaggaacaagcaccagggatcttgaaaattcactgcagaaggcacaagaaaactttataaagagccagatagagatgttgcaaatccaattgcaaatggttcaacgtggtgctgctgtgctggcaactaacaatgagaatgcggagcacacaaagaatgactgaagctgtaaataggtggagatgaggatgggataaacaaagacaaaaattggtaatagctgaggggaaaaagttagatgatgcctcgccttgatttcggtaggcttgttcgtttaaacatccccggtagtgccttcttaccaacaacaaatgtttctactttttgtgttgtggtttctgtagtatggatccatcaagccggtataatactattcgatggggagagcttgtcatgttgtaacaatggctagtttcatagtaattatgagtttaaacaaaatctatcgaaaatataaatgacttcttttttggct

SEQ ID NO: 2695 - DNA, 2605 bp, Sorghum bicolor
ttcacccctctctctctttctcgtggcgacgacggcgaccgacgccgccgccctccgtcaggtgccagggtccctcggattcttcgccggcgacgagtacccaccagcgacccagtggtgttctggtgcggtttcgttgcgggaatcgttgggtgatttccagcgggcgggcgggcggcggtccccggtggcgaagatgatccgactaccgacgtacgcggcgttcagcctgctggcgacggcgtcggcggcgtactacgcgttcagcagccgggagcagttctacccggcgatggtgtacctctccacgtccaagatctgcttcgtgctgctcctcaacacgggcctcgtcgccatgtgcgtcgcctggcagctcgccaggcgcctcttcctcggcccgctccgggaggctgaggtcgagcgcctcaacgagcagtcctggcgggaggtcatcgagatcctctttgctgtcaccatcttccggcaggacttctcggtgtccttcctcgccatggtcgccgcgctgctcctcgtcaaggcgctgcactggctcgcgcagaagagggtcgagtacatcgagaccaccccctcggtgcccttgctctcgcacgtcaggatcgtctccttcatggttttcctgctcaccgtcgactgcctcttcctgtctaactcgctcaggtcactcatacagaagcgggaggcatccgttgccatcttcttctcctttgagtatatgatattagcaacatccacagtatcaacattcgtgaagtatatattctatgtcagtgacatgctaatggaaggccaatgggagagaaaggcagtgtatacattttacttggagctcatcagtgaccttgtgcacttgtccttatacatgctcttcttcatagctatcttcctgaactacggtgtcccactgcacttgattcgtgagctatatgagaccttccgcaacttcagaatccgcattgcagattatgtgcgctacagaaagatcacttccaacatgaatgaacgctttccagatgctacagcagaagagctcgatgcgagcgatgctacatgtattatttgccgtgaggagatgactacagcaaagaaactgctctgcgggcatctgttccatgtgcattgtctaaggtcttggctagagcgccagcacacttgccctacatgcagagctccaatcattcccgcagataatggacgcgctgcatcagcacgacaacatggagctcaagctggagttcagcctgctgcaggtactgctactccatcctcagaaggagcaccaggtgagaacataagcaggcgccaagcaaaacttgaagctgctgcagcggcagcttctttatatggaagatcttttgtttatcctccagcaaacaccctaaacaggtctggtcctccccagtctacatcaagcacaccacaatctgaagcaagtagctccaatcagtcacaaaaagaccaagaaatgcagttacaaaacagcagtgacggtttagtgcctctgcatgttaatgcaaatggtgctgttggttcaggaacaagcacaagggatcttgaaaattcattgcagaaggcacaagaaaactttattaagagccagattgagatgttacaaatccaactgcaaatggtgcagcgtggtgctgctgcgtcggccagtaacaatgggaatgctgaacacagaaagaatgactgaatctgtaaacaggcgcttctgcatcgtggagtaataatgagaatgctgagcacatagagaatagctgaatctgtaaataggcggagatgaggaagggataaaagagaacaaaaattggtggtacctgggggataaactattacatgataccttgccttgaatttgttaggcttgttaatttaaacttctctgttagtgccttcttgccagcactagacgtttcttctttgtcatgtgtggtggtttctgtagtttgggtacatcaagcctgtataataccttttgatgggagaacaatggctggtttaatcatgagactacacagaattcttctaccaagggaaaatatatatgacttttttcttgccaatccatgatatcaggaaagtctgtagattttatgtttactgaagtcaaacagaacatttgtctagtggttggatgttgaacactggaaatttcggttgcatccgtgatcactaaaccgagtgaccgttgaaacatactgtaagactacaagttggtttccgtggcgttgggtcgccttcttggcagctggagtagtagctcgactcgtgaattcgacatcgacgacgatgcttgtgaattttgtctactagtgagtataatttttttccaatcaggtttacatctcaaatttactggtagaatgttgttttgttgcttcagagtccaattatttttctagcttcaccggcacattgtggatggatttagaggggctagcagctagtgtttgttgttggaggtgaagatgaagaggaatcacaacatgggccagcgaactgtaggctgaacatgtctgctgtgctttattgaagtgaaagaaaaggcctccattccggccatgggccatttcttactaggcca

SEQ ID NO: 2696 - DNA, 1880 bp, Setaria italica
ctctagctgatccggcggcgtcgacgtcccacatctgggagcccccgctgtggcctctcatccgagcgagaggcgcaaccgccggccttccggcgccgccaaggacttctccccgccagatccagtggtggtggggctgtgccagtgccagctctgaaggcgaagatgatccgtcttcagacgtacacagcgttcagcctgctggcgatggcatcggcggtgtactatgccttcagtagccaggagcagttctacccggcgatggtctacctctccacctccaagatctgcttcgtgctgctcctcaacacaggcctcgtcgccatgtgcgtcgcctggcaactcgtcaagcgcctcttccttggatcgctccgggaggccgaggttgagcgtctcaatgagcagtcctggcgggaggtcgttgagatcctctttgccatcaccatcttccgccaggacttctcagtctccttgcttgccatggtcgctgcgctgctccttgtcaaagcactgcactggctggcccagaagagggtcgaatacatcgagaccacaccgtccgtgcccatgctctcgcacataaggatcgtttccttcatggcgtttctgctcatcgtcgactgcctcttcctgtccaactcgctcaggccgctcatagagaaacgggaggcatcagttgccatcttctcctttgagtatatgatactggcaacatccacagtatcaacatttgtgaagtatatattctatgtcaccgacatgctaatggaaggtcaatgggagagaaaggcagtgtatacattttacttggagctcatcagtgaccttgtgcacttgtcattatacatgctcttctttgtagctatcttcctgaactacggtgtcccgctgcacttgatccgtgagctatatgagaccttccgcaacttcagaattcgcattgcagattatctacgctacagaaagatcacgtccaacatgaatgaacgctttccagattctacagcagaagagctcaatgcgaatgacgctacatgtattatttgccgtgaggagatgactacagcaaagaagctgctttgtgggcatctattccatgtccattgtctaaggtcatggctagagcgccagcacacttgccctacgtgcagagctccaatcattcccccagataatggacgtgctgcatcatcgcgacaatatggagctcaacctggagtccagcctgctgcaggtactggcactccagcctcagaaggagcagcaagtgagaacatgagcaggcgccaagcaaagcttgaagcggcagcagcagcagcttctttatatggaagatcttttgcttatcctccagcaaacaccctaaataggtcagttcctccccagtctgcatctagtataccacaatctgaagcaagttgctccaatcaatcccagaaagaccaagaactgcagttccaaaacaccaacgatggtttagcacctcaggcttttaatgcacatggtgctattagttcaggaacaagcaccagggatcttgaaagttcactgcagaaggcacaagaaaactttataaagagccagatagagatgttacaaatccaactgcaaatggttcagcgcggtgctgctgtatcagccactaacaatgagaatgcggagcacagaaagaatggctgaagctgtaaataggcagagatgaggacgggataaacaaaacaaagatttggctataccacagggcaaaactgttacgcttgttcacttatactaacctgttagtgccctcttaacaacactacatgtttcttctctttatgtggtggttgcacagtttggatatgtgtcaagcctgtataatagctttgatagagaggccg

SEQ ID NO: 2697 - DNA, 2058 bp, Panicum virgatum
cccaagatcttcccgagcctgctagcctgctcagcccatctcccgagcccagagggataaaggttacctgcacttgttcctccgcctgctccccgtttcccacgtgctccgctggtcgccgccgagcacgaagaaacacacgattaggcgatccgatccggtggtggcgcggtgcggattcgtcgcgggaaggatcgctgcggccggcgccggcggcgaagatgatccgtcttcagacgtacgcggcgttcagcctgctggcgacggcgtcggcggtgtactacgccttcagcagccgggagcagttctacccggcgatggtctacctctccacctccaagatctgcttcgtgctgctcctcaacacgggcctcgtcgccatgtgcgtcgcctggcaactcgtcaagcgcctcttcctgggatcgctccgggaggccgaggtcgagcgcctcaatgagcagtgctggcgggaggtcgtcgagatcctcttcgcggtcaccatcttccgccaggacttctccgtctccttcctcgccatggtcgccgcgctgctccttgtcaaggcactgcactggctggcccagaagagggtcgagtacatcgagaccacaccctccgtgcccatgctctcgcacataaggatcgtctccttcctggccttcctgctcatcgtcgactgcctcttcctgtccaactcgttcaggtcgctcatggacaagtgggaggcgtcagttgccatattcttctcctttgagtatatgatactggcaacatcgacagtatcaacatttgtgaagtatatattctatgtcagtgacatgctaatggaaggtcaatgggagaagaaggcagtgtatacattctatttggagctcatcagtgaccttgtgcacttgtcattatacatgctgttcttcatagctatcgtcctgaactatggtgtcccactgcacttgattcgcgagctatatgagacattccgcaacttcagaattcgcattgctgattatgtacggtacagaaggatcacttccaacatgaatgaacgctttccagatgctacagcagaagagctcaatgcgagtgatgctacatgtatcatttgccgtgaggagatgactgcagcaaagaagttgctttgtggccatctgttccatgtctattgtctaaggtcatggttagagcgccagcacacttgccccacatgcagagctccaatcatccccccagataatggacgtgctgcatcagcgcgatatggagctcaacctggagctgcaggtattggcactccagcctcagaaggagcagcaggtgagaacatgagcaggcgccaagcaaagattgaagtggctatagcagctgcttctttatatggaagatcttttgcttatcctccagcaaacaccctaaataggtcaggtcctccccaatctacatcaagtataccacaaaccgaagcaagtagctccaatcaatcccataaagatcaagaactgcagtgccaaaacaccagcgatggtttagcacctctgccttttaatgcacatggtggtattagttcagggacaagcaccagggatcttgaaatttcactgcagaaggcacaagaaaactttataaagagccagatagagatgttacaaatccaactgcaaatggttcagcgtgctgctgctgtgtcagtcactgataatgagagtgccgagcacacaaagaatgactgaagctgtaaataggcagagataaggacgggataaacaaaacaaagatttggtgatacctgaggggaaatggttacatgctgctttgccttgattttggtagggttgttcatttgtacttccctgttagtgccctcttaacaacactagatatttcttgtgcacagcttggatctctgattctctgtcaagcccgtatagtaactttgatggagaggctgccgtattgtaccaatggttagttgagattgaacaaactccattttctgaggaaaaatagaatggatctttttctccatcttcaatatcacaaaaatgttttttgttgctttta

SEQ ID NO: 2698 - DNA, 2132 bp, Zea mays
aggcaaaacagccccggaccgcgtgcgtttcgcttccggcttccgcccctgctgtttcttggcgttcaccccctctttctctcgtggcgacgacggcgaccgtcgccgcccccctacgcgctaggtgccagggtccgtcgggtccttcgctggcgacgagcacctaccaggcgatccagtggtgtgtttgggaaggtttccgcggtcgggcggcgccccccagtggcgaagatgatccgactaccgacgtacgcagcgttcagcctgctggcgacggcgtcggcggcgtactacgcgttcagcagccgtgagcagttctacccggcgatggtgtacctctccacctccaagatctgcttcgtgctgctcctcaacacgggcctcgtcgccatgtgcgtcgcctggcagctcgccaggcgcctcttcctcggctcgctccgtgaggccgaggttgagcgcctcaacgagcagtcctggcgggaggtcatcgagatcctctttgctgtcaccatcttccgacaggatttctctgtttcctttcttgccatggttgctgcgcttctcctcgtcaaggcgctgcactggcttgcacagaagagggtcgagtacattgagaccacgccctctgtgcccttgctctcgcacatcaggatcgtctccttcatggttttcctgcttaccgtcgactgcctcttcctgtcaaactcgctcaggtcactcatacagaagcaggaggcgtccgttgccatcttcttctcctttgagtatatgatactagcaacatccacagtatcaacattcgtgaagtatatattctatgttagtgacatgctaatggaaggtcaatgggagaaaaaggcagtgtatacattttacttggagctcataagtgaccttgtgcacttgtcattatacatgctcttcttcatagctatcttcctgaactatggtgtcccgctgcacttgattcgtgagctatatgagactttccgcaacttcagaattcgcattgcagattatgtgcgctacagaaagatcacttccaacatgaatgaacgctttccagatgctacatcagaagagctcgatgtgagtgatgctacatgtattatttgccgtgaggagatgactacagcaaagaaactgctctgtgggcatctgttccatgtgcattgtctaaggtcgtggctagaacgccaacacacttgccccacgtgcagagctccaatcattcccgcagataatggacatgctgtatcagcacgacaacatggagcccaggctggggttcagcctgctgcaggtactgccactccatcctcagaaggagcaccaggtgagaacatgagcaggcaccaagcaaaacttgaagctgctgcagcggcagcttctttatatggaaggtcttttgtttatcctccagcaaacaccctaaaaaggtctgttcctcctcagcctgcatcaagtacaccacaatctgaagcaagtagctccaatcatcagtcacaaaaagaccaagaaatgcagtcccgaaacagcagcgatggtttagtgcctctgcctcttaatgcagatggtgctgttggttcaggaacaagcacaagggaccttgaaaattcacttcagaaggcacaagaaaactttattaagagccagattgagatgttacagatccaactgcaaatggtgcagcgtggcgctgctgggccgcccagtaacgagaatactgagcacacagaagaatgactgaatctgtgaacagacacttctgcatcgtggtgtaataataaggagaatactgatgagcacacagctgaatctgtaaataggcggcgatgaggatgggacaaaagaaagccaaggattggcgatacctggggctgggggaaactgttacatgatgtcttgcctggatttttggcaggcctgttaatttatgcttcactattagtgccttgttgccagcaccagatgtttctctctctctgtgtgtgtgtggtggtttctgtacatgaaagccttttgacgggagaaccaaccatggctagtttaattatgaagttcacttgttgtacccgagggaaaatagaaatgactcttgtttttgcctatctatccatgacttgttgtac

SEQ ID NO: 2699 - DNA, 2346 bp, Oryza sativa
aagccattggccagcgacacgccatcgtcgcaccccacaaccgttccatgaaccaagtccacccgcatacgggcaacaccagctactagtctacgacccacccacgcgttctcatccgacgtggtgaaccgcgtccacaaccactctcgcctcacgcccattctcccaccaagatcaaacccgttcgtttcactcccggagaggaagaagaaaaaaacacaaaaaccgaaaagaaaagaaaaaaaaaacaacaacaacaagattttttttttccgcaaaccctctcgaaccaaaatcgcggcggctttatccacgaatcaaaaaaaatccccgcgacaatgtctccgcccaatctttcctcctcctcctagagccggagaatccacccgccatcaccatcgtgctcgcaatcgcatcgcctgtggcgggatcgccggcggcggcggcggagatgattcggctgcagacgtacgcggcgttcagcctgatggcgacggcgacggcggtgtactacgcgttcagcagcagggagcagttctacccggcgatggtgtacctctccacctccaagatctgcttcgtgctgctcctcaacacgggcctcgtcgccatgtgcgtcgcctggcagctcgtcaagcggctcttcctggggacgctccgggaggccgaggtggagcggctcaacgagcaggcgtggcgggaggtggtggagatcctcttcgcggtcaccatcttcaggcaggacttctccgtctccttcctcgccatggtcgccgcgctgctgctcgtcaaggcgctgcactggctcgcgcagaagagggtcgagtacatcgagaccacgccctccgtgcccatgctgtcgcacgccaggatcgtctccttcatgctgttcctgctcgtcgtcgactgcctcttcctgtccaactcgctcaggtcgctcatacacaagcgggaggcgtctgttgcaatcttcttttcgtttgagtacatgatactagcaacatccacagtatcgacattcgtgaaatatatattctatgtcagtgacatgctaatggaaggtcaatgggagaaaaaggcagtgtatacattttacttggagctcatcagtgaccttgtacacttgtctttgtatatgctcttcttcatagctatcttcctgaactatggtgtcccactgcacttgatacgtgagctgtatgagacatttcgcaacttcagaatccgtatcgcggattatgtacgctacagaaagataacttccaacatgaatgaaagatttccagatgccacagcagatgagctcaatgcgagtgatgctacatgtattatttgccgtgaggagatgaccacagcaaaaaagctgctttgtgggcacctgttccatgtccattgtttgaggtcatggttagaacgccaacacacttgccctacatgtagagctccaattctgcccccagataatgggcgtactgcagcacgtccgcatggagttcatcctggagttcagcctgttccaggtaatggcacaccaggttcagaacgagcagcaggtgagaacataagcaggcgccaagcaaaacttgaagcagctgcttcggctgcttccctatatgggagatcctttgcttatcctccagcgaacaatttgaacaggtattcaactcctccacagtctacatcaaatggtccacaatcaggagaagcaagtacttccaatcaatcgccaaaaggccatgcaactgccgatccttcagcgcctactttttatgcacgtggtgctgttagttcagtgacaactaccagggaacttgaaagttcactgcagaaggcatatgaaaatgctataaagagccagatagagatgttgcaaatccagctgcaaatgtttcagcatggggctacttcatcagcgactaacaatgaaaacggtgagcacacaaaaagcgactgaagttgtaaataaggggaaggtgagggctgaacaaacaaaggatatatagatggtgacttggcaaatacccgaggagaaactcccatgccatgctttatttcgattttggtaggctcgttcatttgtatgtccatgttagaggcctcctatcaacatcagatatttatttgcttaatgtggtcatttgagtagagatgcagtgttgtaactacgactaatttcagattagcacatctgggaaaaagcaacatgattcttcaatctgaaccatcagtatgctccctcttttttctggcatttttgtttgtacgctatagttggatttatactgtccagacattcaatactgaatttaataaatgtgaatatggtttaagtcgctcttctgaatt

SEQ ID NO: 2700 - DNA, 2066 bp, Brachypodium distachyon
acatctcgctggccgccgctttgcagatcagacctccttctctccgcagtccgcacgcgcaccttctccctcctggtttggacatcacgccgccgcgccgagcgccctagacccctcccctcgcccgtcttcctcctcacgcgagcgccgccatccctccttccttctggcccatcccgctgccgagcgccgccgcagcctcctcgccaccaccgccggcaaaaatcaaggtagggcggccgccgtaccgctctactgggtcctctgcctgtggcgaagatgatccggttgcagacgtacaccgcgttcagcctgctggctacgatgtcggcggtgtactacgccttcagcagccgggagcagttctacccggcgatggtctacctttccacgtccaagatctgcttcgttctgctgctcaacacgggcctcgttgccatgtgcgtcgcctggcagctcgtgaagcgcctcttcctgggcacgctccgggaggccgaggtcgagcggctcaatgagcagtcatggagggaagtcgtggagatcctcttcgcggttaccatcttccgccaggacttctctgtcgctttccttgccatggtcgccgccctgctcctcgtcaaggcgctgcactggcttgcacagaagagggtcgagtacattgagaccacgccctccgtgcctatgctgtcccacataaggatcgtgtcctttatggcattccttcttgttgtggactgcctcttcctgtccaagtcgctggggtcactgatacagaagcgtgaggcatctgtcgctatcttcttttcctttgagtatatgatactagcaacgtccacagtatcaacattcgtgaaatatgtattctatgtcagcgacatgctaatggaaggtcaatgggagaaaaaggcagtgtatacattttatttggagctcatcagtgaccttgtgcacttgtctttatatatgctcttcttcatagcaatctttctgaactacggtgtcccactgcacttgattcgtgagctctatgagaccttccgcaatttcagaattcgcatatcagattatgtacgctacagaaagataacttccaatatgaatgaacgctttccagatgctacaacagaggagctcaatgcgagcgatgcaacatgtattatttgtcgcgaagagatgaccactgcaaagaagctgctttgcgggcacttgttccatgtacactgtttgaggtcatggctagagcgccaacatacttgccccacatgtagagctccaattatcccgccggataatggacgtgcggcatcagcacgacaacatggagctcaacctggagctcagcctgctgcaggcactggtaatccgagttcgggagaagcaccaagtgagaacgtgaacatgcaccaagctaaacttgaggctgctgcttcagctgcatccttatatgggagatctcttgcttatcctccagcgagtactttgaataggtactcatcacctctgcatgccacatcaagtacttcacaatcaggagaagcaagcagttccactggcaatcctttagcacctcgtcctttttattcacatggcccagttggttcaatagcaagcagtagagaccctcaaatttccctgcaaaaggcatatgaaaacgctataaggagccagatagagatgttgcacatccaattgcaaatggtgcagcaagcggctactccatcagcaactaacaatggcagttctaagcacccggaaaatgagtgaagttgtaaatacggggaagccggggatctggatgtacatagagatttggtaatacctgaggtgtgactgacgtgatgtcttgttgattttggtatcagtctctgttaacatctgctgttcgtttgttttatctggtaatttgcttaccctaaatcttgttgtcaagtacggattgtacgtaagatagaaatgcagatatattgtggcgatgactttcacagtaactgtgggactaggcaaatacatatgcataaaggaatttcgtacctgccatcggaataaaacattgttttttttaaaat

SEQ ID NO: 2701 - DNA, 1671 bp, Brachypodium distachyon
gccctcggtgttcggagattcgccgtggggcagcagcggcagagatgatccggctgcagacctacgcggcgttcagcctgctggcgacgacgacggcggtgtactacgcgttcagcagccgggtgcagttctacccggcggtggtctacctctcgtcgtccaagatctgcttcgtgctgctcctcaacacgggcctcgtcgccatgtgcgtcgcctggcagctcgtcaagcgcgtcttcctgggcaagctccgcgaggccgaggtggagcggctcaacgagcagtcgtggcgggaggtcgtggagatcctcttcgcggtcaccatcttccgccaggacttctccgttgccttcctcgccatggtcgccgccctgctcctcgtcaaggcgctgcattggctcgcgcagaagagggtcgagtacattgagaccacgccctccgtgcccatgctgtcgcacttaaggattgtgtccttcatggtgttcctgcttgctgttgactgcatattcctgtccaactcgttgatgtcactgataaagaattgggaggcctctgttgcaatcttcttttcattcgagtatatgatactagcaacatccacggtgtcgacattcatgaagtatgtattctatgtcagcgacatgctaatggaaggtcaatgggagaaaaaggcagtgtatacattttatttggagctcatcagtgaccttgtgcacttgtctttatacatgctcttcttcatagctatcttcctgaactatggtgtcccgctgcacttgatccgtgagctgtacgagaccttccgcaatttcaggattcgtgtttcagattatgtacgctacagaaagataacttccaacatgaatgaacgctttccagatgctactgccgatgagctcaatttgagtgatgctacatgtattatttgccgcgaagagatgaccacggcaaagaagctgctctgtgggcacttgttccatgtgcattgtttgagatcatggctagagcgccaacatacttgccccacatgtagagcaccaattatccccccggacaatggacgtgctgcatcagcgcgacagcatggagctcaacggggagttcagcttgctgcaggcgctggtactccaggttcgggaggagcaccaagtgagaacgtgaacatgcgccaagcaaaacttgaggctgctgcttcagctgcttccttatatgggagatcttttgcttatccaacaaacactttaaataggtattcgggacctcgtcatgctacatcaaatgcttcacaatcaggagaagcaagtacttccaatcaatcccagacagaccaatcagtgcagtggaagcatactggggatgctttagaaccagagccttttatttcatatggccctgttgtcccaataacaagcaacggggaccttgaaaattcactacaaaaggcgtacgagaatgctataaggagccagatagagatattgcaaatccaattgcaaatggtgcagcaaggagctacgacattggcaactgacaacaacaatgctgatcgagcacccgacccgaaaaatgagtgaagtggtatatatggggacatggagtctggatgaggaaaggatttagatggagattcggcaatacttgtatgttacttagtacctctatcaacaccag

SEQ ID NO: 2702 - DNA, 2421 bp, Hordeum vulgare
tagcgacacgccaccaccggcgcatctccctcgccgccgctgtgcagacccccgttctctccgagcgaacacgcctccttcctcctccccacaccccattcactcacatggtcctcacagggtgaataccttgatgctatctcccctcctagagtttctcccaatccaaccaatcacaagggtacgaaatccggataggggcgcggccgcatcccgggacgagatttcactccgccgccgcccccggcggtgctcagtgtccgtgcctacgagggagtgagggggcgcgcaaaccctctcgccgcaaaatcgccgtgaacgccagcaggagcccccgttggatcaaatcttccgacgtgttccccgtccgatctctcccgggatcctcgtatcggtgatctattggttgcgtgccttagggtttgtggcggaattcgcgaggggattcgccgagggcggcggccgagatgatccggttgcagacgtacgccgcgttcagcctgctggcgacggtaacgtcggtgtactatgcgttcagcagcagggagcagttctacccggcgatggtctacctctccacctccaagatatgcttcgtgctgctcctcaacacgggcctcgtcgccatgtgcctcgcctggcagctcgtgaagcgcgtcttcctggggacgctccgggaggccgaggtcgagcggctcaacgagcagtcgtggcgggaggtcgtggagatcctcttcgcggtcaccatcttccgccaggacttctccgtctctttcctcgccatggtcgccgccctgctcctcgtcaaggctctgcactggctcgcgcagaagagggtcgagtacattgagaccacgccctccgtgccaatgctgtcgcacataaggatcgtgtccttcatgctattccttcttgtcgtcgactgcctcttcctgtcgaactcgctggggtcactgatacaaaagcgggaggcatctgttgcaatcttcttttcctttgagtatatgatactagcaacatcgacggtatcgacattcgtgaagtatgtattctatgtcagcgacatgctaatggaaggtcaatgggagaaaaaggcagtgtatacattttatttggagcttatcagtgaccttgtgcacttgtctttatatatgctcttcttcatagcgatcttcctgaactatggtgtcccactgcacttgattcgtgagctgtatgagaccttccgcaacttcagaattcgcatttcagattatgtacgctacagaaagataacttccaacatgaatgaacgctttccagacgctacaccagatgagcttgatacgagtgatgtcacatgtattatttgccgtgaagagatgaccacagcaaagaagctgctttgtgggcacttgttccatgtacattgtttgaggtcatggctagagcgccaacatacttgcccaacatgtagagctccaattatccccccagataatggacgtgcagcatcagcacgacagcatggagctcaacctggagttcagcctggtgcaggcgctggtactccaaattcaggaggagcaccaactgagaacgtgaacatgcgtcaagcaaaacttgaggctgctgcttcagctgcttccttgtatgggagatcatttgcttatcctccagtgaacactttgaataggcattcaggacctctgcatgctacaccaagtacttcacaatcaggagaagcaagtacttccaccggccatccattggaacctcagccttcttattcaactggtccagttagttcaataacaagcagccgggaccctgaaaattcactacaaaaggcatatgaaaaggctataaggagccagatagaggtgttgcaaatccaattgcaaatgatgcagcaaggggccaccaccacatcggcaactggcaatgagagtgctgagcaagccgaaaaataagtgaagtggataataggcgaagaaggggtctagaaaaacatatgttatatatggaggttgtgcgatacttagcataaacaaacgacatagatggagattgtgcaatacatgaggtggaactttgccgtgatgttttgttgatcttggtagactcggttatcaacatcagatggtcgtttgtttggtctggtgatttgcttagtttatattttgttgttatgagcagatttacaccttagacagaaatgagcagtgtcgtaacaatgactaatttcatagcaaccgtgagaccaaggacgcgtttgattgcttcaagtgaacagtacctgcatttcatacacgtctcgagccgagccaacctggtttagcaaaaacagacaagaaatcaacatgtgcataaaacagataacaaatcaacatgtttgtgacctggatcagatagatagccagcattagtatatcctaccat

SEQ ID NO: 2703 - DNA, 1282 bp, Saccharum officinarum
gttaggacagcacaactgaactgatagtaaagttgttagttttgccagggtgcatgaattttgtttcaattgtatggctagtattctttttagaattatcaacatgacgttaggacagcacaactttactgaaagtaaagttgttagttttgccagggtgcatgaattttgtttcaattgtatggctagtattctttttggaattatcttcaggtgtttgatggattaggtatcttgttaatgcactatgtttgctacaatgcagggaagagcaaattggcaagtggtgactatgatgagtcagtaaaaccttcccaaattaatggttctactctgaaacatcaatcagatatgccaccaccaccagctccaccccctcggaacaataatttcaatggaaaggagaaacaaccagtccctattgcaagagcagacgatgatgacatttttgtcggagatggagttgattattcagttcctaacaaggaaatgagccaaagccctgttgctgaggatatggaggaatcaccacataataaccatcagaagcagtcctatttcactgaacccatgtatggcccagtaccaccatctgaatctgctcaggcttggcaacagccgaatgagtatgatgctgctcaagcccagatggtagctgctggatatcaaggcgattggtcaggctatgtgtatccagaacagccattgggttatcaagaacaatatgtgcaacaaagtacccaggaatatgatgtactggctgaccctagtatatcccaggatccaaggttcatgactcaagcagacaaggatcggggtctaggttctgttttcaaacgtgatgatcaaaggcttaatcagctgagggaaaaagatgcacgagagagagatccaaactttatttcggatagttactcagagtgttatcctggttaccaggagtataataatgagattgcagggagtgatgatgaagatgatttatcaaagatggatatgggtggacgggctaagggccgtcttcacaggtgggattttgagacggaagaggagtgggctaagtacaacgatcagaaagaaaccatgccaaaggccgcctttcaatttggggtgaaaatgcaagacggcaggaagacaaggaagcagaacaaggaccagaagctcaccaatgacctccacaagaaaaacaagatcctggctcgaaaaaagggtgagaaagatggggccgatgatggcggtcattacgatgatgatttaccaagcgcaaagaaacaacgtggct

SEQ ID NO: 2704 - DNA, 1273 bp, Zea mays
actatgtttgctacaatgcagggaagagcaatttggcaagtggtgactatggcgagtcagtaaaaccttcccaaactaatggttctactctgaaacatcaatcagatatgccaccaccaccggctccaccccctcggaacaataatttcaatgggaaggagaaacaaccagtccctgtttctagagaagatgatgatgacatttttgttggagatggagttgactatttagttcctaacaaggaaatgagtcagagccctgtctctgatatggatgaatccccacataaccatcagaagcagtccaatttcactgaaccgctgtatggcccagttccaccatctgaatctgctcaagcttggcaacaaccgaacacgtacgatgctgctgttcaagctcagatggcagctgctggatatcaaggtgactggtcaagctatgtgtatgcggaacagcagttgggttatccagaacagtatgtgcagcaaagcacccaggaatacgatgtgttagcggaccctagtatatcccaggatccgaggttcatgactcaggcggacaaggatcggggtttaggttctgttttcaaacgtgatgatcaaaggcttaatcagctgagggaaaaagatgcacgggagagagatccaaattttatttcagatagttactcagagtgttatcctgggtaccaggagtataataatgagattgcaggaagcgatgatgaagatgatttatcgaagatggatatgggtggacgggcaaagggccgtcttcacaggtgggactttgagactgaagaggagtgggccaagtacaacgaccagaaagaagccatgccaaaggctgccttccagtttggggtgaagatgcaggacggcaggaagacgaggaagcagaacaaggaccagaagctcactaatgacctccacaagatcaacaagatcctggctaggaagaagggcgagaaagatggggcggaagatggcggtcactacgacgatgatttacctagctcgaagaaacagcgtggctgaagctgtcatttttcgtttctcctgctggttatggcattctacgggagagttacgatggtgtttagctggcagctgtatcatgatgctttcatttaaggtggcatcaggacataatacatgtcaaaaactttacaaccgtggtcgatattttaacaggaacagaatgatccttggtgattttgtttgtcttgtaagacatatcgaaattgtataaaatgtcaaaaatctaaaatctt

SEQ ID NO: 2705 - DNA, 1685 bp, Hordeum vulgare
tcagggaaacaaaagaagaccgagcagtctcattccgcactgcaattgcaaagtctgtctaccagtggactgtaaagcaacaacaaagcatgataaaggcgaatgacatgtttcttcctggccggatggcatttatttacaatatggaggatggacttaacagtgatattccaacgactcttcacaggagtaaagctgattgccctgtcccagaggaaatggtcactgtcagcgtggatggctctgtacttgacaggattgccaaaatcatgtcataccttagacttggatcatcagggaaggtcttgaagaagaagaaaaaggagagggatacaaaagggaagaataatttggcaggcggtgtttacaacgagacagtaagacctgcccaaagtgatggttctgttcagaaataccactcagaaaaagatatgctaccacctccacccccacccccacgaaagagtaacttcagtgaaaaggagaaacattctgtccctgttgctagagcagatgacgatgacatattcattggagatggagttgactatgctgttcctaacaaggaaatgagccagagccccatctctgaggatatggatgaatccccacgtatccatcagaaccagtccaatttgaatgaacctgtgtatggtcctattcaaccatctgaacctgctcaagcttggcaacagccaatggatggttatgatgctattcaagcccaaatggcagctgctggataccaaggcgagtggtcaggctatcagtatgctgaacagcagctggcttatccagaacagtacatgcaacagggtactctgggatacgatgtattggttgacccaaatatatcccaggatccaaagttgatgactcaagcagacaaggataagggtctaggttctgtcttcaagcgtgatgatgacaggcttaagcagctgagggaaaaagatgcgcgggagaaagacccaaattttatttcagatagttactctgagtgttatcctggttatcagggttataatcaagagatagcagggagtgacgatgaagatgatttgtcaaagatggatatgggtggacgggcgaagggccgtcttcaccggtgggactttgagacggaagaagagtgggcgaaatacaatgatcagaaggaagccatgccaaaggcggcattccagtttggggtgaagatgcaggatggcaggaagaccaggaagcagaacaaggatcagaagctcagcaacgacctcaacaagatcaacaagatcctggcgaggaaaaagggtgataaagacggagaagggcattacgatgacgatctacccagcgggaagaaacagcgagcttgatctaactggtcatccattgttttcccgtctgtcttgttagaaccgagaaacagccatgcttttgtgagctgaaacgattagatctgtcgctcagtgctgttttatgtatgcacctgtattttcattttttatggaaatcagtcttgcatggcattcgttgtagaatatgtaaagcagatggtcccatctagtcaggtcaggcaaaagtacaagatatgccatgagaagccatgtaaaaatgtgggaaacgattataatctgctgctcttgtctttgaaaaggacgtttcgtttcaatgggatgcttttggttgctcgcattaggtccgcg

SEQ ID NO: 2706 - DNA, 2884 bp, Sorghum bicolor
cacgcttacctggttctgtggtcatcttctcgggtcagcatctcgtggagttttcacagttcacaccagtgtcatcactgattgccattttggctcttcccgtgattatctgtcctgtggccatatcgcaattgtcacgatcgatgcgacgcgactcacatcgaatcagtatcacagtaatcgtggaaccaaaaatcaacgaggagtcgtagtggaggtgaagatggctctcgtccttggtccttgttgcagcaggcggcaggcaaaccatggcattgcccccgcggtccgcagagaatcccgcgccgttccccacgcgtcaccgaggtgcgcctcgtgctcccgctcccctctccacctcgactaccaaacactgatccggtcgctgatttgctggtgctgctgtttagggtaaacaaatcccccagttgacaaacagagcgctgcagcagcggtcctggcccagcgcgagaaaactcttttgctcttggaatcttgctgccgctgccccccaatcggcgccgctttcttcctagtctctgcaaggttccgcgcatcaccatcggagacttgggatggagggcaccgcgtcttcttggagccgcgactagggaagccgcgtctccttgccgtcttcccagtctgtgtgcaggttacagccggagatcagagatcttggtgcagacaagttcttgtgcagtctttgcagatcttggtgcagacaagttctgtttgctcctccatcgattttcagggtaaatatgtcgtctcccttcttaagatggatatatatgcttgtcgtcgaagtatataatatgctgctaataccttgttccatcatcagcttttcttcccatttgtagttctgtctaggcggaattcttctgttcttgaggggaaaaaaaaggtagcgtagaggtgagatttgtgaagtgagttgtggcactaaagagcgaaaatcagaaaaatcttgtggatacaatctccaaggaatgataatggacccccgtcctcgtgataatctcaactttggtgctcgattgcccaccccaaatccacccacacctcacatgattagcttctccctccaacagccacagcctcagttcttcccgtcatatggattccacagccacaaccacaacaaccctgctatcagctcacatccatctccaccctcagtcatgcctggctgcaccacgccaagcccagcatcaacaaccacaaccgaggcagacaatgccgaggatctctccgaggctgttgctgatgatgcagtccttgcttacatcaaccagttccttcttgaagatgaggatgaggagtcctatcctgttaccagtgtgcctgtggaggattcagtactcctcgccgctgtcgagaaaccattcgtcgacatcctcaagtctgctaaccatatcacagcaaaggcctatgaagtaaaatcctggatcactgatgattgccattccacgggaagtggaagatttcatgatgtggtcacaagtactctggactccacccaattggcccctgaaatggttcaaggggatgtagttgatgctgttcataagggtcagaagaacccacgtgacaatgacttggaggtggagaggaggaagagcaaacagtccgcattgtgtgatgaggagactgtccgagagatgtttgacaaagtgctgttgtgtaccgataagaattgtgcgttccactcaccaatgccagccgatgcacaaaacagcgggggatatgtgaaaggatctggaaatagaagagggcgaaggaagggaagatccggtgctggtgcagagcaggagccagtcgatctcacaaccctacttattcattgtgctcaggccgcggctattgatgaccacagaaactcaagtgagcatctgaaacagattaggaagcattcttctgctactggagatgctggccagagattggcacactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgttgcaaatacgaccatcttaaatgctacgaagagcgtgacaaggttgcacattatagactacgggataatgtatggtttccagtggccaatcctcatgcagcggctctcaaagagatctggtgggcccccaacccttcgaatcactggtatagactttcccctgtcaggattccgccctgcagagcgtgttgaggcgacagggcgacggttacatgagtatgcccgtatgttcaatgttccgtttgaatatcaggccattgctgccaagtgggatactatccaagttaaagatctcaatataaagagcgatgagttcattgtcgttaactgcctttaccgaatgaggaacatgatggacgagacggcaacagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacaaggttggaagggtcgtgtcatatatgctctttcagcatggagtacctagacttgtaaatcctagttagcttagctgacatc

SEQ ID NO: 2707 - DNA, 2732 bp, Zea mays
gtcgctgattcgctggtgctgctgcagtttaggctaaacaaatcacccagttgacgaagagggagctgctgccgcggtcctggcccagctcgagagaagtcttttggtcttggcctcttgctgccgctgccccccaatcggcgccgctttgcttcctggtttccgcaaggttccacacatcagcatccgagacttgggatggaaggcacggcgtcttcttggagccgcgactagggtgggaaggaaagttacttgctgccgtcttcgcggtctttgcgcaggcagggtagagccggagatcagagatcttgatgcagacaagtccttcggcgtgcagggtaaatatcgcctcctttttcttcagatatatatgcttgtcggcgaagtccttcggcgttccgatcatcaacttttcttccaatttgtagttctctctaagcggaatccttgtgttcttgagagagagagagagagagagagagagagagagagagagagagagagactcagaaaggtagcgcagaggtgagatttgtaacctgtaataagtgacttgtggcgctgaagatcgaaagtcagagaaatcttgtggatacaagctccacctccaaggaatgataatggaccctcgtcctcgtgacgatcccaacctcggtgctcgattgcccaccccaaatccacccgcacctcacatgattagcttctccctccagcagccacagcttcagttcttcccttcgtatggattccacggccacagccacagctctcctgtcagctcgcatccatctccaccctcggccatgcctggctgcaccacgccaagcccggcatcgacaaccacaaccgagccagacagcgtcgaggatttttccgagactgttgctgacgacgcggtcctagcatacatcaaccagttccttcttgaagacgaggacgaggaatcctatcctattaccagcgcgcctgtggaggattcagcactcctcgccgccgtcgagaaaccattcgtcgacatcctcgagtctgccaagcctatcgcagcacagggctatgaagtaaagtcttggatcactgatgactgtgattctacaggaagcggaaggtttcgcgatgtggtcacaagtagtctgcctcgtgaaatggtgcgggagggtttagttggtgctgctcataagggtcagaagaacccgcgtgacgaggacatggagatggaggggaggaagagcaaacagtcggcactgtgtgacgaagagactgtccgggagatgtttgacaaggtgctgttgtgtaccgacaagaactgtgagttccactcaccaatgccagccgatgcacagatcagcgggggatatgtgaaaggatctagaaataagcgagggcgaaggaaggggagatcaggttctggtgcagaggaggagccagttgatctcacaaccctactcatacattgtgctcaggccgcggctatcgacgaccacaggaactcaagcgagctgctgaaacagatcaggaagcattcctctgctactggagatgctggccagagattggcacactacttcgccgatgggctggaggctcgcctagctggctctggcagcagcatctaccgttcgcttgctgcaaagagaacttccactggtgatatactgaaggcgttcagtttgtatgtcaaagcatgtccgtttaggatactatcacactatgtcgcaaacacgaccatcttaaacgctacgaagagcgccacaaggctgcacatcatagactacgggataatgtatggtttccagtggccagtcctcatgcagcggctctcaaagagacctggtggccccccgtaccttcggatcactggtatagactttcccctgtcaggattccgccctgcagagcgtgttgaggcgacagggcggcggttgcatgagtatgcccgtatgttcaatgtcccatttgaataccaagccattgctgccaagtgggatactatccaagttaaagatctcaacatgaagagcgatgagttcgtcgtcgttaactgcctctaccggatgaggaacatgatggacgagacggtgacggatgacagcccgagaacgcgggttttgaacacaatcagaaagctgaatccccatctgttcgttcatgggatcgtcaatggtacttacaatgcacccttcttcgtgacgcggtttaaggaggctatgttcttcttctcttcgatctttgatatgctcgaagcgaatgccttacggatggatgagcataggctgctgatagagagagagttctttggccgggaagctgtcaatgtgattgcctgtgagggcacagagaggattgaaaggccagagacctacaaacaatggcagatgagaaacctcagggcaggcttccggcagttagctctggacagggagataatgaagagagcaaggtacaaggtaagcaagagctatcagggggatttcctcgtggacgaagataacaagtggatgctacaaggttggaagggtcgtatcatatatgcactttcagcatggactagctagacttgtaaatattagtgagctactgagctgcttagctgacctcttccattaatttcttgattaatcaccatttcattttgctgtattatgtttacgttgttgaatctagccctcttttagaaaccaaagttttgtatgtttgaattggctgcaataatagaatcttgtccgtgtctgcct

SEQ ID NO: 2708 - DNA, 2638 bp, Setaria italica
cccaaccagagctcttgttcttggactcttgctgccgctgccccgaatcaccactgctttcttcctccaaggttacacgcatcagcgccagcatcccaggcttaggatggagagcaacgcgtctccttggagccgcaactaagcaagtaagcaacgcttgccagtctttcctagtagcgtagatcacagatcttgccagacagttgcccgtccatgttcttcaatcgctttgtagggtaaatctcatcttctttcgcttttcaaattacttctcggcaaaaacgtgggatgccaatactttgttccatcatcagctttcttgccatttgtagttctctaagcggaatcgttgtgttctagagggaaaaagagagttacagtagatgtgggattgagattcatgaacctataagtgactgcgacacggataggctttcttgtggatagaagcttcaaggaattatgatggaccctggttctcgtgataatcttgattttggtgatcagttgtccaccccaaatccgcccacccctcacatgattaatttctccctccaacaacaatcacaagttcaatatttcccttcatatggattccacagccacaaccctcccgtgagttctcatccatcgccaccctgggtcatgcttggctgcaccacaccgagtccggcatcaacaaccacaacagagctggacagcgccgatgatgccgatgatgcggtccttgcatacatcaatcaattccttctcgaagatgaggatgacgaatcctaccctgttagcagtgcatctgtggaggattcagccctcctcgccgtcgagaaaccctttgttgacattcttaagtctgctaagcctatcatggcacaggcctatgaaatgaaatcttggatgactgacgattgtgagtccactggaagcagaggatttcatgatgtggtcacaagtaatcagaactcttcccaattacctagtcagatggtggtggagtgttcagttggtgccactcataaaggtaggaagacgaagaacccacacgatgatgatctggagatggaggagaggaagagcaaacaattggcattgtgcgatgaggagactgtccgagagatgtttgacaaagtccttttgtgtactgatgcaaattgcgagttccactcaccaatgccagctgaagcacaaatcaatggcagatatgtgaaaggatcgggaaatagaagaggccgaaggaagggaagatctggtactagtccagaagaggaggcggtcgatctcacaaccctacttatacactgtgctcaggccgcagctattgatgatcaccgaaacgcaaatgagttgttaaaacagattaggaagcattcttctgctactggagatgctggccagagattggcacactacttcgctaatggtctcgaggctcgcctagctggcactggtagcagcatctaccgttcacttacttcaaagagaacttctactggtgaaatgctgagagcattcggtttatatgttaaggcatgctcatttaggttaatatcgcactacgttgcaaatacgaccatcttgaatgcttctaagagtgaagcaaggttgcacattattgactatggggtacagtatggttttcagtggccagtcctcatgcagcgtctctcaaagagatgtggtgggcccccaagccttcggatcactggtatcgattttcccctaccaggattccgccctgcagagcgtatagaggcgacagggcgacggttacatgagtatgcccgtatgttcaacattcccttcgaatatcaagctattgcttccaagtgggataccatccaagttgaagatctcaagataaaaagcgatgagtatcttgtcgtcaactgcctttaccgaatgaggaacatgatggacgagacagtaacagatgacagccccagaacaagggttttgaacacaatcagaaagttgaatccccatttgttcgttcatgggattgtcaatggtacttacaatgcacccttcttcgtgacacggttcaaggaggctatgttttttttctcttcaatcttcgatatgcttgaagcaaatgcctcacggatggatgaacataggctgctgatagaaagtgaattctttggacgggaagctcttaatgtgattgcctgtgagggcacagagaggattgaaaggccagagacctacaaacagtggcagatgaggaacctcagggcaggttttaggcagctacgcctgaacgaagagataatgaagagagcaagatacaaggtgagcaagagctaccacagggatttccttgttgacgaagataacaagtggatgctacaaggttggaagggccgtatcatatttgctctttcagcatggactagctagacctgtaaatattagtgggctcagctgacattttctatgaatttattattttttttcgtcatttcattttgttgtatgatgtttatgtccatgaattctggccgttctcctgaagccaaaattttgaaattttaattgcctgcaataaaagatgcttgttggtgtctgcataatctgtgcaatgaagtaacaggtttttgctgtagcttactttgttcctcctatcatataatagaagaca

SEQ ID NO: 2709 - DNA, 1900 bp, Pennisetum glaucum
ttgcggaaagaagcttcaaggcatgatgatggaccctgcttctcgtgataatattgatttaggtgaccagttgtccgccccaaatccgccgaccctgattaatttctccctccaacgacagtcacaagttcaatatttcccgcaatatggattccacagccacaaccctccttcccatccatcaccaccctgggtcatgcttggttgctccacaccgagtccagcatcaacaaccacaacagaggtggacagcgctgaggaattgtctgagactgctgccgatgatgcggtccttgcatatatcaatcagtttcttcttgaagatgaggatgacgaatcctatcctgttagcagtgcatctgtggaggattcagccctcctcgctgttgagaaaccctttgttgacattcttaagtctgctaagcctatcacggcacaagcctacgaagtgaaatcttggatgactgacgattgtgagtccactggaagtggaggatttcgtgatgttgtcataagtaatcagaactcttcccaattactgagtcagatggtggtggaatgttcagttggtgccgctcataaaggtcggaagaacccacctgatgatggtctggagatggaggagaggaaaagcaaacaatcggcattgtgcgatgaggagactgtcagagagatgtttgacaaagtccttttgtgtactgatgcaaattgtgagttcagctcaccagtgccagctgaagcacaaatcaatggcagatatgtgaaaggatcgggcaataaaagaggcagaaggaagggaagatctggtactaatccagaagaggaggcagtcgatctcacaaccctactcatgcactgtgcccaggccgcagctattgatgatcaccggaacgcgaatgaattgctgaaacagattcggaagcattcttcttctactggagatgctggtcagagattggcgcactacttcgctaatgggcttgaggctcgcctagctggcactggtagcagcatctaccgttcacttacttcaaagagaacttctgctggtgaaatgttgagagcattcggcttatatgttaaggcatgctcatttaggttgatatcgcactacgttgcaaatgcgaccatcttgaatgcttctaatagttcagcaaggttgcatattattgactacgggatactgtacggttttcaatggccagtcctcatgcagtatctctcgaagagatgtggtggccccccaagccttagaatcactggtattgatttccccctaccaggattccgacctgcagagcgtgtagaggcaacagggcgacggttacatgagtatgcccgtatgttcaacattcccttcgaatatcaagctattgctgcgaagtgggataccatccaagttgaagatctcaagataaaaagcgatgagtatctcgtcatcaactgccttcaccgaatgaggaacatgatggacgagacagtaacggatgatagccccagaacaagggttttgaacacaatcagaaagttgaatccccatttgtttgttcatggtattgtcaatggtacttataatgcacccttcttcgtgacacggttcaaggaggctatgttttttttctcttcaatcttcgatatgcttgaagcaaatgcctcgcggatggatgaacataggctactgatagaaagtgaattctttggacgggaagctcttaatgtgattgcctgtgagggcacagagaggattgaaaggccggagacctacaaacagtggcaaatgaggcacctcagggcaggctttaggcagctacgcctgaatgaagagataatgaagagagcaagatacaaggtgagcaagaggtaccacagggatttcctggttgacgaagacaataagtgg

SEQ ID NO: 2710 - DNA, 2437 bp, Setaria italica
catttctcttcatcgccttctttctccattgtggttacaaacgcgcattctctttgaggtcttgttgcttacagtggtttgatttgcgttttgcagtcagttcacagttcttgactggttctcgagctgcgccgagcaatggaggtggcggctctggagaagaagggacacagagcttttgccaagcctctgaagtctttcagttcttcagagcacaagcgatccaagaggttagtgtctgcagccttctgcaatttttttttcttctcttgtgattctgccggcaaggatgctcaaattgtgattaagcggtttctgaatggcagttattttgaggatatgtatgctgcagatgctttgcgctcttcagataaaaccatcgttctgcctaagccggaagttgtaaaagctaaggtgaaaagcgacatcaataaggatgtgcaacctgggaggggagcacaaagcaccttgagaaaagagattctgcaactagaaaagcacctcaaggatcagcaggttgtgcgtggtgccctggaaaaagctttagggcccgacgctgctccagtcaacttgtcacctgagaatccaatgccaaaagctgctaatgaattgatacgagagattgccacattggagcttgaggtcaagaacatggagcagtatctcctgacgttgtatcggaaagcgtttgagcagcaagcacctacattttctcctcctgatcaccaggatgcttcaaagccgtcagtgagctcacggtctgggcagctccgggaaatgccgatggcaatgaagtcttgcaagagtagaggggatgcagcactccggtccagctatccgccaccacataagaagtggaatgatccattgacagattgctgcacatcggttcgtcctgatagagcagttgattcggatgtcctccgctgccagtctgcgttatcgtaccgtggagtttgttcgtccaggatattgccttcagaggatgatagtcttgcaagggctcttcgttcgtgccactcacaacctttttcattcctagaggaaggagagaccggtgcatcaggaatgataagcttagcagagtatctaggaactaatgtagctgaccacatccctgaaactccgaacaacctgtcagaagagatggtgagatgcatggcagggatctactgcagacttgcagatcctccgttggttcaccatggctcctcgtcttcgccaacatcgtcattctcctcagcaagtgcaatatctccacagtatgtgggggacatgtggagtcccaattacaagagagaaaatactcttgactctcggttgataaacccattccatgttgagggtttgaaggagttcagtggaccgtacaacacaatggttgaggttcctatgattagccgcgacagtcggaggctgaaagaagctgaggacctactccagacgtacaagctgatattgtaccggttggaaactgttgatctgaggagaatgacaaatgaagaaaagatagcattctgggtcaacatacacaatgctttgctgatgcacgcttatctgaagaatggcgtcccacagaacaatctgaagaagacatccctacttgctaaggctgcctgcaaaatcgccggacgaaacatcaacgtagccgttatccagagcatggtccttggatgcaatacgcactgtcccggacagtggctacggacattgctttaccccaggatcaaaagcaaagtgagcaaagccgggcacgagtggcgagcctttgccgttgcacaatcagagcctcttttacgctttgcgctttgttcggggagccattctgatcccgcggtgagggtgtacactccgaagcggctgttccaccagctggaggcggcgaaggaggagttcatccgggcgacggccggcgtgtggagggagcagaagctgctgctcccgaagctggtggaggcgtacgccaaggacgtgaagctctcgccgcaggggctcgtggacatggtccagcgctacctcccggagagcatgaggatggccgtgcagaggtgccagcagggcggcaggtcgtcgagcaaggtggtggagtgggtgccctacaacccggccttccggtacctgctcgccagggaccttgcgttccctcacctcagctgaccgtgtgtgtctctgcaagactgcaacagtagcagtcggcttggtgatgaactgaagtttggttggagttggagtagagtatatgcgtgtaccatagggtttaaagagagttaggcaaggctttgtgcagattttgtgtcgtgtgggttgtaggatgagacgatcagtggcgccggcgtgtggcgtgtttccaattgtccgctgtaaaaaagggaaaaggttattttgtagatgaacaggagacaggatggaatgggaaagcaacatgttagtagtggtt

SEQ ID NO: 2711 - DNA, 1490 bp, Panicum virgatum
acctcgctcgtcttaattttatttttcttttttaaaaaaagaatgacaagatctaaggccattgttgacattttcactgcccgccggctaccatgatttcgttcagcgggcaggggcagtacgacatgcatcgccgtcgccggccataattttgacggtccacggcgcatgacaaaactgttgaccgttgctggacacccagctcgttacaccaaccagcgtcacgacgtacctgctgccactttatttgacgcaacagatccttcggcccattaaactcgatctgcagcccaggacatgttcaggctcggctgaaaagtgcctttcaggatgatcacagccagctgctgttcttgcggctcagcagcagctagcagtgccagtcacctctataattgcatttgggggcgtggtatttgccgtgtacgtgtgttggttaggccgccagtcaggatgagaaaggcaaggaggacaggagctactagcagcagcacaaaaggtgctctccctctcctgcctactaggcttaactttgctgtccggttggtgacgcgcatggaccacgagaggtaggttggtgcgacgctcctccccacgcacgaccgctcgtctcggcaagattgccgtgcagcacagcaactcacgtacgaaaaacacacggaaatctcacgggatcacgaccaggttaaaaaaaaccccggaaaaccgagcgccaggcccgttcgccatatgggccatctacatctagccaaaccccccaaaagctgcaagaaaaaaaagaccggcccagtttcgggcgggagagagatctctctccttccacgagagcgccaccgccgtctcgccaagcccaccacggttgtagggtttattggcatctctctccgctcctgccgtgccccgccaccacagagcagaacaccgcacccgccgccgaaatggccgccgccgccgccgccgccgccgccgcgagatccttcctccgatccagcccccccctcgtcgctccgcagtgcggcggccagagccgcctcgcgtgcggggccggctccgctgccgaggcggatgcccacctctgccccccgcgtcctcctaaggtcgccggtggagatgagcagcgtgtgtctggagtccctgatgcccatgcacagcgccacggcttcggcgctcatgacgtcgcttctcgccgccccggcttgcaagggattcggttggctcttggaagatggatgatttgtcattattggggctctgcagtgatgctagctggtgaggattatggactaccacctcatgaatttaaagtacctgtttggcgtctcagttaccatgcgctctgtcctctgggattccagtttgtataagattttacagaattattcttgagattcattggtgggtatccaatagatttttggtcttgacgacctgcttgattaacagatctggaatgaataaatttgacagggagtttctgcagatttttgtgg

SEQ ID NO: 2712 - DNA, 3491 bp, Zea mays
atgtgctaccccctctcccagaagctacgcaccaattcaattcccgagaaagtgattggggttttacatcttttatgcctttgttggatctgtatgattcaagtaaaggatatgttgtgaatgataaatgtatcatagaagctgaggttgctgtgcgtaaaactcttgatttctggaactatgactccaaaaggatgactggttatgttggcctgaagaatcaaggggctacctgttacatgaactcccttcttcagactttataccacattccttactttcggaaggctgtatatcatatgcctactacagagaatgatacgccttcagggaacattccattggctttgcaaagccttttttataaacttcagcatagtgataacagtgttgctacaaaagagctcaccaaatcttttggatgggatagctatgattcgttcatgcagcatgatgttcaagaattgaatagggtcctatgtgaaaagctggagaacaagatgaagggaaccactgtggaaggagcaatacaaaaattgttcgagggtcaccatatgaattatatcgagtgtattaatgttgagtctaaatctaccaggaaagagtcattctatgatcttgcactcgatgtcaagggatgttctgatgtctatgcatcatttgataagtatgttgcagtggagaggttagaaggtgataataagtatcaatctgaggaacatggtctacaggatgccaagaaaggaatgctttttattgactttcctccagttctgcaacttcagttaaaacggtttgaatatgattttgtgcgggatacgatgctcaagataaatgaccgttatgagttcccacttcaattggatcttgatagagatgatggaaaatatctttctccagacgcggatagaagtgtgcgtaacctatatactcttcatagtgtactggttcatagtggtggagttcatggaggacactattatgcctttattcgtccgaagctgtctgatcaatggtacaagttcgaggatgaacgagtgacgaaagaagacatgaaacgagcattggaggaacaatatggtggtgaagaagagctcccgcataccaaccctgggttggatactgcaccgcttagatttaccaagcattcaaatgcttacatgcttgtttacattcgagaaagtgacaaagataacattatctgtgatttggatgatgaagatatttcagaacaccttaaggttaggttgagaaaggaacatgaagagaaggagtacaagaaaaaggagaaggctgaggctcatatgttcactgcattgaaggtggcccgagactttgatattaaagagcaaattggaagacacatgcactttgatcttgtggactttgacagagttaatagcttccgtgcacctaagaacatgtcaatcaacgaagtcaaggaggagctttctaaagaatttggcatccctgtagaatgccaacgattttgggtatgggcaaaacgacagaactgtacctacagacccagtcgtccattaacctcccaggaggaaacatctactattggggttctcaaagatgcaacagtggcgaagttaccgaattctgaagtacgattgttcttggaggttcatttcagacaggagaaccaaccaattgctccttggaataccaaagaagatatattacttttcttcaagctctatgatcctgaaaaagaagacctaagatatgtcggcaatttttttgtgaaagcatcaggcaaaccatctgatatagtagaaaggctgaatcagattgctggatttctgtctgatgaagatattgagctctatgaggaaataaagtttgaaccagttgtgatgtgcgtacccattgagagtaatgcttcgttccgttcaagccagattgacaatggtgatataatatgctaccaaaagcactgtttgccagattcaatggatcgatatcgatatcctaccgtcccttctttctttgaatatattcataatagacagattgtccatttcagattgcttgagaaaccaaaagaagaaggcttctctcttgagctttcaaaatgctccacatatgatgatgttgttgagaaggttgctaagcaactacgtatggatgacccttctaaaatccggcttactcaacacaatccatcgtctcagcaacccaaacctcacttcatcaaatacaggagtcttaattatctttcggacatgctacataatcacaatcagatgtgtgacatattatattatgacatcctggatattcctttgcctgaactagaatctatgagatctctgaaggtcgctttccaaaatgccgcaaaccatgagatgtcgtttcacattatgcggttaccaaaaagtaactctctccttgatttgattgaagacttaaagtcaaaggttgaaatttcttgtaatgatgctgaatttcggttttttggagtctaccttcacaagatatgcaaggtgtatcaacctggagataagatagattcagttaatgaccatggacccttgtatattgaagaggttcccgaggatgaaaaaaatgccgggcctcatgaccgtttggttcatgtctatcattttgaatataatcatcatattcagtattttggtgaacctttcttcttcctaattcgtgatggtgaagctttgtcggatatgaaagtacggattcagaagagacttcaagttcctgatgagcagtttctaaagtggaaatttgctcatgttacattcagtaagccagaatacctccaagattcagatattgtaatgaacagattccataaacagagacctgtttatggaggttgggaacaacaccttggattggagcatacagccaccaccccaaaaaggtcctacttaggcaacaaccagaaccgccattcttttgagaagcctgtgaggatttacaactaaagctaggaatactttttacatgcgatgaatgatgaacaggatatgaagcagtcttgttccaaaagcagtcttttggtgatgtacatggagcttttgcatagagtagtttatgtggcaattatctcaagaattttcatctggtggatgtacagggtccgtatagcaacatttccttgtagaaagttgaagctgtatatcgagggtggatttacatgtgttaatcttttcgaccccaagcctctgggaggctgtgaaccatagcctcatgaaatatgcctgttgttcattcagtgtttgtgtttttctcgtttgtcattattgtgcactcgcttttaatatgctcggtctattggaccgagcaggaaaatgatgttttaccttatagtggtctaactggttcattaggcgcgcaagtgcacagttgaattactcctttggaagcttgaaacgagaaacataggaaatgtctatgacggtggacatgccaagaccccaagtcctcggtttcaaggcctcccaccgctggctttctag

SEQ ID NO: 2713 - DNA, 2076 bp, Setaria italica
cccttccttcttccccaccgccacacacggcctcctcatcatctccagcaactcctccggcagccgccgttccccgtggcacatgtcaggtggcctcgtccttcacgccaggctgggcgatggcgatggcgacggggacggcggcgagctcgttccgtcgcgacgacacgcgtaagccgcacgtaacattctgctcatgtgcaagatagcccgcgtggccgccgcgctgatccgcgtcctgtacctcgtcgcggtggccgccccggttaaaagcctcctcgccgtcgccaaggtcgccttctcgctggtgaacgcgccgtgcctccggtacatgaaccaggcagcgctcgggcggagctgcacgggcaccttctgcggcgacctgctggtcggggccatggcgcactcgtggaggatgctcgtgcagggcctcacgtcgctgatgttcttctgcgcccacgccgatgagtacgtccggccgccgccgagcccgctcgtgctgatggcgcacgacaagccggcgtcccatcctcagcaggtacacatctcagttgtagggccgaaccacatgcgtatctcatgggtcaccgacgaccggaacgcgccgtccgtggtggagtacgggacatccccgggcaagtacacggcgtcggcgacgggcaaccacaccacgtaccactacttcttctacaagtccggcgccatccaccacgtcaccatcggcccgctggagcccgtcacgacgtactactaccggtgcggcagggccggcgacgagttcagcttccggactccgccggccactctgcccatcgagttcgtcgtcatcggtgacctcggtcagacggggtggacggcgtcgacgctgtcgcacatcggcggcggcgactacgacatgctcctgctccccggcgacctctcgtacgcggacacgcagcagccgctgtgggactcgttcgggcgcttggtgcagccgctggcgagcgcgcggccgtggatggtgacggagggcaaccacgagatggagaccctccccgtcgtggagttcgcgccgttcgccgcctacaacgcgcgttggcggatgccgcacgaggagagcggctcgcgctccaacctctactactccttcgacgcggcgggcggcgccgcgcacgtcgtgatgctggggtcctacgcggcgttcggcgaggggtcggagcagcaccggtggctggaggccgacctggcgcgcgtcgaccggcggcgcacgccgtggctgctggtcctgctccacgcgccgtggtacaacacgaaccaggcgcaccagggggagggagagaggatgcggctggccatggagcggatgctctacgaggcccgcgtcgacgtcgtcttcgctgggcacgtccatgcctacgagcgcttcacgaggatctacgacaatgaggccgacagccggggcccgatgtacatcaccattggcgacggaggcaacagggaaggccttgctctcaggttcatcgaggaccacaagtcggcgcacctgtcggtgttccgggaggcgagttttgggcacggccggctgaggatcgtcaacgagacgagcgccgtctggacgtggcaccgcaacgacgacgagtacgccaccgtccgcgacgaggtctggctcgagagcctggccgctgcaaaaccgagcctagcaacaaccaccgccggtcgtcacacagatgagctgtaggaggaagcatcaaggaagaagggattcatcgcatcgctacaccattgatggttcttgtgccacacgccatgtaattttcaaggatacatcgcccagcacataacatgtatattgctcggacctcgtctggcgatatgcttcaaatttggagggtcacgagttgcccaattcaagattcagtagaaacgcgcacaactgatattgaaatgttcaacaaggttgactttgacaagcaagatattttgtatattgacaccttcaaggatgatgctttgtccattgggcataactattcgtgctgtctgcccaaccatgtttatttgaccgatgatgatgatgaatattcgctgatggatgat

SEQ ID NO: 2714 - DNA, 1877 bp, Panicum virgatum
gaaatcatgcgtgtttctacacgcgtagcaggtggaggtggtctcgtcctccacgccaggctgggcgatggcgccggagccggcggcgagctcaccccgtcggcgtcgcgacgacacgcgtaagccgcacatcacattcctcatccgcacgctactgctcgcgtgcaagatagcccgcggggccgccgcgctgatccgcgtcctctgcctcgccgcggtggccgcccccgccaaaagcctcctcgccgccgccacggccgccttcgcgctcgtgaacgcgccgtgcgtccggtacatgaaccaggccgcgctcgggcggagcttcacgggcaccttctgcggcgacctggtggccggggccatggcgcactcctggaggctgctcgtgcagggcctcacgtcgctcatgtttctctgtgcccgcgccgatgagtacgtccggccgccgcccagcccgctggtgctcatggcgcacgacaagccggcgtcccatccccagcaggtacacatctccgtcgtcggcgcgaagaagatgtgcatctcatgggtcaccgacgaccggagcgcgccgtccgtggtcgagtacggcagatccccgggcaagtacacggcgtccgcggcgggcgaccacaccacgtaccattacttcttctacaagtccggcgcgatccaccacgccaccatcggcccgctggagcccggcacgacgtactactaccggtgcggcaaggccggcgacgagctcagcctccggacgccgccggccaccctgcccatcgagttcgtggtcatcggcgacctgggccagacggggtggacggcgtcgacgctgtcgcacatcggcggcggggactacgacatgctcctgctccccggcgacctgtcgtacgcggacacgcagcagccgctgtgggactcgttcgggcggctggtgcagccgctggcgagcgcgcggccgtggatggtgacggcgggcaaccacgagatggaggcgctgcccgtggtggagctcgcgccgttcgcggcctacaacgcgcggtggcggatgccgcacgaggagagcggctcgcgctccaacctctactactcgttcgacgcggcgggcggcgcggcgcacgtcgtgatgctggggtcgtacgcggcgttcggcgaggggtcggagcagcgccggtggctggaggcggacctggcgcgcgtcgaccggcggcgcacgccgtggctgctggtgctgctgcacgcgccgtggtacaacaccaaccaggcgcaccagggggagggcgagaagatgcgcctcgccatggagcggatgctctacgaggctcgcgtcgacgtcgtcttcgccgggcacgtccatgcctacgagcgctttacgaggatctacgacaatgaggccgacagccggggcccgatgtacatcaccattggcgacggcggcaacagggaaggccttgctctcaggttcatcgcggaccacaggtcggcgcacctgtcggtgttccgggaggcgagcttcgggcacggccggctgaggatcgtcaacgagacgagcgccgtctggacatggcaccgcaacgacgacgagtacgccaccgtccgcgacgaggtgtggatcgagagcttggccgccggaaaacaaagcatagcaagaaccgccggtcgtcacactgatgagctctaggaaacattattttttgtgtgaaaggtagctaacgctgtaacatggcaatgctatgacgttttcttagtgaaatgggggtgggaattttatacatccaaaatgccctgatgtttagcgttacgatagaaatgggggcataataaaatcactgtcggtaccccaagactggggtaccccgtcttgctgtgtccaggcaagg

SEQ ID NO: 2715 - DNA, 2136 bp, Saccharum officinarum
gattttccatacgataaattggatatatctgatgaagttagagagcaggttgagttagtgcatgtacagctcaaaagagccaaagaacgggtcgacatgcctgatgatgagttctacaatgaattactttcgctgtataacaagagccatgacccaagtgctgaattggatatccttggaagattgtcaaaaaagttacacctgatgaccatcactgatctcacacaagaatcccttgctttgcatgagatggtggcatctggtggaggtaacgatcctggagaacacgttgaaaagatgtcaatgctattgaagaagatcaaggactttgtgcaaactcagaaccctgaaatgggcccgccagtgactaccaagctaatggattccaacgggcagccaagacctgtaaacattcctgatgagttccgctgtccaatttctcttgagctgatgaaagaccccgttattgttgctactggccagacatatgagcggacattcatcgagaaatggctagcttctgggcatcatacttgtccaaatactcaacagaggatgccaaacacaacactgacaccaaactatgttcttagaagtcttattgcgcagtggtgcgaggccaacgggattgatccaccgaagcgctcaacgcagcctgacaaacccacatcttcatgctctccgagtgaacgtgctatcatcgatgctcttctcttcaagttatgctctgcagatcctgaggaacagagatcatctgctgcagagctccggctcctagcaaagcggaatgcaaataatcggatctgcattgctgaggctggtgccatccccttactattgagtctcctgtcgtcatctgatctgcagactcaggaacatgctgtgactgcacttctgaacctctctatacatgaggataacaagtctagcatcatattatctggtgctgtcccgggcatagttcatgttctgaagaatggaagcatgcaggcacgggagaatgctgcagccacccttttcagcctgtcggtggttgatgaatacaaagtaacaattgggggaacaggagctatccctgcccttgtagttttgctaagtgagggcagcccacgtgggatgaaggatgcggcagctgctctattcaacttgtgtatttaccaagggaacaagggccgtgctatacgagctggccttgtgccactcatcatggggctcgtgacaaaccccactggtgctctgttggatgaggctatggcgatactctcaatactgtccagccatcctgagggtaaggctgcgatcggggcagcagagcctgttcccgtgcttgtggagatgattggaagtgggtcaccgaggaatagggagaatgctgcagctgtgatgttgcacctgtctgtgcataacgtgcatttagctcgggcacaggagtgcggcatcatggttccgctacgggaactggccctgaatggcacagagagggggaaaagaaaggcggtgcagctccttgagcgaatgagcagattcctggttatgcaacatgaggatattgcttcccaacagttggacgagatcgagcgtcagcttgttgccttaggacctaatgttacagaggctgatcttgaccaactgggacttctttaacctccatatcctacggttgcatgatgatgatgaatctatctttgccacaatactactaaaagggtttgtttttggataagtactaccaaaaggatgagcaagctgtatccgagtcactttgcttccggatccatgatttatgctgaacgagagttcttgtatggcaacgttctatcggtactgaaatctgtgatgatccgtctggcttggcttcttccatgcttgtgtgctgaagcccccatcgctccatctgtttctgggtatgtaaggtagcccagaatgttgagatgtgtacagtctacttagtatgccgctccaaatgtcatgtatggctatgttttgactagaatatgtacattttcactatggtactagataaatgagaagttctagcggcggacttaaatcagtaaatcttatttcatgctactgtatgttggcgtgagtttcagatttcagaatttttattatggtgacgcgtatgcatttgtg

SEQ ID NO: 2716 - DNA, 2048 bp, Zea mays
ctcgaggtgaacatgtcaaagaattccagggtaggtgtaggtcttactttcttgtttatatgagatacacacgtggactgattcctcctgttgttctggtccttgatagggatgaagtaatgaagaagttccatgaatcaattgctcagctggagcaagccctgtgcgattttccatatgataaactggatatatctgatgaagctagagagcaggttgagttagtgcatgcacagctcaaaagagccaaagagcgggtcgacatgcccgatgacgagttctacaacgaattatgttcgctgtataacaagagccacgacccaagtgctgagttggatatccttgggagattgtcggagaagttacacctgacgaccatcgctgatctcacgcaagaatcacttgctttgcacgagatggtggcatctggtggtggcaacgatcctggagaacacattgagaaaatgtcgatgctgctgaagaagatcaaggactttgtgcagactcagaaccctgaaacgggcccgctggtgactgccaagccaatgggttccaacgggaagccaagacctgtaaacgttcctgacgagttccggtgcccaatctctcttgagctgatgaaagacccggttatcgttgctactggccagacatacgagcgggcattgatcgagaaatggctagcttccgggcaccatacctgtccaagcactcaacaaaggatgccaaacacgacgctgacaccgaactatgttctcagaagccttatcacgcagtggtgtgaggccaacgggatcgatccaccgaagcgcccgacgcagcagcctgacagacctacatcttcatgctcttcgagcgagcgcgccagcatcgacgctctcctctccaagctatgctccgcagatcccgaggaacagagatcggctgccgcagagctccggctcctagcgaagcggaacgcgaacaaccggatctgcatcgccgaggccggtgccatccccttgctactgagcctcctgtcttcgtctgacctgcagacgcaggagcacgccgtgacggcgcttctgaacctctccatacacgaggacaacaaggcgagcatcatactgtccggcgctgtcccgggcatagttcatgtcctcaagaacggaagcatggaggcacgggagaacgctgcggccacactcttcagcctatcggtggtggacgaatacaaggtcacgatcgggggcacaggagccatccctgccctcgtggtcttgctgagcgagggcaggcagcgcgggaagaaggacgcggcggctgccctattcaacctgtgcatctaccaggggaacaagggccgcgccatacgggctggcctcgtgccactcgtcatggggctcgtgacgaaccccaccggagctctgctggacgaggccatggcgatcctgtcgatactgtccagccaccccgagggcaaggccgcgatcggggcggcggagcccgtccccgtcctcgtggagatgatcgcgggtgggtcgccgaggaacagggagaacgctgccgccgtgatgctgcacctgtccgccagcgtgcggcagtccgcgcatctggctcgggcgcaggagtgcggcatcatggccccgctgcgggagctggcactgaatggcacggggagggggaagaggaaggccgtgcagctgctcgagcggatgagcaggttcctggtccagcagcaggaggacgcggtggatccacgtgtgcaggagctggaggagatcgagcgccagcttgccgcctttggacctggcgttacggaggctgatgtccttcaacagttgggagctctttaacctatggtacatttttcactatgatactactatacttatatagaaaagttctagcggcggactttattatcagtaaaatctcagttctagctactgaatgttagcgtgggtttcggatttcaagatttttatggccatgcgtgtatatgcatttgcgattttgacattgtcagtaggtggtatcgtagtctacggcagtgccagttgcaacga

SEQ ID NO: 2717 - DNA, 2428 bp, Panicum virgatum
atgtatgctttgcaggtccttgagagggataatgtactgaagaagtttcaaggagtaattgctcagctagagcaagctttgtgtgattttccatacgataaattggatatatcagatgaagttagagagcaggttgagttagtgcatgcacagctcagaagagcaaaagaacgggcagacatgcctgatgatgagttctacaatgacgtactgtctctgtataacaagagctatgacccaagtgctgaactggatatccttgaaagattgtcagaaaagttacacctgatgaccatcactgatctcacacacgaatcgcttgctttgcatgagatggtggcatctggtggtggtcaggatccaggagaacacattgagaaaatgtcaatgctgttgaagaagatcaaggactttgtgcaaactcaaaaccctgagatggggccgccaataggtaccaagctaatggattccaacggggagccaaggcctgtaaacattcctgatgagttccggtgtccaatttctcttgagctaatgaaagatcctgttattgttgctactggccagacatatgagcgggcatgcatcgagaagtggctagcttctgggcaccatacttgtccaaatactcagcagaggatgacaaacacaacactgacaccgaactatgttcttagaagtcttattgcccagtggtgcgaggccaacgggattgagccacccaaacgttcatcgcaacctaacaagcctacatcagcatgctcttcgagcgaacgtgctaacatcgatgctcttctgtcccaattatgctctcatgatcctgaggagcagaggtcagctgctgcagaactccggctcctagcaaagcggaatgcaaacaacaggatttgcattgctgaggctggtgccattcccttactactgagtctcttatcttcatctgacctgcggactcaagaacatgctgtgactgcacttctgaacctctccatacacgaggataataaggcaagcatcatttcctcaggtgctgtgccgagcatagttcatgttctgaagaatggcagcatgcaagcacgggagaatgctgcagctacacttttcagcctctcagtgatcgatgaatacaaagtaacaattgggggaacaggggctatccctgcccttgtagttcttttaagtgagggcagccaacggggaaagaaagacgcagcagcagctctattcaacctttgcatttatcaagggaacaagggtcgtgcaatacgagctggccttgtgccgctcatcatggggctggtgacaaaccccacaggagctcttatggacgaggctatggcaatactctcgatattgtcgagccaccctgaggggaaggcggctattggtgcagcggagccagttcctgttcttgtggagatgattggaagcgggtcaccaaggaatagagagaatgctgcagctgtgatgttacatctttgcagtggtgagcaacaacttgtgcatttggcccgtgcacaagagtgcagaatcatggtcccgctacgggagctggccctgaatggcacggagaggggaaagagaaaggcggtgctgctgcttgagcgaatgagcagattcctggttcagcaacaagaggaaaaggaagcccagctgctggcatccgcacaggccattcctcggatcgcagaacaggtccaagagaccgacatccctgaacagttggatagtccttcacctcaatatcccatggtcgcatgatgtcgatgaatatatttgcaacaatactgacaaaaggtgggccaagcagtatctgagtcacttggcttctggatccatgattcatatactgaacgagagttttttaagctgtcagagtcacttttaattggtgattatcccagacgcttcttcccatgcttggtcgctgaagctcccatcgcgccacctgtttctgggtatgtaaattagcccagaatgttaagatgtgtacagtctagtaaagatgttgctccaaatgtcatgtagcttattactatgtacattttcactatgatactatataaaagagaaattatatcggcggacataatcagtaaatcttgttgctgtgctactgcatgttgccgtgagtttcaagtttcagaacttttatggtgacccctatgcattgtaattctactggtaggatatggcattataatctattccctgtcttgaaatataaagcatccaacattcttggagagtcaaagtttttagagagaatatcataaaaattcttggagaatctaatgatacatatttgatatcataaatattattactttattatataaatttgatcaaacttgaaaaactttgactctccaagaatgttagaatgtcttatatttcaggacggagggagtatacatcagtgctagtt

SEQ ID NO: 2718 - DNA, 2224 bp, Pennisetum glaucum
ccgggaggcgcgcgcggggtgggggggcgcccccgcggagggagaccaggagcgggtgctggcgccgctcgccgacgcgctggagacggcgctcgacctgctccagctcggccgcgacgggagcaggatcttcctggtcctggagagggataatataatgaagaagtttcaaggagtaattgctcagttggagcaagctttgtgcaattttccatacgataaattggatatatctgatgaagttagagagcaggttgagttagtgcatgcccagctcagaagagcaaaagagcgcacagacatgcccgatgatgagttctacaatgatgtgctgtctctgtataacaagaactatgacccaagtgctgaactggacatccttgaaagattgtcagaaaagttgcacctgatgaccatcactgatctcacacaagaatcacttgctttgcatgagatggtggcatctggtggtggtcaggatccaggagaacacattgagaaaatgtccatgctactgaagaaaatcaaggactttgtgcaaactcagaaccctgagatggggccgccaataggtaccaagataatggattcaaacggggagccaagacctgcaaacattcctgatgagttccgttgtccaatttctcttgagctgatgaaagatcctgttattgtttctactggccagacatatgagcgggtgtgcattgagaaatggatagcttctgggcaccatacttgtccaaatactcagcagaggatgacaaatacgacactgacaacaaactacgttcttagaagtcttattgcccagtggtgcgaagccaacgggattgagccacccaagcgttcaccgcagcctagcaagcctacattagcatgctcatcgagcgaacgtgctagcatcgatgctcttcttgcccagttatgctcccctgatcctgaggagcagaggtcagctgctgcagagctccgcctcctagcaaagcggaatgcaaacaaccgaatttgcattgctgaggctggtgccattcccttactactgagtctcttgtcttcacctgacctgcggacacaagaacatgctgttactgcacttctaaacctctccatacacgaggataataaggcaagcatcatatcctctggtgctgtaccgagcatagttcatgttctgaagaatggcagcatggaggcacgagagaatgctgcagctacacttttcagtctctcagtgatcgatgaatacaaagtaacaatcgggggaacaggggctatccctgctcttgtagttctattaagtgagggcagccagcgggggaagaaagatgcagcagcagcactgttcaacctgtgcatttatcaagggaacaagggtcgtgcaatacgagctggccttgtgccgctaatcatggggctggtgaccaaccccacaggagctcttatggatgaggctatggcaatactctcaatactgtccagccaccctgaggggaaggctgctattggggcagcagagcctgttcctgtgcttgtggagatgatcgggagcgggtcaccgaggaatagagagaatgctgcagctgtgatgttgcatcttagtagtggtgagcaacaacttgtgcatctggcccgcgcacaagaatgtggcatcatggtcccactgcgggagctggccttgaacggcacggatagggggaagagaaaggcggtgcatctgcttgagcgaatgagcagattcctagttcagcagcaagaggaaaaggaagcgcagctgctggcatcgacgcaggccattcctcagatccctgaacaggtacaagagatcgacatccctgaacaattggacagtccttcacctcaataccccatggcggcatgatgatgatgaatatcatcaagacagtgctacgaaaaggttgagcaagtagtgtccgataagtcacttggcttccagatccatggttcagcatgctgaacgagagttctttacgccgtcggattcgcttttgaaatcggtgatgatctttctggtttcttcccatgctcgtgtggtgtgttgaagatcccattgcgcacctgtttctgggtatgtatattagcccagaatgttgagatgtgtacagtccagtaaagatgcagctccaaatgtcatgtaactatggtactgctagtatatgtacattttcactatggtactatataaaaagagaagttctagcga

SEQ ID NO: 2719 - DNA, 2526 bp, Oryza sativa
ctccatttccccactatttaccattctgccactagccgaggtctcctcctcctcttcttcttcccgctgcttcgcctcgcgctcgccatggccggcgaccgagcggaggaggaggagggggaggcgccgcctccggaggcgcgtgccgcggcggcggtggagagggtggcggcggattcggctgctggggcccttcgtggaggagctccgggagcggaggcggggggagggggagggggaggaggaggagcgggcgctggcgccgctcgccgacgcgctcgaggcggcgctcgcgctgctccggctcggccgcgaggggagcaggatctccttggttcttgagagggacagcgtaatgaaaaagtttcagggagtaattttgcagctggaacaagctctgtgcgacattccgtacaatgaattggatatatcagatgaagttagagagcaggttgagttagtgcacgcacagctcaaaagagcaaaagaacggattgatatgcctgacgatgaattctacaatgatctactatctgtatatgacaagaactatgacccaagtgcagaactggctattcttggaagattgtcagaaaagctacacttgatgacaatcaccgatctcacgcaagaatcactcgccttacatgagatggtcgcatccggcggtggtcaggacccaggagaacacattgagagaatgtcaatgctactgaagaagattaaggattttgtgcaaacacagaaccctgacatggggcctcctatggcttccagggtattggattcaaatggggattcaaggcctataaccattcctgacgagttccgatgtccaatttctcttgagctgatgaaggatcctgttatagtgtctacagggcagacatatgagcgggcatgcattgagaaatggatagcatcaggccatcatacctgcccaaccacgcaacagaagatgtcaacctcagcattgacgccaaactatgtccttagaagtctcatttcccagtggtgtgaaaccaatgggatggagccaccaaagcgctcaacccagcctaacaagcctacgcctgcatgctcttcgagtgaacgtgctaacatcgatgctctgctatctaagttatgctctccagacactgaggagcagagatcagctgctgcagagcttcgcctccttgcaaagcggaatgcaaacaaccggatttgcattgctgaggcaggtgccattcccttgctattgagtctgctgtcctcatctgacctacggactcaagaacatgcagttactgcccttctgaacctctccatacatgaggacaataaggcaagcatcatatcatctggtgctgtcccaagcatagtccatgttctgaagaatggcagcatggaggcacgggagaatgctgcggccacactttttagtctctcagtgattgatgaatataaagtgacaattggagggatgggggctatccctgcgcttgtagtgctgttaggcgagggtagccagcgggggaagaaggatgcagcagcagctctcttcaacttgtgtatataccaagggaacaagggacgagcgattcgagctggccttgtgccactcatcatggggctggtgaccaaccccacaggagcgctcatggatgaggctatggcaatactctccatactatccagccaccctgagggcaaggcagcgattggggcggcagagcctgtccctgtgcttgtggagatgatcggaagcggaaccccgagaaatcgagagaatgctgcggctgtcatgctacatctgtgcagtggagagcaccatcttgtgcatttagctcgtgcgcaggagtgcgggatcatggtcccgttgcgggagctggctttgaacggcaccgatagggggaagaggaaggctgtgcagctgctcgagcggatgagcagattcctagtccagcaacaagaggaacaggagtcccagtcgcaagcctccgcgcaggtccctcctcaggccacccctgagcaggtcccggaaaatgacatccctgaacaattggacagcccagcgtctcaataccctatggttgtatgaactcgatgatgagcgagtcatcgtcgcaatcctatcaaatgtcggattgagtagcatcctggtcactttgcattctgctcatgattcatggcatgccgaccaattgaggtttttccacaagcttgaactataaggtttccatgcttgtgtgctgaaactcccaggttgtgagaatttgtttaggcagcccaggatgttgagatagatgtgtacagtttcttaaacatgcagctgctatatgtagacaacataatgcaaggttttcccatgtatatcctgaagactgtaataccatatgtaaaagagaagtttcaaatgcggatttgagcagtaaatctgatggctttactactagtaactactccctctgtccaaaagactcaattcctgagtttttttgactaacgtttgactgttcgtcttatatgaaattttttttataa

SEQ ID NO: 2720 - DNA, 2721 bp, Brachypodium distachyon
tttggcggccggggtaaactgcactgcactgcacggagtggaaatggggttgggaagtaaaaggaaaaagtcgagatctgccgtggaaggaagggaagaaggagacgacgaccaggccagcccaagacgctgaccggcccgacgactccagccaccgcttatttatcgcccctgccaactagcagccgccgacccgagtacccgatcgatccccagacgcggcggctgctactgctgctgccccgcttgatttcccttccccatggccggcgaccgcgaggaggacgaggagggggagggggtggccctggcgccgcgcccggccacggcgacggagcgggtggccaaggcggtggacgccgccacgacctgctccaccgccggggagtaccgcaacgcgtacaagcggccgttgctggcgctgtcccgcaggattcgcctcctcggccccttcgccgaggagctccgcgagcgccgtgcccctgcggagaaggaagaggatggggaggagaagacgctggcgccgctcgccgacgcgctggagaaggcgctcgacctgctccggctcggccgcgaggggagcaggatctccttggtttttgagagggacagggtaatgaagcaatttcaggaagtaattgctcagttggagcaagcattgtgcgattttccgtgcaatgaactggatatatcagatgaagttagagagcaggttgagttagtgcatgcacagctcaaaagagcaaaagaacgggttgatatgccggatgatgagttctacaatgacttattatctctgtataacaagacctatgacccaagtgcagaacaggctatccttgaaaggttgtcagaaaagctacacctgatgactatcattgatctcacacaagaatcacttgctctgcatgagatggtggcatccggtggtggccaggatccaggagagcatattgagaagatgtcaatgctactgaagaaaatcaaggactttgtgcaaacccgcaatcctgagatgggccctcctatggtttccacagtaatggattccaatggggaacagaaatctatagccgttcctgatgaattccggtgtccaatttccctcgagctaatgaaagatccagttattgttgctactggccagacgtacgagcggacatgcatcgagaaatggctagcatctggtcaccatacatgcccaactacacaacaaaggatggcgaacacgacattgacaccaaactatgtccttagaagtctcatctctcagtggtgtgaaacgaatggggttgaaccgcccaagcgctcatcccagcctgacaaaccgacaccggtatgctctccaagtgaacgtgctaacattgatgctcttttaaccaagttatgctctccagacctggaggagcaaaggtcagctgctgcagagcttcgcctcctagcgaagcggaacgctcacaaccgactttgtattgctgaggctggtgcaattcccttactattgagtttgctcgcctcatctgacttgcggactcaggaacatgctgttactgcacttctgaacctctccatacatgaggacaacaaggcaagcatcatgtcctctggtgctgtgccaagcgttgtccatgtgctgaagaatggcagcatggaggcccgggaaaatgctgcagccacactttttagcctctctgtggttgatgcatacaaagtgattatcgggggaacaggggctatccctgcccttgtagtgttgctaagcgagggcagccagcggggaaagaaggacgcggcagcagccctcttcaacttgtgcatttaccaagggaacaagggccgcgcgatacgagctggccttgtgccactaatcatgggtctggtgaccaaccctacaggagctctcatggacgaggctatggcgatactctcgatactatccagccaccaagagggcaaagcagccattggagctgcagagcctgttcctgcgcttgtggacttgatcggaagcgggtcaccgagaaacagagagaatgctgcggctgtgatgctgcatctgtgctgtggggagcaacagctcgtgcatttagcccgtgcacatgagtgcgggatcatggtcccgttgcgggagctggcactgaatggcaccgatagagggaagaggaaagcagttcagctgctcgagcggatgagcagattcctggtccaacaacaagaggaacatgaatcccattcccggctgcaggcggccttggtgcaggtcctccctgaggcccctgtacaggtccaagaaggcgagatccccgatcagctggacagtccagtgcctcaataccctgtcttgttatgatcatggcgatcagtgtttacaatgccagcgttccattactataatgctagcgaaagtgggatattcggcgcatcagaattcatgcgtgctgaattatataatatgtaagtatgataagccaagtgtcagtggagatcctccgaaatggaggcttctttggctgaaactccttcctgccaggtttgtgggcacgcggagtgctagtatcccagacttgagagagatatgtacagttcctgaatttgcaatttcatataatcatgtagcgacaatgtgatgcaataataacaatgagtaatgtaaaagaggagaactgatgaaggatttactcagaacaatgtcttatcttcctctactgtgtctttgactct

SEQ ID NO: 2721 - DNA, 1768 bp, Solanum phureja
atgtcatcttatttacattaataaaaatcaaatctttagattccctttggtctaaatcaataaaaaaagtcataaagttcttgtctttttataacagaaattagttattcctaatttttatttaatgtgttgtttcttgaagtgttgagattaagggaggagggaaaaaaaaaaagagatggggtttgagggtatgaaaaagttgaagcctttattgcatttgttgttgccattatgtgttcattggattgctgaagagatgactgtttctgtgcttgttgatgttactactggtgctctttgtccaggcaaaaccacttgttctgaagctatttacatcaatggtgttcaacaaacagtcgttggaatattcaagatgatagtccttcctatcctaggtcagcttgcagatgagtatgggcgtaaaccgcttcttattctcactgtatctacaacaattattcctttcggtttactcaccatcaataagtcaagggaaatggtctatgcttattatatcttgcggacgatttcctatatcataagtcaagggagcattttctgtatctctgttgcttatgcggcagatgttgttgacgtgagtagtagagctgcagtttttagttggattacaggccttttttctgcatcccatgttctcggaaatgtcctcgcacgttttcttcccgtgggctacattttccaggcacgttggtgtctcttgatctttgttcctgtttatatgcaagtgtttctagaagagactgtagcaccaaaaacagaggtgagccaaagttcgacactaaagagcaataccttgaagattgtcaaggaacgatataactcaatgcgatatgctgcaaatcttgtcactagcagcccaacactgaagtgcatttctcttgtatctttcttctacgagttgggaatgtccgggatcagcggcgttttactgtactatttgaaatcagcctttggcttcaacaagaatcagttctcagaaattttgatgatggtgggagtcggttccatagtctcacagattgtggtgcttcctctcatcaatcctctttttggggagaaagtgatactttgtatggccttgctttcatcaattgcctatgcaatgctctatggattagcatgggcaccttgggtgccatatttaagtgcttcttttggggtcatctacatccttgttaaaccttctacttatgctgtaatatctaaagcagcactttcagcagatcagggcaaagcacagggatttgttgctggtattcaatcagtcgcgagtttgttatctccaattgtaatgagtccattgacctcatggtttttatcccgcgatgcacctttcaactgcaaaggattcagtatactctgtgcttctttatgcatggtggtttcactgtgttatgctagcacgctaaaagttgaggcaccacgagagaggaccttcgatgaaaatgcagagaacattgaagcaccacttttgacatgatacttgagacattggtacccaaggctgcccctttatacaacgccaataagtccggtctacgatctacgtacgatagagttgtaaatcttattaagctaagtatgatctaattagattagaaaaggtgtattcatcttgtattaaaatttgtagctcttcaatgtatcactttatttttttggtctaaatgaaagatgttggtttgtacttttgtatttttgtatctatgaaactggggttatgcacattatattagtgaattca

SEQ ID NO: 2722 - DNA, 1702 bp, Triticum aestivum
actcgccctgtcggtgccgttcgcgtatccgtagacgacgtagccggactactaacagtacttttactttaaaccccttttggttaaaaccgtaaacttaaacttaggttcggaaacgtccggtacttaacttttacttaaaccgttcccgtaacccctaattcctcctctagtgttcgattattaattatttcgttagtaaacgactaaaacgttacgtaagggagacggaggtaataagtatactaactaatattgttgtgtcctacgtagagaatactacaactacaactaaactattttggtttttccttcctacgttttcggttacggtacggtcgtaaggggaaaaaggggtaggaaggagctcgtactcatagatgaaactactatcattgcaggagcattggagatgactcaaaagactgcaaaagatgccatgactcccatatctgaaaccttctcacttgacataaatgccaagctggatgtgtatgaatcttccaatttattgtgtgtttttatcgaaatatatggtactgatgctactatttgtctcttgataggcatacggtgggtatgataatgaccaaagggcacagccgtattcctatatactctggaagaccaagcaatattatcggtcttatattggtaaaaaacttgcttacttgccggcctgaggatgaggtgcccactagacatgttactatcagaaaaattccaagggtggctgatgatcttcctctctatgacattctaaatgagtttcagaaaggtcacagccacatggctgtggttgttaaacgcactaaagaagaaggagcatctgttgaaaagaataacagttttacagcagattacaaaatgacaaacggacatgctcatgctgatggtctcggtctgtcaccctcgcatgtcaacattcccggaagtcgtcgaaataacaatgacaagtacagtaagaaaattgaaagaaaacgggacaatattcttgattttaacactgatccacttcctcactattcaatggatgaggaagcggtgggaataattacgatggaagatgtcatggagcaactgctgcaggaagatatcttggatgaaacagatgagtatgttgatgtgcataacaagatcaaaataaacatgttaccgccaggcaaatcagtgtcgcctcttatatctcctagtggtgaacctctgtctcaaggtctaagaaagacccctatggcttctccgctgtcgccgtaccataatggcggctccatcttacgttcccctgttgcaaaccatgctcggtcacctgggactttaccgacaatgttctctcctggaaggtcacctgcgtcacaaactcccgttcgcagttcgccgacttcaagttgggtctcgaggaattcgtaccgaaatccgtagaaatggtggtgagagctaaagccaaagagctcagggggcaacaattcccaattccagttgagatcactgcctggatcaaattaaggcactgaagagtgtagggtcaaagaatgaagacccaacagctctctgctttgttgctggtccttgtttatttatgtatcgcgcatctgcgcatctgtgctggtattcttgtttgtcagccgccattgtactcactgaaactcaagtaaagtagctgttggtgctagtactgctgatggctgccccatttatgtaagaa

SEQ ID NO: 2723 - DNA, 2445 bp, Triticum aestivum
gcgaggtggtctcacgcagagtacggcgggggcgcgcgcccagctctttcccgcgtccccgcttaccgacattagggtttcgatccgtgccggcgtccgcgggaggcgtaggcgtgcttgccagccggagatggaggagcctcactgggagagggagcgtctcctggacctggccgtcgactacggcttcgaccgcgacttcgccgtagccgccctctcccgcctcgtccacctctacggagagggtggccaagatttcattactgtggagaactgtggcgatgattttattgctgcattggctgatgcaacacaacttactgatgactgggatgacctgaatgcaatagagactgaagcttgtggcaatttgaatgaaatgatgaggaagggtgtaaatgatgaaaaaggaggagttgttctggatacccctttgttcaaaagggcagactcctccagtcaacataatccgaaaggtttaaaaacatcgagcttttcctctgatgattcagattttgacatatttgatgaaacaaacacccaccgtgataataacgtgggtacccagaagaagccacaaacaagaaactctaaagctcagacaagaagctcaacaaaatctactgtgaccaaaggaaccaagagatatgaatcaacaactccaacttcaaatagagagggacagccaaatgcatgtcttcggaagagagaaattttgagttatgagcagctttcttctctagatgacatcaatttggccaatgctgtcatctttggcaacaaaagttttaggcccctgcagtatgaagcttgtagtgctgcactggacaataaagactgttttatacttatgccaacaggtggtggcaaaagcttgtgttatcagctccctgcaacattgcatccaggtgttactgttgttgtgtgtccattgctgtcacttattcaggatcaggtggttgctttaaccttcaagtttgggatacaagcagcattcttgaattctcagcaaactgctgcacaggcatctgcagttatccaagagcttagaaatggcacaccttctttcaaacttctgtatgtcacacctgaaagaatggctggaaactatcccttcatggagatcctcaaaggcttacaccagaggggattgctagcaaggtttgtgattgatgaagcacactgtgtaagtcaatggggacatgacttccgtccagattaccgaggcctaggatgcctcaaacagcacttccctagagtcccaatcatggctctaactgcaacagcaactgaagctgtccgtaaggacgtcctcagtaccttgaggatcccaaacgctttggtacttaagaggagctttgacagacacaacctcaaatacatggtgattggcaagacgagaactccccagatgcagctgggtgagctcctgaaagagcgtttcatgaacatgtctggcattgtgtattgcctctcgaagaacgaatgtgcagacactgccaagttcttgagggagaagtacaagataaaatgtgcgcattaccatgctggcttggcggcccgtcagcgaagcagcgtccaagagaagtggcacagaggagaggtcaaagttatttgtgctacaatagccttcggcatggggattgacaagcctgatgtgagctttgttgtccacaacacgctgtcgaaatcgatagaaagctactatcaggagtctgggcgggctggaagagatggccttccagcgcattgtgtggtgttatatcagaagaaagacttcagccgcatcgtgtgcatgctgaggagtgctgataacttcaagagtgaaaccttcaaggttgcaatggaccaagcaaagaaaatgcaggcgtattgcgagctgaagactgagtgtcgcaggcaaactcttctgggtcactttggcgaacagttcaacagtcaaaggtgtaaagatggccctagcccctgtgacatctgtctgaaggaagcttcatgagggcactaagaaagtgttggtcttaactccatgatggcttgctacttagaagctgtgttcctacagaaccagtacaagctttgtgatggtgatgcacaccgtcactgtacttgatgttcaggctttacgatggatgcagaggactggaaggggttatgttgaacatattttgggattttaccttatagctcttcactgcatatataagcgcgtagcgcgtaacccttttatgtttctcctctcggttcctcgaagtcttgttataatgatatcaagatgttaagagctgattaagcctacattcataccataacaatagaggtgtcttttctttactcttattctagtggcttcaaagtatcaacatcgggtattttcttaagcccacacaatggaatcctgtggtctccactaacatgcaaacaaacgactgaagtttttggatggtc

SEQ ID NO: 2724 - DNA, 2121 bp, Secale cereale
ttcgatccgtgccggcgtctgcgggagccggagatggaggagcctcacagggagagggagcgtctcctggacctggccgtcgactacggcttcgaccgcgacttcgccgtagccgccctctcccgcctcgtcaacctctacggagagggtggccaaaatttcattaccgtggagaactgtggcgatgattttattgctgcattggctgatgcaacacagcttactgatgactgggatgacctgaatgcaatagagactgaagcttgtggcaatttgaatgaaatgatgaggaagggtgtaataaatgatgaaaaaggaggagttgttctggatacccctttgttcaaaagggcagactcctccagtcaaaatagtccgaaaggtgtaaaaacatcgagcttttcctctgatgattcagattttgacatatttgatgaaacaaacacccaccgtgataattccgtgggtacccagaagaaggcgcgaaccagaaactctaaagctcagacaagaagctcaacgaaatctactgtgaccaaaggaaccaagagatatgaatcaacaattccaacttcaaatagagagggacagccaaattcatgtcttcggaacagagaaattttgagttatgagcagctttcttctctcgatgacatcaactttgcaaatgctgtcatctttggcaacaaaagtcttaggcccctgcagtatgaagcttgtagtgctgcactggataataaagactgttttatacttatgccgacaggtggtggcaaaagcttgtgttatcagctcccggcaacattgcacccaggtgttacagttgttgtgtgtccattactgtcacttattcaggatcaggtggttgctttaaccttcaagtttgggatacaagcagcattcttgaattctcagcaaacttccgcacaggcatctgcagttatccaagagcttagaaatggcacaccttctttcaaacttctgtatgtcacacctgaaagaatggctggaaactattccttcatggagatcctcaaaggcttacaccagaggggattgctagcaagatttgtgattgatgaagcacactgtgtaagtcaatggggacatgacttccgtccagattaccgaggcctaggatgcctcaaacagcacttccctagagtcccaatcatggctctaactgcaacagcaactgaagctgtccgtaaggatgtcctcagtaccttgaggatcccaaacgctttggtacttaagaggagctttgacagacacaacctcaactacatggtgattggcaagacgagaactccccagatgcagctgggtgagctcctgaaagagcgtttcatgaacatgtctggcattgtgtattgcctctcgaagaatgaatgcgcggacactgccaagttcttgagggagaagtacaagataaaatgtgctcattaccatgctggcttggcggcccgtcagcgaagcagctaccaagaaaagtggcacagaggagaggtcaaagttatttgtgctactatagccttcggcatggggattgacaagcctgatgtgcgctttgttgtccacaacacgctgtcgaaatcgatagaaagttactatcaggagtctgggcgggctggaagagacgatcttccagcgcattgtgtggtgttatatcagaagaaagacttcagccgcatcgtgtgcatgctgaggagtgctgataatttcaagagtgaaaccttcaaggttgcaatggaccaagcaaagaaaatgcaggcgtattgcgagctgaagactgagtgtcgcaggcgaactcttctgggtcactttggcgaacagttcaacagtcaaaggtgtaaagatggccctagtccctgtgacatctgcctgaaggaagcttcgtgagggcactaagagactcgtggattatatttcgtgtataatagccgcatggcctgccgacgacgacccctgtttgatttcttccaccatgctcttacaatcagatgcaacgtaaatcttctgaacatataaatcttctgccattgccaacgttccctcactgctaatgcctcaagtacggttgggttatggatgtgtttaaaagtaatagctgacgacaaa

SEQ ID NO: 2725 - DNA, 2205 bp, Brachypodium distachyon
cgtccgcgggcgtgctctgctcgacggggagatggcggggatcgagagggagcggctcctggaactggccgccggctacggctttgaccgcggcctcgccgccgactgcatcgccaccctcctcaacctctacggtgcggatgggcaaggttttattactgtggagaactgtggcgatgatttccttggtgcattagctgatgcaacacaagatactgatgattgggatgatctcaatgcgattgagaccgaagcttgtggcaatttgaacaaaatgatgggaaagggtgtacctcatgaaaaaggaggagttgctgcaaatacccctctttccgaaagggcaaatacctccagtcaacatactcccgacaatccgaagactttgagcttttcctcagatgatgattcagattttgaaatgaccacccatcgtgatagctcttttggtacacagaagaaggcacagcccagaaactctaaagtgcagacaagaagctcagcaaaatctactgtgaccaaaggaagcaatagatatggatcaccaactccaacttcaagtaaagagagacgtccaaacacatttcatcaaaagagagaaaccctgagttatgaacaactttcttgtctagacgacctcaatcttgcgaatgctgtcatctttggcaacaaaagttttaggcccctgcagtatgaagcttgcagtgctgcactgaacaacagagactgttttatactaatgccaactggtggtgggaagagcttgtgttatcagctccctgcaacattgcaccccggagttactgttgttgtatgccctttactgtcgcttatccaggaccaggttgttgcattgaccttcaagtttgggatacaagcatcattcttgaattctcagcaaacttcatcacaggcatctgtcgtcatgcaagagcttagaaatggcacaccgtcttttaagcttctttatgtcacacctgaaaggatggtcggaaactactccttcatggagatccttagaggcttacaccagagaggattgctagcaagatttgtgattgatgaagcacattgtgtaagccaatggggacatgacttccgtccagattaccgagccctaggatgcctcaagcagaatttccctcgagtcccaattatggctttaactgcaacagcaactgaagctgtccgtaaggacatcctcagtaccttgagggtcccaaatgctctggtacttaagaggagctttgacagactcaacctcaattacatggtcattggcaagacaaaaactcctcagatgcagctgggcgagctcctgaaagagcgctttatgaacatgtctggtattgtatactgtctctcgaagaatgaatgcgcggatactgccaagttcttgagggagaagtacaagataaaatgtgctcattaccatgctggcttggcggctcgtcagagaacaagtgtccaagaaaagtggcacagaggggaggtcaaagtcatatgtgctaccatagcatttggcatggggattgacaagcctgacgtgcgctttgttatccacaacaccctgtcaaaatcgatagagagctactatcaagagtctgggagggccggaagagatgatcttccagcacattgcgtcgtgctatatcagaagaaagacttcagccgtatcgtgtgcatgctgaggaatggagataacttcaagagcgagacattcaaggttgcgatggatcaagcaaagaaaatgcaggcgtactgcgagctgaagactgaatgccgtaggcagactcttctggctcattttggcgaacagtacgacaggcaaaggtgcaaagatggacctagcccctgcgacaactgcctgaagacagcttcttgagtgtgttctacaatctagagtgtgcactgacatagtatcgatcctaaccccgtgatgagttactactttgaagatgtattcgtacatgagcaacacaagctttctgtatctaatattcaggctcggcgactgtaacaaagaggtggtaaggttgcacttgttcctggatgctcgacattgaatataatcacataactctttcttagactgcagttctgttacagtctaagaaaaaaaatgtatttgaacaaacgtactatggagtgctatgtacacttttttagatttaactttaatcaaaaaccctgttataacaatacacg

SEQ ID NO: 2726 - DNA, 2305 bp, Secale cereale
actccccctcctcttgtcacaatcaatcaagaacgtactggaaggaaggaagaggaggaagaaccaagaaagaaccgcctctcttaacgagaacgcagagtctcttttgaatctttgctagctgcggaaaggccttcttccgtcatgtgctctggtccgcgcaagccgtcgaccccgcctccggtggcggcggcgccgaaggattcggcggccatggcctcgcttctcctcgagctggcggcggcggataacgtggtggagttcaggcgggtcgtggaggaggagaaggcgtcccttgatgctgcgggatcgtggtatgggccgtcggctgttggccttggccggctggccgcggagagccggactccggctatggtcgccgcgctctacgggagcacggccgtgctggcgcacgcgctgtccgtcgcgccgggcgaggcctgccgcgcgtctgatacggacggcgccaccgcgctccatatggctgctgccggtggcgcggctaacgccgtcgcggccacgcacctgctgctagccgcgggggcctccacggaggcgctctcggtgtccgggctccgcgccggggacctgctcccgcgcgccgccggcgtgtcggagaagcctctccgcctgctgctcaagtcccccgccgtgtcgccctcctcgtcgcccaagaagtccgcctcgccgccggcgatggtcgccgcgcaggagcccaggaaggagtacccgccggacctgacgctgccggacctcaagagcgggctcttcagcaccgacgagttccgcatgtacagcttcaaggtgaagccctgctcccgcgcctactcccacgactggaccgagtgccccttcgtgcaccccggcgagaacgcgcgccgccgcgacccgcgccgctactcctacagctgcgtgccctgcccggagttccgcaagggcgggtcgtgccgcaagggcgacggctgcgagtacgcgcacggcgtcttcgagtgctggctccacccggcgcagtaccggacgcgcctctgcaaggacgaggtcggctgcgcgcgccgcatctgcttcttcgcgcacaggcgcgacgagctccgctccgtcaacccctccgccgtctccgtgggcatgatgcagcccgtgtccccgcgctcctcgcctcccaacgggatggacatggggatgctcaaccccgcggggtggccgtcgtccccggtcagccggctcaagaccgcgcgggagctcgacttcgacctggagatgctcgcgctggaccagtaccagcagaagctgttcgacaaggtgtccaacaacgcgcactcgccgagggcgagctggggcgcgcccaacggcggcctcggctcgccgcacgccgccgggtcgcccgccagaaacatgccggactacaccgacctgcttgggtccatggacccggccatgctttcccagctccacgcgctgtcgctgaagcaggcgggcgacatgtcgccgtacagctccatgccggacacgcagctgcacatgccgacctcgccgatggtgggcgcgaacaactcgttcggcctcgaccactccatggccaaggccatcatgacctcgcgcgcctccgcgttcgccaagcgcagccagagcttcatcgaccgcggcgcgcgcgccccggccgcgcgctccctcatgtcgccggccaccacgatcggcgagccttccatgctcaccgactggggttctcccagcggcggcggcaacctcgactggggctcacccggcggcaagctggactggggcgtgcagggagacgagctgcacaagttccgcaagtcggcgtccttcgggttccgcgggcagaccgccatgccggcggccgccgcagccaccccggccgaacccgacgtctcatgggtgaactctcttgtcaaggatggccacacaggcgaccattttccgcagtggctggagcaggagcagatggtggcctgatcccaccccgtcgacgatcgatcaattcactggctcatagcatctagctgaccaaagttctttccttcaaattttttccacccctttttatttgcttaatttgattcatatgagatggttctttagtacgtacatatatgctgttcacaaaaataaatattgctcatcagcaatcagcatggatgcccaaagggagccttaggttgatgaagaacagcaccaccaatatttactctttttcccccttcccctcggtttattataaatactagctgtatacaagaattccatcaagagtttatttacttgatatttatatacatactttgagacc

SEQ ID NO: 2727 - DNA, 2390 bp, Triticum aestivum
cgcttctttcccctcctcttgtccccatcaatcaagaacgtactggaagaagaagaaccaagaaagaatcgtctctccccggcgctcttaacgagaacgcagagtctcttttgaacccttgttagcagcggacaggccttcctccgtcatgtgctccggcccgcgcaagccgtcgaccccgccgccggtggcggcggcgcccaaggatccggcggccgtggcctcgctcctcctggagctggcggcggcggacgacgtggtggagttcaggcgggtcgtggaggaggagaaggcgtgccttgatgccgcgggatcgtggtatgggccctcggctgtcggccagggacggctggccgcggagagccggacgccggccatggtcgccgcgctctacgggagcacggccgtgctggcgcacgcgctgtccgtcgcgccgggcgaggcctgccgcgcgtccggcacggacggcgccaccgcgctgcatatggctgccgccggtggcgcggccaacgccgtcgcggccacgcacctgctgctcgccgcgggggcctccacggaggcgctctcggtgtccgggctccgcgccggggacctgctcccgcgcgccgccggcgtggccgagaagcctctccgcctgctgctcaagtcccccgccgtgtcgccctcctcgtcgcccaagaagtccgcctcgccgcctgcggcgatggtcgccgcgcaggagcccaggaaggagtacccgccggacctgacgctgccggacctcaagagcgggctcttcagcaccgacgagttccgcatgtacagcttcaaggtgaagccctgctcccgcgcctactcccacgactggaccgagtgccccttcgtgcaccccggcgagaacgcgcgccgccgcgacccgcgccgctactcctacagctgcgtgccctgcccggagttccgcaagggcgggtcgtgccgcaagggcgacggctgcgagtacgcgcacggcgtcttcgagtgctggctccacccggcgcagtaccggacgcgcctctgcaaggacgaggtcggctgcgcgcgccgcatctgcttcttcgcccacaggcgcgacgagctccgctccgtcaacccctccgccgtctccgtgggcatgatgcagcccgtgtccccgcgctcctcgccccccaacgggatggacatggggatgctcaaccccgcggggtggccgtcgtcgccggtcagccggctcaagacggcgcgggagctcgacttcgacctggagatgctcgcgctggaccagtaccagcagaagctgttcgacaaggtgtccaacagcgcgcactcgccgagggcgagctggggcgcgcccaacggcggcctcggctcgccgcacgccgccgggtcgcccgccagaaacatgccggactacaccgacctgctcggctccatggacccggccatgctctcccagctccacgcgctgtcgctgaagcaggcgggcgacatgtcgccgtacagctccatgccggacacgcagctgcacatgccgacctcgccgatggtgggcgcgaacaactcgttcggcctcgaccactccatggccaaggccatcatgacctcccgcgcctccgcgttcgccaagcgtagccagagcttcatcgaccgcggcgcgcgcgccccggccgcgcgctccctcatgtcgccggccaccacgatcggcgagccttccatgctcaccgactggggctcccccagcggcggcggcaacctcgactggggctcacccggcggcaagctggactggggcgtgcagggagacgagctgcacaagttccgcaagtcggcgtccttcgggttccgcgggcagtccgccatgccggcggcctccgcagccaccccggccgaacccgacgtctcatgggtgaactctcttgtcaaggatggccacacaggcgaccattttccgcagtggctggagcaggagcagatggtggcctgatcccaccccgtcgacgatcgatcgatcactggctcatagcatctagctgaccaaagttctttccttcaaattttttcacccctttttatttgcttaatttgattcatatgagatggttctttagtacgtacatatatgctgttcacaaaaataacattgctgctcatcagcaatcagcatggatgcccaaagggagccttaggttgatgaagaaagaacagccaatatttactctctttccccccttcccttcggtttattataaatagctgtatacaagaattccatcaagagtttatttacttgatatttatacatactttgagaccagcaagatttgttttgtgtgcttccttgtctcttgatttatcaaacttgtggaatattgtactcttctcatgccaaagtacat

SEQ ID NO: 2728 - DNA, 2971 bp, Brachypodium distachyon
tgcttagacatggcatctgaaacacattgcaccccgctcttgttcttctttcaggtcagcgccgccatgccggggaggaggaggaagttgcaagtcgcagccttgctcctccttttctgtgtctgctcgtctgccgggataatctgcagagcacaactagtagatcagttcaagcccgccgacagctacctcgtcaactgcggctctgctaagggcaccacggtcagcgagagaaacttcgctgccgatggggctgctccgttgacggtctccacacctcaagaaatcctcgccggcacctcggccaacggggtgtcctcgttcgacaactcggcgctctaccagaccgcccgcatattcaccggcccgtcgtcctataccttccctatcaacaagcaaggccgccatttcgtccgtctctacttctttcctttcatctaccagagttacgatctctccaccgccaagttcaccgtgtcgacccaggatgtgcttctgcttagcgacttccagcagccggacaagaccgcgccgctgttcaaggaatactctttgaacatcacacgggaccagcttatcatctccttcaagccgtccaacgggatcgcattcgtcaatgcaatcgaagtggtttctgtcccggatgatctcatagctgatgttgcccagatggtcaaccccgtgcagcagtacagcggtttgtctacgcagtcgttggagacggtgtatcgcgtcaatatgggtggtccgaaggtcactcccaacaatgataccctctcaaggacatggctgaatgatcagaagttcataatgaaccctagtgtgaccaaaaaggttgtttatggcaagacaatcaagtacaagaatggtggagcatcgtcactcactgcccctgatgttgtctacagtacagctacagaactggcagcttcaaatacatccaacgcacttttcaacatgacatggcagtttgatgtagatgcaggcttcagctatttaataagatttcacttctgtgatattgtcagtaaggcacttaaccaactctacttcaatgcatatgtggggggtttctttgcacaacatgaccttgatctctcagagcaatcaatgaatcaattggctacagccatctatgttgatgtggttctttcatctaatgatgcatctagcaagctcagcatcagcattggtccatctacattgaacaacgcattccctgatgggattctgaatggccttgaggttatgaagatgggcagtggctcgggttctgcttttactgttggatcttctggttcaaagaaaattttggctgttatcattggttcagtcattggggttattggacttttggtaattgtccttcttttggtactgctttgccggaggaaaaagactgatgacaagcagcactccaagacttggatgcctttctctattaatggtctcacatctctcagtacaggaagtagaacttcttatggtactactctcacatcaggtctgaatggaagccttggatatcgctttgccttcaatgttctccaagaagcaacaaacaattttgacgagaactgggtcattggagttggaggttttgggaaagtctacaagggagtgttgagggatgacacgaaggttgcagtgaaacgaggaaaccccaagtctcagcaaggtcttaacgagttccgcacagagattgaactcctttcacgtttgcgtcaccgccatctggtgtctctgattgggtactgtgatgaaaggaatgagatgatcttggtatacgaatatatggagaatgggaccgtcaaaagccacctatatggttcagacaacccatcactcaactggaagcagcgcttggagatctgcattggagctgcaagggggttacactatcttcatactggttctgcaaaggccattatccaccgtgatgtcaagtctgcaaacatcttgcttgatgagaatttcctagcgaaagttgctgactttgggctatcaaagactgggcctgagcttgatcaaactcatgtcagcactgcagtgaagggtagctttgggtatcttgaccctgaatatttccgaaggcagcagctgactgagaagtcagatgtctattcctttggtgttgtcatgctggaggtgctttgcgcgaggccggtgattgaccctacgctcccgagggaaatggtgaatctagcagagtggggaatgaaatggcagaagaggggagagttgcatcagatcgttgatcagagactttccagtacgatcaggccggattctctaaggaagtttggtgaaacagtagagaagtgcctggcagactacggtgtggagcggccgtcgatgggagatgtcctatggaacctggagtatgtcctgcagctccaagatgcagattcttcaacagtatcagacgtgaacagcatgaaccggatcgttgacctctcgtcgcaggttcagcatgtgggtgctcttgagagcatcagcatgactatggcagaagctggggcttcacacgagcctgaccacgacctctccgacgtgtcgatgagcagggttttctctcagctaatcaaagctgagggaaggtgaaaacatatccgacgactatccgcaagggtatctacagaagtgagagtatgccttgcaaactagtgtatttcattacttgagattaattggttgtttcatcccctatgattgtaccgaaccacggttccattttctctcagctaatcaaagctatatcttgttgttgtaagtaatctgttcatattcggttgtagcaatgtgcactgatctggcaaaatgctggatttctagttgcaattgccgcattcccacgttctctgtatgccgccttttttcttgtatgaatgtatcccagttgaagtggattcagctgtataagattcaatcaaacacacaagataacatgatcctgatgcaccataggaga

SEQ ID NO: 2729 - DNA, 2062 bp, Triticum aestivum
tttcttccccccgcccccgcgcccgaccacgtcctccgccggcgcccatcctacgccagataatcgacgccgtcgcccctgtccatcccgtctcgccgccgccagctcgacctcgcccccctgtctcgccgctgtccagctcgctgccggctagctccctaagctcaaaacgaggccttggggggccgccctttttgctccatctcagggccggccccgatggcttgtgcggcttacagtatcagggggcatctcaagcttgccgcggggcatggcctggccagtaatcacctgtgcggcggctggaagccttcggcgtcttgccctgtttctcgggcatggagtggcaatgtctccagtaatgcagtgcagcacgtcgcccgccattatcatttgactgtccggaattctgaaagatggcgctcgatcccgaaagcttcgccagaggacgggaccgccgttgctgaagggaggatgactgtactcgtcattggtggcggtggaagggaacatgcgctctgttatgctttgacccgttcaccttcttgcgacacagttttatgcgcccctggtaatgctggtattgctcaatccagagacgcggtctgtatatcggacttagatatttctagtagtgatgctgttatatcgttctgccgcaagaggggagtgggaatggtggtagtgggtcctgaaggtcctctcgttgcgggtcttgcgaatgaccttgtcaaagctgggatacctacctttggtccgtcgtccgaggctgcagcattagaaggatcaaaggactttatgaagaggttgtgtgataagtataatatccccactgctcagtaccgcacattcacggatcctgcaaaagctaaagagtacatcaaggatcaaggggcccctattgttgtcaaagctgatggattggcagctggaaaaggcgttgttgttgctatgactttggatgaggccttcgaagcaatagactctatgatggttgacgagtcatttggttctgctggttcgcgggttgtcattgaggagtatctggagggcgaagaagcctctttctttgcattagtagatggtgaaaatgctttgccacttgaatcagcacaggatcacaaaagagttggtgatggtgatactggtccaaacacgggtggtatgggtgcatactcccctgcgccaatagtgaccgaagagcttaagagcgtgatcatggaaaccataattattccaactgttaaaggtatggctgctgaaggatgcaagtttgttggtgtattatatgccgggcttatgatagagaagaaatctgggctgcctaagcttattgaatataatgtgcgatttggggatcctgaatgccaggttctgatgatgagattggagtctgatcttgcacaggtcctgctatccgcatgcagaggggaactgggcaaggtttcgctaacctggtcacctgaaatcgcgatggtggtcgtgatggcgagtgaagggtaccctggctcttataagaagggaaccgtgataaaaaacatcgacaaggccgagcaggtttctccagctgtcaagatattccatgctgggacagctttggatggagacggcaaccttgtagctgtcggaggccgagttcttggcgtaactgcgaagggcaaggacattgaagaagcgaggtttagagcgtacgatgcggtagatgttgtcgactggccagaaggattcttcaggcgagatattggttggagggcactgaagcaggagcagacggctaactactgattagttaggtttcctaaatctggggtgagcttccatcctcaagtgaaatgaagacagtagagtcaccattgttgtggttgcggaattgacaggagcatagcttctcccgtcgaacatgagcatcttttggccatggtttggctccgaaccatttgtagcagtcatgtattttccacaagtcaggcaatgtgtcaattgctcttgaggtgcaataataataccaccaaccaactattttcaagtgaacataaccatgtgatctctaaataagcatctc

SEQ ID NO: 2730 - DNA, 2426 bp, Triticum aestivum
gtagccgcctcctcctttcagccgccgtttctcccccccgtccccgcccccgaccacgtgctccgccggcggccatctttcgccagataatcgacgccgccgcccccgtccatcccgtctcgccgcccccagctcgacctcgccgctgtccagctcgccgccaactagctccctaagctcagaacaaggccttgggcgggcgccctttttgctctatctcagggccggccccgatggcttgtgcggcttacagcatcagggggcatctcaagcttgccacggggcctggcctggatagtaatcatctgtgcggcggctggaagccttcggtgtcttggcccgtttctcgggcatggagtagcaatgtctccaataatgcagtgcaacacgtcgcctgccattctcatctgtctgtccggaattcagaaagatggcgctcaatcccgaaagcttcgccggaggacgggaccgttgttgctgaagggaggataactgtactcgtcattggtggtggaggaagggagcatgcgctctgttatgctttgacccgttcgccttcttgcgggacagttttatgcgcccctggcaatgctggcattgctcagtccagggatgcgatctgtatatcggacctagacatttccagtagtgatgctgttgtatcgttctgccgcaagaggggagtgggaatggtggtagtgggtcctgaaggtcctctcgttgcgggtcttgcgaatgaccttgtcaaagctgggataccgacgtttggtccttcatcagaggctgcagcattagaggggtcaaaggactttatgaagagactgtgtgataagtgtaatatcccgactgctcagtatcgcacattcacggatcctgcaaaagctaaagagtacatcaagaatcaaggggcccctattgttgtcaaagctgatggattggcagctggaaagggcgtcgttgttgctatgactttggatgaggccttcgaagcaattaactctatgatggttgacgagtcgtttggttctgctggttcacgggtcgtcattgaggagtatctggagggcgaagaagcctctttctttgcattagtagatggagaaaatgctttgccacttgaatcagcacaggatcacaaaagagttggagatggtgatactggtccaaacacgggtggcatgggtgcatactcccctgcgccaatagtgaccgaagagcttaagagcgtgatcatggaaactataattattccaactgttaaaggtatggctgctgaaggatgcaagtttgttggtgtgttatatgccgggcttatgatagagaagaaatctgggctgcctaagcttattgaatataatgtgcgatttggggacccagaatgccaggttttgatgatgagattggagtctgatcttgcacaagtcctgctatccgcatgcagaggcgaactgggcaaggtttcactaacctggtcgcctgaaatcgcgatggtggttgtgatggcgagcgaaggataccctggctcttataagaaaggcaccgtaataaaaaacatggacaaggccgagcaggtttctccggctgtcaagatattccatgctggaacagctttggatggagacggcaaccttgtagctgtcggaggccgagttcttggcgtcactgcgaagggcaaggacatcgaagaagcgaggtcgagagcatacgatgcggtggatgtcgtcgactggccggaaggattcttcaggcgagatatcggctggagggcactgaagcaggagcagacggctaactactgacttgttaggttttcctaaatccggggtcagcttcgagcgtcaagtgaaatgaagacagtagagtcaccattgtcgtggttgcggaattgacaggagcatagcttctcccgtcgaacatgagcatcttttcaccatggttttggctccgaaccatttgtagcagtcttgtgttttccacaaggcaggcaactttgtcaagtgcaattatctcttgatgtgcaataataataccaccaactaattattttctagtgaacataaccacgtgagctcttcataagcatttgcttataggacctactccttccattcctaaatataaatctttttagatatttcaatatgaactacatacggatgtagtagaaattatgtggtgagctcatgacacattagaggagggacaatacatgaattcaatagtctgttgaggaacagcccatgctgccatagcctcctcttttgctattcggggtccatcgccatcactaactgatatgagcagaacattcttctcttccggggttcatcgccatccattgtcatctctttgctactatttgtatgtatggatctctttgctacttttttgtatcgatctctttgctacttcaagttgctgtttgg

SEQ ID NO: 2731 - DNA, 2067 bp, Triticum aestivum
aggagcgacctgaccggcgacgaccactcccccgattcgcggctctgaccggtgaagaccgccgtctcacgccgccaaccaccgcgcatcgcgccgctaacctgactccccctgcgtcgctccactgcccacgacgctgccatccgccggccctgatggcctgtgccgcctacagtatcaggggccatctcaagcttgccgcggggcatggcctggccagtaatcacctgcgcggcggctggaagccttcggcgtcttgccctgtttctcgggcatggagtagcaatgtctccagtaatgcagtgcagcacgtcgcccgccattctcatttgactgtccggaattcagaaagatggcgctcgatcccgaaagcttcgccggaggacgggatcgccgttgctgaaggggtgatgactgtactcgtcattggcggtggaggaagggagcatgcgctttgttatgctttgacccgttcgccttcttgccagacagttttatgtgcccctggtaatgctggcattgctcaatccagagacgcggtttgtatatcggacttggacatttctagcagtgatgctgttatatcgttctgccgcaagaggggagtgggaatggtggtagtgggtcctgaaggtcctcttgttgcgggtcttgcgaatgaccttgtcaaagctgggataccgacctttggtccgtcgtccgaggctgcagcattagaaggatcaaaggactttatgaagaggttgtgtgataagtataatatccccactgctcagtatcgcacattcacggatcctgcaaaagctaaagagtacatcaaggatcaaggggcccctattgttgtcaaagctgatggattggcagctggaaaaggcgtcgttgttgctatggctttggatgaggccttcgaagcaatagactctatgatggttgacgagtcatttggttctgctggttcgcgggtcgtcattgaggagtatctggagggcgaagaagcctctttctttgcattagtagatggtgaaaatgctttgccacttgaatcagcacaggatcacaaaagagttggtgatggtgatactggcccaaacacgggtggtatgggtgcatactcccctgcgccaatagtgaccgaagagcttaagagcgtgatcatggaaactataattactccaactgttaaaggtatggctgctgaaggatgcaagtttgttggtgtattatatgccgggcttatgattgagaagaaatctggtctgcctaaacttattgaatataatgtgcgatttggggatcctgaatgccaggttctgatgatgagattggagtctgatcttgcacaggtcctgctatctgcatgcagaggagaactgggtaaggtttcgctaacctggtcacctgaaatcgcgatggtggttgtgatggcgagcgaaggataccctagctcttataagaagggcaccgtaataaaaaacatcgacaaggccgagcaggtttctcctgctgtcaagatattccatgctgggacagctttggctggagacggcaaccttgtagctgtcggaggccgggttcttggcgtcactgcgaagggcaaggacatcgaggaagcgaggtcgagagtgtacgatgcggtagatgtcgtcgactggccggaaggattcttcaggcgagatatcggctggagggcactgaagcaggagcagacggctaactactgattagttgggttttcctaaatctggggtgagcttccagcgtccagtgaaatgaagacagtagagccaccattgttctggttgcggaattgacaggagcatagcgtctcctgtcgaacatgagcatcttttgaccatggtttggctccgaaccatttgtagcagtcttgtgttttcctcaaggctggcaacgtgtcaagtgcaattatctcttgaggtgcaataataccatcaactgattattttctagtgaacataaccacgtgagctcttcataagcatttgcttataggacctactccttccattcctaaatataaatctttttagatatttcaatatgaactac

SEQ ID NO: 2732 - DNA, 2161 bp, Secale cereale
tcaggcgagacataaggcacccactcggactcggagggtttcctcaccccgccgccaggttctgaccccgccgcctgtacctctccccctccttccgacgaccggcgtcctccccatcgccctgcaggagccggcgacccagccccgacgcgcccataccgccggccgctcttcagatctccttccaccgctgcctgttcagggacattacagacatttcagctcaaaccgaggccttgggcgggcggcctttttgctctaccttagggccggccgtgatggcttgtgcctcttacagtatcaggggccatctcaagcttgcgacggggcatggcctggtcaataatcacctgagcggcggctggaagccttcggtatcttgccctgtttctcgggcatggagtagcaatatttccagtaatgcagtgcaacttgttgcccaccattctcacttgaccatccggaattcagcaagatggcgctcaagcccgaaagcttcgcgcgaggacggcaccatcgttgccgaagggaggataattgtgcttgtcattggtggtggaggaagggagcatgcgctttgttatgctttgacccgttcaccttcttgcgagacagttttgtgtgcccctggtaatgctgggattgctcaatccagggatgcgatctgtatatcggacttggacatttccagtagtgatgctgttatatcgttctgccgcaagaggggggtgggaatggttgtagtgggttctgaaggtcctctcgttgcgggtcttgtgaatgatctggtcaaggctgggataccgacctttggtccgtcatcagaggctgcggcattagagggatcaaaggactttatgaagaggctgtgtgataagtgtaacatccccactgctcagtatcgcacattcacggatcctgcaaaagctaaagagtacatcaaggatcaaggggcccctattgttgtcaaagctgatggattggcagctggaaagggcgttgttgttgctatgactttggatgaggccttcgaagcaataaactctatgatggttgatgagtcatttggttctgctggttcgcgggtcgtcattgaggagtatctggagggcgaagaagcttctttctttgcattagtagatggtgaaaatgctttgccacttgaatcagcacaggatcacaaaagagttggtgatggtgatactggtccaaacacgggtggtatgggtgcatactcccctgcgccaatagtgaccgaagagcttaagagcgtgatcatggaaactataattattccaactgttaaaggtatggctgctgaaggatgcaagtttgttggtgtgttatatgccgggcttatgatagagaagaaatctgggctgcctaagcttatcgaatataatgtgcgatttggggatcctgaatgccaggttctgatgatgagattggagtctgatcttgcacaggtcctgctatccgcatgcagaggagaactgggcaaggtttcactaacctggtcacctgaaatcgcgatggtggtcgtgatggcgagcgaaggataccctggctcttataagaaggggaccgtaataaaaaacatcgacaaggccgagcaggtttctccggctgtcaagatattccatgctggaacagctttggatggagacggcaaccttgtagccgttggaggccgagttcttggcgtcactgccaagggcaaggacattgaagaagcgaggtcgagagcgtacgacgcggtagatgccgtcgactggccagaaggattcttcaggcgagatatcggctggagggcgctgaaacaggagcagacggctaactactgataatgtttccttaaagctgggttgagcttccagcgtcaagtgaaatgaacacagtagagtcaccattgttgcggttgcggaattgacatgagcttgagcttcttttgaccatggtttggctccgaaccatctgtagcagtctagtggtttccacaaggcaggcaacttgtcaagtgcaatttatctcttgatgtgcaaataataataccacctaataattgttttacaagtaaagaaaaaaaaaaaaaaaaaaaaaaaaacaaaaaaaaaaaaaaataaaaaaaaacagaagacagacaagacaagacgagggtaag

SEQ ID NO: 2733 - DNA, 2115 bp, Triticum aestivum
ggcggcggcgagctagcaagcaagcaggtggcggcggcgaccggcggccaccagattagctaagttttgtccatctgctggccgattgaaggaacctggctctgccactgtcacgtatacgaagctcttacgccagataatcgacaccaccggacccgtccatcccgccaagttcggcctcagtctccagctcgcggccgactagctcctggacaagcttaagcacaaagagaggcctcgggcgggctccctttttgctctatcttaggtctggccccgatggcttgtgccgcatacagtatcaggggctatctcaagcttgccacggggcatggcccggtcaatagtcacctgtgcggcggctggaagccttcagtatcttgccctgtttctcgggcatggagtagcaatgtctccagtaatgcagtgcaacacgtcgcctgccattctcatctgactgtccggaattcaaaaagatggcgctcaatcccgaaagcttcgctggaggacgggaccgttgttgctgaagggaggataactgtactcgtcattggtggtggaggaagggagcatgcgctctgttatgctttgacccgttcgccttcttgcgaaacagttttatgcgcccctggtaatgctggcattgctcaatccagggatgcgatctgtatatcggacttagacatttccagtagtgatgctgttatatcgttctgccgcaagaggggagtgggaatggtggtagtgggtcctgaaggtcctcttgttgcgggtcttgcgaatgaccttgtcaaagctgggataccgacctttggcccttcatcagaggctgcagcattagagggatcaaaggactttatgaagagactgtgtgataagtgtaatatcccgactgctcagtatcgcacattcacggatcctgcaaaagctaaagagtacatcaaggatcaaggggcccctattgttgtcaaagctgatggattggcagctggaaagggcgtcgttgttgctatgactttggatgaggccttggaagcaataaactctatgatggttgacgagtcatttggttctgctggttcacgggtcgtcattgaggagtatctggagggcgaagaagcctctttctttgcattagtagatggtgaaaatgcgttgccacttgaatcagcacaggatcacaaaagagttggtgatggtgatactggtccaaacacgggtggtatgggtgcatactcccctgcgccaatagtgaccgaagagcttaagagcttgatcatggaaactataattattccaactgttaaaggtatggctgctgaaggatgcaagtttgttggtatattatatgccgggcttatgatagagaagaaatctgggctgcctaagcttattgaatataacgtgcgatttggggatcctgaatgccaggttctgatgatgagactagagtctgatcttgcacaggtcctgctatccgcatgcagaggagaactgggcaaggtttcgctaacctggtcccctgaaatcgcaatggtggttgtgatggcgagcgaaggataccctggctcctataagaaggggaccgtgataaaaaacacggacaaggccgagcaggtttctccggctgtcaagatattccatgccggaacagctttggatggagacagcaaccttgtagccgtcggaggccgggttcttggcgtcactgccaagggcaaggacatcgaggaagcgaggtcgagagcgtacgatgcggtagacgttgtcgactggcccgaaggattcttcaggcgagatatcggctggagggcactgaaactaaccacttactagttaggttttcctaaatccggggtcagcttcgagcgtcaagtgaaatgaagacagtagagtcaccattgttattgttgtggttgcggaattgacaggagcatagcttgtcccgtcgaacataagagcatcttttggccatggtttggctcccaaccatttgtagcagtcttgtgtttccctcaaggcaggcaacgtgtcaagtgcaattatctcttgaggtgcaataataccaactaattactacctccggtcttaaatatttgtctttctagatgtttc

SEQ ID NO: 2734 - DNA, 2050 bp, Secale cereale
tcgctgaacgcgagacataaggcacccactcgactcgagggtttcctcaccccgccgccaggttctgacccccgccgcctctacctctccccctccctccgacgaccggcgtcctccccgccgccctgcaggagccggacacccggccccgacgcgcccataccgccggccgcagatctccttccaccgctgcctgttcagggacattacatacatttcagctcaaaccgaggcctttggcggcctttttgctctaccttagggccggccctgatggcttgtgcctcttacagtatcaggggccatctcaagcttgcgacggggcatggcctggtcaataatcacctgagcggcggctggaagccttcggtatcttgccctgtttctcgggcatggagtagcaatatttccagtaatgcagtgcaactcgtcgcccgccattctcacttgactgcccggaattcagcaagatggcgctcaagcccgaaagcttcgcgggaggacggcaccatcgttgctgaagggaggataattgtgcttgtcattggtggtggaggaagggagcatgcgctttgttatgctttgacccgttcaccttcttgcgagacagttttgtgtgcccctggtaatgctgggattgctcaatccagggatgcgatctgtatatcggacttggacatttccagtagtgatgctgttatatcgttctgccgcaagaggggagtgggaatggttgtagtgggtcctgaaggtcctcttgttgcgggtcttgtgaatgacctagtaaaggctgggataccaacctttggtccgtcatcagaggctgcggcattagagggatcaaaggactttatgaagaggctgtgtgataagtgcaacatccccactgctcagtatcgcacattcacggatcctgcagaagctaaacaatatgtcaaggatcaaggggcccctatcgttgtcaaagccgatggattggctgctgggaagggcgttgttgttgctatgactttggatgaggcctttgaagcgataaactctatgatggttgaagagtcattcggttctgctggttcacgggtcatcattgaagagtatctagagggtgaagaagcctctttctttgcattagtagatggtgaaaatgctttgccacttgaatcagcacaggatcacaaaagagttggtgatggtgatactggtccaaacacgggtggtatgggtgcatactcccctgcgccaatagtgacggaagagcttaagagcacgatcatggaaactataattattccaactgttaaaggtatggctgctgaaggatgcaagtttgttggtgtattatatgccggtcttatgatagagaagaaatctgggctgcctaagcttattgaatataatgtgcgatttggggaccctgaatgccaggttctgatgatgagattagagtctgatcttgcacaggtcctgctatccgcatgcagaggagaactgggcaaggtttcactaacctggtcacctgaaatcgcgatggtggtcgtgatggcgagcgaaggataccctggctcttataagaaggggaccgtaataaaaaacatcgacaaggccgagcaggtttctccggctgtcaagatattccatgctggaacagctttggatggagacggcaaccttgtagctgtcggtggccgagttcttggcgtcactgccaagggcaaggacatcgaagaagcgaggtcgagagcgtatgatgcggtagatgtcgtcgactggccagaaggattcttcaggcgagacatcggctggagggcgctgaaacaggagcagacggctagctactgataatgtttccttaaagctgggttgagcttccagcgtcaagtgaaatgaacacagtagagtcaccattgttgcggttgcggaattgacgggagcttgagcttcttttgaccatggtttagctctgaaccatctgtagcagtcttgtgttttccacaaggcaggcaacttcgtcaagtgcaactatcttttgatgtgcaataataataccacc

SEQ ID NO: 2735 - DNA, 1565 bp, Triticum aestivum
aatgtctccagtaatgcagtgcagcacgtcgcccgccattatcatttgactgtccggaattctgaaagatggcgctcgatcccgaaagcttcgccagaggacgggaccgccgttgctgaagggaggatgactgtactcgtcattggtggcggtggaagggaacatgcgctctgttatgctttgacccgttcgccttcttgcgggacagttttatgcgcccctggcaatgctggcattgctcagtccagggatgcgatctgtatatcggacctagacatttccagtagtgatgctgttgtatcgttctgccgcaagaggggagtgggaatggtggtagtgggtcctgaaggtcctctcgttgcgggtcttgcgaatgaccttgtcaaagctgggataccgacgtttggtccgtcatcagaggctgcagcattagaaggatcaaaggactttatgaagagactgtgtgataagtgtaatatcccgactgctcagtatcgcacattcacggatcctgcaaaagctaaagagtacatcaagaatcaaggggcccctattgttgtcaaagctgatggattggcagctggaaagggcgtcgttgttgctatgactttggatgaggccttcgaagcaattaactctatgatggttgacgagtcgtttggttctgctggttcacgggtcgtcattgaggagtatctggagggcgaagaagcctctttctttgcattagtagatggagaaaatgctttgccacttgaatcagcacaggatcacaaaagagttggagatggtgatactggtccaaacacgggtggcatgggtgcatactcccctgcgccaatagtgaccgaagagcttaagagcgtgatcatggaaactataattattccaactgttaaaggtatggctgctgaaggatgcaagtttgttggtgtgttatatgccgggcttatgatagagaagaaatctgggctgcctaagcttattgaatataatgtgcgatttggggatcctgaatgccaggttctgatgatgagattggagtctgatcttgcacaggtcctgctatctgcatgcagaggagaactgggtaaggtttcgctaacctggtcacctgaaatcgcgatggtggtcgtgatggcgagtgaagggtaccctggctcttataagaagggaaccgtgataaaaaacatcgacaaggccgagcaggtttctcctgctgtcaagatattccatgctgggacagctttggatggagacggcaaccttgtagctgtcggaggccgagttcttggcgtcactgcgaagggcaaggacatcgaggaagcgaggtcgagagcgtacgatgcggtagatgtcgtcgactggccggaaggattcttcaggcgagatatcggctggagggcactgaagcaggagcagacggctaactactgattagttaggtttcctaaatctggggtgagcttccagcgtccagtgaaatgaagacaatagagccaccattgttctggttgcggaattgacaggagcatagcttctcccgtcgaacatgagcatctttt

SEQ ID NO: 2736 - DNA, 2360 bp, Oryza sativa
gttgtggtatttgggccttcactgaacaaccctgcccagcccatcgctgctttactcccccatcaacgccgctcgctcactactcgcgccgccgcttccgccgccgctccgctccagtcgcgtcggcttcccgcctcctcgccggcgagccgtgcctcgacgctctccctctgttgctccgccggccagcagcatgccgcgcttctgctcccactagctcccgccaccgccgcccctactgagcccggtgagaccgtgaggcggtggtgtgcaccagtccggcagttcgcccccctcctcctcccaatccggccgccgcttcatcaccgccggcgaggctccgcgtctcctcctaggtcgcgctgcttcgtatcacagagagaggccagctcggtctccggataagcaagaaccatggcgtctgctgctgccgcttacggcgtcggggctccactcaagctcgctgcaaggcggcatggggcactcgcgctggccggtagccatcgctgcagtggatggaagtcttcagtgtcttgccctgttcctcaggcttggatgggcagttgctcttctgtcgcaatgcgccgtgtcgcctccggttctcgattgattgttcaggcttcaaacagcgggggctcaagcttgaaggcatcattggctgatgctagcctgcttactgaagagaggataactgttttggtgattggaggtggaggaagggagcacgctctctgttacgccttgaatcgctctccgtcttgtgatgcggtcctatgtgcccctgggaacgcaggtattgctcagtctggagatgcgacctgtatatcggacttagacgtctccgatagcgatgccgttatcgcgttctgctgcaagaggggagtgggaatggttgtagtaggtcctgaagctcctcttgttgccggtcttgtgaatgaccttgtgaaagctgagataccagcatttggtccttcctcagaagctgcggctttagaaggatcgaaggactttatgaagaaattatgcgataagtacaatattcctacagctaagtatcgcacattcacagatcctgcagaagctaaacaatatgtcaaagatcaaggcgcccctattgttgtcaaagctgatggattggcagctggaaaaggcgtggttgttgctatgactttggatgaggcatttgaagccatagactctatgctggttcaagggtcatttggttctgctggttcacgggttatcattgaagaatatctggagggtgaagaagcctctttctttgcattagtggatggtgaaaatgcattgccacttgaatcggcacaagatcacaaaagggttggtgatggtgatgtaggcccaaatactggtggtatgggtgcatattcccctgcaccaatagtgacagaagagcttaagcacacaattatggatagtataataatcccaacagttcaaggtatggcagctgaaggatgcaagtttgttggtgtattatatgctggacttatgattgagaagaaatctggtctgcctaagcttatcgagtacaacgtacgattcggtgacccagaatgccaggttcttatgatgcgattagaatccgatctagcacaggttctgatgtctgcgtgcagaggggaactgggcgatgtttcactaacctggtcacctgaaatggcaatggtggttgtgatggcaagcgaaggataccccggatcttataagaaggggactgtaataagaaatctcgagaaggccgagcaggtctcgcccgcggtaaaaatattccatgctggaacagcactggatggggatggaaatcttgtcgctgtcggaggccgggtgctcgggatcacggctaagggcaaagacattgaggaagcacgggcaagagcatatgatgcagtagatgttgttgactggcctgaaggattcttcaggcgcgatattggttggagagcactgaagcacaagcaagtggccaattactgatgcggattttcctgagcacaccacaactatggtgagcatgtaatgttaagagcaataaagagaaaatttgtcacttctgtggttgaggaaaggcaaaaccatagctcaaatttgagtttttttttttgtaccaactgttaaatttgagttgggcttgcattttgaggaacagccagatgaacaatgaccgagttttgacttccacaagtagagagagagcattgttcggtgcttaatatctacttccgttggttagtggtattaagggattccatatgtaagtcgttttagacttgtgcacaagaattaagataacaatctcaatgattttgttacccttcatttaaacaaaaaaaaaaaaa

SEQ ID NO: 2737 - DNA, 2609 bp, Sorghum bicolor
cgggtaccgggcggggaggccatctgtccatagaaacaagcctggatttaggcccagaccgccgccgccgccgctgccaccaccagagcggagagctaaccagttgctcacttccccgcccgagctttctccagactgcgctgacggccgcggtccgccggccaccgtgccttctccaggccgcgccgacgccccgcgaagaagaagacctcggttgcgctggcgcccgtcgcgaagccccctccggcaagaagctccgaaagcaggcggcggaccctcaagctcgtgcgctgagtctcggaagctaagagggttgtaagagcatctgccgcgggaacaaagggctagtacttttcaatcctttgctctgcttgttcagtgccagattataccgaattgcatactgtagaaattggctaggactatcctggtccgccactggtcatggcgtgtgctgcttacagtatcagaggccctctcaagctcgctgcaaggcaccgcttggatgtgttgactagtaacaactcgtgcaatggcttcaagtcttcagtgtcataccccgtcgctcagaggtggagcagcaactgctcatccatcacaatgcggcatgtcgcctcccatcatcacttgattgttaaggcttcagcaatgttgcactcaaaagcttcagcaactgatgcagccacggcttccgatgagaggataactgtactggtcattggtggtggaggcagggagcatgctctttgtcatgccttgaaccattccccatcatgtgctgcagttctatgtgcccctggtaatgctggtattgctcagtccggggatgcaacatgtatttcagatttggacatctccagtagtgatgatgttatctcattctgccgcaataggggtgtgggaatggttgtagtgggtcctgaagcccctcttgtcgccggtcttgcaaatgatcttgtcaaagttgggataccaacctttggacctacatcagaggctgcagcattagaaggatcgaaggacttcatgaagaagctgtgtgataagtacgatatccctacagctaagtatcgcacattcacggatgctgtggaagctaaaaaatatgtaaaaaatgaaggagcccctattgttgtcaaagctgatggtctggcagctggaaagggtgtggttgttgcaatgactttggatgaggcgttggaagccatagactctatgttggttgaaggctcattcggttctgctggttcacgggttatcattgaagaatttcttgagggtgaagaagcctctttctttgcattggtagacggcgaaaatgctttgcctcttgaatcagcacaggatcacaaaagagttggtgatggtgatgttggcccaaataccggtggtatgggtgcatactcccctgctccaatagtaacagatgagctcaaacgcattgtaatggaaagtataattatccctactgttaaaggcatggcagccgaaggttgcaagtttgttggtgtattatacgctgggcttatgatcgagaagaaatctggactgcctaagcttattgagtacaatgtaagatttggtgacccagaatgccaggttctgatgatgcgattagaatctgatttggcacaagttctgttatccgcttgccagggagagttaggcaatgtttcactaacctggtcacctgaaatggcaatggttgttgtgatggcaagccagggataccccggctcttataagaaggggaccgtaataaaaaacgtggacaaggctgagcaggtgtctccagctgtcaagatattccatgctgggacagcactagatggagatggcaatcttgtcgccgttggagggcgagttcttggtgtcactgccaaaggcaaggacatcgaagaagcaagggcaagagcatatgatgcggtagacgctgtccagtggccagaagggttcttcaggcgggacattggttggagagcactgaagcagaagcaagtggctaactagtagctagctacccatgaccatgagattttccaagagaaccacaactatggtgagcttgtagtgtttacgagtaataaaaagggaaacggtgtaacattccctgtttttggttgtggaaagacaaaagtattgctggtcaaacagcagcttgttaaagttttaacgcctgctgatttcagcatgatttggtacatgtttgcactgagattgtgttcggattccagacaaaacagcaccatctaaattctgaccaatcgtcttcagtttccggataagtggacctcccaaataattgtgatatctcaaaccaaacaaagttcagtgggatcgacacgtcgcacttcgtccttgaatcaagcacacggtaaaaatgctaatgatgcttctgttttgttttcatattgtgtactacactcgttggaccagttcgatcatctgaaagtaaaaaacagatgtgcagacagccctagagcaggaatattgctaacaacggccaacttaggccacgctgtatttgtatgtactcgtttagatataatagtcaccaagctagatcatcagtcacagtacggtaattaaagtgtaaagatctggtgagt

SEQ ID NO: 2738 - DNA, 2109 bp, Setaria italica
cggactcctctccacagccacagcagggccttcttctccgtccgagctcagccgcgctcttttcccctccttctccaattcgtgctcgtccagctctggtggatagtggtagacggccggcgacgagttggcatacaggacctcctgctgccaatcaaggtgcggttacagcttgttttccagaaattttgggggtttgagctgaagccccgtgccgcaaaccaatcctgcccctgccatggcgtacactgcttacagtatcaggggccctctcaaactcgctgcaaggcacggctccgatgtgtattattcgtgcaacggtttcaagtcttcggtatcttaccccgttgctcaggggtggagcaggaattggtcttcggttgcgacacggcatgtcacatcacattgtcaattgagtgttcgggcttcagcaaggtggcgatccaccctgaaagcttcagcaaccgatgcaggcattgtcactgatgagaagataactgtattagtcattggtggtggaggcagggagcatgccctttgctatgccttgaaccgttccccgtcttgcaatgcagttctatgcgcccctggtaatgtgggtattgctcagtccggggatgcaacctgtatctcagacttggacatctccagtagcaatgatgttatctcgttctgtcgcaagaggggagtgggaatggttgtagtgggtcctgaagcccctcttgtcgctggtcttgccaatgaccttgttaaagtcgggataccaacctttggcccttcttcagaggctgcagcgctagaaggatccaaggacttcatgaagaagttgtgtgataagtacaatatcccaacagccaagtatcggacatttacggatgctgtggaagctaaaaattatgtcaaacatgaaggagctcctattgttgttaaagctgatggactggctgctggaaagggtgtggttgtcgcaatgactttggatgaggcattcgaagccatagactctatgttggttgaaggttcatttggttctgctggttcacgggttattattgaagagtttctggagggtgaagaagcctctttctttgcattggtagatggtgaaaatgcgttgcctcttgaatcagcacaggatcacaagagagttggtgatggtgatgttggtccaaatactggtggtatgggtgcatattcccctgcaccaatagttactgatgagctcaagcacattatcatggaaagcataattatccctaccgttaaaggtatggcagcagaagggtgcaagtttgttggtgtactatatgctgggcttatgattgagaagaaatctgggcttcctaagcttattgagtacaatgtaagatttggtgacccagaatgccaggttctgatgatgcgattggaatctgatttagcacaagttctgttatccgcttgccggggagatttaggcaatgtttcagtaacctggtcacctgaaatggcaatggtggttgtgatggcaagccagggataccctggctcttataagaaggggactgtaataaaaaaccttgacaaggctgagcaggtctctccagcagtcaagatattccatgctgggacagctctagatggagatgggaatcttgtcgccgttggaggccgagttcttggtgtcacagccaagggcaacgacatcgaagaagcaagggcaagagcatatgatgcggtagacgctgttgattggccagaagggtttgttaggcgcgacattggttggagggcgctgatgcacaaggaagcggttaactactcatgagattttacttgataaccacaactacagtgtgcttgtactgttatgagtaataaaaaggcaaacggtgtaactgttactgcttttggttgtgggaagataaggatttgctgttgaaacagcagcatgttcagattgtaacaattgctgatggcagcaggattcagttgatgtttgaactgattttgtgatcagagtctagacaaacacttgagcgaaatcagcaccatctgaattctgaccaattttgtcatacacagtttttgtacaagtggatctcccaaataattgtcacatctctacac

SEQ ID NO: 2739 - DNA, 2161 bp, Zea mays
aatggagggcatcagacaaacaaacagaacctttaaagtgccagaccgccgcatccgccgccactagcggagactgccccgccgcgctttctccaagttcagctgacggccgccgtgcctactccaggccccgccgacgccctgtgaagaagaccctggttgcgctggcgcccatcgcgagcaagaagctctgaaactcgacggcggagcctcaagctcgtgcgccgaagttcattctttcgccctgtagaaacaaagggcagaaattggctaggactatcctggccccccactggccatggcgtgtgctgcttacagcatcagaagccctctcaagctcgctgtaaggcacggctcggatgtgttgagtagcaacaacttgtgcaatggctttaagtcttcggtgtcttacctcaattctcaacgttggagcagcaactgctcagccgtcacaatgcggcatgtcgcatcccattgtcactcgattgttaagactccagcaatgtggccctcaaaagcttcagcaactgatgcagccacagcttccgatgagaggataactgtactggtcattggtggtggaggcagggagcatgctctttgttatgccttgaaccattccccatcatgtgctgcagttctatgtgcccctggtaatgctggtattgctcagtcccgggatgcaacatgtatcccagatttggacatctcgagtagtgatgatgttatctcattctgccgcaagaggggagtgggaatggttgtagtgggccctgaagcccctcttgtcgcgggtcttgcaaatgaccttgtcaaagttgggataccaacctttggcccttcatcagaggctgcagctttagaaggatcaaaggacttcatgaagaagctgtgtgataagtataatatccctacagctaagtatcacacatttacggatgctgtggaagctaaaaaatatgtaaaaaatgaaggagcacctattgttgttaaagctgatggactggctgctggaaagggtgtggttgttgcaatgactttggatgaggcgttggaagccatagattctatgttggttgaaggctcattcggttctgctggttcacgggttatcatcgaagaatttctagagggtgaagaagcgtctttctttgcattggtagacggcgaaaatgctttgcctcttgaatcggcacaggatcacaaaagagttggtgatggtgatgttggcccaaataccggtggtatgggtgcatactcccctgctccaatagtgacagatgagctcaaacgcattgtaatggaaagtataattatccctactgttaaaggcatggcagccgaaggttgcaaatttgttggtgtattatacgcagggcttatgatagagaagaaatctgggctgcccaagcttattgagtacaatgtaagatttggtgacccagaatgccaggttctgatgatgcgattagaatctgatctggcacaagttctgttatctgcttgcaaaggagagttgagcaatgtttcactgacctggtctcctgaaatggctatggtggttgtgatggcaagccagggataccctggctcttataagaaggggaccgtaataaaaaacgtggacaaggctgagcgagtgtctccagctgtcaagatattccatgctgggacagcagtagatggtgatggcaatcttgttgccgttggagggagagtccttggcttcactgccaagggcaaggacatcgaggaagcaagggcaagagcgtacggtgcggtagacgctatcgagtgggtagaagggttctgcaggcgtgacattggttggagagcactgaggcagaagcaagtggctaaccagtagctattccatgaccatgagatttccccagagaaccgcaactacggtgagcctgtactgtttacaagtaataaaaagggaaacggtgcgacccccattgtttttggttgtggaaagacaagtattgctgatcaaacagtagttaacacctgttgatttcagcatgattcggtatatgtttgcaccgatattgtgttcagagtccagacaagcgctagagtgaaaacagcgcgcgccatctgaattctgaccaattgtcttcagttatcggataagtggacctttccaaataattgt

SEQ ID NO: 2740 - DNA, 2737 bp, Panicum virgatum
cagctttgtgttagggtttcaaacttatccatccacatttcttccctcactcccaaatcctccctccgtgcgccgccaggggctcgtctgcctctcctctccctccgcgcgctgccaggggcctgtccgctccgccccccagcccccctcctcggctccgcggcgaacggcgccgccgccggtgcacccggcctaccccctcatccttcctccctctcggccgcgcgccaccctcgttcctcgtcacctcggattcgtcacctcgccaagcgcaccgccatcgggttctcgtcgtgcctgggctggaccggccgccgccgcgggggcctcgccgtccgtggaccggcaggcgccgcgggaggcctcgccgtccctggaccagcaggcgccgcgggggccctcgccgcccctggaccggcaggcgccgcgggagccctcgccgccccctcgactggcggccgccacggggctcgcagttcctggatccgccgccgccttgagggccctgcagccgccgcgacgggactctgcgggtacaggcatacccgcgggcacgtgacatccgcggatagggattttacccgttgccatctataagagatcgacattagttggcacacaggacttgttgctgctcaataaaggtgcggggtgcagcttgtgttccacaaattttgggggatcaagcgaaccccgtgccgcaagccgaccacgcccctgccatggcgtctgtggcttgcagtataaggggccctctcaaactcgctgcaacgtgtggcaccgccgctgtgtattattcgtgcaacggctacaggacttgggtgtcttaccccgttgctcaggggtggagcagcaattgctcttcggttgcgacgcggcatgtcgcatcccattgtcaattgagtgttcgggcttcagcaaggtggcaatccaacctgaaagcttcagctaccgatgcaggcattgtttctgatgagaagataactgtactcgtcatcggtggtggaggcagggagcatgctctttgttacgccttgaaccgctccccgtcttgcactgcagttctatgcgcccctggtaatgcgggtattgctcagtcaggggacgcaacctgtatcccagacttggacatctccagtagtgatgatgttatctcgttctgtcgcaagaggggagtggaaatggttgtagtgggccctgaagccccgcttgttgccggtcttgctaatgaccttgtcagagttgggataccaacctttggcccttcttcagaggctgcagcactagaaggttccaaggacttcatgaagaagttgtgtgataagtacaatatccccacagccaagtatcggacattcacggatgccacggaagctaaaaaatatgtcaaacatgaaggagcccctattgttgttaaagctgatggactggctgctggaaagggtgtggttgtcgctatgactttggatgaggcatttgaagccatagactctatgttggttgaaggctcatttggttctgccggttcacgggttatcattgaagagtttctggagggtgaagaagcctctttctttgcattggtagatggtgaaaatgcattgccacttgaatcagcacaggatcacaaaagggttggtgatggtgatgttggcccgaatactggcggtatgggtgcatactctcctgcaccaatagttacagatgagctcaagcgcatggtcatggaaaatataattatccctaccgttaaaggtatggcagcagaagggtgcaagtttgttggtgtactatatgctgggcttatgattgagaagaaatctgggctgcctaagcttattgagtataatgtgagatttggtgacccagaatgccaggttctgatgatgcgattggaatctgatttagcacaagttctattatccgcttgccagggagaattacagaatgtttcactaagctggtcatctgaaatggcaatggtcgttgtgatggctagccagggatatcctggatcttatattaaggggactgtaataaaaaacctcgacaaggctgagcaggtctctccagctgtcaagatattccatgctgggacagcactagatggagatggcaatcttgtcgctgttggaggccgagttcttggtgtcactgctaagggcaaggacattgaagaagcaagggaaagggcatatgatgcagtagatgctgtcgattggccagaaggatttttcaggcgtgacattggttggagagcactgagacactcatgagattatcatagtggatttattttttaaaaaaggattatcatagtgaaccacaacttggcgagcttgtactgttatgagtaataaaaagggaaacggtgtaatgtcactcctttttggttgtgggaagataaagatttactggtgaaacagcagcaattttaaaaattgctgatagcagcatgatttggtagatgtctgaactgatgttgtgttccgtgtccagacaaacacttgagtgaaaacagcaccatctgagttctgaccaattttttttcttcctcaatctttggataagttgatctcccaaatgattgtcacatctctgcacatgtttttgtctgagatattgtccattataatacctatggtgcttctcctttttgatcactgtctgctgtacaaagtttcacttctgttttaatcaatgccaacatttctaactagagctacttaaaatttga

SEQ ID NO: 2741 - DNA, 2698 bp, Panicum virgatum
ctgcatttgaacgttaatgattgtcagaaaatttgtcttttttgtaactgcaagtgtaagatgaatttgatcgtgaaaatttatatatagatgagatagaccgagatgtacattcatgatttttttcaaaattttttgaagatctttttagtttgattgcacggtgctttcaccagttcggtgattgcaccagatatgcctcccatcccccctcctcccaaatcctccctccgggcgccgccaggggctcgtctgcctcttttcgccctccgcgcgctgccaggggcctgtccgctccgcccccaagcccccctcctcggctccgcggcgaacggcgccgccgccggtgcacccggcccaccctccttcctccctttcggccgcgcgccaccctcgttcctcgtcacctcgccaagcgctccgccatcgggtcctcgtcgtgcctgggctggaccggccgccgccgcgggggcctcgccgtccgtggaccggcaggcgccgcgggcgccctcgccccgcgcggattttacccgtttccatctatactccccagtgaggcatacgggcgaccgctccagtgaggttcttgttctgcgttccattgggttcttcttcagcactagcactagagatcgacattagttggcacacaggacttgttgctgctcaataaaggtgcggggtgcagcttgtgttccacaaattttgggggatcgagcgaacccctgcgccgcaagccgcccccgcccctcccatggcgtctgccgcttgcagtataaggggtcctctcaaactcgctgcaacgtgcggcaccgctggtgtgtattattcgtgcaacggctacaggacttgggtgtcttaccccgttgctcaggggtggagcagcaattgctcttcggtcacgacgcggcatgtcgcatcccattgtcaattgagtgttcgggcttcagcaaggtggcaatccaacctgaaagcttcagctaccgatgcaggcattgtttctgatgagaagataactgtactcgtcattggtggtggaggcagggagcatgctctttgttacgccttgaaccgctccccgtcttgcattgcagttctatgcgcccctggtaatgcgggtattgctcagtccggggacgcaacctgtatcccagacttggacatctccagtagcgatgatgttatctcgttctgtcgcaagaggggagtgggaatggttgtagtgggccctgaagcccctcttgtcgccggtcttgctaatgaccttgtcagagttgggataccaacctttggcccttcttcagaggctgcagcactagaaggaccaaggacttcatgaagaagttgtgtgataagtacaatatccccacagccaagtatcagacattcacggatgccgcggaagctaaaaaatatgtcaaacatgaaggagcccctattgttgttaaagctgatggactggctgctggaaagggtgtggttgtcgctatgactttggatgaggcatttgaagctatagactctatgttggttgaaggctcatttggttctgccggttcacgggttatcattgaagagtttctggagggtgaagaagcctctttctttgcattggtagatggtgaaaatgcattgcctcttgaatcagcacaggatcacaaaagggttggtgatggtgatgttggcccaaatactggcggtatgggtgcatactctcctgcaccaatagttacagatgagctcaagcgcatggtcatggaaaatttaattatccctaccgttaaaggtatggcagcagaagggtgcaagtttgttggtgtactatatgctgggcttatgattgagaagaaatctgggctgcctaagcttattgagtataatgtgagatttggtgacccagaatgccaggttctgatgatgcgattggaatctgatttagcacaagttctgttatccgcttgccagggagaattacggaatgtttcactaagctggtcatctaaaatggcaatggtggttgtgatggctagccagggatatcctgaatcttatatgaaggggactgtaataaaaaacctcgacaaggctgagcaggtctctccagctgtcaagatattccatgctgggacagcactagatggagatggcaatcttgtcgctgttggaggccgagttcttggtgtcactgccaagggcaaggacattgaagaagcaagggaaagggcatatgatgcagtagatgctgtcgattggccagaaggatttttcaggcgtgacattggttggagagcactgagacactcatgagattatcatagtggatttatttaaaaaaaaggattatcatagtgaacaacaacttggagagcttgtactgttatgagcaataaaaagggaaacagtgtaatgtcactcctttttggttgtgggaagataaagatttactggtgaaacagcagcaattttaaaaattgctgatagcagcatgatttgatagatgtctgaactgatgttgtgttccgtgtccagacaaacacttgggtgaaaacagcaccatctgagttctgaccaattttttttcttcctcaatctttggataagttgatctcccaaatgattatcacatctctgcacatgttttttctgagatattgtccattataatacctatgatgcttccccttttttatcctatgct

SEQ ID NO: 2742 - DNA, 3407 bp, Sorghum bicolor
tccatctatggactattggtagcctcacttctaccagtatacaattttcttctctgtctcgcccggtcccggtctcctcccctgcctgttctaccactaccagtcctcccacatccttcctccccctcttgccaagaccaagattcacgcgaaataaaccttacaattgcagaggagaagagaagacgccatggcacatgcgagaaggtggagctgcggttggctgccttgatgactagctagctgcctctccgtctgccatcggccatctccatcggagaaacacaaaggattaaacgaatcagaggagccagacgcccccccgaatcgccggaaaagatcaagatgcggcctttgcggcgaagctccggggatcttgcggccttcggctgctgcctcttcctcctcctcccgctgctgtcccgcggcgccgacatgccggtgggttcgaccctgtcgccgggcaactcggcgacgtggacgtcgcccaacagcaccttctcgctcggcttcacggcgtccgcgtcctccccgtcgctcttcgtcgccgccatctcctacgccggcggagtgcccgtctggtccgcgggcgatggcgccgccgttgactcgaggggctcgctccgcctctcgtccaacggcgacctccagctcgtcaacggctccggtaccgtgctctggtcgaccaacacggggggtcagaacgtgtccgccgcggccgtccaggagagcggcaacctcgtgctcaaggactcccgcggcgccacgctgtggcagtcgttcgaccaccccaccgacacggtggtgatgtcgcagaacttcacctccgggatgaacctcacctcgggctcctacgtcttctccgtcgacaaggccacgggcaacctcacgctccggtggaccagcgccgccaccaccgtcacctacttcaacaaggggtacaacacctccttcacggggaacaagacgctgacctcgcccacgctcacgatgcagaccaacggcatcgtctccctcaccgacggcaccctcacctcccccgtcgtcgtcgcctacagcagcaactacggcgagagcggcgacatgatgcggttcgtccgcctcgacgcggacggcaacttccgcgcctacagcgccgcccggggcagcaacaccgccacggagcagtggtcggcggtggcggaccagtgccaggtgttcggctactgcggcaacatgggcgtgtgcagctacaacggcacggcgccggtgtgcgggtgcccgtcgcagaacttccagctcaccgacgcttccaagccgcgcggcgggtgcacgcgcaaggccgacctcgccagctgccccggcaactccaccatgctccagctcgacaacacgcagttcctcacctacccgccggagatcaccacggagcagttcttcgtcggaatcaccgcctgccgcctcaactgcctctcgggaagctcctgcgtcgcgtccaccgcgctctccgacggctcgggcctctgcttcctcaaggtctccaacttcgtgagcggctaccagtcggccgcgctgcccagcacgtctttcgtcaaggtctgctacccgccgcagcccaacccggtcccgggcagcaccacaggcgcgccgtcgcggggcggccccggcgtccgcgcctgggtcgtcgcggtcgtggtcctggccgtggtctccggtctggtgctctgcgagtgggcgctctggtggttcttctgccggcacagccccaagttcggtccggcgtcggcgcagtacgcgctgctggagtacgcgtcgggcgcgccggtgcagttctcgtaccgcgagatgcagcggtccaccaaggggttcaaggagaagctgggcgccggcgggttcggcgccgtgtaccgcggcgtgctggcgaaccggacggtggtggcggtgaagcagctggaggggatcgagcagggggagaagcagttccggatggaggtggccaccatcagcagcacgcaccacctcaacctggtccgcctcatcggcttctgctccgagggccggcaccggctgctggtgtacgagttcatgaagaacgggtcgctggacgcgttcctcttcggcggcgaccgcgacgcgccgccgccgggcgggaagatgccgtggccgacgcggttcgcggtggccgtcggcacggcacggggcatcacgtacctgcacgaggagtgccgcgactgcatcgtgcactgcgacatcaagcccgagaacatcctcctggacgagcacttcaacgccaaggtgtccgacttcgggctggccaagctggtgaaccccaaggaccaccgccaccggacgctcaccagcgtgcgcggcaccaggggttacctggcgccggagtggctcgccaacctgccgatcacggccaagtccgacgtgtacagctacgggatggtgctgctggagaccgtcagtggccgccgcaacttcgacgtgtcggaggagaccggcaggaagaagttctcggtgtgggcgtacgaggagtacgagaggggaaacctcgccggcatcgtcgacaggaggctccccgcggaggacctcgacatggcgcaggtggagcgcgctgtgcaggtgagcttctggtgcatccaggagcagccggcgcagcgcccgtccatggggaaggtggtgcagatgctggaaggggtcatggagctggagaggccgccgcccccgaagtcgtccgacagttttctgagcaccaccacggccaccagtgccgtcagctccagcatggtctcgacggtcgtctcgtcgggggctccggtcgcgcccgcgccatcgcccaccctggagcaggagatggcgctgggccgctccgagtcggccaggaaccgtgagcgcgtgtcgcggcagctgctgtcgccgcagccgtacatgacgatgtgaaaaggcgcgtgtgcgtcatcctcatccgatccatggcagagatcatcatcatccggcgaactggatagcaaagcaaaatgatcacacgcaggcatccattcccaggaagaggaaaatgtacagatttgtagagcggttagggaatcgacgatatgatttgctctaagctctggctggcgaaccttggcggcagaacaaactgatctttcactggtactgtggcttccatatggcaatactatgtaattgtaagcttcaaattcagatcgagcttgatgttgagcaatgcaatttgtacaaaataaccggcatattttagtatggactgtttgtttcaaaaactgatgcagtagtttttttaataacaattttgtttacctcatcaagggaagttcagagcagctcttgaggcaaatagattgtatcataaataaattcataataataatgcggagctgttagagagtttgactatcagtactgaa

SEQ ID NO: 2743 - DNA, 1450 bp, Triticum aestivum
agccgcacggggccgcgtgcgtgcgcctcatgtgcagcttcggcggccgcatcctgccgcgcccgggcgaccaccggctccgctacgtcggcggcgagacccgcatcgtctccgtcccgcgcaccacctcccacgccgtcctcttcgccgcgctcgccaagctcgcccccgcgctcttcgtccccggcgagcccaccccggcgctcaggtaccagctcccgcacgacgacctcgacgcgctcatctccgtctcctccgacgacgacgtcgacaacctcatggaggagctcgaccgcgtccacagcctcgccgccaccgccatcaagccgccccgcctgcgcctcttcctcttcgccgcctcgccggaccacccctccgcgggcgcgttcggctccgtgctctccggtgtcggcgacgcctcctccgaccagtggttcgtcgaccagctcaacgccccgccgcccggttccatcgagcgcggccgatccgaggcctcctcgatcgtctcggaggtcccggactacctcttcggcttcgacacgacctccgaggagcccagccccggcgcgggtgcgcagcccaagtctgacgcggaggtggcgcaaggcgacgatgacgacgacgcgccggctcccgtgctgggcgctcctctggtgccatacgtcccggagagcgccccgtggccggccccgcctccaccgtacatggcgcagccggtgtactacgtgcctgtgcgcccggtccactacctcaacgcggctgcgcacggcggctacatgcccgggccggtttaccacattgtcggtggagggagaaacgaaggcccgggagatctctactcgtctgggggcgtcggtggcgtctacggcgtcccccgctccatgccgccattccgtcaggtgatgtacgcgccgccacccgccacggaagcctactcggtggaggggaagccgccggaaggtgagtcccactctccgtaggcgcaaggggaggaagagtcatggccgtggtagattctgatgatcgcatgggctgttcctgaagccggttaattctgatgatcgcttatatttgagctaagatttttgcattgccgtggtaaatgttcactgtttctgctggggttactcttggtagctgtatagatgagggaggtggaggatggatgggtcatggatatcacaattttcgtcgagtgaaatagattcttgaattgttattatgtgagtacatttggtgtgattagtactagcaagtttactgtaatgtgggattggattcatatatattctactagaagattttttatctgcgaaacacaatgtttctgcattttgtattcatatgcttgatgctggatgtatcatggtccatgaatgtcctatatatctactctagctttgatgcgaatgtttgcgcatttgttctcgtgaaagcttaatgtactgaa

SEQ ID NO: 2744 - DNA, 1377 bp, Triticum aestivum
cgcaccctccgctccggccatcctccaaaccgtcagcactcaggccaccggagcttcgctcgccgaccgactcgactcggccggcgatggggaggacgctggacgtgctgctgggccgaacaacgaagcagacggcgcggctcaagtccctcctgcacctcgccacgaagcggatcgcggtggtgcgcgcgcaccgggaggtgcggtgcgcgcaggcgcggggggacgtggagcagctgctgcggcagggccacccggaccgggccctcctccgcgccgagcaggtgatccgggagcggggcacgctcgacgccctcctcctgctcgacgcctactgcgcgctcctcgccgaccgctccgccctgctcgacgacgcgcaccgggactgccccgacgagctgcgggaggccgcggcggggctctgctacgcggcggcgcgctgcggggacctgcccgagctgcaggaggcccgcgccctcctcgccgccaggttcggccggggcttcgcgtccggcgccgccgagctgcgcgccggctgcggcgtcaacgccaagctcgtgcagcggctctccaccgcgctgcccagcctcgagagccgccagatggtgctcctcgagatcggcgccgacaaggacatccccgtgcgccttcacagcgacgccgccgactcatacgaggatccggccggccgctcccaccatggccatggccacaggaagaagaggcacgacgacgacgacgagcggcggcacgcgacgccgcgggccgaggagccggagggagacaaggccgccacgaagctgacgttcaaagacgtggaagaggcggcgcaggccgcgtttgaatcggctgccacggcggcggcggccgccaaggctgccatagagctctcgcgagcagggtccggcagcaccgacgacaggcacaggaggaacccaggaagggcgcatgccgacgacgagatgctccacggcggcgaggatctggccgatgcaaagaaattcggaaggatcggacatgttcggaactacagctcagacgcagaggatctgccggaggaacgcggagaagagcaggatacgcccaggagcaggccggcttcagtcaggacgaacagaagactctagcagtctagctgcagccatatggccacagcagagatggtttcttgatttagttgtattgattgatagcagttgaactcttgcagctatatattgcagatcattcgttattaaattttgtgtatgccatgtaaatagagaattgggaaagtaaatattaatatgattccgatttttcaccgaagaacagagagcaaaaaccatgagctgatgttgtcagttataggctcctcgatataatttaagatggtga

SEQ ID NO: 2745 - DNA, 1233 bp, Secale cereale
aggacgctggacgtgctgctaggccgaaccaccaagcagacggcgcggctcaagtccctgctggggctcgccacgaagcggatcgccgtggtgcgcgcgcaccgggaggtgcggtgcgcgcaggcgcggggggacgtggagcagctgctgcggcagggccacccggaccgggccctgctccgcgccgagcaggtcatccgggagcgggacacgctcgacgtcctcctcctgctcgacgcctactgcgcgctcctcgccgaccgctccgccctcctcgacgacgcgcgccgcgactgccccggggagctgcgggaggcggcggcggggctctgctacgccgccgcccgctgcggggacctccccgagctgcaggaggcccgcgccctcctcgccgccaagttcggccggggcttcgcgtccggcgccgccgagctccgcgccggctgcggcgtcaacgccaagctcgtgcagaggctctccacggccctgcccagcctcgagacccgccagatggtcctcctcgagatcggcgccgacaaggacatccccgtgcgccttcacagcgacgccgcctcctacgaccacgaggatcccgccggccgctcccaccatggccatggccatggccacaggaagaagaggcacgacgacgacgacgacgacgacgagcgacggcacgcgacgccgcgggccgacgacgacaacaccgactcgccgcggacattcaaagacgtggaagaggcagcgcaggccgcgttcgaatcggcggccacggcggcggcggccgccaaggctgccatagagctctcgcgagccgggcccgggagccccgacgacaggtacaggaggaacccaggaagagcgcacgccgacgacgagatgctccacggcggcgacgatctggccgacgacaaggccttcaagaggatcggccatgttcggaaccacagctcagacgcagaggatctgccggagaagaaacgcggagaagagcaggatacgcccaggagcaggccggcatcagtcaggaccaacagaagactctagcagtttagctacagccatactaccatatggccacagcagagatggtttcttggtttagttgtattgattgattgatagcagttgaactttttgcagctatatattgcagatcattcattattaaattttgtgtgtgcgatgtaaatagagaattgggaaagtaaatattaatatgattccgatttt

SEQ ID NO: 2746 - DNA, 4719 bp, Secale cereale
cgccgccgggaagaccatcgaggagatgtaccagaagaagacgcagctggagcacatcctgctgcgcccggacacctacgtcggctcggtccagaagcacacgcagacgctctgggtctacgaggacggcgccatggtgaaccgccccgtctcctacgtccccggcctctacaagatcttcgacgagatcctcgtcaacgccgcagacaacaagcagcgcgacccctccatggactccctcaaggtcgacatcgacgtcgaggggtgctgcatctccatctacaacaacggggacggcgtgcccgtcgagatccaccaggaggagggcgtgtacgtgccggagatgatcttcggccacctcctcaccagcagtaactacgacgacaacgagcggaagaccaccggcgggaggaacggctacggcgccaaactcgccaacatcttctccacggagttcgtcatcgagaccgctgacgggcaccggctgaagcggtacaggcaggttttctctgagaacatggggaagaagtcggagcctgagattaaaaagtgcaagcagtcagagaactggaccagagttacgttcaagcctgaccttgaaaagttcaacatgaccgagcttgaagctgatgttgtggcactcatgaggaagcgagtagttgatatggccggcactcttggcaaaactgtgaaggttgagttgaatgacgagaaggtgtctgtaaaaagcttctctgattacgtgcaactgtatattaactctgcttccaaagaaggaatcgaactaccaagaatttaccaaaaaataaatgatcgttgggaggtgtgtgtgagtctaagtgaaggccagttccagcaggtcagttttgtaaatggaattgctaccataagaggcggaactcatgttgactacgttgcaaaccaagttgccagccatgtgatgggggttgtgaacaagaagaacaagcaggctaacatgaagttgcatacagtgaagggttacctatgggtatttgttaatgcgctcattgacaaccctgcatttgactcacagaccaaagagaccttaacgactcgtcaagcaaactttgggtccacgtgtgagctttctgatgaattccttaagaaggtctctagctcgggtgttgttaccaatcttctttcttgggccgagttcaaactaagcaaggaacttaaaaagactgatggaaccaagaggacaagtattcttggcatccctaagctggaggatgcaaatgacgctggtgggaagaactctgacaagtgcaccttgatccttactgaaggagattcagcaaaggctctagctatggctggcataggtgtggtaggaagggaccactatggcgtgtttcctctcaggggtaaattattaaatgtgagagaagcaagccataagcagttaatggagaatgcagagatccaaaatataaagaaaatattaggtctgcagcatgaaaagaactatgatagcacgaaaggcttgagatatggccacctcatgataatgacagatcaggaccacgatggttcccacatcaaagggttgttgatcaatttcattcacaaagagtggccatctctcctcaaagttccttctttcttggttgagttcattactccaattatcaaggcaacgaagggaaaaactgtccgtccattttactcaatgcctgactatgaagcatggaaagagtccttaggagcaagtgcaagttcgtggactataaagtactacaaggggctgggaacaagcacagctgaagaaggccgggattactttgaacatattacccttcacaagaaggattttgtctgggcagatgataaagaagattgtgaagctattgagttagcgttcagcaagaaaaagatcgctgagaggaaggattggctgaccaactatcagcctggtacttgccttgatcaacgtgagaaacgcatcaagtacagcgactttatcaacaaagagctgatactcttctcaatggcagaccttgaacggtcaataccttcaatggttgatggctttaaaccagggcagaggaagattttgttttgctcgttcaagaagaatttgattaaagaatctaaggtggcgcagtttattggttatgtgtctgaacactctgcataccaccatggtgagcagagtctagcaagcacaatcgtaggaatggctcaggattttgttggcagcaataatattaatcttttggagcctcgtggccaatttggtaccagaaattcggggggcaaagatgctgctagtgctaggtacatcttcaccagattacaacctatcacccgtataatttttcctaaggatgatgatgttcttctgaactatttgaatgaagatgggcaatcaattgaacccagctggtatctgccaatcattcccatggttttggtcaatggaagtgaaggcattggcactggatggagcacttttgtcccaaactacaatccaagagatattattgctaatctgaaaaggttgctaaatgaggagactattgtaccaatggttccttggtacagggggttcaagggctctttgaaggagacaagttcaaaggcaaccggtgtgacatataccatcactggtgtcatagaggaagttgctgacaccaagcttaaaattactgagctccctgtccgccgctggactacagattacaaagagtttcttgaatccatgtgtcctattcctatcaaggaaaaggaaaagagcaaggacaagaacaaggaaaagaagaaggacaaggacaaggacaaggagaaggaaaaggaaaagagcaaggaaccacctctgttagaggaaataaggtcgcagtgtgatcacgcggatgtggaatttgagcttatactgactgagcaaaacatgaatatagctaagcaagaaggccttgagaagaaattcaagctgactaccacaataggaacaacaaacatgcacttgtttgactcacatggtaaaatcaaaaaatatgacacccccgaggatgtacttcaagagtttttccatttgaggtttgatttctatgtcagacgaaagaaagtaatgttggaaaacatggcgagtgagttgctgaagtatcagaacaaagttaggtttattcttgctgttatatccggggaaatcatagtcaataacaggaagagggcagatctattcaaggagctgaaggatatgaattatgaccctttcccaaagaagaaaccaacgtctgagccagttgctgtagggtctacagaaggtgatgaagataatgatgagagtcctgttgaagctgcaggaagtggttatgagtatcttcttgcaatgtcgattggtaccttgactatggagaaggtgaaggagctcattgcgcagcaggataaggttaaggaagatcttaaaatcctgggtaatactgcgcccaaaactctctggttgagagatcttgacgctcttgagaaggaactggatgtgcttgatgcaaaacttgaagctgaacagaacaacagatctagcaagcgcgccaaaaattctgaagacgcgaagcaatctaaggcagcagccaagaaacagcctaagaaggctgcagccaaatctcagaaggcgaatttggctgggagtgatgatgatgattatgaagcagcgattccgaaacctgcagcacaaaagaagaaaccaccacccaagaaggcaagtgcaccggtgaaagatgaggtgaaagatgaggaggacgaagtggctgaactgaaagaccgcctggctgcttataatatccatagtgacaactctccagaacccagtgccatggaaacagaagaacagcataaaggaaagaaagggaggaatggaccaagcaaaagaggagcagcaaagaaggccatgtcatcctttgctgagatttctgatgaagacgtagccgagcccccccatgagagcgacgatggggggtcttccatggaagttgagaagaaaactaaaggaagaaaacctgccgctgagaagccgaagactaccatcaggaagagggcaccagctcagaccaaagggatgcggcagaaagtgatggaagaaatattcaagcctactgatgacagcaccctcagtgctccttctcctgagaagaaggtgcgaaggatcagagactcccccttcaacaagaagagcggctcggttctgcacagaatggcgagcgcttcaacagggacagaagatggtgaggctcctccctctggcagctctgctgagccagttgcaccaagaaggacaacaagggagaggaaggcggcagtagtctatgtcgcttctgggagcgaagatgatgagtctgaggatgaagacgtgtcggaaccaagcgacgacgatttctctgaagatgactagactccttggcttaaccgcccaaacattgcgtggggtgcagtgactctagtgtcttgagacatttggttagctaatctgatgtattggtgctttgctcaggtgcatctcttgtgcgtcgtatgctatgttaggttgccgagaccaatctgtgagctaatctgtttgagacttgtgcctcaggaatctggcatcaccacttctagttctgatttattcatgcctgagacatgttgcttaccttaaaacgtagacatcctggagcttaatgtcagaattgatgctttatgcctgtcttctgtcagtaaattgggttt

SEQ ID NO: 2747 - DNA, 1654 bp, Setaria italica
tccttgacccaacccacggcacgggctcctccgcctctcgtccaagttctcctcccccaaatcctccgaatccaaagcgattcctccgagccgccgccgccccgatcgcgccgccgaggcggcgtctcccagcgcgcccgtggctccgctcgcgctccggtgggacagacaagagagttgggaatggagatccagtcgtccggccggtccatcgacgtgctgatggagaaggtgctgtccgtcaacatcctctcctcggactacttcaaggagctctacaagttcaagacctaccacgaggtcgtcgacgagatctaccaccaggtcgaccacgtcgagccctggatgaccggcaactgccgcgggccctcctccgccttctgcctcctctacaagttcttcaccatgaagctcaccgtcaaccagatgcacggcctgctcaagcacccggactccccctacatcagagctattggatttctctacctgcgatatgttgctgaaccaaagacactgtgggcttggtatgaaccctacatcaaggatgatgaggaattttcccctggatcaaatggtaaaatgactacaatgggtgtttacgtgcgtgatctcctccttggtcagtactatttcgacagtcttcttccacgagtgcctctcccaattctgcggcaggtcactagccatcttgagaagctgaagcttccaacaaagcagtcaggaatgacaggggattccaatagacatgaatcaaacgatactgcccgaaggcctccttctgtaaaggcttctttgtctgtctcttttggtcagcgtgctccacaccgtgcatctacaagagattcatccccagtccgaagaacattaccttccaaacaggaaaaggaaagaagttatgatggtgaccgtgcaagatcaccaccaaggaagcgccgaagtaggagccgtgagcgtgatcatgattctgagagggaccgttcagatcgtgatcgtggcaggtacaaggatagggactatgatcgacgagctcgtgatcacagtgaccgggaccatcatcgatcaagttattcagatagggatggtgagaggcgaggccgtgaaaagagggacagggattctgacagaagtggacgttcaagcacccgcaggagcaggagcaggagtccagtccgtggcagaactgaaggtgacaaacatcgctctagcccatttggtaaggcaccagaatcatccaacttggcaaagctgaaggatctatatggtgatgcaacaaacacaaagaatgattctggtgatgatcgagctcacagggattctggaactgaggaggtaatccgactgggaggcgcaaggtggaggtgaatctcattctcatgttaaggaacaccccgacactgcatctgggcccatgaattcttgttgtactaacatcaatatttgtcagaaatgacccaagagtaatgggctgtatctgtctcgcactatgggatttccaatatttacctgggaggtttttttcgccattatggtgttaatctttttctgtggaggcaatgctgcttatcagctcatgattgatgctgcaaaatgtttttctcgcgtcagtgtgattgattgtttgctgcatcttgcattacatctgtataagtacaaa

SEQ ID NO: 2748 - DNA, 1880 bp, Setaria italica
agggggtcacacgagaacgcccgccccgccggccccgtgtccctaaccttttctgttccggtggtcgatcgcccaacgttgtacacttcacagcagccgaagcccaaaaggagcaagttcctaggcatcaattccatcctcccctgctggacggcaccaacgacgatggcgggcagggcatggcggccggtgctcgccggcgcttggctcctgctgctgctgctgctgctcccgtcggcttccgccgtccgccggagcgacttcccggcgtcgttcctcttcggcaccgccacttcctcgtaccagatcgaaggtgcatacctcgagggcaacaaaagtttaagcaattgggatgtgttcacccaccaaccagggagaatcaaggatagaagcaccggggacatcgcggatgatcactaccatcgtttcgaggacgatgttgagctgatgcactcgctcggcacaaacgcctacaggttctctatatcatgggccaggattcttccaagagggagattcggcagagtgaacctagcaggcatcgcgttctacgacgaactcatcgattcactcctgcacaaagggatagaaccattcgtgacgctgacccactacgacatcccgcaagagctggaggacaggtacgggtcgtggctcagcgacgagatccagcgagacttcggctacttcgccgacgtgtgcttcgcggcgttcggcgaccgcgtcaagtactgggccaccttcaacgagcccaacgtggctgtccgcaagggctacatgctcggcacgtacccgccggcccggtgctcaccgccgtacggctcctgcgcccgcggcgactccggcgccgagccctacctcgccacccacaacgtcgtcctgtcccacgccaccgccgtcgagatttacaagagaaaataccagagcgagcagaagggcttgatcggcatcgtcatgtccaccacctggttcaaaccgatgacggacgcaccagtggaccggctggcgactgaacgggcgctggccttcgacgtcccatggtttcttgatccaatagtctacggcgactacccaccggagatgcggcagatcctgggctccaggctgccggccttctcgccggacgagagaaggaagctgggttacaagctggacttcatcggcgtcaaccactacaccaccctgtacgccagggactgcatgttttcaccaggctgcccactggggcaggagacccagcacgcgctggcggccgtcaccggagagaggaacgggctccccgtcggacctccaacagcgatgccgacgttctacgttgtccctgaagggatagagaagattgtcacctacatcatgaagagatacaacaatctgcccatgttcatcaccgaaaatggttacgcacaaggcggagatggctatgcccatgtcgaagactggcttgacgaccagggcaggatagagtaccttgatggttacctcacaaaacttgccaaagttatcagggatggagctgatgtccgtggctacttcgtctggtctctcatcgacaatttcgaatggctctatgggtacactctccggtttggacttcactacgttgactaccaaacgcaggaaagaaagcccaagtcgtccgcgctgtggtaccaacggttcctccaaagtctgcttgaagctcagtagaggaatatattgccttatttctaaaatcttgaaaagtgtgtgaccggacatcctggtagtagctcttcatcaatttatgaaaacgaagagcttgatcttgtataaactgattaatcatgaatagaataaaatgtcccgactgtcaacagtcggcatatttcgtacaggaaagaaaaaggatagattcacgtcca

SEQ ID NO: 2749 - DNA, 1839 bp, Panicum virgatum
gcaagccgtcgagagaggatcacatgaaaacgcccgcccctcctcgtcactccaactaacccccctcgtcgtcggctcgtcgcccaacattgtatcctagcaaggaaaagagcttggcagagaaaaggtcctagctagctagcgtatattaccaaaccggagagggtggggagagagagatggcaggcggcgaggtatggcggccgttgctcgccggcgcctggctgctgtggcttctcccgtgggcatcggccgtccgccggagcgacttcccggcggcgttcctcttcggcaccgccacttcctcgtaccagatcgaaggtgcatacctggagggcaacaaaagtttaagcaattgggatgtgctcactcatctaccagggagagtcaacgatggaagcaccggggacatcgcggatgatcactaccatcgtttcgaggacgacgttgagctgatccactctcttggcacaaacgcctacaggttatctatatcatgggccagaatccttccaagagggagattcggcaaagtgaacccagcaggcatcgagttctacaacaaactcatcgacgcactcttgctcaaaggaatagagccgttcgtcacgctgaaccactacgacatcccgcaagagctggaggacaggtacggggcgtggctcagcgccgagatccggcgcgacttcggccacctcgccgacgtgtgcttcgcggcgttcggcgaccgcgtcaagtactgggttaccttcaacgagcccaacgtcgtcgtgcgcaagggctacatgctcggcacctacccgcccgagcgctgctcgccaccgtacggctcctgcgccggcggcgactccggcaccgagccctacctcgccacgcacaacatcgtcctggcccacgccaccgccgtcgagatttacaagaggaagtaccagagcaagcagaagggcctgatcggcatcgtcatgtcgaccacctggtatgagccgctgacggactcaccagaggaccggctggcgactgaacgggtgctggccttcgacgttccatggtttcttgatccaatagtctacggcgactaccctccggagatgcggcagctcttgggctcccggctaccgaccttctccccggaggagagaaggaagctgggttacaagcttgacttcatcggggtcaaccactacaccaccctgtacgccaaggactgcatgttttcagcaggttgcccattgggacagcagacccagcccgcgctggtggccgtcaccgaagagaggaacgggatccccatcggacctccaacaccgatgccgacgttctacgttgtccccgacgggatagcgaagattgtcacctatgtcatgaagagatacaacaacctgcccatgttcataaccgaaaatggttacgcgcaaggcggagatggttacgcccatgtcgatgactggcttgacgaccagggcaggatacagtacctcgacgcttacctcacaaaactcgccgaagttatcagggacggagctgatgtccgtggctacttcatctggtctctcatcgacaattttgagtggctatatgggtacactctacggtttggacttcactacgtggacttccaaacgcaggaaaggaagcccaagtcgtcagcgctgtggtacaaaagattcctgcaaagtctgcatgaagctcaatagaggattatgccttgtttctaaatcttgaaaagtttgagacccaacattatgcttgctcttcaccaattatttatgaaactgaagagcttgatcctgtatatactgattaatcatgaataaagcatccaaactttcctagctgttc

SEQ ID NO: 2750 - DNA, 1704 bp, Sorghum bicolor
atgcacgccggcggcatggcggcggccggtagctggcccagggccagtgcgcggcggctcttgctcgccggcgcttattattcgctcctgtggctgctggatctcccttgggccacggcggcggtccgcaggagcgacttcccggcgtcgttcctcttcggcaccgccacctcctcctaccagatcgaaggtgcgtacctcgagggcaacaaaagcttaagcaactgggatgtcttcactcatgcacctggaagaatcaaagacagaagcaccggagatgttgcggatgatcactatcatcgttacgaggaagacattgagctcatgcactccctcggcacgaacgcctacagattctcgatatcatgggccagagttcttccaaaaggaagatttggcaaagtcaacccagcaggcatcgcgttctacaacaaactcatcgattctctcctgctcaaaggaatagagccattcgtgacgctgacccactacgacaccccgcaagagctggaggacaggtacggggcgtggctcagcgccgaggcgcggcgcgacttcggccacctggcggacgtgtgcttcgcggcgttcggcgaccgcgtcaagtactggagcaccttcaacgagcccaacgtggtggtgaccaggggctacatggtcggcacctacccgccggagcgctgctcgccgccgctgggctcctgcgcccgggggaactccgacgccgagccctacgtcgccacgcacaacgtcgtcctcgcccacgccaccgccgtcgagatctacaagaggaagtaccagagcaagcagaaaggcatgatcggcattgtgatgtccgccctctggttggtgccgctgacggacacgccagtggaccggctggcgaccgaacgggcactggccttcgacgctccatggtttcttgatccgataatctacggagactaccctccggagatgcgacagctgctgggctccaagctgccgaccttctcgccggaggagaggaggaagctgggttacaagctggacttcatcgggatcaaccactacacgacgctgtacgccaaggactgcatgttctcgtcaggctgcccgtcgtcggggcaggagatccatcatgcgctggcggccttcaccggagaaagaaatggaattccaatcggacccccgacagcgatgccaaagttctactttgttcctgatgggatagagaaaatggtcacctacatcatgaagagatacaacaatcttcccatgttcattaccgaaaatggttatgcacaaggtggagatagttataccaatgtcgaagattggcttgacgaccagggcaggatacagtacctcgatggttacctcacaaaacttgccaaagtcatcagggacggcgccgatgttcgtggctacttcgtctggtctctcattgacaattttgagtggttatacgggtacaccctccgctttgggcttcactacgttgactaccaaacacaggaaagaaagcccaagtcatccgcgctctggtacaaacggtttctccaaagttttgttgaagctcagtagggagggtgccttgttcaaatacagtataagcgtgtgtgacgactgaacatgctgcttcttcagttcagaaaataaagaacctgatatgatttgtataaatctattgatccttaataaagggccaccacagttgtcatc

SEQ ID NO: 2751 - DNA, 1832 bp, Sorghum bicolor
tacgtacagagccaagagcaaataaagtagactagctggtgtggtgtgtgtgcatggcgggcagggccagggcacggcggctcatgctcgccggggctttattgctcctcctggggctgctggatctcccatgggccacggcggcagtccgccggagcgacttcccggcgtcgttcctcttcggcaccgccacctcctcctaccagatcgaaggtgcgtacctcgagggcaacaaaagcttaagcaactgggatgtcttcactcacataccaggaagaatcgaagatggaagcaccggggataccgcggatgatcactatcatcgtttcgaggatgatgttgagctcatgcactctctcggaacgaacgcctacagattctcgatatcatgggccagaattcttccaagaggaagattcggccaagtcaacccggaaggcatcgctttctacaacaaactcattgattcactcctgctcaaaggaatagagccattcgtgacgctggcccactacgacatcccacaagagctggtggacaggtacggtgcgtggctcagcaccgaggtccagcgcgacttcggctacctggcggacgtgtgcttcgcggcgttcggcgaccgcgtcaagcactgggccaccttcaacgagcccaacgtcgccatgaccaagggctacatgctcggcacctacccgccgggccgctgctcgccgccgttcggctcctgcgcccagggaaactccgacgccgagccctacgtcgccacgcacaacgtcgtcctgtcccacgccaccgccgttgagatttacaagaggaagtaccagaggaagcagaagggcatgattggcattgtgatggccgccttctggttcgttccactgacggacacacctgtggaccggatggcgactgaacgggcattggccttcagcgttccatggtatcttgatccgatagtctacggcgactacccaccggagatgcgacagctcctgggctccaagctgccgaccttctcgccggtggagaagaggaagctgggttacaagctggacttcatcgggatcaaccactacacgacgctgtacgtgaaggactgcatgttcacgtcaggttgcccatcgggacaggatatccaatacgcgttggcggcctacaccggagaaagaaatggaattcccatcggacctccaacagcgatgccactgttcttcgatgttcctgacgggatagagaagatggtcacctacatcatgaagagatacaacaatctacccatgttcataaccgaaaatggttatgcacaaggtggagttggttacaaccaagtcgaagattggcttgacgaccagagtaggatacagtacctcgatggttacctcacaaaacttgccaaagttatcagggacggcgccgacgttcgaggttacttcatctggtctctcattgacaattttgagtggacatacggatacaccctccgctttgggcttcactatgttgactaccaaacacaggaaagaaagcccaagtcatccgcgctctggtacaaacggttcctccaaagtttacatgaagctcaatagagggtgccttttgtttaaatatataagcgcgtgaggcgtggcgactgaacaggctgctgcttcaattcagaaaatgaagaacatgatcttatttgtaggctagtcttagtgaaagttttatattatagttttgaatgcacatatgtattttagaaatagtacagaagatttttatccccataaaaattctctgtactcctatgaaatgtttattatatctctttattaatatagttctataccggt

SEQ ID NO: 2752 - DNA, 2376 bp, Panicum virgatum
ccttccattccggacggctcgtttcttcctccctccacttcgccgcttcccacttccaccaaaaccacaccgccgcgtcgccgccgcccaccatggcgatcccatcgcacgccgtcccgctccgcgcgctcctcgtcgggcttcccctcctctcccttttcatcgtcttccatctcctacaccgcccggcgcagcccctgcccccgccgatccggacccacgcccacgcccacgcgcggccctcctcggcggcggccgcagaggaggtggtggtgggttccccttcctccacggcgcccccggcttcgcggcaccggccggagccggagacggagccgacgtccctgcgccacgtggtgttcggcatcgcctcctcccgccgcacgctgccgctccggctcccgctcctccggctctggctgcgcgcgcccacgcgcgccttcctcttcctcgacgcgccggcgccggcgcccgccgccgggggcctcccgtgcggcctcgcgctccgcgtctccgccgacgcgtcccgcttcccctacacgcacccgcggggcctcccctcggccgtccgcgtcgcgcgcatcgccggggagctcgtcgccgcgctcgaaaaggaggaggagggccgccgcgcgccgccgcggtggctcgtgctcgccgacgacgacaccgccttcgtgctcccgaacctgctccgcgccctccgcgggtatgaccaccgcgagccgtggtacctcggctcgcgctccgagtccgcggcgcagaacgcctggcacggcttcgccatggcctacggcggcgccggcatcgccgtcagctggccgctcgcgcgccgcctcgcccgcgcgctcgactcgtgcgtcctcaggtacccgcacctctacggcagcgacgccaggatctacgcctgcctcgccgagctcggcgtcgagctcacccacgagccaggattccaccagatcgaccttcatggggatatttctggcctgctaagagcgcatccactttctcctttggtttcactgcaccatcttgatcatgtgcatcctctttaccctggaatggaccggacaagagcaatgaaacatttcttccgagctgctaatgctgatccagccaggatcctgcaacaaacggtgtgctatgaccgtaaaagatcgcttacagtatcaattgcatggggctattcagttcaggtgttcaaaggcaatgttctgctccctgacctccttgctgtgcagaaaacatttgtgccatggaaaaggggccgcaatgttacagatgtctatatgtttaacaccaaacatgttcccagagatgagtgcaaaagaggagctcttttcttcctgaaaagcatttcttcaggggaaggcaagacagaaaccacttacaatagacagccaccaagaaaatgctcgcatgacttgataccattgaggaatctaagtctgataaaagtgacagcagaacagctgcaactggttcctgggaaggccttgagacgacattgttgtgacatcgtaccttcttcatctgataccaccatggatattaacatcagaaaatgcaaagatgatgagttgatcgctatgcattcatagccattcttcagtcaaataggatgctcatctattgtagttatcatccaccccaacttgtgtcctgacaccgaggaatgctctgaagaatcatcatggatgaacactagacccatagcatagagaccgacagaaacagcaaagaaatacagatatatagtcttttttattatttgaaaaaacccatagatacacagtctagacagaggtaggatcaattagcatctttattccttcaaatagcagagttggggcatcatcatttgattattccatagtctgacttgtaacattaaatagtcaattttttgccagacaacgctgcaactaatacagcttaggcaaatcacttgtttttctgatggaaatttgagataggtcttgggaatgttaaaaacaattgcacttctttgtcaccatttgggataccgatacagagtatctcttgaaatgctcatgttctcaagtaacaaataaataaaacctgtcacataaaaagtttttaagataaagtaaacaagcacaacaagcctttgcttatactcaatttgctcggatacacaaaaaaaaaacggtacaaagaactcctttgattacactcaatctgaaatcagttttacaactgccagcaccgctgccgagggcgttttacaacagtgatcgttttaccaactgttattttttttagcacgttttaccaaactgttctgaggtatggtgtgcccattcaaaaatcttgtcctcaggtatgtctaaattcacaaaggcacagcaaaat

SEQ ID NO: 2753 - DNA, 1885 bp, Panicum virgatum
cggacggttcgttccgtcctcccttccacttcgccgcttcccaccaaaaccacgccgccgcccaccatgcccatggcgaccccatcccacgccgtcccgctccgcgcgctcctcgtcgggctccccctcctctccctcctcatcgtcttccacctcctccaccgcccggcgcccctgcccctgccgctccgcgcgcgcgcggaggcgctggtggatccccctccctccacgacgccgcccccggcgtcacggcaccggccggagccggagacggagccgacgtccctgcgccacgtggtgttcggcatcgcctcctcccgccgcacgctgccgctccggatcccgctcctccgcctctggctgcgcgcccccgcgcgagccttcctcttcctcgacgcgcccgcgccggcgcccgtcgtcgccgggggcctcccgcgcggcctcgcgctccgcgtctccgccgacgcgtcccgcttcccctacacgcacccgcggggcctcccctcggccgtccgagtcgcgcgcatcgccggggagctcgtcgccgcgctcgaaaaggaggagggggagggccgccgcccgccgccgcggtggctcgtgctcgccgacgacgacaccgccttcgtgctcccgaacttgctccgcgccctccgcgggtacgaccaccgcgagccgtggtacctcggctcgcgctccgagtccgcggcgcagaacgcctggcacggcttcgccatggcctacggcggcgccggcatcgccgtcagctggccgctcgcgcgccgcctcgcccgcgcgctcgactcgtgcgtcctcaggtacccgcacctctacggcagcgacgccaggatctacgcctgcctcgccgagctcggcgtcgagctcacccacgagccaggattccaccagatcgaccttcatggtgatatttctggcctgctaagagcgcatccactttctgctttagtttcactgcaccatcttgatcatgtgtatcctctttaccctggaatggaccggacaagagcaatgaaacatttcttccaagctgctaatgctgatccagccaggatcctgcaacaaacagtgtgctatgaccgtaaaagatcgcttacagtatcaatcgcatggggctattcagttcaggtgttcaaaggcaacgtcctgctccctgacctccttgctgtgcagaaaacatttgtgccatggaaaaggggccgcaatgttacagatgtctatatgtttaacaccaaacatgttcccagagatgagtgcaaaagaggagctcttttcttcctgaaaagcatttcttcgggggacggcaagacagaaaccacttacaatagacagccaccgagaaaatgctcgcatgacttgataccattgaggaatctaagtctgataaaagtgacagcagaacaactgcaattggttcctgggaaggccttaagacgacattgttgtgacatcgtaccttcttcatctgataccaccatggatattaacatcagaaaatgcaaagatgatgagttaattgcgatgcattcatagtcattcttcagtcaaatgggatgctgatatattgtagttatcatccaccccaacttgtgtcctgacactgaggaatgctctgtgaagaatcgtcatggatgaacactagacccatacatagagacagtcagaaacagtgaagaaatacagatagatctttttttgagaaaccaatagatacagtctagacagaggtaggatcaattagcatctttattccttcaaatagcagagtggggcatcatcatccgatcgttccatagcctgacttgtaacattaaatagtcatattttttgccagacaacgctgcaattaatacagcttatgagtcttttt

SEQ ID NO: 2754 - DNA, 2163 bp, Sorghum bicolor
gtttgctttatatattacttcaatataaaccgtccatatagatagcggcccctcccaacaaaattgacttgaatttgaaatttgactcggcagtccgcaccggattccttccgttgcggacggacggttggtttttgcttttcatgcgcctccacttcccacccaaaccaccaccacgcccgcacgccgccacctcggctcgacggctcggcgccggacactttccccgccgcggcgccgcccatggcgaccccgtcgtcccacggcatccccctccgcgcgctcctcctcgtgctgcccctgctctccatcctcatcgtcttccagctcctccaccgcccggctcccctgcccccaccgctcctccggacgcacgccgacgcggcggcgtcgcactcacaccgcgcggaggaggagccgagttcccctccactcacctccaacgtaccgccgcccccggcgccgaagccggaggaatcatcatcggagccgacgtccctgcgccacgtggtgttcggaatcgcctcctccaagcgcacgctgccgctccggctccccctgctccgcctctggctgcgcgcccccgcgcgcgccttcctcttcctcgacgcgccggcgccgcacgcggacgcggacgcgcgcgacctccctcccggactcgccctccgcgtctccgccgacgcgtcacgcttcccctacacgcacccgcgcggcctcccctcggccgtccgcgtcgcgcgcatcgccggggagctcgtctccgcgctcaagcaggagcgggaggaggaggatgtgcggtggctcgtgctcgccgacgacgacaccgccttcgtgctcccgaacctggtccacacgctgcgcaggtacgaccaccgcgagccctggtacctcggcgcgcgctccgagtccgcggcgcagaacgcgtggcacggcttcgccatggcttacggcggcggcggcatcgccgtcagctggccactcgcgcgccgcctcgcgcgcgtggtcgactcctgcgtcctcaggtacccgcacctctacggcagcgacgccaggatctatgcctgcctcgccgagctcggcgtcgagctcacccacgagccaggcttccaccagatcgatcttcatggcgatatttctgggctcctaagagcacatcctctttcccctttagtttcactgcaccatctcgatcatgtgtatcctctttaccctggtatggatcggaccagagcaatgcaacatttcttccaagcagctgatactgatccagccaggattctgcaacaaacagtgtgctacgaccaaaaaaattctcttacagtatcagtctcttggggctattcagtccaggtgttcaaaggcaatgtgctgctccctgacctccttgctgttcaaaaaacctttgtaccatggaagaggggtcgcaatgttacagatgtgtatatgtttgacaccaaacattaccctagagatgagtgcaaaagaggagctcttttcttcctgaaaagcattacttcaggggaaggcaagactaagacagaatccacttacaatagacagccacctaggaaatgcccgcctgacttgatcccactgaagaatctgcgtctgataaaggtcacatcagaacgactgcagctggctcctgggaaggccttaagacgccattgttgtgacattgcaccttcttcatctgataataacatagacattaacatcagaaaatgtgaagatgatgagctcatcgcgatgcattcatagcaggccatcattcacatcaactctgccctgacaccaagccatgcactgtggatcatcatggatgaacaccatacattcatagtatagccacacaggagacagagaaaatgcagatacagaggcagtatagacagacacagatcagttaacaaaatgcagatacagatggggtatagacggacacggatcagtttagcatttttttattttttatttcctttcagaaaaaaaaacagagctggggcatcaggatttgagtgttccatagtctgacatgtaataacatcaagtagtcgtatttacaagataaagttccttccattttatacagcttattcaaatctccgttgttttaatggaaagtttaggtaaacctcgcaaatgaaaaagaaatcacatttc

SEQ ID NO: 2755 - DNA, 1962 bp, Zea mays
ggattccttccgtggcggacggacagttggtttttcctttttcatgcgctctccaacttcccacccaaaccaccacgccgccacctcgggctcggcgccggacgcttccccgccccggcgcccatgtcgaccccgtaccacggcatccctctccgcgcgctcctcctcgcggtgcccctgatttccatcttcatcgtctttcacctcctctaccgtcccgctcccctgccctcgacgttccggacctacgccgatggggcggcgtcgcaccgtgcggaggagctgagttgccctccgctctcctccaacttaccgcccccggcgccgaagccggaggagacattggagccgacgtccctgcgccacgtagtgttcgggatcgcctcctcccggcgcacgctgccgctccggctccccctgctccggctctggctgcgcgcccccgcgcgcgccttcctcttcctcgacgcgccggcgccggcgccggacgcccgcgacctcccgccgggcctcgctctccgcgtctccgccgacgcatcccgcttcccctacacgcacccgcgcggcctttcctcggccgtccgcgtcgcgcgcatcgccggggagctcgtctccgggctcaagcagggggagggggaggatgtgcggtggctcgtgctcgccgatgacgacaccgccttcgtcctcccgaacctgctccacacgctccgcaggtacgaccaccgcgagcactggtacctcggcgcgcgctccgagtccgcggcgcagaacgcgtggcacgccttcgccatggcatacggcggcggcggcatcgccgtcagctggccgctcgcgcgccgcctcgcgcgcgtggtcgactcctgcgtcctgaggtacccgcacctctacggcagcgacgccaggatctacgcctgcctcgccgagctcggcgtcgagctcacccacgagccaggcttccaccagatcgatcttcatggggatatttctgggctcctaagagcacatcctctttcccctttagtttcactgcaccatctggatcatgtataccctctttaccctggtatggaccgggccagagcaatgcgacacttcttccgggcagccgatgctgatccggccaggattctgcagcagacagtgtgctacgaccgtaaagagtcgctcacagtatcagtctcatggggctattcagtccaggtgttcaagggcaacgtgctgctccctgaccttcttgctgtccagaaaacctttgtaccatggaaaaggggtcgcaatgtcacagatgtgtacatgtttaacaccaaacattaccccagagacgagtgcaaaagaggagctcttttcttcctaaaaggcattacctcgagggaaggcaagacggaaaccacttacaatagacagccacctaggaaatgcccgcctgacttgatcccactgaagagtctgcgtctgataaaagtgacatcagaacggctgcagctggctcctgggaaggccttaagacgccattgctgtgacatcgtaccttcttcatctgatgctaacatagacatcaacgtcagaaagtgcagagatgatgagctgatcgcgatgcattcatagtcattctttactcatatcagttcgtagttgcagcaggccatcatccacatcaactctgcgctgacaccaggccatgcaccgcggatcaacatggatcagcagcacacgttcatagtatagacacacaggatatacagaaaatgcagatgcagaggcagtatagacagacacggatcagttagcattgtttttcttttaaaaaagcagagctgaggcatcaggatttgagtgctccatagtctgacatgtaataacatcaaatagtcgtatttaccagacaaggtcggttccgttttatacagcatattcaaatctactttgttataatggaaaagaaatcacattttattctactgc

SEQ ID NO: 2756 - DNA, 2782 bp, Setaria italica
cgggcccaccgctgccccttacctcctctcctcgtctccaccactttccctctgcgccccggcccccacgaaatctggagacctggacgccattgctcgctagccttttccgtcaagcgcaaggaaaccgcgcgccaccacgggagggagggattgccgtgaccaattcgaaagccgctgcgggcgcgggcggagtcgggccgcggaggtggggagatgtccgccggattcgtcggggtcgtcgtgtccgacccctcgctgcaggggcagttcacgcaggtcgagctccgatcgctcaaggccaagttcgtgtctctgaagagagattccggccatgtcaccacgaagaatctgccggggctgatgaagaagctgagggggctcaatgaggtggtctccgaggaggagatcgccgccttcctgtcggagtcgtaccccgacagcgatcaggagattgagttcgagtccttcctccgggagtatctgaatctgcaggcgagggtgagtgccaaggtaggtggtggtgctggtggtgggggtggcaagacctcatcgtcgttcctcaagtccagcaccactacgctgctgcacaatctcaatcaggcagagaaatcgtcctacgtggcgcacatcaacacttatctccgcgaagacccatttctgaggaagtacttgccaatcgacccgtctggaaaccagctttttgatctgatcagggatggtgttctgctctgcaaattgatcaatgtagctgtacctgggaccattgatgagagagcaataaataagaaaagagttcttaatccatgggagagaaatgaaaatcatacactctgcctcaattctgccaaggccattggatgcactgttgtcaacattggtacacaggatttggtggagggaaggcctcatttagttcttggattgatatcacaaatcataaagattcaacttttggctgatctgaacctcaagaagacaccgcagctggtggaattgtttgatgatagcaaggatatagatgaggttttgagcttgtcaccagaaaagatgctacttcggtggatgaaccatcatctgaaaaaagctggctacaagaaaactgttaacaatttctcttcagatgtgaaggatggtgaagcctatgcttaccttctgaaagctcttgctccagagcattcccctgaaactacattggataccaaggatcccgatgagagggcaaaactggtacttgaacaagcggagaagttggactgtaaaagatacctgaccccaaaggatatcaccgagggatctgccaatttaaatcttgcatttgttgcgcaaatattccagcataggaatggtctaacgagtgacaccaaacaagttacgctcacacagacggcaacacgtgatgatgttctattgtctagagaagaaagagccttcagaatgtggatcaacagccttggggttgaatcatatgtaaacaatgtatttgaagatgttcgcaatgggtgggtacttcttgaagtacttgataaggtttctcctggatctgtcaattggaagctggcatcaaaacctccaattaaattgccattcagaaaactggagaattgcaatcaagttgtaaaaatcgggaaggagttaaagttttctttagtaaatctagctgggaatgatattgttcagggaaacaagaaactgattgttgcacttttgtggcaattgatgagattcaatatccttcagctgttaaacaagctaagattccattcccaagggtcccaaggaaaagaaattactgatgctgatattctaaactgggccaacagcaaagtgaaagcatcaggaagaacttctcgaatggaaagtttcaaggacaagagcttatcgaatggattgttcttccttgagcttcttagcgcagtacagccaagggttgtgaactggaaagttgttactaagggggaagctgatgaggacaagaagctgaatgctacctacatcattagtgttgctaggaagcttggatgctctgtatttctgttgccagaggacatcatagaggtgaatcagaagatgatccttacacttaccgctagcattatgtattggagcctacagaaacaacctcagtcacaatctgaaatgccagagcaatcagagccatctagcatgacttcagatgcagcctctgatattgcctcggaggatggagcttcaacgactgcgccatctgagtccgaagaggtgaactcgctgtctgatagcatgtccaatttgacaacggatgatgctacttcgaacgccccatctaccgaaaatggaaatggtgtggcaggatcctgatggttatgcagctgcagttctttttccacacagtcctggtttttaatagagggaatagtgctttcgtttcccaaagtcttcgctaccagaagtgattttttttactacttctgcttcctgtgtatggtagcttgatagatacaacaaatgcagatagatatagatgccgtttgttcattggattcgcttcatatcttactataggggaaaaaagatatagtatatgctgctggatgggtattttttgtattgctggtatacacccatgaaaatcttatgtgcttctgtatctggtcggtcaattcgttcatctgttccttggactagtagtcattatgtactacttggtggccatcatctattgtaatgcgttggtattctgatgaaacatgcctgtacataacatactttaaaaaggttttgccctgcccaggattttttt

SEQ ID NO: 2757 - DNA, 2850 bp, Sorghum bicolor
ttacctcctctcctcgtctccaccactttccgtctgcgccccggcccccacgaaatctggagacctggacgccattgctcacattttccgtcgagcgcaaggaaaccgcacgccagggggagagggtgagggattgccgtgaccaattcgaaagccgcttcgggcgcgggtggaatcggcccgtggccggcggagatgtccggattcgtcggggtcgtcgtgtccgacccctcgctgcaggggcagttcacgcaggtcgagctccgatcgctcaaggccaagttcgtgtctctgaagagagattccggccatgtcaccactaagaatctgccggggctgatgaagaagctgagggggctcaatgaggtggtctctgaggaggagatcgcggccttcctgtcggagtcgtaccccgacagcgatcaggagattgaattcgagtccttcctccgggcgtatctgaatctgcaggctcgggtgagtgccaagcaaggtggtgccggcggtggcgggggtggcaagtcgtcgttcctcaagtccaccatcactacgctgctgcacaacctcaatcaggcagagaaatcgtcttatgtggcgcacatcaacacttacctccgtgaagacccattcctgaagaagtacttgcccatcgacccgtctggaaaccagctgttcgatctcatccgggatggtgttctgctctgcaaattgatcaatgtagctgtacctgggaccattgatgagagagcaataaataagaaaagagttcttaacccgtgggagagaaatgaaaatcacacactctgcctcaattctgccaaggccattggatgcactgttgtcaacattggcactcaggatttggtggagggaaggcctcatttaattcttggattgatatcacaaatcataaagattcaacttttggctgatctgaacctcaagaagacaccgcagctggtggagctatttgatgacagcaaggatatagacgaggttttgagcttgtcaccagaaaagatgctacttcggtggatgaaccatcatctgaaaaaagctggctacaagaaaactgttaacaatttctcttcagatgtgaaggatggtgaagcctatgcttaccttctgaaagctcttgctccagagcattcccctgaaactacattggacatcaaagatccgaatgagagggcaaaactggtacttgaacaagcggagaagttggactgtaagagatacttgaccccaaaggatattactgagggatctgccaatttaaatcttgcatttgttgcacaaatattccagcataggaatggtctaaccagtgacaccaaacaagttactctctcacagacagcaacacgtgatgatgttctattatctagagaagaaagagcctttcggatgtggatcaacagccttggggttgaatcatatgtgaacaatgtgtttgaagatgttcgcaacggatgggtacttcttgaagtacttgacaaggtgtctcctggatctgtcaattggaagctggcaacaaaacctccaattaaattgccatttagaaaactggagaattgcaatcaagttgtaaaaattgggaagcaattaaagttttctttagtaaatctagctgggaatgatattgttcagggaaacaagaaattgattgttgcacttctgtggcaattgatgagattcaatatactccagctgttaaacaaactgagattccactcccaaggggcccaaggaaaagaaatttctgatgccgatattctagactgggccaacagcaaagtgaaagcgtccggtagaacatctcgaatggaaagtttcaaggacaagagcttatcaaatggattattcttccttgagcttctaagcacagtacagccacgggttgtgaactggaaagttgttactaaaggggaagctgatgaggacaagaagctgaatgctacctacatcattagtattgcaaggaagattggatgctctgtgtttctgttgccagaggacatcgtcgaggtgaatcagaagatgatcctaacacttactgctagcattatgtattggagcctacagagacagcctcaatcacaatctgaaatgccagaacaatcagaaccatctagcatgacttcagatgcagcctctgacattgcctctgaggatggtgcttcaacgacagcaccatctgagtcggaagaggtgaactcgctgtctgatagcatatcgaatttgacaatggatgatgctacttcaaacgccccacctgctgaaaacggaaatggtgtggaagggtcctgatggttataattatgcagacccggttcttttttgctacacagtgctgttttttatatacaggaaatagtgctttcatggtgcccaaagtcgtcgctaccagaagtggttttttaatacttctgcttcctgagtatggtagcttgatagatacaacaattgcagatagatatagatgccgtttgttcatccgcttatactataggggaaaaaagataatagtaatgtcgccggctgggtattttctgtattgctggcagacccatgcaaattttacttcttctgtaccttgtcgatcaattcgttcatatgtttattggactagtcatcgcttgtaatgctgttgctgctctgaaccgtgcctgtacataacatatactttaaaaaaaggttttgcctttcccgaaatttctgtttatactgcttttattttcgttgtttgcatgggatttattgtcatgaggtttcgatttgatttgactgacggcatttcaaatcgcatccaatccccgttttaataaatcatttcagaagccaaaatga

SEQ ID NO: 2758 - DNA, 2864 bp, Zea mays
tgcgcctcggcccccacgaaatctggaaagcctggacgccattgctcacctttttccgtccagcgcaaagacaccgcgcgccagagagggtgagggattgccgtgaccgattcgaaagccgcttcgggcgcgggtgggatcggcccgtggccggcggagatgtccggattcgtcggtgtcgtcgtgtccgacccctcgctgcaggggcagttcacgcaggtcgagctccgatcgctcaaggccaagttcgtgtctctgaagagagattccggccatgtcaccactaagaatctcccggtgatgatgaagaagctgagggggctcaatgaggtggtctctgtggaggagatcgcggccttcctgtccgagtcgtaccccgacagcgatcaggagattgaattcgaatccttcctccgggagtatctgaatctgcaggcgcgggtgagtgccaaggagggtggtgccggcggtggccggggtggcaagtcgtcgttcctcaagtccagcaccactacgctgctgcacaacctcaatcaggcagagaaatcttcgtatgtggcgcacatcaatacttacctccgtgaagacccattcctgaagaagtacttgcccatggacccgtctggaaaccagctgttcgatctcatccgggatggtgttctgctctgcaaactgatcaatgtagctgtacctgggaccattgatgagagggcaataaataagaaaagagttcttaacccatgggagagaaatgaaaatcacacgctctgcctcaattccgccaaggccattggatgcactgttgtcaacattggcacacaggatttggtggagggaaggcctcatttagttcttggattgatatcacaaatcataaagattcaacttttagctgatcttaacctcaagaagacaccacagctggtggagctatttgatgacagcaaggatatagacgaggttttgagtttgtcgccagaaaagatgctacttcggtggatgaaccatcatctgaaaaaagctggctacaagaaaactgttaacaatttctcttcagatgtgaaggatggtgaagcgtatgcttaccttctgaaagctcttgctccagagcattcccctgaaactacattggacaccaaggatccgaatgagagggcaaaactagtacttgaacaagcggcgaagttggactgtaagagatacttgaccccgaaggatatcactgagggatctgccaatttaaatcttgcatttgttgcacaaatattccagcataggaatggtctcaccagtgacaccaaacaagttactctcacacagaccgcaacacctgatgatgttctagtatctagagaagaaagagcctttcggatgtggatcaacagccttggggttgaatcatatgtaaacaatgtctttgaagatgttcgcaatggatgggtacttcttgaagtgcttgacaaggtgtctcctggatctgtcaattggaagctggcaacaaaacctccaattaaattgccatttagaaaactggagaattgcaatcaagttgtaaaaattgggaagcagttgaagttttctttagtaaatctggctggaaacgatattgttcagggaaataagaaattgattgttgcacttctgtggcaattgatgagattcaatatcctccagctgttaaacaaactgagattccactcccaaggagggtcccaaggaaaagaaatttctgatgctgatattctagactgggccaacagcaaagtgaaagcgtccggaagaacatctcgaatggaaagtttcaaggacaagagcttatcaaatggattgttcttcctcgagcttcttagcacagtacagccaagggttgtgaactggaaagttgttactaaaggggaaactgatgaggacaagaagctgaatgctacgtacatcattagtgttgcaaggaagattggatgctctgtgttcctgttgccagaggacatcgtcgaggtgaatcagaagatgattctaacacttaccgctagcattatgtattggagcctacagaatcagcatcagtcacagtctgaaatgccagagcaatcagaaccatctagcatggcttcagacgcagcctctgacattgcctcggaggacggtgcttcaacgacagcaccatctgagttggatgaggtgaactcgctgtctgatagcgtatccaatttgacaacggatgatgctacttcaaacgccccatccactgaaaacggaaatggtgtggcagggtcctgatggttatagttatgcagacccagttctttttcccacacacagtgctgttttttttatacagggaacagtgcttttcatggtgctcaaagtcgtcgctaccagaagtggtttttttaatacttctgcttcatgagtatggtagcttgatagatacagcaagtgcagatagatatagatgccctttgttcatggaatctgcttagactatagggggcggggcgggaaagatagtatatgtcgctggccgggtagtttctgtatttgtggcacacgcacccatgcaaggttttacctctttatgtatcttgtcggtcaattcgttcatatgtttattggactggtcatcgcttgtaatgctgttgctgctctgaaccgtgcctgtacataacatacactcaaaagtgtttttgccttgtccctaagtttctgtttatactgcttttttattttccttctttacattggatgtgttatcatgaggtttcaatttgatttgattgccttccctccctgacggcatttcaaatcccatccaatccccgtttcatatcattccagattatcaggagccaaaacgataaaaaaaa

SEQ ID NO: 2759 - DNA, 3182 bp, Panicum virgatum
aagcgacgtggcaatttacagttgattcaaatgtgttttatgaattataaggtccggagcttgttgtaacgagtttgatggttaatggaacctgctttcggtgtagagaaaactgtaaatccatgagaaaaaaagtttatgccaactcagccatgaagaaagaaagcaataggaactgggaagggggaggaaagaggcagtttcctggatttgtttaccttttccaatcactgcgtttgacagactagagttggaatgttgtgagaaaaaaacactattaactggctagtggctggaggctgcagcgatgtgagagggaaatactgtcttaacccccgataaacttaattcggcgacaggaaacaaaaaaaaaacaaacagaagaaaacggggcccacccctgcccttacctcccctcctcgtctccaccactttgcctctgcgccccggcccccacgaaatctggagacctggacgccattgctcgccttttttccgtcgagcgcaaggaaacccgcgcgcgccaggggagggattgccgtgaccaattcgaaagccgctgcgggcgcgggcggaatctggccgcggcggtggtgagatgtccgccggattcgtcggggtcgtcgtgtccgacccatcgctgcaggggcagttcacgcaggtcgaactccgatcgctcaaggccaagttcgtgtctctgaagagggattccggccatgtcaccacgaagaatctgccggggctgatgaagaagctgagggggctcaatgaggtggtatccgaggaggagatcgccgccttcctgtcggagtcctaccccgacagcgatcaggagattgagttcgagtccttcctccgggagtatctgaatctgcaggccagggtgagtgccaaggaaggtggtgctggtgctgggggcgggggcggcaagacgtcgttcctcaagtccagcatcactacgctgctgcacaatatcaatcaggcagagaaatcgtcctacgtggcgcacatcaacacttatctccgcgacgacccatttctgaagaagtacttgccaatcgaccccgctggaaaccagttgtttgatctcatcagggacggtgttctgctctgcaaattgatcaatgtagctgtacctgggaccatcgatgagagagcaataaataagaaaagagttcttaatccatggcagagaaatgaaaatcatacactctgcctcaattctgccaaggccattggatgcactgttgtcaacattggtacacaggatttggtagagggaaggcctcacttagttcttggattgatatcacaaatcataaagattcaacttttggctgatctgaacctcaagaagacaccgcagctggtggaattgtttgatgacagcaaggatatagatgaggttttgagcttatcaccagaaaaaatgctacttcggtggatgaaccatcatctgaaaaaagctggctacaagaaaatcgttaacaatttctcttcagatgtgaaggatggtgaagcatatgcttaccttctgaaagctcttgctccagagcattcccctgaaactacattggataccaaggatccggaggagagggcaaaactggtactcgaacaagctgagaagttggactgtaaaagatacctgaccccaaaggatatcactgaggggtctgccaatttaaatcttgcatttgttgcgcaaatattccaacataggaatggtctaaccagtgacaccaaacaagttacgctcacacagacagcaacacgtgatgatgttctattgtctagagaagaaagagcctttcggatgtggatcaacagccttggggttgaatcatatgtgaacaatgtatttgaagatgttcgcaatggatgggtacttcttgaagtacttgacaaggtttctcctggatctgtcaattggaagctggcaacaaaacctccaattaaattgccatttagaaaactggagaattgcaatcaagttataaaaattgggaagcagttaaagttttctttagtaaatctagctgggaatgatattgttcagggaaacaagaaattgattgttgcactcttgtggcaattgatgagattcaatatccttcagttgttaaacaaactgagattccactcccaagggccccaaggaaaagaaattactgatgctgatattctaaattgggccaacagcaaagtgaaagcatcaggaagaacttctcgaatggaaagtttcaaggacaagagcttatcaaatggattgttcttccttgagctgcttagcgcagtacagccaagggttgtgaactggaaagttgttacaaagggggaaactgatgaggacaagaagctgaatgctacctacatcattagtgttgcaaggaagcttggatgctctgtgtttctgttgccagaggacatcatagaggtgaatcagaagatgatccttacacttactgctagcattatgtattggagcctacagaaacagcctcagtcaccatctgaaatgccagaacaatcagacccatctagcatggcttccgatgcagcctctgatgttggctcagaggatggtgcttcaacaatcgcaccatccgagtctgaagatgtgaactcgctgtctgatagcatatccaatttgacaatggatgatgctacttcaatcgccccatctaccgaaaatggaaatgtcgtggcagaatcctgatgattatgcatctgcagttctttttccacatagtactgttttttatacagggaatagtgctttcgtggttcccaaagtcgtagctaccagaagtgaatttttttactacttctgcttcctgtgtatggtagcttgatagatacaacaaatgcagatagatatagatggtgttggttcattgaactcgcttcatatatgatactataggaggggaatggataattatatgttgctggatgggttcttttttttttgtgttgttggtatagaccccatgcaaatcttaagttctcttctgcatctgggcggccaattcgttcatctgttcgatggactcgtcattttgtactacctggtggccatcatctcttgtaatgtcttgctattctgaactatgcctgtacataacatactttaaaaaggttttgccttgcccaggagcttttgtaaatactgttctttc

SEQ ID NO: 2760 - DNA, 2686 bp, Pennisetum glaucum
cgccttttccgtcgagcgcaaggaaaccgcgcgccaccacgggagggaagggattgccgtgaccaattcgaaagccgctacgggcgcgggcggagtcgggccgcggcggtgcggagatgtccgccggattcgtcggggtcgtcgtgtccgacccctcgctgcagggccagttcacgcaggtcgagctccgatctctcaaggccaagttcgtgtctctgaagagggattccggccatgtcaccacgaagaatctgccggcgctgatgaagaagctgagggggctcaatgaggtggtctccgaggaggagatcgccgccttcctgtcggagacgtaccccgacagcgatcaggagattgagttcgagtccttcctccgggagtatctgaatctgcaggcgagggtgagtgccaaggcaggtggcggtggtgctggtggtgggggtggcaagaactcatcgtcgttcctcaagtccagcaccactacgctgctgcacaatctcaatcaagcagagaaatcgtcctacgtggcgcacatcaacacttatctccgcgaagacccatttctgaggaagtacttgccgattgacccgtctggaaaccagctctttgatctgatcagggatggtgttctgctctgcaaactgatcaatgtagctgtacctgggaccattgatgagagagcaataaataagaaaagagttcttaatccatgggaaagaaatgaaaaccatacactctgcctcaattctgccaaggccattggatgcactgttgtcaacattggtacacaggatttggtggagggaaggcctcatttagttcttggattgatatctcaaatcataaagattcaacttttggctgatctgaacctcaagaagacaccacagctggtggaattgtttgatgacagcaaggatatagatgaggttttgagcttatcaccagaaaaaatgctacttcggtggatgaaccatcatctgaaaaaagctggctacaagaaaactgttaacaatttctcttcagatgtgaaggatggtgaagcctatgcttaccttctgaaagctcttgctccagagcattcccctgaaactacattggataccaaggatccggagcagagggcaaaactggtactcgaacaagcagagaagttggactgcaaaagatacctgaccccaaaggatatcactgagggatctgccaatttaaatcttgcatttgttgcgcaaatattccagcataggaatggtctaacaagtgacaccaaacaagttacactcacacagacggcaacacgtgatgatgttctattgtctagagaagaaagagcctttcggatgtggatcaacagccttggggttgaatcatacgtaaacaatgtatttgaagatattcgcaatggatgggtacttcttgaagtacttgataaggtttctcctggatctgtcaattggaagctggcatcaaaacctccaattaaattgccatttcgaaaactggagaattgcaatcaagtcataaaaattgggaaggagttgaagttttctttagtaaatctagctgggaatgatattgttcagggaaacaagaaactgattgttgcacttttgtggcaattgatgagattcaatatccttcagctgctaaacaaactgagattccactcccaagggtcccaaggaaaagaaattactgatgctgatattctaaactgggccaacagcaaagtgaaagcatcaggaagaacttctcgaatggaaagtttcaaggacaagagcttatcgaatgggttgttctttcttgagcttcttagcgcagtacagccaagggttgtgaactggaaagttgttgcgaagggggaagctgatgaggacaagaagctgaatgctacctacatcattagtgttgcaaggaagcttggatgctctgtatttctgttgccagaggacatcgtagaggtgaatcagaagatgatcctaacacttactgctagcatcatgtattggagcctacagaaacctcagtcacaatctgaaatggcagagcaatcagagccatctagcatgacttcagatgcagcctctgatattgcctcagaggatggagcttcaacaaccgcaccatctgagtctgaagaggtgaactcgctgtctgatagcgtatccaatttgacaatggatgatgctacttcgaacgccccatctaccgaaaatggaaacggtgtggcaggatcctgatggttatgcagttgaagttcttctgcatactcctatttttgaatacagggaatggtgctttcgtggttcccaaagtcattcgctaccagaagtgattttttactacttctgcttcttgtgtatggtagcttgatagatacaacaaatgcagatagatatagatgccgtttgtttattgaattcgcttcatatatatcttactataggggaaaatatatagtatatgctgctgggtgggtattttttgtattgctgctggtatacacccatgaaaaatcttctctgcttggtcaattggttcatctgttccatggactagtagttactatgtactacttggtgaccatcatctattgtaatgtgttggtaatctgaaccatgcctgtaccaaaaaaaaaaacaaaaaaaacaaaaaaaagtaactctgtcgttgactacctactcgt

SEQ ID NO: 2761 - DNA, 2864 bp, Secale cereale
cgaaatctgggagttcccggacgccattgcccacctttttccccgagcacaaggaaagcacgcctcagaaggaagagaagagggcgcacggtagaattaccgtgagcaattcggaagccgcgccggaggttggtcggatcaggccgcggcgagaggaaatgtccggtttcgtcggggtcgtcgtctccgacccctccctgcagggccagttcacgcaggtcgagctccgatcgctcaaggccaagttcgtgtctctgaagagggactccggccatgtcaccaccaagaacctcccggggctgatgaagaagctaaggggacttcacgaagtggtctccgaggaggagatcgccgctttcttgttggagtcctaccccgatagcgaccaggagatcgagttcgaggccttcctccgggagtacctgaatctgcaagcaagggtgagtgccaaggaaggaagcgccgctgctgccggcggtgggggggctggcggccgcaagaattcctcgtcgttcctcaaatccaccatcactacgctgctgcacaatctcaaccaggcggagaagtcatcttatgtggctcatattaatacttaccttggtgaagacccattcttgaagaagtacttgccaatcgacccatccggcaaccagctattcgatcttattagggatggtgtcctgctctgtaagttgatcaatgtagctgtacctgggaccattgacgagagagcaataaataagaaaagagttctcaacccatgggagaggaatgaaaaccacacactctgcctcaactctgcaaaggccattggatgtactgttgtcaacattggcacccaggatttagtggaaggaaggcctcatttagttcttggattgatatctcaaatcataaagattcaacttttggctgatcttaatcttaagaagacaccccagctggtggaattgtttgatgacagcaaggatatagatgaggtgttgagcttgtcaccagaaaagatgctgcttcgatggatgaaccatcacctgaagaaggctggctacaagaaaactgttaacaatttctcttcggatgtgaaggacggtgaagcctatgcttatcttctaaaagctcttgctccagagacttcccctgaaaccacactggagactaaggatcctgatgaaagggcaaaaatggtacttgaacaagcagagaagttggactgcaaaagataccttacaccaaaggatatcactgagggttctgccaacttgaatcttgcatttgttgcacaaatattccagcatcggaatggtctaactagtgacattaaacaagttacactcacacagacagcctcacgtgatgatgttctagtatccagagaagaaagggccttccgaatgtggattaacagccttggggtcgagtcatacgtgaataatgtttttgaagatgttcgcaatggatgggtacttctcgaagtacttgacaaagtttctcctggatctgtcaattggaagttggcatcaaaacctccaattaaattgccatttaggaaactggagaactgcaatcaagttgtaaaaattggaaaggagttaaagttttcattggtaaatttggctgggaatgatattgttcagggaaataagaaattgatagttgcacttctgtggcaattgatgagatttaatatccttcaattgctaaacagactgagatcccactccaaaggatcccaaggaaaacaaattaccgatgcggatatactaaactgggcaaacagcaaagtgaaagcatcaggaagaacatctcgaatggaaagcttcaaggacaagagcttatcaaacggagttttcttcctcgaacttcttagtgcagttcagccaagggttgtgaactggaaagtagttacaaagggggaagctgacgaggagaagaagctaaatgctacctacatcatcagtgttgcaagaaagcttggatgttcagtgtttctactgccggaagacattatagaggtgaaccagaagatgatcctaactcttacagctagcatcatgtattggagccttctgagacaaccacagcctgaaatatctgaagcgtcggagccatctagcatggcttcagacgcaacctccgacattgggtcggaggatggcgcctcaacagctgcaccgtccgagggagaagaggtcaactcgctgtccgatactatgtccactctgaccacagatgatgcctcctcaaatgctccacctgccgaaaacgggagcgacgcctcctcaaatgcttcacctgcagaaaacgggaccgatgcctcctcaaatgctccacctgcagaaaacgggaacgacgccacatgatgctgatggttatatgttcgttcgtagcgctgtccatcgttagctttatacaaggggattggtacttccctgttgcccgcacaaagttgctgccaccagaagtgaaattttctcctgctttccaggtagcataataggtacaccatcatacagatagtcgtagccgccgtttgttcattattaaattgaattttgctgaatactgctagtaagtactatacgggagaaagagagagaaatacacagacacatatagtaggccaccggttggtttggctggccgttccctgtacactctttagtgcactttgctgtcgaagctccattgcccaactcgtgtcctgtcggtccatccatgtgctccagttttcttattcgtgtacaatttgctgtactgctcgggccattatcgtgttttgtaccaaactgtcttggctgctgtggagtgtggaccatgcaaggtgagctgtacatatacatgttggtttctggcgtgccaaggaa

SEQ ID NO: 2762 - DNA, 2973 bp, Hordeum vulgare
tccctcccgcccccaccaaatctgggagttcccggacgccattgcccaccttttccgccgaccacaaggaaagcacgccagccgagagaaggaacagcagaggccgcacggcagaattaccgtgagcaattcggaagccgcgccggagccgggtcggatcgggccgcggcgaggggaaatgtccggcttcgtcggggtcgtcgtctccgacccctccctgcagggccagttcacgcaggtcgagctccgatcgctcaaggccaagttcgtgtctctcaagagggactccggccatgtcaccaccaagaacctcccggggctgatgaagaagctcagggggcttcacgaggtggtcgccgaggaggagatcgccgccttcttgtcggagtcctaccccgacagcgaccaggagattgagttcgagtccttcctcagggagtacctgaatctgcaagcaagggtgagcgccaaggaaggaaacgcagccgccgccggcggtggcggggctggcggccgcaagaactcgtcgtcgttcctcaaatccaccattactacgctgctgcacaatctcaaccaggcggagaagtcttcttatgtggcgcatattaacacttaccttggcgaagacccattcctgaagaagtacttgccgatcgacccatccggcaaccagctattcgatcttattagggacggtgtcctgctctgtaagttgatcaatgttgctgtacctgggaccattgatgagagagcaataaataagaaaagagttcttaacccatgggagaggaatgaaaaccacacactgtgcctcaactctgcaaaggccattggatgtactgttgtcaacattggcacccaggatctagtggaaggaaggcctcatttagttcttggattgatatctcaaatcataaagattcaacttttggctgatcttaatcttaagaagacaccccagcttgtggaattgtttgatgacagtaaggatatagatgaggtgttgagcttgtcacccgaaaagatgctgcttcgatggatgaaccatcatctgaaaaaggctggctacaagaaaactgttaacaacttctcttcggatgtgaaggatggtgaagcctatgcttatcttctaaaagctcttgctccagaaacttcccctgaaaccacactggagactaaggatcctgatgaaagggcaaaaatggtacttgaacaggcagagaagttggactgcaaaagataccttacaccaaaggatatcactgagggttctgccaatttgaatcttgcatttgttgcacaaatattccagcatcggaatggtctaactagtgacattaaacaagttacactcacacagacagcatcacgtgatgatgttctagtatccagagaagaaagggcctttcgaatgtggatcaacagccttggggtcgagtcatacgtcaataatgtttttgaagatgttcgcaatggatgggtacttcttgaagtacttgacaaagtttctcctggatctgtcaattggaagttggcatcaaaacctccaattaagttgccatttaggaaactggagaactgcaatcaagttgtaaaaattgggaaggaattaaagttttcattagtaaatttagctgggaatgatattgttcagggaaataagaaattgatagttgcacttctgtggcaattgatgagatttaatatccttcaattgctaaacagactgagatcccactccaaaggatcccaaggaaagcaaattactgatgcggatatactgaactgggcaaacagcaaagtgaaagcatcaggaagaacatctcgaatggaaagcttcaaggacaagagcttatcaaatggagtgttcttccttgaacttcttagtgcagttcagccaagggttgtgaactggaaagtagttacaaagggggaagctgatgaggaaaagaagctaaatgctacctacatcattagtgttgcaagaaagctcggatgttctgtgtttctgctgccagaggacattatagaggtgaaccagaagatgatcctaactcttacagctagcatcatgtattggagcctgctgagacaaccacagcctgaaatatctgaagcatcagagccatctagcatggcttcggacgcaacttctgacattggctcggaggatggtgcctcaacagcagcaccgtccgagagcgaagaggcaaactcactgtccgatagtctgtccaccctgaccacagacgacgccacctcaaatgctccagctgcagaaaacgggaacgacgccaccccaaatgctctacctgcaggaaacgggaacgacgccaccccaaatgccccacctgcggaaaacgggaacgacgccaccccaaatgctccacctgcagaaaacgggaacaacgccacatgatcctgatggttatatgatcgtttgtagcgctgtccatctttagctttatacacacaaggggattggtacttccctgttgcccgcacaaagtcgctgctaccagtaccagaagtgaatttttctcctgctttccaggtagcataataggtataccatcatacatatagatagtagccgccgtttgttcattaaattaaattttgctggacagtaagtattaagtactggagtatacgggagaaagaaaaagaaatacacagacacataggccagcggttggctggccatttcctgtacacccttcactgcactttgatggtatcgaagctccactacccgactcgtgtcttgtcggtccgtccatgtgctcctttttttttctccctctcttccaaatttgctgtcctgcctgtgccattatcgtttttgtaccaaactgtctttgctgctgtggagtgtggaccatgcgtcgtgagctgtacataaacatgttggtttctggcatgccatggaatcggtgtacacattgtgatggtattcttggggcattcttt

SEQ ID NO: 2763 - DNA, 2865 bp, Panicum virgatum
ccaaggagccatttgcatgccgcatgcagagtgcatgcagcaaattgcatggaattaataaatatgagtacaactgtctttttttatcctctcagtactcaactctgccattcatcatgaggcctgacacatgtacagatttcaacacaaatttgacacaaattgagcagaaattttggcacccaattttgggatctaaacacagcctcgaacgccgaacagtgtcgatgtcggaacgcgccaagccaagggccaggccggtgacgctttcggcagcacgaatcgcaaggggacaagggacgcgcggccgcggtgggccgtgccgaattgtcggtccgatctggtatctcgccctctcgtgctgctcctgggatcggcgctggccggtgcgttcttggcgtctggttttttcttttgctgtcttaaaaactcgtgcgccaccgattccgtacgggttttctgcttgcagttcgaatagttgtaacaaagtgacagattattttacccgcaaaaaaacagaacgtggcagattatttaccgctgattcgtatgtgctttgtgaattgtacaagcccctgagtttgcaacgggtttgatggttaatggaacctgcttggtgtagaaaaaactgcagtacttgaagaaataaaagttcagccctgaatgaagaaagaaaggagtaggaagggggaggaaagaagcagtttcctggatttgtttaccttttccgatgtcttaaccccgggggaaacctaattccgcgacaggaaacggaaaaaacaaacagaagaaaaccgggcccacccctgcccttacctcccctcctcgtctccaccacttccccctctgcgccccggcccccacgaaatctggaggcctggacgccattgctcgccttttccgtcgagcgcaaggaaacccgcgcgcgccaggggagggattgccgtgaccaattcgaaagccgctgcgggcgagggcggaatccggccgcggcggtggggagatgtccaccggattcgtcggggtcgtcgtgtccgacccctcgctgcaggggcagttcacgcaggtcgagctccgatcgcttaaggccaagttcgtgtctctgaagagggattccggccatgtcactacgaagaatctgccggggctgatgaagaagctgagggggctcaatgaggtggtatcggaggaggagatcgccgccttcctgtcggagtcctaccccgacagcgatcaggagattgagttcgagtccttcctccgggagtatctgaatctgcaggcaagggtgagtgccaaggaaggtggtggtggtagtgctggtggcgggggcggcaagacgtcgttcctcaagtccagcatcactaccctgctgcacaatatcaatcaggcagagaaatcgtcctacgtggcgcacatcaacacttatctccgctacgacccatttctgaagaagtacttgccaattgacccggctggaaaccagttgtttgatctcatcagggacggtgttctgctctgcaaattgatcaatgtagctgtacctgggaccatcgatgagagagcaataaataagaaaagagttcttaatccatggcagagaaatgaaaatcatacactctgcctcaattctgccaaggccattggatgcactgttgtcaacattggtacacaggatttggtggagggaaggcctcatttagttcttggattgatatcacaaatcataaagattcaacttttggctgatctgaacctcaagaagacaccgcagctggtggaattgtttgatgacagcaaggatatagatgaggttttgagcttgtcaccagaaaaaatgctacttcggtggatgaaccatcatctgaaaaaagctggatacaagaaaaccgttaacaatttctcttcagatgtgaaggatggtgaagcctatgcttaccttctgaaagctcttgccccagagcattcccctgaaactacattggataccaaagatccggatgagagggcaaaactgatactcgaacaagctgagaagttggactgtaaaagatacctgaccccgaaggatatcactgagggatccgccaatttaaatcttgcatttgtagcacaaatattccaacataggaatggtctaaccagtgacaccaaacaagttacgctcacacagacagcaacacgtgatgatgttctattgtctagagaagaaagagcctttcggatgtggatcaacagccttggggttgaatcatatgtgaacaatgtatttgaagatgttcgcaatggatgggtacttcttgaagtacttgacaaggtttctcctggatctgtcaattggaagctggcaacaaaacctccaatcaaaatgccatttagaaaacttgaaaattgcaatcaagttataaaaattgggaagcagttaaagttttctttagtaaatctagctgggaatgatattgttcagggaaacaagaaattgattgttgcacttttgtggcaattgatgaggttcaatatccttcagctgttaaacaaactgagattccactctcaagggtcccaaggaaaagaaattactgatgctgatattctaaattgggccaacagcaaagtgaaagcatcaggaagaacttctcgaatggaaagtttcaaggacaagagcttatcaaatggattgttcttccttgagcttcttagtgcagtacagccaagggttgtgaactggaaagttgttacaaagggggaagcggatgaggacaagaagctgaatgctacctacatcattagtgttgcaaggaagcttggatgctctgtgtttctgttgccagaggacattatagaggtaaatcgctattgctagtt

SEQ ID NO: 2764 - DNA, 2784 bp, Triticum aestivum
gtgtctctgaagagggactccggccatgtcaccaccaagaacctcccggggctgatgaagaagctcaggggacttcacgaagtggtccccgaggaggagatcgccgctttcttgtcggagtcgtaccccgacagcgaccaggagattgagttcgagtccttcctccgggagtacctgaatctgcaagcaagggtaagcgccaaggaaggaagcgccactgctggcggcggcggggctggcggccgcaagaactcgtcgtcgttcctcaaatccaccatcactacgctgctgcacaatctcaaccaggcggagaagtcttcttacgtggcgcatattaacacttaccttggtgaagacccattcttgaagaagtacttgccaatcgacccatccggcaaccagctattcgatcttattagggatggtgtgctgctctgtaagttgatcaatgtagctgtacctgggaccattgatgagagagcaataaataagaaaagagttcttaacccatgggagaggaatgaaaaccacacactgtgcctcaactctgcaaaggccattggatgtactgttgtcaacattggcacccaggatttagtggaaggaaggcctcatttagttcttggattgatatctcaaatcataaagattcaacttttggctgatcttaatcttaagaagacaccccagcttgtggaattgtttgatgacagtaaggatatagatgaggtgttgagcttgtcaccagaaaagatgctgcttcgatggatgaaccatcatctgaaaaaggctggctacaagaaaactgttaacaatttctcttcggatgtgaaggatggtgaagcctatgcttatcttctaaaggctcttgctccagagacttcccctgaaaccacactggagactaaggatcctgatgaaagggcaaaaatggtacttgaacaagcagagaagttggactgcaaaagataccttacaccaaaggatataactgagggttctgccaacttgaatcttgcatttgttgcacaaatattccagcatcggaatggtctaactagtgacattaaacaagttacactcacacagtcagcatcacgtgatgatgttctagtatccagagaagaaagggccttccgaatgtggatcaacagccttggggtcgagtcatacgtgaataatgtttttgaagatgttcgcaatggatgggtacttcttgaagtacttgacaaagtttctcctggatctgtcaattggaagttggcatcaaaacctccaattaagttgccatttaggaaactggagaactgcaatcaagttgtaaaaattgggaaggagttaaagttttcattagtaaatttagctgggaatgatattgttcagggaaataagaaattgatagttgcacttctgtggcaattgatgagatttaatatccttcaattgctaaacagactgagatcccactccaaaggatcccaaggaaagcaaattactgatgcagatatactgaactgggcaaacagcaaagtgaaagcatcaggaagaacatctcgaatggaaagcttcaaggataagagtttatcaaatggagtgttcttcctcgaacttcttagtgcagttcagccaagggttgtgaactggaaagtagttacaaagggagaagctgacgaggaaaagaagctaaatgctacctacatcattagtgttgcaagaaagctcggatgttctgtgtttctactgccagaggacattatagaggtgaaccagaagatgatcctaactcttacagctagcatcatgtattggagcctgctgagacaaccacagcctgaaatatctgaagcatcagagccatctagcatggcttcggacgcaacttctgacattggctcggaggatggtgcctcaacagcagcaccgtccgagagcgaagaggcaaactcactgtccgatagtctatccaccctgaccacagacgacgccacctcaaatgctccagctgcagaaaacgggagcgacaccacctcgaatgctccagctgcagaaaacgggaccggcgccaccccagatgctccacctgcagaaaacgggaacaacgccaccccagatgctccacctgcagaaaacgggaacgacgccacatgatcctgatggttatattttcatccgtagcactgtccatcaattagctttatatacaagggttggtaccaaaagttgctgctgctaccagaagtgattttttctcttttcaggtagcataataggtacacaccatcatacagatagatcgtagccgccgtttgttcattaagttaaattttgctgaatagtaagtactatacgggagaaagagagagaaatacagacacatacatatagtaggccgccggttggtttggttggctggccatttcctgtacactctttagtgcacagctccattgctcaactcgtgccttgtcggtccgtccatgtgctccgtattttttttccttccaatttgctgtactgcttggaccattatcatttttgtaccaaactgtcgtcgctgctgtggagtgtggaccatgcgtcgtgagctgtacaaaaacttgttgatttctggcatgccaaggaatcgctgtacacattatggtagtagagtagtattcctgggcattcttgttccttcgcgtgcaatgtgacgtgtcggacagcgatttgtaaatcagtgagcgcgaggtgcactgggaattaccccctgtctttgtagatgcgctcattttgctccgtatgtag

SEQ ID NO: 2765 - DNA, 2570 bp, Triticum aestivum
gaagagggactccggccatgtcaccaccaagaacctcccggggctgatgaagaagctgaggggacttcacgaagtggtccccgaggaggagatcgccgccttcttgtcggagtcgtaccccgacagcgaccaggagattgagttcgagtccttcctccgggagtacctgaatctgcaagcaagggtgagcgccaaggaaggaagcgccgctgtcagcggcggtggcggggctggcggccgcaagaattcgtcgtcgttcctcaaatccaccatcactacgctgctgcacaatctcaaccaggcggagaagtcttcttatgtggcacatattaacacttaccttggtgaagatccattcttgaagaagtacttgccaatcgacccatccggcaaccagctattcgatcttattagggatggcgtcctgctctgtaagttgatcaatgtagctgtacctgggaccattgatgagagagcaataaataagaaaagagttcttaacccatgggagaggaatgaaaaccacacactgtgcctcaactctgcaaaggccattggatgtactgttgttaacattggcacccaggatttagtggaaggaaggcctcatttagttcttggattaatatctcaaatcataaagattcaacttttggctgatcttaatcttaagaagacaccccagcttgtggaattgtttgatgacagtaaggatatagatgaggtgttgagcttgtcaccagaaaagatgctgcttcgatggatgaaccatcatctgaaaaaggctggctacaagaaaactgttaacaatttctcttcggatgtgaaggatggtgaagcctatgcttatcttctaaaagctcttgctccagagacttcccctgaaaccacactggagactaagaatcctgatgaaagggcaaaaatggtacttgaacaagcagagaagttggactgcaaaagataccttacaccaaaggatattactgagggttctgccaacttgaatcttgcatttgttgcacaaatattccagcatcggaatggtctaactagtgacattaaacaagttacactcacacagtcagcatcacgtgatgatgttctagtatccagagaagaaagggccttccgaatgtggatcaacagccttggggtcgagtcatacctgaataatgtttttgaagatgttcgcaatggatgggtacttcttgaagtacttgacaaagtttctcctggatctgtcaattggaagttggcatcaaaacctccaattaaattgccatttaggaaactggagaactgcaatcaagttgtcaaaattgggaaggagttaaagttttcattagtaaatttagctgggaatgatattgttcagggaaataagaaattgatagttgcacttctgtggcaattgatgagatttaatatccttcaattgctaaacagactgagatcccactccaaaggatcccaaggaaagcaaattactgatgcagatatactgaactgggcaaacagcaaagtgaaagcatcaggaagaacatctcgaatggaaagcttcaaggataagagcttatcaaatggagtgttcttcctcgaacttcttagtgcagttcagccaagggttgtgaactggaaagtagttacaaagggagaagctgacgaggaaaagaagctaaatgctacctacatcattagtgttgcaagaaagctcggatgttctgtgtttctactgccagaggacatcatagaggtgaaccagaagatgatcctaactcttacagctagcatcatgtattggagcctgctgagacaaccacagcctgaaatatcagaagcatcagagccatccagcatggcttcggacgcaacttccgacattggctcggaggatggtgcctcaacagcggcaccgtccgagagcgaagaggcaaactcactgtccgacagtctatccaccctgaccacagacgacgccacctcaaatgctccacctgcagaaaacgggaacggcgccaccccagatgctccacctgcagaaaacgggaacgacgccaccccagatgctcaacctgcagaaaacgggaacgccgccaccccagatgccccacctgcagaaaatgggaacgatgccacatgatcctgatggttatatgttcgtccgtagcgctgtccatcattagcttcatatacaagggttggtacccaaagttgctgctgctaccagaagtgaaattttctcctgcttttcaggtactagcataataggtacacaccatcatacagatagatcgtagccaccgtttgttcattaaattaaattttgctgaatactagtaagtactatacggcggagaaagagagggaaatacagacacatacatatactagtaagtaggccgccggttggtttggttggctggccatttcctgtgcactttagtgcactttgatgtcgaagctccattgcccaactcgtgtcttgtcggtccgtccacgtgctctgttttttttttcttctaccaatttgctgtactgctcgggccattatcgtttttgtaccaaac

SEQ ID NO: 2766 - DNA, 2378 bp, Hordeum vulgare
gctccaagaattgggctccccgccggagacagacggatagatgtccgggttcgtgggggtcgtcgtctccgacccctccttgcagggccacttcacgcaggtcgagctccgatcgctcaaggccaagtttgtgtccctgaagagggagtccggccatgtcacggccaagaacctgccgggcctgatgaagaagctgaaggggctcaacgaggttgtctccgaggaggagattgctgcgttcttgtcggaggtttaccccgacagcgaccaggagattgagttcgagcaattccttcaggagtacctgaacctggaggcgagggtgagctccaaggcgggcgcgagcgggagcaagaactcgtggtcgttcctcaagtcgagcaccaccacgctgatccacaaccccaaccaggcagagaagtcgtcctacgtcgcgcacatcaacgcgtacctcggcaacgatcctttcctgaagaagtatttgccgatggatcctgcgggcaatgatttgttcgacctcgtcagagacggggttgtgctctgtaagttgatcaacgtagcggtaccggggactattgatgagagagccatcaacaagaaaaggatccttaacccatgggagagaaatgagaatcatacattgtgcctcaactctgcaaaggctattggatgtaccgtcgtgaatcttggcgctcaagacttggtggaaggaaggactcatctagttctcggattgatatctcaaattattaagatacaacttttggctgatctaaatcttaagaagacaccacagctggtggaaatttttgatgacagcaaggatatagatgaagttctgagcttatcacctgaaaagttgctgcttcagtggatgaattatcatctgaagagagttgattacaagaaaactgtcagcaacttctcttcagatgtcaaggatggtgaagcctacgcctatcttatcaaagctcttgctccagagcattcctctgtacttacatttgagaccaaggatcctgccgtaagagcgaaattggtacttaaccaagcagagaaattgggctgcaaaagatacttgagcccaaaggatattaccgagggctccccaaatcttaaccttgcatttgttgcacaaatattccagcatagaaatggcttgagtactgacaccagacaggttaaactcacacaaacatcatcgcaagatgaggttatattgtgccgagaagagagagccttccgaatgtggatcaacagccttggagttgcgacatacgtgaacaatgtgtttgaagatgttcgaactgggtgggtcctactagaagtgctcgacaaagtctctccaggatctgtcaactggaagctagcgacaaaacctccaataaaaatgccatttagaaaactggagaattgtaatcaagttataaaaattgggaaggagctgaagttttccttggtgaatttagctggaaatgatattgttcagggaaacaagaagttgattgttgcacttctatggcaattgatgagattcaatatcctccagctgttaaacaaactaagattccactctcaagggtctcaaggaaaagaaataaccgatgccgatatcttgagttgggcgaataacaaagtgaagtcttctgggagaaattctcgaatggaaagttttaaggacaagaacctatcaagtggaatttttttccttgagcttctcagtgctgtactgccaagggttgtgaactggaaggttgtatcgaagggtgtagatgatgatgagaagaaattaaatgcaacatacatcatcagtgtcgcgcggaagctcgggtgctctgtttttctgttaccagacgacatcattgaggtgaatcagaaaatgatccttacattgactgctagcatcatgtactggagcctgcaaaaaccacagcagcctgaaacatcggaacagtcagaatcatcttgtgcggcttcagatgctgcttccgatatcgcctcagaggattccgcttcgatagtggcaccatcggaaggagaagaggtgaattcattgcctgatggagggtccagcatgccatcggatgatactagtacttcagaggctcctgtttgaattctttgcctgatagtccaactccaacttaaccacaattgacaatatttcagacatcgggacgatgtgcgatcatgacaacagaatgatgatttagaatagtactttccctctatttttgtttttctgtctcatgcacagaatagatctgagcaaatttgttatttttatttgtatagttttcttactgagtgcacataaaacaatgcactgtataggattaaactgaatataggctgtatttgttcactgaattttgctc

SEQ ID NO: 2767 - DNA, 2879 bp, Triticum aestivum
gagtacgcgggaatgtcgtaagctaacgagaaaaagatttggcgcaaagccagcaagaacatctccaccaattcgaccgtgccaaaggcgccaccgccaccaccccgcatcctcccatcgatcgattacgcgctcgtccggcgatccctccctcgtcaattcgatcccccaatgcgcgcgcgaacgagacgatcgatccccgcatttcctcttttgatctgaggcccgcgcgtcccgcagcggcgttcgctagggcgctcccaagaattgggctccccgccggagacagatagatagatgtccgggttcgtgggggtcgtcgtctccgacccctccttgcagggccacttcacgcaggtcgagctccgatcgctcaaggccaagtttgtgactctgaagagggagtccggccatgtcaccaccaagaacctgccgggcttgatgaagaagctgaaggggctcaacgaggttgtctccgaggaggagattgctgccttcttgtcggaggtttgccccgacagcgaccaggagattgagttcgagcaattcctccgggagtacctgaacctgcaggagagggtgagctccaaggcgggtgcgagcgggagcaagaactcgtggtcgttcctcaagtcgagcaccaccacgctgatccaccacagccccaaccaggcagagaagtcgtcctacgtcgcgcacatcaacgcgtacctcggcaacgatcctttcctgaagaagtatctgccgatcgaccccgcgggcaatgatttgttcgacctcgtcagagacggggtcgtgctctgtaaattgatcaatgtagcggtgcctgggactattgatgagagagccatcaacaaaaaaggatccttaacccatgggagagaaatgagaaccatacgctttgcctcaactctgcaaaggctattggatgtactgttgtgaatcttggcgctcaagacttggtggaaggaagggctcatctagttcttgggttgatatctcaaattataaagatacaacttttggctgatctaaatcttaagaggacgccacagctggtggaaatttttgatgacagcaaggatatagatgaagtgctgagcttatcacctgaaaagttactacttcagtggatgaattatcatctcaagaaagctggctataagaaaattgttaccaacttctcctcagatatcaaggatgctgaagcctacgcctatcttatcaaagctcttgctccagagcattcctctatacttgcatttgacaccaaggatcctgccgtaagagcgaaagtggtacttgaccaagcagagaagttgggctgcaaaagatacttgagcccaaaggatattactgagggctccccaaatctgaaccttgcatttgttgcacaaatattccaacatagaaacggtttgagtactgacaccagacaggttacactcacacaaacatcatcgcgagatgaggttatattgtgccgagaagagagagccttccgaatgtggatcaacagccttggaattgcgacatacgtgaacaatgtgtttgaagatgttcgaactgggtgggttctactagaagtgctcgacaaagtctatccgggctctgtcaactggaagctagcgacaaaacctccaataaaaatgccatttcgaaaactggagaactgtaatcaagttataaatattggaaaggatctgaagttttccatggtgaatctagctggaaatgatattgttcagggaaacaagaagttgattgttgcacttctatggcaattgatgagattcaatatcctccagctgttaaacaaactgagattccactctcaaggatcccaaggaaaagaaataaccgatgctgatatcttgagttgggcgaataacaaagtgaaggtttccgggagaaattctcgaatggaaagttttaaggacaagaacttatcgagtggaattttttccttgagcttctcagtgctgtagagccaagggttgtgaactggaaggttgtatcgaagggtgtaattgatgatgagaagaagttaaatgcaacctacatcatcagtgttgcacggaagctcgggtgctctgtttttctgttaccagaagacatcattgatgtgaatcagaaaatgatcctaacattgactgctagcatcatgtactggagtctgcagaagccacagcagcctgaaacatccgaacagtcagaatcatcttatgctgcttcagatgctgcttccgatatcgcctcagaggattccgcttcgatagtggcaccatcagaaggagaagaggtgaattcattccctgatagagcatccaacatgccaactgctgatactagtacttcagaggctcctgctgctgatactagtacttcagagactcctgctgctgatactagtacttcagaggctcctgctgctgatactagtacttcagaggctcctgctgatgatactagtacttcagaggctcctgcttgagtttttcgcctgatagtccaactccaacttaaccacaattgacaatatttcagacaccgggacgatgtgcgatcgtgactacagaatgatgatttagaatagtactttccctccatcattttcgttttcctgtctcgcgcacagaatagatctgagcaaatttgttatttgtatttgtatttgtatttgtatagttttcttactatgtgcacataaaaacaatccagtgtatatgattatgctgaatataggttatatttgttcactgaatttttctcttgctcttacaatacaaaaggtcggtcacttgagctgtttaccaacttaaagttgttggttgctaacaatcggtcgaatgttgtaaggatgaattgtcaattgtgta

SEQ ID NO: 2768 - DNA, 2650 bp, Triticum aestivum
tcctcccgtcgatcgattacgtgctcgtccggcgatcccttcctcgtcaattcgatcccccaatgcgcgcgcgaaagggacgatcgatccccgcatttcctattttgatctgaggtccgcgcgtcccgcagcggcgttcgctagggcgctcccaagaattgggctccccgccggagacagatagatgtccgggttcgtgggggtcgtcgtctccgacccctccttgcagggccacttcacgcaggtcgagctccgatcgctcaaggccaagttcgtgtctctgaagagggagtccggccatgtcaccaccaagaacctgccgggtctgatgaagaagctgaaggggctcaacgaggttgtctccgaggaggagattgctgcgttcttgttggaggtttgccccgacagcgaccaggagattgagttcgagcaattccttcgggagtacctgaacctgcaggagagggtgagctccaaggcgggtgcgagcgggagcaagaactcatggtcgttcctcaagtcgagcaccaccacgctgatccaccacagccccaaccaggcagagaagtcgtcctacgtcgcgcacatcaacgcgtacctcggcaacgatcctttcctgaagaagtatctgccgatcgaccccgcgggcaacgatttgttcgacctcgtcagagacggggtcgtgctctgtaaattgatcaacgtagcggtgcccgggactattgatgagagagccatcaacaagaaaaggatccttaacccatgggagagaaatgagaaccatacgctttgcctcaactctgcaaaggctattggatgtactgtcgtgaatcttggcgctcaggacttggtggaaggaagggctcatctagttctcgggttgatatctcaaattataaagatacaacttttggctgatctaaatcttaagaggacgccacagctggtggaaatttttgatgacagcaaggatatagatgaagtgctgagcttatcacctgaaaagttactacttcagtggatgaattatcatctcaagaaagctggctacaagaaaattgttaccaacttctcctcagatatcaaggatgctgaagcctacgcctatcttatcaaagctcttgctccagagcattcctctatacttgcatttgacaccaaggatcctgccgtaagagcgaaagtggtacttgaccaagcagagaagttgggctgcaaaagatacttgagcccaaaggatattactgaaggctccccaaatctcaaccttgcatttgttgcacaaatattccaacatagaaacggtttgagtactgacaccagacaggttacactcacacaaacatcatcgcgagatgaggttatattgtgccgagaagagagagccttccgaatgtggatcaacagccttggaattgcgacatacgtgaacaatgtgtttgaagatgttcgaaatgggtgggtcctactagaagtgcttgacaaagtctgtcccggatatgtcaattggaagctagcgacaaaacctccgataaaaatgccatttagaaaactggagaactgtaatcaagttataaatattgcaaaggatctgaagttttccatggtgaatctagctggaaatgatattgttcagggaaacaagaagttgattgttgcacttctatggcaattgatgagattcaatatcctccagctgttaaacaaactgagattccactctcaagggtcccaaggaaaagaaataaccgatgctgatatcttgagttgggcgaataacaaagtgaaggtttccgggagaaattctcgaatggaaagttttaaggacaagaacctatcgagtggaattttttccttgagcttctcagtgctgtagagccaagggttgtgaactggaaggttgtatcgaagggtgtaaatgatgatgagaagaagttaaatgcaacctacatcatcagtgtcgcacggaagctcgggtgctctgtttttctgttaccagaagacatcattgatgtgaatcagaaaatgatcctaacattgactgctagcatcatgtactggagtctgcagaagccacagcagcctgaaacatccgaacagtcagaatcatcttatgctgcttcagatgctgcttccgatatcgcctcagaggattccgcttcgatagtggcaccatcagaaggagaagaggtgaattcattccctgatagagcatccaacatgccaactgctgatactagtacttcagaggctcctgctgctgatactagtacttcagagactcctgctgctgatactagtacttcagaggctcctgctgctgatactagtacttcagaggctcctgctgatgatactagtacttcagaggctcctgcttgagtttttcgcctgatagtccaactccaacttaaccacaattgacaatatttcagacaccgggacgatgtgcgatcgtgactacagaatgatgatttagaatagtactttccctcccatcatttttcgttttcctgtctcgcgcacagaatagatctgagcaaatttgttatttgtatttgtatttgtatttgtatagttttcttactatgtgcacataaaaacaatccagtgtatatgattatgctgaatataggttatatttgttcac

SEQ ID NO: 2769 - DNA, 2598 bp, Brachypodium distachyon
accatctcatcctcctgttcattgattacatgccttccaggcccggccggcgaccccccgttcctcatcaattcgagcccggacgatctccgcatttcctctttttgatctgatgaagaagtcctgctccaagaatcgggcttcccgcaggagatagatgtctgggttcgtaggggtcattatctctgacccctctttgcagggccagttcacgcaggtcgagctccgatcgctcaaggccaagtatgtgattctgaagagggagtccggacatgtcacctccaagaacctacccggtttgatgaagaagctgagggggctcaacgaggtagtctccgaggacgagatcgctgcgttcttgtcggaggtttaccccgacgaagacaaggagattgagttcgagtcattcctgcgggagtacctgaacctgcaggctagggttacccacaaggagggcggcagcggggccaagcactcgtcgtccttcctcaagtccagcaccaccacgctgctccacaaccccaaccaagcagagaagtcatcctatgttgcacacatcaacgcgtaccttgctgatgatccttttctgaagaagtatctgccgctggaccccgcgggcaatgatctgttcgacctcgtcagggacggagtcgtactctgtaaattgatcaatgtagctgtacctgggactattgatgagagagccatcaataagaaaagaatccttaacccatgggagagaaatgagaaccatacactgtgcctcaactctgccaaggctattggatgtactgttgtcaatcttggtgctcaagacttggtggaaggaaggactcatctagttcttggattgatatctcaaattataaagatacaacttttggctgatctaaatcttaggaagacaccacaactggtggaagtgtttgatgacagcagggatatagatgaagtgctgagcatgtcacctgaaaagttgctacttcagtggatgaactatcatctaaaaagagctggttacaagaaaactgttagcaacttctcttcagatgtcaaggatggcgaagcctatacctacctcatcaaagctcttgctccagagcattcctctgaaactgcatttgagacgaaggatcctacggaaagggcaaaactggtacttgaacaagcagagaagttggactgcaaaagatatttgagcccaaaggatattaccgagggctctccaaatcttaaccttgcatttgttgcacaaatattccaccatagaaatggcttgactactgacaccaatcagattaacctcacgcagacatcatcacgagatgatcttatcttatctagagaagaaagggccttccgaatgtggattaacagccttggaattgtgacatatgtaaataatatgtttgaagatgttcgaaatgggtgggttcttctagaagtacttgacaaagtatatccgggatctgtcaattggaagatagcaacaaaacctccaattaaaatgccatttagaaaactggagaactgcaatcaagtcatacaaattgggaagcagctgaagttttctttagtgaatttagctggaaatgatattgttcagggaaataagaagttgattgttgcacttctttggcaattgatgagattcaatatccttcagttgctaaacaaactgaggttccactctcaagggtcccagggaaaacaaataactgatgctgacatcctgaattgggcgaataacgaagtcaaggcttcagggagaacttctcaaatggaaagttttaaggacaagaacttatcaagtggaatatttttccttgaacttctcagtgctgtacagccaagggttgtgaactggaaggttgtatccaagggtgtagatgatgatgagaagaagctaaatgctacctacatcatcagtgttgctcggaagcttggctgttctgtgtttttgttgccagatgacataattgaggtgaatcagaagatgatcctaacactggctgctagcatcatgtactggagtctccagaaaccaccacagagtgaaacatctgaacagtctgcaccatctaatgtggcttcagatgctgcttctgatatcgcctcggaggattccacgtcgataatggcatcactagagggagaagaggtgaattcgttgcctaaaagcatggcaacggataatactagcacttcagatgctctattttgaattctttgcctgatagtcgagttccaacataaccacaattgacgatgcttcagatacaactctggcagataacgataatgttgtatatgcagaatgaagatttagagtagtagttctccattcatcgggtttttttttctgtcttgcacatagaatagagctaagcaaatattttctctttttcttgagtttgttttgtagttactgcacatagcaatggtctatatagagttatgatcaaaataggtccattttcccattgaattttgatcaaaatgtatacagaaggtgtccattgacattctatttttcttttcaacaatttatatgcatgaattaggatagttcgaagatctgccttttattctgccacc

SEQ ID NO: 2770 - DNA, 2568 bp, Sorghum bicolor
aggcgagcagcttcccgtctccccgtctcatctcatgtcatgactcagcaccacctcccccatcctctcctctgtcctcgtataaagcgccgcagcccacgacggcgacgccgcccatgggagctggagcaccagcacacgccgctgccccggctccgcgccgcgaaccctagccgaccgccccatggccgccgagtcctgcggcagccgcggcgcctcgccgccgccgcctcctccctccactggcggcgcggccgggaggcgccgcaaggcggaggcctacgccgaggtgctccgccgcatccgcgctggcgccggcggctacggtgctgctcgccccgggttggaggacgagctctgggcccatttccaaggcctacctgccagatatgctttggatgtcaacgtagagcgggttgaagatgtcttactgcacaagaaattgctcgagcaagcccatgaacccatgaatggtctggtctttgatgttcgtccttcacaggttgttactctggaagaaagcactggatttgagtccgcaacttcctttaagcaagaagaacaagatccccagtgctcagtattcacatcaagaggtcaaaggcctctgcatgaaattatatttgcgtgtgacgataagccaaagcttctgagtcagttaacctctcttcttggggagcttggtcttaatatccaagaagcacatgcatattcgacgagtgacggctattccttggacatctttgttgttgatggctggaagtatgaggctgatattctccgaagtgcattgagggaaggcgttgataaaataaagtacagagcatggccgttggttccgtcgatgtctgctaggatggatcaccaaccattggaggtttctccttcatctgactttgtccagataccagctgatgcagctgatgtttgggaagtcgatcccaggcttctcaaattcgaacaaaaattagcgtctggatcatttggtgatctataccatgggacgtactgtagtcaagatgtagccatcaaagtactcaagcctgagcgggttagcgttgatatgctgcgcgagtttgcgcaggaagtatatataatgaaaaaggttcgtcacaaaaatgttgtgcaatttatcggtgcatgcacgagacctcctgttttgtgtatcgttacagaattcatgcatggaggcagtatttttgacttcctttacaatagacgaggaaattttcagctaccggatgtgattagaattgcatctgatgtgtccaagggaatgaattacttgcatcagattaatatagttcatagggacttgaagactgcaaatcttcttatggatgatcaggttgtcaaggttgcagactttggggttgcaagggttaaagaccagtcaggagttatgactgcagaaacaggaacctacagatggatggcccctgaggtcattgagcacttgccgtatgatcatagagcggatgttttcagttttgggatagttctttgggagctgctgactggaaagcttccatacgaggacatgacacctcttcaggcagcagttgccgttgttcaaaaggatctgaggcctattattgctgctgatactcatcctatgctcgcgaatctccttcagagatgctggcagaaagatcctgctctaagaccaacctttgccgagattgtggatatactcaactctataaaggaggtggttcagagttctgtgcatcacaagaggcatccaggtcgatcgcactctgggaggagacgaggctgttgatgcgccagttttgtgtagtgtgcacgcccgtttcattttcattttgtagtcgagtgatgacttcagaatgcggccagaatagtttactatgttcattccgagagtttttttacaacttttttctttaattttgtgaaaggttatcagctttttaaattttgactaaactttccacctttaaaagcttatagaagggggcatatccacgtttacatttggcctgtatctgtatttcgtactgtctctcctttcttttttcaagttgcggtaggcaaccaagattcaaatgaaaatctttaatcaatatagaataagtatgtgtagattaaaccatgtaaatttagagaaccattttggtatattgttaattttatgtttatgtttatgagtattatagatatatgaggtataactgttaacattgtgccgttggagaccgtgctggatcaatttgtgccttatatggagtatattagtggtgctactagcggttagggaagaatgccgtctttggcccatgttggctgatcccttacgtgatcagatacatggaagaggtggagagttgtttttgggctttggtgctttgaacctgttgaacgttgtaatttggttactgtggtaataaaatttggttttaagatggtggaaaaaaaggaataatactatcaaaatgttatggacggtttggcagaagaatggctgctgaccctgttcgtttgggtgaaaataatgttcgttgatttgttgtgcgagataaatattgtttaatggttgacagattt

SEQ ID NO: 2771 - DNA, 2088 bp, Setaria italica
ggcgagcagcttcccgtctccccgtcgcatgactcagcaccaccttccctcatcctccttctctctcctcgtataaagcgccgcaacccacgacggcgacgccgcccatgggagcaccaccacgccacgccgccccggctccacgccgcgaaccctagccgcccgccccatggccgccgagtcctgcggcagccgcggcgcctcgcctccgccgccaccttcctccgctggcggcggcggcggcggcgcggctgggaggcggcggaaggctgaagcctacgccgaggtactccgccgcatccgctctggcgggtacggcggcgggcgcccggggttggaggacgagctctgggcccatttccaaggcctaccagccagatatgctttggatgtcaatgtagaacgagttgaagatgtcttactgcacaacaaattgcttgagcaagcccgtgaacccatgaatgggctggtctttgatgttcgtccttcacaggttgttactccggaggacagcaccggatttgagtcctcaacttcctttaagcaagaagaacaagatccccaatcctcagcatttacatcaagagatcaaaggcctttatatgaaattatatttgcatgtgacgataagccaaagcttcttagtcagttaaccttgcttcttggggagcttggtcttaatatccaagaagcgcatgcatattcgacaagtgatggctattccttggacatatttgttgtcaatggttgggagtacgaggttgacattctccgaagtgcattgaggaaaggcattgataaaataaagtacagagcatggccattggtccagtcaatggctgctaggatggatcaccggccaatggaggtttctccttcatccgactttgtccagataccagctgatgcagctgatgtttgggaagttgatcccaggcttctcaaattcgaacgaaaattagcgtctggatcatttggtgatctataccatgggacgtactgtagtcaagatgtagctatcaaagtactcaagcctgagagggttagcgttgatatgctgcgtgagtttgcacaggaagtatatataatgaaaaaggttcgtcacaagaatgttgtacaatttattggtgcatgcacgagacctcctatttcatgtatagttacagaattcatgcatggagggagtattttcgacttcctttacaatagacgaggaaaatttcagctcccagatgtgataagaattgcatctgacatttccaagggaatgaattacttgcatcagattaatattgttcacagggacttgaagactgcaaatcttcttatggatgatcaggttgtcaaggttgcagactttggggttgcaagggttaaagaccagtcaggagttatgactgcagaaacaggaacctacagatggatggcccctgaggtcattgagcacttgccgtatgatcatagtgcagatgttttcagtttcgggatagttctttgggagctactaaccggaaagcttccatacgaagacatgacacctcttcaggctgcagttgccgttgttcaaaaggatctgaggcccacgattgctgctgatactcatcccgtgcttgctgatctgattcagcgttgctggcagaaagatccggctctaaggccaacctttgcagagattgtggatatactgaactccataaaagaggtggttcggagttctgggcatcacaagagacatccaggtcgatccgactctgggaggagacgaggatgttgatgcggcagttttgtttagtgttccacgcctttgtttcgtcgccctttctcattttcatctttgacattggtgttattttggttgtagttcagtaatagcttcagaatatggtcagatgagtttgttgcactcatttcgagagggttacttacagtttgtaggcttgactaaatgttaagaggagttccactttttaaagcttgatgaggggtgtagcgtatccacgtgtggtgtacttaggggttaggggggttagggatggtaaaggatcctctaatttagcctaacaaatttaagtatcgggtttaataaag

SEQ ID NO: 2772 - DNA, 2258 bp, Oryza sativa
cgcagcttcccttctccccgtcgcagcgggggtgatgactcagcacccccatccccacccccccaaatctcctctctctcctctcctctcctctcctcgcgtataaagccggcggccgcttctccgtcaagctccccccctccatgacgcctcgctcctccgccgccgcctccgcctccgcctccgccgccgccgcggcacagcgtcggaaaccctagcctgcgcgggggcggccggaggacagggaggttgtttgtttgtttgtgtgtatcatacggatacggcggcatggccagcggcgccgagtcgtgcggcagccgcgggggggagtcgccaccaccgccgcggacgcggggggcgtcggcggggggcaggcggcggaaggcggaagcctaccgcgaggttctccgccggatccgcgggggcggcggcgcgctcgacgacgacgagctctgggcccacttctacagcctccccgccaggtatgctttggatgtgaatgtcgagcgggttgatgatgttctactgcacaagaggttgcttgaccaggcccgtgaaccaatgaatgggctggtcttcgatgttcgtcgttcgcaggctgctactctggatggaagcactgaagttgagcaatcaacttcctttaagcatgaagtacaagatcctcagtgctcatcgttcacatcgagagaccaaaggtgtttccatgaaattatatttgcatgtgacgataagcctaagcttcttagccagctaaccgctctacttggggaacttggccttaacatccaagaagcacatgcattttcgacgagtgatggctattctcttgacatctttgttgtcgatggctggagtcatgaggtcgatgttctacgagatgcattaaggagaggagttgaaaagataaagtacaaagcatggccattggttcagtccatgcctactaggacaggtcacgagctaatggaggattctcctccagctgattttgtccagattccagctgatgcaactgatgtttgggaagttgatccaaggcttctaaaatttgaacgaaaattagcatctggatcatttggtgatctataccatgggacatactgtagtcaagatgtagcaatcaaagtactcaagcctgagcgggtcagcgttgatatgctgcgtgagtttgcacaggaagtatatataatgaaaaaggttcgtcacaagaatgttgtgcaatttattggtgcatgcaccagaccacctattttgtgtatagttacagagttcatgcgtggaggaagtattttcgactttctttacaattttagaggaacttttcagctccctgatgtgttaagaattgcctctgatgtatccaaggggatgaactacctgcatcaaattaacattgtccacagggacttaaagactgctaatcttcttatggatgaccaggttgtcaaggttgcagactttggagtagccagagttaaagaccagtcaggagttatgactgcagaaacaggaacctatagatggatggctcctgaggtcatcgagcacttgccctacgatcagagagcagatgttttcagtttcgggatagttatttgggagctgctgactggaaagcttccttatgaagatatgacgcctcttcaagcagccgttgccgttgtccaaaaggatctgagacctatcattcctgctgatactcatcctatgcttgctggtctacttcagaaatgctggcagaaagatccagctctaagaccaactttttcagagattcttgatatactaaattctataaaggaggctgttcgaagttctggacatcagaagagacactcaggtcgatcttattccaggcagagacgaagcggttgatgcagcaattttcctttttttttaaaaaaaaaatcttgtttcggtttagtttctgaaatgcggcaggttttgtttagcgttccacaccctcccttttgttatggtcatttccacggcgagcaatttttacttggttgtatctcagcggtaacgttggaatataatctggtgagtttcttgtatttttttttcatgtcgtgagctggtgtaaacgattgttgattataatcctttcagttcaaccacgagatgtcatgacttctttttttttaaaatcatccttttaactctctcaggtcttttgatgtgtgactttgaccataattttgtattaggataaatctgataagtttaagagataataatatttatcaaggcaa

SEQ ID NO: 2773 - DNA, 2230 bp, Brachypodium distachyon
cagaaatatggggaaacgaagggttttctgcgcgagaaggtgtcgcctcgaatccaggcccaggcgagcagtttcccgtctccccgtcgcagatgactcagcacccaccacctcccccatccgggaaacccttctctctctctcctcgtataaagcgctgctctccggccgcgaggtcgcctccatgagtagactaagaccaccacgacccatccaccacgccgccgccgccgccccgtctcgcctcgcgcgaaccctagcgcccccgccctattatggccgccgagtcctgcggcagccgcggcgcatcgcctccgccgctgcacccgtcctccgccagcggcggggcggtcgggaggcggcggaagacggaggcctaccgcgaggtgctccgccggatccgcggcggcgccgcttccggcggcgcgcgccccgggttcgatgacgagctctgggcccacttccacagcctccccgccagatatgcattggatgtcaatatcgaacgggttgatgatgttttgttgcacaagagattgcttgaggaggcccgtgaaccaatgaatgggctggtctttgatgttcgttgttcacagattgtcacagttgatggaagcactgaagttgagtcatcaacttcgattaagcaagaagaacgagatcctcaatgctcagcgcttgcatcaagtgatctaaggcctttgcatgaagtcatatttgcatgtgatgataagccaaagcttcttagtcagctaacagctctacttggggagcttggtcttaatatccaagaagcgcatgcattttcaacaagtgatggatattccctggatatctttgttgtggatggatggaagtatgaggtcgatgttctacgaaatgcactcagtagcggaattgagaaaataaagtacagagcatggccattggttcattccatgcctgttagcatgggtcgtcagctattggaggattcttctccagctgattgtgtccagataccagctgatgcaaccgatgtttgggaagttgatccaaggcttctcaaatttgaacaaaaactagcagctggatcatttggtgacctataccatgggacctattgcagtcaagatgtagcaatcaaagtactcaagcctgagcgagttagcgtcgatatgctgcgtgagtttgcacaggaagtatatataatgaaaaaggttcgtcacaagaatgttgtacaatttattggtgcgtgcaccagaccacctattttgtgtatagttacagagttcatgcgtggagggagtatcttcgattatatttacaaccataggggcacttttcagcttgttgatgtcctaagaattgcatcagacgtgtccaagggaatgagctacttacatcagataaacattatccacagggacttgaaaactgcaaatcttctcatggatgataaggttgtcaaggttgcagattttggggttgcaagggttaaagaccagtccggagttatgactgcagaaacaggaacttaccgatggatggctcctgaggtcattgagcactcgccctacgaccacagggcagatgttttcagttttggagtagttctttgggagctactggcaggaaagcttccttatgaagatatgacaccacttcaagcagctgttgctgttgttcaaaaggatctgagacctaccattcctgctgatactcatcctatgctcataggtctccttcagaaatgctggcagagagatcccgccctaagaccaacattcgcagagattttggatatattacagtcaataaaggaggtagttcaaagttctggacgtcacaagaggcgtccgggtccatcccactctggacagagatagacactccgctgtttttttagtctaccacgtcctatatttactgtcaacttttttctatcttggtagctcgttatttgttagttctgtaggtgagggggggaaggtccttttatgttgtaatttgacgagttgttcatgtggagaggacgttgtgtaacgatttgagtaaactgcacaagagctgcttgttcgtttttttgaggtttccggaattaacgatcaaattgaccttttagcctgacagtgatggtcatttctattacttgctggttagatgggtcaagcacagatgttcgttgttattagtgggttttccacgcgcgtttaagatgaatagcatcagttccctcgttgagttcatt

SEQ ID NO: 2774 - DNA, 2019 bp, Sorghum bicolor
tgtataaaacacccgtctccgtctccggtgagcaggagaagggggagggaggaggccaaggacgcagccgcgaagccaagcccacccgatccagtccctgccgccctgccccagctcgtctctcaggtcgccgtgccactgccagtcccgcgagcagctcagattcacgagctcgtctcctagatcttgcgccgtttggctgaattctgttctttgggagcaaagaggtgctggttggcggcgttgtttggtgctttgggggcggcgagtttttgcgttctcccgctgtgcttgtgttgctgctgcggcggggtggagatgggggtggcgggggagaagttccagttggggacggtgggggcgctcagcctctcggtggtgtcctccgtctccatcgtcatctgcaacaaggctctcatgagctccctcggcttcaacttcgccactactttgacaagctggcatctcctggtcacgttttgttctctccatgtggcattatgtatgaagctctttgagcacaaacctttcgatgcaaggaccgtcatgggatttggagtgctcaatggcatatcgattggacttcttaacttgagtctgggtttcaattctgttggtttctatcagatgacaaagctggctattattccctgtactgttatattggagacccttttcttcaggaagaaatttagtcggaatatcaaactctcccttagcgtgctccttgttggtgttggtgttgcaactgtaactgatctgcaactcaacactgtgggatctgtactgtcactgctggcaatcatcacaacctgtattgctcagattatgacaaatacaatacagaagaagttcaaggtatcttcaacgcagcttctgtaccaatcttgcccataccaagcattgactttgttccttatcggtccattccttgatggatttttgactaaccaaaatgtctttgctttcgattacacaactcaagttctgtttttcatcgtgttgtcatgcctgatttcagtctcagtaaacttcagtacttttctcgtgattgggaagacatctcctgtaacttaccaagttcttggccatctgaaaacatgcttggttctcacctttggctatgttctgcttcacgatccgtttagctggagaaacatacttggaatcctaattgcggtaattgggatggttttgtattcatacttctgcactagagagactcagcaaaaaccagcagaagtctccccacaagtaattcaggcgaaagagggtgaatcaaaccctctgatctcagactccctgagcgctgctgaaaacgggggcagtgccaccgacgacgaacctctgaaggtaccaatgtggagctcaaagtactcgaaggcgtgaaggctgttctgttactagtgtacggtgctatacagaattcagcttggttaggcagatactagggttggaaggcaaccctgttcctgttccatttttggccttctattttttttcttcctttctggcatatactataaatatatgtgctgtcagtaaatggatctcactcttcagaggataatacctcagctcgagacgagtggtctgcctgaaagctattttcttatgctccactccacatgtgtaacttggtagatggacatgatgtcaacagtagtagtttgcattcttttgtactagtagtatatgtatatttctcagtcttctgttatgtattcctcgcgttccgcaagcttcttgtcgcccgccatctgcatccttcgcctccttgtcgcccgccaccaccagcattccgccgccctcttcaccgctctctaagccacattcctcgccggagaagaaaccaccgcggcggaggtggtcgcccacaaggccacaaccacaaaggtgcagacagaagctatcgggcctacttgtcagctttgctcgcccaagtcctgacgtcgatccagcggtgcaaccttattactactatctttggccataaaagaatacaattcttggatttta

SEQ ID NO: 2775 - DNA, 1751 bp, Saccharum officinarum
ggagggaggaggccaaggacgcagccgcgaagccaagcccacccgatccagtccctgctcccctgccccagttcttttctcaggtctccgtgccactgtcaggcccgcgcgcagctcagattcacgagctcgtctcccagatcttgcttcgtttggctgaattctgttctttgggagcaaagaggtgctggtcggcggcgtggtttggtgctttggggcggcaagtttttgccttctcccgctgtacttgtgttgctgctgcggtggggtggagatgggggtggcgggggagaagttccagctggggacggtgggggcgctcagcctctcggtggtgtcctccgtctccatcgtcatctgcaacaaggctctcatgagctccctcggcttcaacttcgccactactttgacaagctggcatctcctggttacgttctgttctctccatgtggcattatgtatgaagctctttgagcacaaacctttcgatgcaaggaccgtcatgggatttggagtgctcaatggcatatcgatcggacttcttaacttgagtctgggtttcaattctgttggtttctatcagatgacaaagctggccattattccctgtactgttatattggagacccttttcttcaggaagaaatttagtcggaatatcaagctctcccttagtgtgctccttgttggtgttggtgttgcaactgtaactgatctgcaactcaacactgtgggatccgtactgtccctgctggcaatcatcacaacctgtattgctcagattatgacaaatacaatacagaagaagttcaaggtatcttcaacgcagcttctgtaccaatcttgcccataccaagcattgactttgttccttatcggtccattccttgatgggtttttgactaaccaaaatgtctttgcttttgattacacaactcaagttctgtttttcatcgtgttgtcatgcctgatttcagtctcagtaaacttcagcacttttctcgtgattgggaagacatctcctgtgacttaccaagttcttggccatctgaaaacatgcttggttctcacctttggctatgttctgcttcacgatccattcagctggagaaacatacttggaatcctaattgcggtaattgggatggttttatattcatacttctgcactagagagactcagcaaaaaccagcagaagtctccccgcaagtcattcaggcgaaagagggtgaatcaaaccctctgatctcggactccctgagcgctgctgaaaacgggggcagtgccaccgatgacgaacctctgaaggtaccaatgtggagctcaaagtactcgaaggcgtgaaggctgttctgttgctagtgtacggtgctatacagaattcagcttggttaggcagatactagggccctgttcattcggcttataatccgtctttttcagcttgttttttcaaccggaacaacaaatcagccaacagtgtttttcagtcggcttatcagcacagccgaacggctcctagggttggaaggcaaccctgttcctgttccatttttggccttctattttttttcttcctttctggcatatactataaatatatgtgctgtcagtaaatggatctcactcttgagaggatgatacctcagctcgagacgagtgatctgcctgaaagctattttcttatgctccactccacatgtgtaacttggtacatggacatgatgtcaacagtagtagtttgcattct

SEQ ID NO: 2776 - DNA, 1612 bp, Setaria italica
cggaggggagggaggagaggaggccgagaaccgcagcagctcaagcagccgcggagccaaagcccggccgatccggtcgctgcttgcctctcaggtccccgcaccattgccagttctgctctcagattcacgagcttgtctcccagatccagcttcgcccgcccgaattctgtttattgggagcaaagaggtgctggtcggcggcgtggttaggttggttgcgccggggagtttctggttctcctccgcttgttttcctggtgcggcggtggagatgggggtggcgggggagaagttccagctggggacggtgggggcgctgagcctgtcggtggtgtcctcggtctccatcgtcatctgcaacaaggccctcatgagctccctcggcttcaactttgccactactttgacgagctggcatctcctggttacgttctgctctctccatgtggcgttatgtatgaagctctttgagcacaaacctttcgatgcaagaactgtcatgggatttggagtgctcaatggcatctcaattggacttctcaacttaagtctaggtttcaattctgttggtttctatcagatgacaaagctggctattattccctgtactgttatattggagacccttttcttcaggaagaaatttagccggaatatcaaactctcacttagcgtgctccttcttggtgttggtgtcgcaactgtgactgatttgcaactcaacactgtgggatctgtactgtccctgctggcaatcatcacaacctgtattgctcaaattatgacaaatacaatacagaagaagttcaaggtgtcttcaacccagcttctgtatcaatcatgcccgtaccaagcattgaccttgttccttgttggtccattccttgatggatttttgactaaccaaaatgtctttgctttcgattacactactcaagttctgtttttcattgtgctgtcatgcctgatttcagtctcagtaaacttcagcaccttccttgtgattgggaagacatctcctgtaacttaccaagtccttgggcatttgaaaacatgcttggttctcacctttggctatgtactgcttcatgatccatttagctggagaaatatactgggaatcctaattgctgtgattgggatggttttatattcatacttctgcactagagagacccagcaaaaacctgcagaagtctctccgcaagtcattcaggggaaggagagtgagtcaaacccgttgatctcagactctttaaatgctgctgaaaacgggggcagtaccccagatgatgaacccctgaaggtaccaatgtggagctcgaagtactcaagggcgtgaagattgctctgtcgttagtgtatggtattatacagaattcagtttagtaggcagataccagggttggaaggcaaccctgttcctgttgcatttttggcattttttgtctgggttatattatatgtactgttggtaaatggatctcactagtgagaggatactattgcttcctctattccagacgattgatctgaatgaatgcgctacatgctgtaacttggcagctggacatgatacagaaagtagtttacattcttttgtgctacc

SEQ ID NO: 2777 - DNA, 1701 bp, Panicum virgatum
caagaacgcagcagctcaagcagccgcggagccaaagctcacccgatccggccacagcttgcctcttaggtccccgcgccattgccagttctgctctcagattcacgagctcgtcgcccagatccagctcctgcttgctcgaattctgtttcctgggaacaaagaggtgctggtcggcggcgtggttcggtggttctggttctcctcctctgcttggtttcctggtgcggcggtgcagatgggggtggcgggggagaagttccagctggggacggtgggggcgctcagcctctcggtggtgtcctcggtctccatcgtcatctgcaacaaggctctcatgagctccctcggcttcaactttgccacaactttgacaagctggcatctcctggttacgttctgctctctccatgtggcattatgtatgaagctctttgagcataaaccttttgatgcaaggactgtcatgggtttcggagtgctcaatggcatctcaattggacttctcaacttgagtttaggtttcaattctgttggtttctatcagatgacaaagctggctattattccctgcactgttatattggagacccttttcttcaggaagaaatttagtcggaatatcaagctctcccttagcgtgctccttgttggtgttggtgtcgcaacagtgactgatctgcaactcaacgcagtgggatctgtactgtccctgctggcaatcatcacaacctgtattgctcaaattatgacaaatacaatacagaagaagttcaaggtttcttcaacccagcttctgtaccaatcatgcccgtaccaagcattgaccttgttccttatcggtccattccttgatggatttttgactaacaaaaatgtctttgcttttgattacacaactcaagtcctgtttttcattgtgttgtcatgcctgatttcagtctcagtaaacttcagcaccttccttgtgattgggaagacatctcctgtaacctaccaagttcttgggcatctgaaaacatgcttggttctcaccttcggctatgttctgcttcatgatccgtttagctggagaaatatacttggaatcctaattgctgtgattggtatggttttgtattcctacttctgcactagagagactcagcaaaaacctgcagaagtctctccgcaagtcattcaggtgaaggagagtgagtcaaacccgttgatctcagactctttaagcactgctgaaaacgggggcagcaccacagacgatgaacccctgaaggtaccaatgtggagctcaaagtactcgagggcgtgaagaatgaaaattgctcttttgttagcgtatggtattatatagaattcagcttagtaggcagatactagggttggaaggcaaccctgttcctgttccatttttggccttcttttttttctctggcttatattatatgcgttgttagtaaatggatctcactcgtgagaggatactactgtttcctctgctccagacgattgatctgcctgaaagctagacatgagagctagctgcacaggagatttctgttgtattttcttatgttctgaatgcgccacgtgcagtaactttgtagctggacatgaaacaacacgtagttttcattcttttgtactaccaaagagttgggtttagctgaaagttcctttaaattgatttttgctgagactcat

SEQ ID NO: 2778 - DNA, 1730 bp, Panicum virgatum
cgtctacggtgagcaggagaggggaagggaggggaggaggccagaacgcagcagctcaagcagccgcggagccaaagctcacccgatccggccacagcttgcctcttaggtccccgcgccattgccagttctgctctcagattcacgagctcgtcgcccagatccagctcctgcttgctcgaattctgtttcctgggaacaaagaggtgctggtcggcggcgtggttcggtggttctggttctcctcctctgcttggtttcctggtgcggcggtgcagatgggggtggcgggggagaagttccagctggggacggtgggggcgctcagcctctcggtggtgtcctcggtctccatcgtcatctgcaacaaggctctcatgagctccctcggcttcaactttgccacaactttgacaagctggcatctcctggttacgttctgctctctccatgtggcattatgtatgaagctctttgagcataaaccttttgatgcaaggactgtcatgggtttcggagtgctcaatggcatctcaattggacttctcaacttgagtttaggtttcaattctgttggtttctatcagatgacaaagctggctattattccctgcactgttatattggagacccttttcttcaggaagaaatttagtcggaatatcaagctctcccttagcgtgctccttgttggtgttggtgtcgcaacagtgactgatctgcaactcaacgcagtgggatctgtactgtccctgctggcaatcatcacaacctgtattgctcaaattatgacaaatacaatacagaagaagttcaaggtttcttcaacccagcttctgtaccaatcatgcccgtaccaagcattgaccttgttccttatcggtccattccttgatggatttttgactaacaaaaatgtctttgctttcgattacacaactcaagttctatttttcatcgtgttgtcatgcctgatttcagtctcagtaaacttcagcaccttctttgtgattgggaagacatctcctgtaacctaccaagttcttgggcatctgaaaacatgcttggttctcaccttcggctatgttctgcttcatgatccgtttagctggagaaatatacttggaatcctaattgctgtgattggtatggttttgtattcatacttctgcactagagagactcagcaaaaacctgcagaagtctctccgcaagtcattcaggtgaaggagagcgagtcaaacccattgatctcagactctttaagcactgctgaaaacgggggcagcaccactgacgatgaacccctgaaggtaccaatgtggagctcaaagtactcgagggtgtgaagaatgaaaattgctctgttgttagcatatggtgttatacagaattcagcttagtaggcagatactagggttggaaggcaaccctgttcctgttccatttttggccttcttttttttctgtcttatattatatgcgttgttagtaaatggatctcactcgtgagaggatactactgcttcctctgctccaaacgattgatctgcctgaaagctagacatgagagctagctgcacaggggatttctgttgtattttcgtatgttctgaatgcgccacatgctgtaactttgtagctgggcatgaagcaacacgtagttttcattcttttgtactatcaaagagttgggtttagctgagagttcgtttaaaatgatttttttg

SEQ ID NO: 2779 - DNA, 2077 bp, Oryza sativa
tacaaagatcttaagaagagtaatcaattgagtccaacaaacagcaatgatcaagcatctctcatctcaccaaacgaatcaacaaatgcagaggataccatcacaaatctcattaaacacgtggtcacaattagcatagatgaacttgcaataatcaaatcaattaaatgcatcccccaaattatcactaatcacccccttcaaaagtcactaatttacaaatttacaaatcagtccattctcacatcaccactcaccaacccgaagcgaccaaccaagaaaaggaggaaaaaaaaagatcccatttttatataaaagcccctgtctccgtctccgatcagctgcaggagaggcgaggaggcgaagcagcagcagctgaagcgagccgagccgatccctcctgcccctgctcgcctcccagatctccccgccattgccagttccccgccaagattcgcgcgcccttctcccagatccagcttcgcctattccgaattccgcgcaaggctctgtcggtggtctgattcggcgggttttggttggggaattttggtgttcctgctcggttttgtgcttgctgctggttgtggtggttcttgggagcggtggagatgggggtgacaggggagaagttccagctggggacggtgggggcgctcagcctctcggtggtgtcctcggtctccattgtcatctgcaacaaggccctcatgagctccctcggcttcaacttcgccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccagatgacaaagctggcaattatcccctgcactgttatacttgagactcttttcttcaggaagaagtttagtcggaatatccagctctcccttagtgttctcctttttggtgttggagttgcaactgtgactgacctgcagcttaatgctgtgggatctgtcctgtctttgctcgcaatcattacaacctgcattgctcaaatcatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtgtttttcattgtgctgtcatgcttgatatcagtctcagtgaacttcagcacttttcttgtgatcgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtaaaagaaagcgaatcggaccccttgatctcggactctttgagcactgctgaaaatgggggcaacgcaggcgacgacgaggctctgaaggtacctatgtggagctccaagtactcaaaggcatgaagaaactgctctgatgatactagtgtatggttctatacagagttcagcttagtaggcagatagtactagggttggaaggaagccaaccctgagtgtaatgaacgatgtctgttccatttttggtcttttttttttctttttgcttaccatgtggtgctgtcagtaaatgaaatctcactttgaagaggaaattatttacctctacactccagatggcagattggccttaaagctagacacaaaagggctagatctctttgtaatatttttcatgtgttcaacttcagcatctgcttcagcattgtaacaacttgccagcaggacataatatcaacacgtagtttacattcttttttgtacccgagtgccaggtggattcaagtttgtggtgaaag

SEQ ID NO: 2780 - DNA, 1883 bp, Brachypodium distachyon
gttggtgtggtgctggtggttttgaccccgggtgcggggggaaaagcccgtttcttggcgtttttctagcttcggttgctcggccggaatgtgatctccgttcgtgcgcaggtcctgccgtcagcgtgattcggtcggttttcgttggccgggaagctgtttctttcggttctgcttgcttctttttgttgagcgacgagcggcggcggagatgggggtgggcggggagaagttccagctggggacggtgggggcgctcagcctctccgtggtgtcctcggtctccattgtcatctgcaacaaggccctcatgagctccctcggcttcatctttgccaccacgttgacaagttggcatcttctggtcacattttgttcactccatgtggcattatgtatgaagctgtttgagcacaaaccttttgatgcaaggactgttatgggatttggagtgctcaatggcatctcaattgggcttctgaatctgagtctcggtttcaattccgttggtttctatcagatgacaaagctggccattattccctgtactgttatattggagactcttttcttcaggaaaaagtttagtcgctacatccagctctcccttagcgtgctcctttttggtgttggagttgcaaccgtgactgacctgcaactcaatgctatgggatcaatactgtctttgctggcaatcgtcacaacctgcattgctcaaattatgactaatacaattcaaaagaagttcaaggtatcctcaacccagctactgtaccaatcatgcccataccaagcattgaccctcttcgttaccggtccattccttgatggttttttaaccaacaaaaatgtctttgcttttgagtacacgcctcaagttctgtttttcatcgtgctgtcgtgcctaatatcagtctcagtaaacttcagcactttccttgttattgggaagacatctcctgtaacttaccaagtcctgggccatcttaagacatgcttggttctcgcctttggttatgtcttgcttcatgatccatttagctggagaaacatacttggaatcctaattgcagtgattgggatggggctatattcgtacttctgcacccgggaaactcagcaaaaacccactgatgcctctccacaagtcactcaggtgaaagaaggcgaatcggaccctttgatctcggactccttgaacagcgctgagaacgggggtgctgcagccgacgacgagcctctgaaggtacccatgtggagctccaagtactcgcgggcatgaaaggctgctacagtcaatgttagtatatggtaatatacataattattcagcttagtaggcagatagtagggctggaaggaagtcagccctgagtgtaacaaacgttcctgtgcaatttttgggcctttttttcttgtttttttgtttaccatatctgtggtgttgttgttaagacttaagatggatctcactcttcagacagaaatggcactgttgttacatctactccaaaatgtggcggatctaccttggagctaagaaacacaggagttcacttgtattattatttcttttttgcatgttcagcgtctgattcgccgttgtaacttggcagcaaagacatgatatcaacatgcagtttacattctttcttttgcataacattttgaccacatgttaggactcggaattgaatagtaggaccagatttctctcgacagacgtagttgaacaaaaaaaaaaaaatactccctcggatccaaaaagtgtcgtccattgtgtactaagtataaattttgtacgaaatgagcgacactttttatgtatcggaaggaatacatttttttgccgggttcaaaatgttatgccaaatgttagtaaa

SEQ ID NO: 2781 - DNA, 1849 bp, Hordeum vulgare
gcaggagagagagagagagggaggacgggtggaggccaagaacgcagcacgactgcacagcaccagctgccgaccgaccgcgggcggagctgaccccgacccgatcagatccctcgccgctcgccccctcctcagatctccccgcgcgcgcctctcccagatccagctccaagcgctcggattttcgacagagaggtcctgccggcggcggtccgcgtctggaagctcgtcggctgctgctgctgctgctgcttcttgctttccgtgctccgtagcgaaggcggccggcggagatgggggtggcgggggagaagttccagctggggacggtgggggcgctgagcctctccgtggtctcctcggtctccattgtcatctgcaacaaggcgctcatgagcgccctcggcttcatcttcgccaccacgttgacaagctggcatctcttggtgacattctgttcgctccatgtggcattatgcatgaagctctttgagcacaaacctttcgatgcaaggaccgtcatggggttcggtgtgctcaacggcatctcgattgggcttctcaatctgagtctgggtttcaattctgttggtttctatcagatgacaaagctggccattattccatgcactgttatattggagactcttttcttcaggaagaagttcagtcgctacatccagctctcccttagtgtgctcctttttggtgttggagttgcaaccgtgacagatctgcagctcaatgctatgggatctgtgctgtctttactggcaatcgtcacaacctgtattgctcaaattatgaccaacacaattcaaaagaagttcaaagtatcttcaactcagctgctgtaccaatcatgcccataccaagcattgaccttgttcattgttggtccgttcctcgatggatttctgactaacaaaaatgtctttgcttttgaatacacacctcaagttctgttcttcattgtgctgtcgtgtctgatatcagtctccgtgaacttcagcactttccttgtgattgggaagacatctcctgtaacttatcaagtccttggccatctaaagacatgtttggttcttgccttcggctatgtcttgcttcacgacccgtttagctggagaaacatacttggaatcctgattgcagtggttgggatgggactatattcctacttctgcacccgtgaaactcagccaaaaccaactgaagcctctccacaagtcacccaggtgaaggaaggcgaatcagaccctttgatcgcggactccttgaacgccgccgagaacggagccgctgcagccaccgacgagcctctgaaggtccccatgtggagctccaagtatgcacgggcatgagcgctgctcctccgacctctgaaggtgcccatgtggagctccaagcgctcgcgggcatgaacgccgcttcggaccttggttcatggtattatatacataattattcagtttagtaggcagatagtagggctggaaggaagccaggccagccctgagtgtaatgaacgttccttgttccatttttgggccttttttttctttgcttttgttttggcttaccatgcctgtggtgctgttgtaaaagtggatctcaccccaaatgactccaaatggcagatctaccctttgttgaagctaagatacaaaattgctgggcaggacatctcttgtattagttttttgcatgttcagcttcggatccgcggttgtaactttggtcgcaagacattaaaatatcaacatgtagtttacatttacaagtgccactgcatgatctgtggtgatcttttgagctttagtttgcgatataagatgcattttctctc

SEQ ID NO: 2782 - DNA, 1718 bp, Festuca arundinacea
ggcacgagggacgggtggagtctccccaggaacgcagctagcacgactacacagcacgagctgccgaccgaccgcgagcggagagctgacccggatcccgatccctcccgctcctgcacctgcccacctcccagatctccctcccgagctcctcccccagatccagctcgaggcacttggattctcttctccccggagcaaagaggtcccgccggcggcggttctggtggagaagctagctcttcggtcccgcttgctgccgtttcttgctgctttctgtcggtaggccgcggcggagatgggggtggcgggggagaagttccagctggggacggtgggggcgctgagcctctccgtggtctcctcggtctccattgtcatctgcaacaaggccctcatgagcgccctcggcttcatcttcgccaccacgttgacaagctggcatcttctggtcacgttttgttcacttcatgtggcattatgtctgaaattctttgagcacaagcctttcgatgcaaggaccgttatggggtttggcgtgctcaacggcatctcaattgggctcctcaatctcagtctaggtttcaattctgttggtttctatcagatgacaaagctggccattattccctgcactgttatcctggagacacttttcttcaggaagaagtttagtcggtacatccagctctccctaagtgtgctcctttttggtgttggagttgcaactgtgactgatctgcaactcaatgctatggggtctgtgctgtctttgttggcaatcgtcacgacctgcattgctcaaattatgaccaacacaattcagaagaagttcaaggtatcttcaacccagctgctgtaccaatcatgcccataccaagcattgaccctgttcgttgttggtccattcctcgatggatttctgactaacaaaaatgtctttgcttttgattacacgccccaagttctgtttttcatcgtgctgtcgtgcctgatatcagtgtcggtaaacttcagcactttccttgtgattgggaagacatctcctgtaacttaccaagtccttggtcatcttaagacatgcttggttcttgccttcggctatgtcttgcttcatgatccatttagctggagaaacatccttggaatcctgattgcagtgattgggatgggactatattcatacttctgtacccgcgaaactaaacccactgaagcctctccacaagtcactcaggtgaaagaaggtgaatcagaccctttgatctcggattccttaagcagcgctgagaacggggctgctgcagccgatgatgagcctctgaaggtacccatgtggagctccaagtacgcacgggcatgaacgccgctccgatgttggttcatggtgctatacataattattcagcttagtaggcagatagtagggctggaaggaagccagccagccctgagtgtaatgaacgttccttgttccatttttgggccttttttttatcttgcttttgttttggcttaccatggccatggtggtgttattaaaatggatctcactccgaatgactccaaatggcagatctaccttgaagctaagacacacaattgctgggcacgagacctcttgtattatttttcacatgttcagcttcgaattcgcccttgtaaacttgtaacttggtagcaagacataaataccaacacgtagtttacattctttt

SEQ ID NO: 2783 - DNA, 1448 bp, Avena sativa
cgcagctagcacgactacacagccacgagctgccgaccgaccgcgagcggagagctgacccggatcccgatccctccagctccttcccccgctcgcctccccagatctccccgtgcgcccctctcccagatccagctccaggcagtcgtcttccaccagcgctccggagccaaagaggtcctgccggcggggagtgcttcggtggttctgctattcggttccgtttcctgcttctgttcggtagcaaaagcggcggcggagatgggggtggcgggggagaagttccagctggggaccgtgggggcgctgagcctctccgtggtctcctcggtctccattgtcatctgcaacaaggccctcatgagcgccctcggcttcatcttcgccaccacgttgacaagctggcatcttctggttacgttctgttcactccatgtggcattatggctgaagttctttgagcacaaacctttcgatgcaaggactgttatgggatttggtgtgctcaatggcatctcaattgggctcctcaatttgagtctgggtttcaattccgttggtttctatcagatgacaaagctggccattattccctgcactgttatcttggagactcttttcttcaggaagaagttcagtcggtacatccagctctccctcagtgtcctcctttttggtgttggagttgcaactgtgactgatctgcaactcaatgctatgggatctatactgtctttactggcaatcatcacgacctgcattgctcaaattatgacaaatacaattcagaagaagttcaaggtatcttcaacccagctgctgtaccaatcatgcccataccaagcattgaccctgtttgttgttggtccattccttgatggatttctgactaacaaaaatgtctttgcttttgcctacacgcctcaagttctgttcttcatcgtgctgtcgtgcctgatatcagtctccgtaaacttcagcactttccttgtgattgggaagacatctcctgtaacttaccaagtccttggccatcttaagacgtgcttggttcttgcctttggatatgtcttgcttcatgatccctttagctggagaaatatacttggaatcctgattgcagtgattgggatggggctatactcatacttctgtacccgagaaactcagcagaaacccgctgaagcctctccacaagtcacccaggtgaaagaaggtgaatcagaccctttgatctcggactccttgagcaccgctgagaacggggccgttgcagccaccgatgagcctctgaaggtgcccatgtggagctccaagtacgcacgggcatgaacgccaccccgacgatagctcatggcactatacataattattcagcttagtaggcagatagtagggctggaaggaagccagtcagccctgagtgtaatgaacgtgttccttgttcc

SEQ ID NO: 2784 - DNA, 1832 bp, Secale cereale
ccgagttagcgtaaactcgatcggacccgtcagtgtcacttacgagcacgtgcagcacgaccccaccgccctaagtccccctcgtcgttgcccttgctcccacgactgagagagacgggtgaggccagaacgcagcacgactgcacagcaccagctgccgaccgaccgcgggcggagctgaccccccgaccgatcagatccctcgccgcccgcccccccagatctccccgcgcgagcctctcccagatccagctcccagcgctcggattttcagctaagaggtcctgccggcggcgtggttcggtgggaagctcgtcggctgctgctgctgctgcttcttcctgctttccgtgctccggctgtagcgaaggcggccggcggagatgggggtggcgggggagaagttccagctggggacggtgggggcgctgagcctctccgtggtctcctcggtctccattgtcatctgcaacaaggccctcatgagcgccctcggcttcatcttcgccaccacgttgacaagctggcatctcttggtgacattctgttcgctccatgtggcattatgcatgaagctctttgagcacaaacctttcgacgcaaggaccgtcatgggattcggagtgctcaacggcatctcgattgggcttctcaatctgagtctgggtttcaattctgttggtttctatcagatgacaaagctggccattattccctgcactgttatattggagactcttttctttaggaagaagttcagtcgctacatccagctctcccttagtgtgctcctttttggtgttggagttgcaactgtgactgatctgcagctcaatgctatgggatctgtcctgtctttactggcaatcgtcacaacctgtattgctcaaattatgaccaatacaattcaaaagaaattcaaagtatcttcaactcagctgctgtaccaatcatgcccataccaagcattgaccctgttcattgttggtccattcctcgatggatttctgactaacaaaaatgtctttgcttttgaatacacacctcaagttctgttcttcatcgtgctgtcgtgtctgatatcagtctcggtgaacttcagcactttccttgtgattgggaagacatctcctgtaacttaccaagtccttggccatctaaagacatgcttggttcttgccttcggctatgtcttgcttcacgacccgtttagctggagaaacatacttggaatcctgattgcagtggttgggatgggactatattcatacttctgcacccgtgaaactcagccaaaaccaactgaagcctctccacaagtcactcaggtgaaagaaggcgaatcagaccctttgatcgcggactccttgaacgctgccgagaacggagccgccgcagccaccgacgagcctctgaaggtccccatgtggagctccaagtacgcgcgggcatgaacgctgctgctccgacctctctgaaggggtgcccatgtggagctccaagcgctcgcgggcatgaacgccgcttcggaccttggttcatggtattatatacataattattcagtttagtaggcagatagtagggctggaaggaagccaagccagccctgagtgtaatgaacgttccttgttccatttttgggccttttttcttcccccccttttttttgcttctgttttggcttaccatgcccgtggtgctgttgtaaaagtggatctcactccaaatgactccaaatggcagatctacctttgttgaagctaagatacaaaattgcaattgctgggcaggggatctcttgtagtattatttttcgcacgttcggcttc

SEQ ID NO: 2785 - DNA, 1740 bp, Secale cereale
gcaccagctgccgaccgaccgcgggcggagctgacccccccgacccgatcagatccctcgccgcccgccccctcagatctccccgcgcgcgcctctcccagatccagctcccagcgctcggattttcagctaagaggtcctgccagcggcgtggttcggtgggaagctcgtcggctgctgctgctgccgctgattcttgctttccgtgctctgtctgtagcgaaggcggccggcggagatgggggtggcgggggagaagttccagctggggacggtgggggcgctcagcctctccgtggtctcctcggtctccattgtcatctgcaacaaggcgctcatgagcgccctcggcttcatcttcgccaccacgttgacaagctggcatctcttggtgacattctgttcgctccatgtggcattatgcatgaagctctttgagcacaaacctttcgacgcaaggaccgtcatgggattcggagtgctcaacggcatctcgattgggcttctcaatctgagtctgggtttcaattctgttggtttctatcagatgacaaagctggccattattccctgcactgttatattggagactcttttctttaggaagaagttcagtcgctacatccagctctcccttagtgtgctcctttttggtgttggagttgcaactgtgactgatctgcagctcaatgctatgggatctgtcctgtctttactggcaatcgtcacaacctgtattgctcaaattatgaccaatacaattcaaaagaaattcaaagtatcttcaactcagctgctgtaccaatcatgcccataccaagcattgaccctgttcattgttggtccattcctcgatggatttctgactaacaaaaatgtctttgcttttgaatacacacctcaagttctgttcttcatcgtgctgtcgtgtctgatatcagtctcggtgaacttcagcactttccttgtgattgggaagacatctcctgtaacttaccaagtccttggccatctaaagacatgcttggttcttgccttcggctatgtcttgcttcatgacccgtttagctggagaaacatacttggaatcctgattgcagtggttgggatgggactatattcatacttctgcacccgtgaaactcagccaaaaccaactgaagcctctccacaagtcactcaggtgaaagaaggtgaatcagaccctttgatcgcggactccttgaacgctgccgagaatggagccgccgcagccaccgacgagcctctgaaggtccccatgtggagctccaagtacgcccgggcatgagcgctgctcctccgacctctgaagaggtgcccatgtggagctccaagcgctcgcgggcatgaacgccgcttcggaccttggttcatggtattatatacataattattcagttcagtaggcagatagtagggctggaaggaagccaagccagccctgagtgtaatgaacgttccttgttccatttttgggccttttttctttccccccctttttttcgcttctgttttggcttaccatgcctgtggtgctgttgtaaaagtggatctcactccaaatgactccaaatggcagatctacctttgttgaagctaagatacaaaattgcaattgctgggcaggggatctcttgtagtattatttttcgcacgttcggcttcggatccgcggttgtaactttggtcgcaagacataaatatcaacacgtagtttac

SEQ ID NO: 2786 - DNA, 1992 bp, Oryza sativa
ctctgagtcaatcaatagctcccaaatctgaaagcctctctctatctttctatccatctctccattcattcatctctctccatttccaatccatctcatcaccgacgacgcgagaagagggacgaccttcccccgtataaaaactccacctttgtctcctcccctccccccttccctcccatcccccgattcgccaccgcgaatcccaccaccacccgcagatctccgcctcggcgccattgcccaccctccacgcccccgccagattcgcccagatccacagccgggtgcatccggcggcgtggctggggcgccctcgatcgggaagctttgatcttcgtaccctttttgcggtgggcgggcggcgggcggcggaggaggaggagatgggtgtcggcggggagaagttccagctggggacggtgggggcgctgagcctctccgtggtgtcatccgtctccattgtcatctgcaacaaggcgctcatgagctccctcggcttcaactttgccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccagatgacaaagctggctatcatcccatgcactgttattttggagactcttttcttcaggaagaagttcagccggagtatccaactgtccctttcagtgctcctctttggtgtcggtgttgcaacagtgactgatctgcaactcaatgctgtgggatccgtattgtccttgctggcaattattacaacctgcatcgcgcaaattatgacaaacactatccagaagaagttcaaggtttcttcaacccaattattataccaatcttgcccctatcaatcactgaccctcttccttattggtccattccttgatggatttttgactaaccaaaatgtatttgcattcgactacacatcccaagttgtgtttttcattgtattatcgtgcttgatatctgtctcagtgaacttcagcactttccttgtgatcggaaagacttctcctgtcacttaccaagtcctgggccatcttaaaacatgcctagtactgacctttggttatgttttgcttcatgacccatttagctggagaaacatactcggcatcctaattgcagtagttggaatggtcttatactcatacttctgcacattggagggccagcaaaaaaacgccgaagtctccccacaacaggcgaaagaaggcgattcggctcctttgatctcagactctctgagcaaagttgagaatggaggtggagtggttgatgatgagcctctcaaggtaccgatgtggagctcaaagtactcaagggcgtgaaaataccttccttttagaaggcggcattatacaggattcaatttggtaggcggatagtagggttggaagccaacccagattgtaatgaacattccagttacatttttgggtttatttaacattactatctagtatctactagcagtaaaagggttcttgggaggattttaccttcaagatagcagatctgccttgaaacttagacaacagatattgtatgattgtatctggatatgctccacatctttctcactgtaacttcctatgggaacatagatccacagatagacttcattcttttgtaccaaagatccagagaactagagatctgcaaggttcaagtttgtgactgtaagtttatgtttactttggacccagtgatggagcttttgtatatttaggaccaagtgcaaagaggggttcttttccaacaagttttcaatgcaataacatggaacaattgttctcttcaatcatgtaatttcccatgttcaaaacaatatttttggctgagtgaatcgaatgccgcatgaaccgatta

SEQ ID NO: 2787 - DNA, 1737 bp, Triticum aestivum
caagaacgcagcacgattgcacagcaccagctgccgaccgaccgcgggcggagctgaccccccgacccgatcagatccctcgccgctcgccccctcagatctccccgcgcgcgcccctcccagatccagctccgagcgcttggatttctgaagaggtcctgccggcggcgtggttcggtgggaagctcgtcggctgctgcttcttgcttcccgcgctctgtagccaaggcggccggcggagatggggctggcgggggagaagttccagctggggacggtgggggcgctcagcctctccgtcgtctcctcggtctccattgtcatctgcaacaaggcgctcatgagcgccctcggcttcatcttcgccaccacgttgacaagctggcatctcctggtgacattctgttcgcttcatgtggcattatgcatgaagctctttgagcacaaaccttttgacgcaaggaccgtcatggggttcggagtgctcaacggcatctcgattgggcttctcaatctgagtctgggtttcaactctgttggtttctatcagatgacaaagctggccattattccctgcactgttatattggagactcttttcttcaggaagaagttcagtcgttacatccagctgtcccttagtgtgctcctttttggtgttggagttgcaactgtgactgatctgcagctcaatgctatgggatctgtgctgtctctactggccatcgtcacaacctgtattgctcaaattatgaccaatacaattcaaaagaagttcaaagtatcttcaactcagctgctgtaccaatcatgcccataccaagcattgaccctgttcattgttggtccattcctcgatggatttctgactaacaaaaatgtctttgcttttgcatacacacctcaagttctgttcttcatcgtgctgtcgtgtctgatatcagtctcggtgaacttcagcactttccttgtgattgggaagacatctcccgtaacttaccaagtccttggccatctaaagacatgcttggttcttgccttcggctatgtcttgctgcacgatccgtttagctggagaaatatacttggaatcctgattgcagtggttgggatgggactatattcatacttctgcacccgtgaagctccaaagcccactgaagcctctccacaagtcactcaggtgaaggaaggcgaatcagaccctttgatcgcagactccttgaacgccgccgagaatggagctgctgcaaccaccgacgagcctctgaaggtccccatgtggagctccaagtacgcgcgggcatgaacgctgctgctccgacctctgaaggtgcccatgtggagctccaagcgctcgcgggcatgaacgccgcttcggaccttggttcatggtattatatacataattattcagtttagtaggcagatagtagggctggaaggaagccaggccagccctgagtgtaatgaacgttccttgttccatttttgggccttttttctttccccccctttttttgcttctgttttggcttacgatgcctgtggtgctgttgtaaaagtgaatctcaccccaaatgactccaaatggcagatctacctttgttgaagctaagatacaaaatttcaattgctgggaaggggatctcttgtagtattatttttcgcatgttcagcttcggatccgcggttgtaactttggtcgcaagacataaatatcaacacgtagtttac

SEQ ID NO: 2788 - DNA, 1778 bp, Secale cereale
tcagaacgcagcacgactgcacagcaccagctgccgaccgaccgcgggcggagctgacccccccgccccgatcagatccctcgccccccgccccctcagatctccccgcgcgagcctctcccagatccagctcccagcgctcggattttcagctaagaggtcctgccggcggcgtggttcggtgggaagctcgtcggctgctgctgctgccgctgattcttgctttccgtgctctgtctgtagcgaaggcggccggcggagatgggggtgcgggggagaagttccagctggggacgtgggggcgctgagcctctccgtggtctcctcggtctccattgtcatctgcaacaaggccctcatgagcgccctcggcttcatcttcgccaccacgttgacaagctggcatctcttggtgacattctgttcgctccatgtggcattatgcatgaagctctttgagcacaaacctttcgacgcaaggaccgtcatgggattcggagtgctcaacggcatctcgattgggcttctcaatctgagtctgggtttcaattctgttggtttctatcagatgacaaagctggccattattccctgcactgttatattggagactcttttctttaggaagaagttcagtcgctacatccagctctcccttagtgtgctcctttttggtgttggagttgcaactgtgactgatctgcagctcaatgctatgggatctgtgctgtctttactggcaatcgtcacaacctgtattgctcaaattatgaccaatacaattcaaaagaagttcaaagtatcttcaactcagctgctgtaccaatcatgtccataccaagcattgaccctgttcattgtcggtccattcctcgatggatttctgactaacaaaaatgtctttgcttttgaatacacacctcaagttctgttcttcatcgtgctgtcgtgtctgatatcagtctcggtgaacttcagcactttccttgtgattgggaagacgtctcccgtaacttaccaagtccttggccatctaaagacatgcttggttcttgccttcggctatgtcttgcttcacgatccatttagctggagaaacatacttggaatcctgattgcagtggtcgggatgggactatattcatacttctgcacccgtgaaactcagccaaaaccaactgaagcctctccacaagtcactcaggtgaaggaaggcgaatcagaccctttgatcgcagactccttgaacgctgccgagaacggggccgctgcagcgaccgacgagcctctgaaggtccccatgtggagctccaagtacgcgcgggcatgagcgctgctcctccgacctctgaaggggtgcccatgtggagctccaagtgctcgcgggcacgaacgccgcttcggaccttggttcatggtattatatacataattattcagtttagtaggcagatagtagggctggaaggaagccaagccagccctgagtgtaatgaacgttccttgttccatttttgggcctttttttcttcccccctttttttttctgcttctgttttggcttaccatgcctgtggtgctgttgtaaaagtggatctcactccaaatgactccaaatggcagatctacctttgttgaagctaagatacaaaattgcaattgctgggcaggggatctcttgtagtattatttttcgcacgttcggcttcggatccgcggttgtaactttggtcgcaagacataaatatcaacacgtagtttacattcaaaaaaaagtc

SEQ ID NO: 2789 - DNA, 2219 bp, Sorghum bicolor
cgttaatatttcatcaccagagtctacatttcgtgttgcgcacgaaatatacaattcaagattaaaaaaagacaagataagttgaggatacaacaattcaagtggtatatcctcgtgtgagtctggctgcttttagctagttctccattcagcatgtttttgcaattctaggaaagaaaaaggaagaaggctggccccacatacaaaaaaaaatcttgaaggttagcaaagtaattactgccactgcagagtcaaaataccagcaatagcaatgccctctctctaatcagctttcctcaccgacggcgaccgaccgaccagccatataataaagaaccaccctcctccccgtccctgattcgcgagaccggagaggggcacgagcgccaccgccttgatcccgcccgctcctcccccagatctcctcgccattgccgccgcgctacccagattcgcgccccctcctcgcccagatccgaccgcgggctctgcttggtttcccaagccgacggaggagcggtgcacccggccgcgtgattccggcggctcgattggaaattcgtgatctttcggcgggggcattcctcgggttggtctgtcggtgccggtggtgtggtggtgctgctgctgcgtttcgagggccgcggagatgggtgtcggcggggagaagttccagctggggacggtgggggcgctgagcctctccgtggtgtcctccgtctccattgtcatctgcaacaaggctctcatgagctccctcggctttaacttcgccactaccttgacaagctggcatctgctggttacattctgctcccttcatgtagcattgtggatgaagttctttgagcataagcctttcgattcaagaactgtcatgggatttggagtacttaatggaatctccattggactcctcaacttgagtcttggcttcaactctgttgggttttaccagatgactaagctggcaatcatcccgtgcactgtcattttagagacacttttcttcaggaagaagttcagtcggagtatccagatgtccctttctgtgctccttctcggtgttggtgttgcaactgtcactgatctgcaactcaatgctgtcggatccatactgtccttgctggcaattatcacgacttgcattgctcaaattatgactaacaccatccagaagaagttcaaggtctcgtcaacccaactgctttaccagtcttgcccttaccaatcactgaccctgtttctcattggcccctttcttgatggctttttgactaaccaaaatgtctttgcttttaattatacatctcaagttgtgtttttcatcgtgttgtcgtgcttgatatcggtctcagtgaacttcagcacttttcttgtgatcggaaagacatctcctgttacttaccaagtcctgggccatcttaaaacctgccttgttcttacctttggttatgttttgcttcacgatccatttagctggagaaacatacttggaatcctaattgcagtagttggaatggtcttgtattcatacttctgcacagtggagacccagcaaaaaaacaccgaagtctccccacagcaggtgaaagaaagcgaggcagcccctttgatctcagattctttgagcaaagctgaaaacgggggcggtggtgttgatgacgagcctttgaaggtacccatgtggagctcaaagtattcacgggagtgaaaatttctacctcttgacgatggcatcatacaggattcaatttagtaggcagatagtagggttggaagccaacccagagtgtaatgaacacatttcagttacatttttgggcttctttagcgtcacaatctactagcggtaaaaggatctgtttcttgggaggatgttaccttcagggttctcagatataccttgaaactagacagcagatattgtatgattgtatctggatatgctccacatcctcttactgtaacttccaactgggacatggcatgcttatatccaaagatagacttcattctttttgtatcaaaaagatcaggacaagacatgtgccaagatttgtagcatttataggttcaattttgttgctttcagttcattaaacctcttgtcatgcaagttttgtacattagaagtcaatttaaggaaacgcttatttttcgtttacttcttccatgtaaaggttacatattttagtgattatgatgccttcatgatc

SEQ ID NO: 2790 - DNA, 2005 bp, Panicum virgatum
gagtcaataggctctcaaatcgcaatgcccttaatcacctttctcaccgacggcgaccgaccagccatataagagaagcgaagcgaaccatcctccctccccgtccctgattcgcgagaccagcggggcacgagcgcccccgccctgatcccgtccggctcctacgcagatctccccgccattgccaccgccccgcccagattcgagccctcctcgctcagatccgaccgcggttctgatttccctagccgacacaggagcggtgctcggggcgacgtgattccagcggtttgattggaaagttttgatcttccggaggcgtccattcgtttgtttgtcggtggtggtgcgtttggaggtcggcggagatgggcgtcggcggggagaagttccagctggggacggtgggggccctgagcctctcggtggtgtcctccgtctccattgtcatctgcaacaaggcgctcatgagctccctgggcttcaacttcgccactaccttgacaagctggcatttgctggttacattctgctcccttcatgtagcgttatggatgaaattctttgagcataagcctttcgattcaagaactgtcatgggttttggagtacttaatggaatctccattgggctcctcaacttgagtcttggcttcaactccgttgggttctaccagatgactaagctggcgatcatcccgtgcactgtcattttagagacacttttcttcaggaagaagttcagccggagtatccagatgtccctttctgtgctccttcttggtgttggtgttgcaacggtcactgatctgcaactaaatgctgtggggtccatactgtcccttctggcaattatcacgacttgcattgctcaaattatgacaaacactattcagaagaagttcaaggtttcgtcaacccaactactctaccaatcttgcccttaccaatcgctaaccctgtttcttattggccccttccttgatggctttttgactaaccaaaatgtctttgcttttaattacacttctcaagttgtgtttttcatcgtgttgtcatgcttgatatctgtctcagtgaacttcagcacttttctcgttattggaaagacatctcctgttacttaccaagttctgggccatctgaaaacatgtcttgttcttaccttcggatatgttttgcttcacgatccatttagctggagaaacatacttggaatcctaattgcagtagttggtatggtcttatattcatacttctgcacagtggagacccagcaaaaaaatgccgaagtctccccacaacaggtgaaagaaagcgaggcagtccctttgatctcagactctttgagcaaagttgaaaatgggggtggtgttgctgacgatgagcctctgaaggtacccatgtggagctcaaagtattcgcgggagtgaaaagttcttcgtcttgacgatggcatcatacaggattcaatttagtaggcagatagtagggttggaagccaacccaggtgtaatgaatgtttcagttacatttttgggcttcttagcgtcgctgtctgtcgctgtctatagaggtaaatggatctgtttcccaggaggatcttaccttcagaactcgcagatctaccatgaaactagacagcagatattgtatgattgtatctggatatgctccaaatctcttcctgtaacttccgaagggggcataccaatatccaaagatagacttcattctttttgtaccaaagatcaagataaccagagttgtgcaagttttgaagtatttacaggttctagtttgtgctgttagttcatattctcttcggaccctggtatgcttgtgttgtatatttgaagtcaaatagtcaattaagaaaacagcaggttaaggttatatattaaaactttcgatgttgaactgcatattgactgagtatcatttcttcatgaaccatacaatggttctccctccgtccataaatgttagcatttctagagattag

SEQ ID NO: 2791 - DNA, 1918 bp, Setaria italica
atgcccttctaatcacttttctcaccgacggcgaccgaccagccatataagatacagaagcgaagcgaaccgcccctctcgtctccctcctccccgtccctgattcgcgagaccagaggggcacgagcgccaccgccctgatcccgcccgctcctacccagatctcaccgccattgctgccgccctgcccagattcgcgccctcctcgcccagatccgaacgtggttctgatttccctagccgacacaggagcggtgctccgggcggcgtgattccagcggtttgattggaaagttttgatctttggggggcgttcgttggtttgcttgtcggtggtggtgcgtttggagagcggcggagatgggcgtcggcggggagaagttccagctggggacggtgggggcgctgagcctctcggtggtgtcctccgtctccattgtcatctgcaacaaagcgctcatgagctccctaggcttcaacttcgccactaccttgacgagctggcatctgctggttacattctgctccctacatgtagcattatggatgaaattcttcgagcataagcctttcgattcaagaactgtcatgggttttggagtgcttaacggaatctccattgggctcctcaacttgagtcttggcttcaactctgttgggttctaccagatgactaagctggcgatcattccgtgcactgtcattttagagacacttttcttcaggaagaagttcagccggagtatccagatgtccctttctgtgctccttcttggtgttggtgttgcaacggtcaccgatctgcaactaaatgctgtgggatccacactgtccctgctggcaattatcacgacttgcattgctcaaattatgacaaacactattcagaagaagttcaaggtttcatcaacccaactgctctaccagtcttgcccttaccaatcactgaccctgtttctcattggccccttccttgatggctttttgactaaccaaaatgtctttgcttttaattacacatctcaagttgtgtttttcattgtgttgtcatgcttgatatctgtctcagtgaacttcagcacttttctcgtgatcggaaagacatctcctgttacttaccaagtcctgggccatctgaaaacatgccttgttcttacctttggttatgttttgcttcacgatccatttagctggagaaacatacttggaatcctaattgcagtagttggaatggttttatattcatacttctgcacagtggagacacagcaaaaaaacactgaagtctccccacaacaggtgaaagaaagcgaggcagcccctttgatctcagactctttgagcaaagttgaaaacgggggtggtgttgctgatgacgagcctcttaaggtacccatgtggagctcaaagtattcgcgggagtgaaaatttcatcctcttgacgatggcatcatacaggattcaatttagtaggcagatagtagggttggaagccaacccagagtgtaatgaatgtttcagttacatttttgggcttctttagcgtcgcttattactagcggtgaatggatctgtttctctggaggacctttaccttcggagccgcaggtctaccttgaaactagacagcagatattgtatgattgtatctggatatgctccaaatcttcttactgtaacttccctggacatgcctatatccaaagatagactccattctttttgtaccaaagatccagataaccagagttgtgcataggttctagtttgtgctgttagttaatattcaccttggaccctgttatgcaagtgttgtatatttaaagtcatttaagaaaacatccattttcctttagttttccatttaagacttccgttgttgagctgcacgttaactgattatcatttcttgatgatc

SEQ ID NO: 2792 - DNA, 1819 bp, Zea mays
aatgatgccctctctctaatcagctttctcaccgacggcgaccgaccgaccagccatataataaagaagcgaagctaagcgagaccggaggggcacgagcgccaccgccttgatcccgcccgctcctccccagatctcctcgccattgccgccgccctgccaggattcgcgccctactcgcccagatccgaccgcggctctgattttccaactgacgcaggagcggtgggtctgaccgggcgcgacccgtcttctcatgggcgagacagcgtgatccctgcggctcgattgtaaattcgtgatctttcggggcattccttggtttgtctgtcggtgctggtggtgctgcgtttggagggccgcggagatgggcgtcggcggggagaagttccagctggggacggtgggggcgctgagcctctccgtggtgtcctctgtctccattgtcatctgcaacaaggcgctcatgagctccctcggctttaacttcgccactaccttgacgagctggcatctgctggttacattctgctcccttcatgtagcattatggatgaagttctttgagcataagccttttgattcaagaactgtcatgggatttggagtacttaacggaatctccattgggctcctcaacttgagtcttggcttcaactctgttgggttttaccagatgactaagctggcaatcatcccgtgcactgtcattttagagacacttttcttcaggaagaagttcagtcggagtatccagatgtccctttctgtgcttcttcttggtgttggtgttgcaactgtcactgatctgcaactcaatgctgtgggatccatactgtccttgctggcaattatcacgacttgcattgctcaaattatgacaaacactatccagaagaagttcaaggtctcatcaacccaactgctttaccagtcttgcccttaccaatcactgaccctgtttctcattggccccttccttgatggctttttgactaaccaaaatgtctttgcttttaattatacatctcaagttgtgtttttcatcgtcctgtcatgcttgatatctgtttcagtgaacttcagcactttccttgtgatcggaaagacatctcctgttacttaccaagtcctgggccatcttaaaacatgccttgttcttgcttttggttatgttttgcttcacgatccgtttagctggagaaacatacttggaatcctaattgctgtagttggaatggtcttgtattcatacttctgcacagtggagacccagcaaaaaaatgttgaagtctccccacaacaggtgaaagaaagcgaggcaggccctttgatcgcagactctatgagcaaagttgaaaacgggggtggtggtgttgatgacgagcctttgaaggtacccatgtggagctcaaagtactcgcgggagtgaaaaggtcacgatggcatggcaccatacaggattcaatttagtaggcagatagtagggttggaagccaacccagagtgtaatgaacatttcagttacatttttgggcttctttagtgtcgcagtctactagcagttaaaggatctgtttcttggaaggatcctaccttcagggctctcagacctaccttgaaactagacagcaggtattgtatgattgtatctcgatatgctccacatcctcttactgtaacttccaactggtacatggcgtgcctatatccaaagatagacctcattctttttgtatcaagaagatccggataagaagacttgtgcaagatttgtagcgtttagtgaaatttgtgactgtcagtcatgttcgcttta

SEQ ID NO: 2793 - DNA, 1811 bp, Panicum virgatum
accgaccagccatataagaaagagaagcgaagcgaaccatcctccctccccgtccctgattcgcgagaccagcggggcacgagcgcccccgcctgatcccgtccggctcctacgcagatctccccgccattgccaccgccccgcccagattcgagccctcctcgctcagatccgaccgcggttctgatttccctagccgacacaggagcggtgctcggggcgacgtgattccagcggtttgattggaaagttttgatcttccggaggcgtccattcgtttgtttgtcggtggtggtgcgtttggaggtcggcggagatgggcgtcggcggggagaagttccagctggggacggtgggggccctgagcctctcggtggtgtcctccgtctccattgtcatctgcaacaaggcgctcatgagctccctgggcttcaacttcgccactaccttgacaagctggcatttgctggttacattctgctcccttcatgtagcgttatggatgaaattctttgagcataagcctttcgattcaagaactgtcatgggttttggagtacttaatggaatctccattgggctcctcaacttgagtcttggcttcaactccgttgggttctaccagatgactaagctggcgatcatcccgtgcactgtcattttagagacacttttcttcaggaagaagttcagccggagtatccagatgtccctttctgtgctccttcttggtgttggtgttgcaacggtcactgatctgcaactaaatgctgtggggtccatactgtccctgctggcaattatcacgacttgcattgctcaaattatgacaaacactattcagaagaagttcaaggtttcgtcaacccaactactctaccagtcttgcccttaccaatcgctaaccctgtttcttattggccccttccttgattgctttttgactaaccaaaatgtctttgcttttaattacacttctcaagttgtgtttttcatcgtgttgtcatgcttgatatctgtctcagtgaacttcagcacttttctcgttattggaaagacatctcctgttacttaccaagttctgggccatctgaaaacatgtcttgttcttaccttcggatatgttttgcttcacgatccatttagctggagaaacatacttggaatcctaattgcagtagttggtatggtcttatattcatacttctgcacagtggagacccagcaaaaaaatgccgaagtctccccacaacaggtgaaagaaagcgaggcagtccctttgatctcagactctttgagcaaagttgaaaatgggggtggtgttgctgacgatgagcctctgaaggtacccatgtggagctcaaagtattcgcgggagtgaaaagttcttcgtcttgacgatggcatcatacaggattcaatttagtaggcagatagtagggttggaagccaacccaggtgtaatgaatgtttcagttacatttttgggcttcttagcgtcgctgtctgtcgctgtctatagaggtaaatggatctgtttcccaggaggatcttaccttcagaactcgcagatctaccatgaaactagacagcagatattgtatgattgtatctggatatgctccaaatctcttcctgtaacttccgaagggggcataccaatatccaaagatagacttcattctttttgtaccaaagatcaagataaccagagttgtgcaagttttgaagtatttacaggttctagtttgtgctgttagttcatattctcttcggacactggtatgcttgtgttgtatatttgaagtcaa

SEQ ID NO: 2794 - DNA, 1933 bp, Panicum virgatum
atgcccttgttaatcacctctctcaccgacggcgaccgaccagccatataagaaagagaagcgaagcgaagcgaagcgaaccatcctccctccccgtccctgattcgcgagaccagcggggcacgagcgccaccgtcctgatcccgcccggctcctacgcagatctccccgccattgccaccgcgcttcccagattcgcgcccttctcgccccagatccgaccgcggttctgatttccctagccgacacaggagcggtgctccgggcggcgtgattccggcggtttgattggaaagttttgatcttccgggggtgttcgttcgtttgtttgtcggtggtggtgcgtttggaggtcggcagagatgggcgtcggcggggagaagttccagctggggacggtgggggccctgagcctctcggtggtgtcctccgtctccattgtcatctgcaacaaggcgctcatgagctccctgggcttcaacttcgccactaccttgacaagctggcatctgctggttacattctgctcccttcatgtagcgttatggatgaaattctttgagcataagccttttgattcaagaactgtcatgggttttggagtacttaatggaatctccattgggctcctcaacttgagtcttggcttcaactctgttgggttctaccagatgactaagctggcgatcatcccgtgcactgtcattttagagacacttttcttcaggaagaagttcagccggagtatccagatgtccctttctgtgctccttcttggtgttggtgttgcaacggtcactgatctgcaactaaatgctgtggggtccatactgtccctgctggcaattatcacgacttgcattgctcaaattatgacaaacactattcagaagaagttcaaggtttcgtcaacccaactactctaccagtcttgcccttaccaatcgctaaccctgtttcttattggccccttccttgattgctttttgacgaaccaaaatgtatttgcttttaattacacttctcaagttgtgtttttcattgtgttgtcatgcttgatatctgtctcagtgaacttcagcacttttctcgttattggaaagacatctcctgttacttaccaagtcctgggccatctgaaaacatgtcttgttcttaccttcggatatgttttgcttcacgatccatttagctggagaaacatacttggaatcctaattgcagtagttggcatggtattatattcatatttctgcacagtggagacccagcaaaaaaatgccgaagtctccccacaacaggtgaaagaaagcgaggcagtccctttgatctcagactctttgagcaaagttgaaaatgggggcggtgttgctgacgatgagcctctgaaggtacccatgtggagctcaaagtactcgcgggagtgaaaaattcttccccttatcgatggcatcatacaggattcaatttagtaggcagatagtagggttggaagccaacccaggtgtaatgaatgtttcagttacatttttgggcttcttagcgtcgctgtctatagcggttaatggatctgtttcctaggaggatcttaccttcagagctcgcagatctaccatgaaactagacagcagatattgtatgattgtatctggatatgctccaaatatcttcttactgtaacttccgaagggggcatgccaatatccaaagatagacttcattctttttgtaccaaagatcaagataaccggagttgtgcaagatttggagtatttacaggccctagtttgtgctgttagttcatattcacttcggaccctggtatgcttgtgttgtatatttgaagtcaattaagaaaacagcactttaaggttatatattaaatctttcgttgttgaactgcacattgactgattatcatttcttgacaatc

SEQ ID NO: 2795 - DNA, 1352 bp, Pennisetum glaucum
cggcggggagaagttccagctggggacggtgggggcgctgagcctctctgtggtgtcctccgtctccattgtcatctgcaacaaggcgctcatgagctccctaggcttcaacttcgccactaccttgacgagctggcatctgctggttacattctgctccctacatgtagcattatggatgaaattcttcgagcataagccttttgattcaagaactgtcatgggttttggagtacttaatggaatctccattgggctcctcaacttgagtctaggcttcaactctgttgggttctaccagatgactaagctggcgatcattccgtgcactgtcattttggagacacttttcttcaggaagaagtttagccggagtatccagatgtccctttctgtgctccttcttggtgttggtgttgcaacagtcaccgatctgcaactaaatgctgtgggatccatactgtccctgctggcaattatcacgacttgcattgctcaaattatgacaaacactattcagaagaagttcaaggtttcatcaacccaactgctctaccagtcttgcccttaccaatcactgactctgtttctcgttggccccttccttgatggctttttgactaaccaaaatgtctttgcttttaattacacatctcaagttgtgtttttcattgtgctgtcatgcttgatatctgtctcagtgaacttcagcacttttctcgtgatcggaaagacatctcctgttacttaccaagtcttgggccatctgaaaacatgccttgttcttaccttcggttatgttttgctccatgatccatttagctggagaaacatacttggaatcctaattgcagtagttgggatggttttatattcatacttctgcacagtggagacacaaaaaaatactgaagtctccccgcaacaggtgaaagaaagcgaggcagcccctttgatctcagactctttgagcaaagttgaaaatggtggtgttgccgatgacgagcctctgaaggtacccatgtggagctcaaagtattcacgggagtgaaaatttcatcctcttcacgatggcatcatacaggattcaatttagtaggcagatagtagggttggaagccaacccagagtgtaatgaatgtttcagttacatttttgggcttctttagcgccgcttattactagcagtgaatggatctgtttctctggaggaccttaccttcagaaattacaggtctaccttgaaactagacagcagatattgtatgattgtatctggcatatgctccatatcttctcactgtaactcccctgggacatgcctatatccaaagatagactccattcttttt

SEQ ID NO: 2796 - DNA, 2067 bp, Hordeum vulgare
cgcagatccccccggcattgcccgctctccggccggattcgcccagatccaccgacgcggcgcgcggtgctcccggcggcgtggcccgggccgtctgatcgggaaggcttgatctttttgttgttgttggcgctgagggtggtggcagcggagatgggcgtcggaggggagaagttccagctggggacggtgggggcgctcggcctctccgtggtgtcctctgtatccattgtcatctgcaacaaggccctcatgagctccctcggcttcacctttgctaccaccttgacaagctggcatctcctggtcactttctgctcccttcatgtggcactatggatgaagtttttcgagcataaggcttttgattcaagaactgtcatgggattcggagtgctcaatggcatctccattgggctcctcaatctgagtcttggtttcaattctgttggcttttaccagatgacaaagctggccatcatcccctgcactgttattttggagactcttttcttcaggaagaagttcagccggactatccagatctctctttccgtgcttcttttgggtgtcggtgttgcaactgtgactgatttgcaactcaatgctgtgggatccatactgtccctgctggcaattatcacgacttgcatcgctcaaatcatgacaaacactattcagaagaaattcaaggtttcttcaacccagttgctataccagtcttgcccttatcagtcattgacgcttttccttatcggcccgttccttgatggattcctgactaaccaaaacgtcttcgctttcaattacacatccaatgttgtgtttttcatcgtcttgtcgtgtttgatatcggtctcagtaaacttcagcacctttcttgtgattggaaagacatctcctgttacttaccaagtcctgggccatcttaaaacatgcttagttttgaccttcggttatgttttacttcatgatccatttagctggagaaacatacttggcatcctaatcgccgtagttgggatggtactatattcatacttctgctcaatcgagacccaaccaaaaaatacagaagtctcctcacagcaggcaaaagaaggtgactcggcacctttgatctctgattctttgagcaaagttgaaaatggaggtgatgacgacgagcctttgaaggtaccgatgtggagctcaaagtactcgaaggcgtgaaaaattcgtctcttagacgtcggatggcattatacaggattcagtttagtaggcagatagtagggatggaagctaactttccaacccaagtaatgaagcaatggacatttcaattacaaagtaatggacatgttacaaattttgtgtttaattagcgtcactatctaaaagcagtaaaatgatctgattctttggaggggtttcccttccaaaatttcagatctaccatgaaactagacaacagatattgtacaattgtatctggatattgtccacatcctctcactgtaacttcatgttgggacattggtccgcagatagactccattctttttgtaccaactgtgcaagattttaaagtatttataggttcaagattgtaactgtaatttcagatttacctggaccataaagaaataatgcaagtgatgtacatttcagtttaaggagttgaaaataaccagattcattaccttgtaacaacccaaacagctatagttaatggaggaaacattcatatcaatcttgtgacaatgtatctatacagttctcacagtccctgtttttaccaacacattctgcaaaactgtaatgaaccagcaactgcatatactccagtttgctaaaagttccgttataacaaggaaaaacctacaatgcatgcatacaaaatggttcaccggttcttcagatgcatgctattgtcctcgctcccaagaaattggtatctttgtcagtgttcccataagcgaacatttatcgataatccaacagcccctcgtggaaacatcactcaacctttgcaacccctccttcaggtagactgctatcagaaaccgcttctcgcacaaacct

SEQ ID NO: 2797 - DNA, 2690 bp, Brachypodium distachyon
tcaccaccagaaaacccggaacattcaagaacgaaaataaataatccccttctgttaatctagcaaaatgcagctggtatatattatccaattgccaaatgggcagccatatctaatggcttcttctgcctttagtcaccgacgaggcgaccatccatataaaatacctcggctccctcttccccgcccctgattcgcaaggccagccagaggaggggagcgccaccgcgaatccccagcccccaccgccgatcccgcccgcccctctgcagatctccccgccattgcccgctcctcgccctgattcgcgctctcctcgcccagatccatcgagacactgcgcggtgcttccgcgggcgcggtccgggcgctgtgatcaggaattttgatattttttcgtggtgctggtgttgggcggcggcggagatgggcgtcggaggggagaagttccagctggggacggtgggggcgctgagtctctccgtggtgtcctccgtctccattgtcatctgcaacaaggccctcatgagctccctcggcttcaccttcgccacaaccttgacgagttggcatctcctggttactttctgctccctccatgtagcattatggatgaagttctttgagcataaggcttttgattcaagaactgtcatgggatttggagtacttaatggcatctccattggactcctcaacttgagtcttggtttcaattctgttggtttttaccagatgacaaagctcgccatcatcccctgcactgttattttggagactcttttcttcaggaagaagttcagccgcactatccaaatatccctttccgtgctccttttgggtgttggagttgcaactgtcactgatctgcaactcaatgctgtgggatccatactgtccttgctggcaattatcacgacctgcatcgctcaaattatgacaaacactattcagaagaaattcaaggtttcttcaacccagctgctataccagtcttgcccttaccaatcactgacactgtttcttattggtccattccttgatggatttctgactaaccaaaacgtttttgctttcaattacacatctcaagttgtgtttttcatcgtgttgtcgtgcttgatatcggtctcagtaaacttcagcacctttcttgtgatcggaaagacatctcctgttacttaccaagtcctgggccatcttaaaacatgcctagttctaacctttggttatgttttgcttcatgatccatttagctggagaaatatactgggcatcctaattgcggtggttgggatggtcctatattcatacttctgctcagtagaggcccagccaaaaagtgccgaagtttccactcagcaggcgaaagaaagcgactcggcccctttgatctcagactctctgagcaaagttgaaaatggaggtgatgatgatgagcctctgaaggtaccgatgtggagctcaaagtactcgagggcgtgaaaatttctttagacaatggatggcattatacaggattcaatttagtaggcagatagtagggttggaagccaacccagagtaatgaagcaatgaacattccagttacatttttgggttcctttagggtcactatctactagcagtaaaaggatctgattcttcagagggatttaccttcaagagtgcagatctgctttgaagctagacatcggatattgtatgattgtatctggaaccatagtcaaaagttctcactgtaacttcatgttgggtattgatccacaggtagactccattcttttgtatcaaagatcctgggaaccaaatgtgcaacatttgaagtatttataggttcaagtctgtaactgtaagtttagatttagcttggacccagtgatgctagtgtacatttcagttcaaggaaaaaaataaaaacaagaagccctttaattttaattttccaacttcattctagtcaagttatttccaccctgtaaataacttgacttgttgtattcttagtgggagcgctggtatttagtataacgggcagttgaactaaatacggaccccgtccacaaaacatacaacattccaagcggagtgaaatgtttagatctttgattacagctgtaccggtagattgttgttcagcacttatcgttcggcaaatgaaggagtgaacatcagtaccaatctagtgagaatgtacgtactactactaccaaaaataaaacggctcactgttttacatccagactagtattttgtgccatatctgttttttacactccaatacaggtcaattcttgcaacattcagatctcataggcatataacaaaactgtatcgacgaacacactaacaatcaatactccagtttccttagggcgccattataccaagggaaaaaaatctacagttcatctatctttcaacttgtcatgttataacagttaataaatagtccgctggttcttcaaatgcatgctcttgtgcagcagtggaattggcagcttgagtttagaatgtctttgccgcggtttccatcaatggacagactagtcaataatttgacagccccttgtggaaatatcactcaacctttgcaacccctccttctggtagactactatcagaaactgcttctcgcacaaacctgcaaagcagaatggtgcggtatcaataacacaacttccgtttaa

SEQ ID NO: 2798 - DNA, 1511 bp, Avena sativa
tcgcagatctccccgccattgctcgctccccgctcagattcgcgccctccttgcgcagatccaccgaggcagcgcgcggtgctgccggcggcgtggtcaggccagtctgatcaggcgtgctattgtttttgtttggagggtaataagcagcggagatgggtgtcggaggggagaagttccagctggggacggtgggggcgctgggcctctccgtggtctcctccgtctccattgtcatctgcaacaaggccctcatgagctccctcggcttcacctttgccaccaccttgacgagctggcatctcctagtcacgttctgctcacttcatgtagcattatggatgaagttcttcgagcataaggcttttgattcaagaactgtcatggggtttggagtgcttaatggcatctccatcgggctcctcaatttgagtcttggttttaattctgttggtttttaccagatgacgaagctggccattatcccctgcaccgtcattttggagactcttttcttcaggaagaagttcagccggactatccagatctccctttccgtgctccttttgggtgttggtgttgcaactgtcactgacctgcaactcaatgctgtgggatccatattgtccttgctggcaattatcacgacctgcattgctcaaatcatgacaaacacaattcagaagaaattcaaggtttcttcgactcagctactataccagtcttgcccttatcaatcactgacgctgtttcttattggtccgttccttgatggatttttaaccaaccaaaatgtctttgctttcaattacacatctcaagttgtgtttttcattgtattgtcgtgtttgatatcggtatcagtaaacttcagcacctttcttgtgatcggaaagacatctcctgttacttaccaagtcctgggccatcttaaaacatgcctagttctcacctttggctacgttttgcttcatgatccatttagctggagaaatatacttggcatcctaattgctgtagttgggatggtactatactcatacttctgctcaatagagccaaaaaatgctgaagtatccccacagcagacaaaagaaggcgactcggcacctttgatctcagactctctgagcaaagttgaaaacggaggcgatgacgacgagcctttgaaggtaccgatgtggagctcaaagtactcgagggcgtgagaaatttcctcttttagccagtggatggcattatacaggattcggttaagtaggcagatagtagggttggaagccaacccacagtaatgaagtaatggacatttcggctacattttttgcgcttaatctactagctgtaaaaggatctgattctttggaggattttaccttcgacgattgcagatctaccatgaaactagacagcagatatactgtatgattgtacctggaaatgggccacatcttctcactgtaacttcatgttgggacattaatccacagacacatagagtccattcttta

SEQ ID NO: 2799 - DNA, 1669 bp, Secale cereale
gattcgcccagatccaccgacgcagcgcgcggtgctcccggaggcgtggcccgggccgtctgatcgggaaggctcgatctttttggttggtgctgttgtctggagggtggtggcagcggagatgggcgtcggaggggagaagttccagctggggacggtgggggcgctgggcctctccgtggtgtcctccgtgtccattgtcatctgcaacaaggctctcatgagctccctcggcttcacctttgctaccaccttgacgagctggcatctcctggtcactttctgctcccttcatgtggcactgtggatgaagttcttcgagcataaggcttttgattcaagaactgtcatgggattcggagtactcaatggcatctccattgggctcctcaatctgagtcttggtttcaattctgttggcttctaccagatgacaaagctggccatcatcccctgcactgttattttggagactcttttcttcaggaagaagttcagccggactatccagatctccctttccgtgcttcttttgggtgtcggtgttgcaactgtgactgatttgcaactcaatgctgtggggtccatactgtccttgctggcaattatcacgacttgcatcgctcaaatcatgacaaacactattcagaagaaattcaaggtttcttcaacccagctgctatatcagtcttgcccttaccagtcattgacactgtttcttatcggcccgttccttgatggattcctgactaaccaaaacgtcttcgctttcaattacacatctaacgttgtgtttttcattgtcttgtcgtgtctgatatcggtctcagtaaacttcagcacctttcttgtgatcggaaagacatctcctgttacttaccaagtcctgggccatcttaaaacatgcctagttttgaccttcggttacgttttgcttcatgatccatttagctggagaaacatacttggcatcctaattgcggtagttgggatggtactatattcatacttctgctcaatagagactcaaccaaaaaataccgatgcctccgcacagcagtcaaaagaaggtgactcggcacctttgatctctgattctttgagcaaagttgaaaatggaggtgacgacgatgagcctttgaaggtaccgatgtggagctcaaagtactcaagggcgtgaaaatttcgtctcttagacggcggatggcattatacaggattcaatttagtaggcagatagtagggttggaagccaactttccaacccaagtaatgaagcaatggacatttcagttacaagtaatggacatgtcagttacaattttgtgtttatttagcgtcaccatctaaaagcagtaaaatgatctgattctttggagggttttaccttccaaaattgcagatctaccatgaaactagacaacagatattgtaaaactgtatctggatatggtccaaatcttctcactgtaacttcatgttgggacactggtccaaaggtcccaaggtcaagagttgtgcaagactttaaagtatttataggttcaagtttgtaactgtaatttcagatttaccttggaccatagcaatgcaagtgatgtacatttcagtttaaggagttaaaaataaccaggttcatttccatgtaacaaggcaaacagcctacagt

SEQ ID NO: 2800 - DNA, 1550 bp, Secale cereale
cacggatccctagcgtcccacgcgctcggagtttctaggcaataggcctgccggcggcgtggtgtctggagcgtctcggctgctgcctgcgtagctgcgtcttcccttgctttccgtcgctcccggctcgtagcgtaaggacgggccggcggaggatgggggtgcggggggagaagtccagctggggacgtgggggcgctgagcctctcctgggtctcctcggtctccattgtcatctgcacaaggccctcatgagcgccctcggcttcatcttcgccaccacgttgacaagctggcatctcttggtgacattctgttcgcttcatgtggcattatgcatgaagctctttgagcacaaacctttcgacgcaaggaccgtcatgggattcggagtgctcaacggcatctcgattgggcttctcaatctgagtctgggtttcaattctgttggtttctatcagatgacaaagttggccattattccctgcactgttatattggagactcttttcttcaggaagaagttcagtcgctacatccagctctcccttagtgtgctcctttttggtgttggagttgcaactgtgactgatctgcagctcaatgctatgggatctgtgctgtctttactggcaatcgtcacaacctgtattgctcaaattatgaccaatacaattcaaaagaaattcaaagtgtcttcaactcagctgctgtaccaatcatgcccataccaagcattgaccctgttcattgttggtccattcctcgatggatttctgactaacaaaaatgtctttgcttttgaatacacacctcaagttctgttcttcatcgtgctgtcgtgtctgatatcagtctcggtgaacttcagcactttccttgtgattgggaagacatctcctgtaacttaccaagtccttggccatctaaagacatgcttggttcttgccttcggctatgtcttgcttcacgacccgtttagctggagaaacatacttggaatcctgattgcagtggttgggatgggactatattcatacttctgcacccgtgaaactcagccaaaaccaactgaagcctctccacaagtcactcaggtgaaagaaggcgaatcagaccctttgatcgcggactccttgaacgctgccgagaacggagccgccgcagccaccgacgagcctctgaaggtccccatgtggagctccaagtacgcgcgggcatgaacgctgctgctccgacctctctgaaggggtgcccatgtggagctccaagcgctcgcgggcatgaacgccgcttcggaccttggttcatggtattatatacataattattcagtttagtaggcagatagtagggctggaaggaagccaagccagccctgagtgtaatgaacgttccttgttccatttttgggccttttttccttccccccctttttttttgcttctgttttggcttaccatgcctgtggtgctgttgtaaaagtggatctcactccaaatgactccaaatggcagatctacctttgttgaagctaagatacaaaattg

SEQ ID NO: 2801 - DNA, 1340 bp, Panicum virgatum
gccacaactttgacaagctggcatctcctggttacgttctgctctctccatgtggcattatgtatgaagctctttgagcataaaccttttgatgcaaggactgtcatgggttttggagtgctcaatggcatctcaattggacttctcaacttgagtttgggtttcaactctgttggtttctatcagatgacaaagctggctattattccctgtactgttatattggagacccttttcttcaggaagaaatttagtcggaatatcaagctctcccttagcgtgctccttgttggtgtttgtgtcgcaacagttactgatctgcaactcaacgcagtgggatctatactgtccctgctggcaatcatcacaacctgtattgctcaaattatgacaaatacaatacagaagaagttcaaggtttcttcaacccagcttctgtaccaatcatgcccgtaccaagcattgaccttgttccttatcggtccattccttgatggatttttgactaacaaaaatgtctttgcttttgattacacaactcaagtcctgtttttcattgtgttgtcatgcctgatttcagtctcagtaaacttcagcaccttccttgtgattgggaagacatctcctgtaacctaccaagttcttgggcatctgaaaacatgcttggttctcaccttcggctatgttctgcttcatgatccgtttagctggagaaatatacttggaatcctaattgctgtgattggtatggttttgtattcctacttctgcactagagagactcagcaaaaacctgcagaagtctctccgcaagtcattcaggtgaaggagagtgagtcaaacccgttgatctcagactctttaagcactgctgaaaacgggggcagcaccacagacgatgaacccctgaaggtaccaatgtggagctcaaagtactcgagggcgtgaagaatgaaaattgctcttttgttagcgtatggtattatatagaattcagcttagtgggcagatactagggttggaaggcaaccctgttcctgttccatttttggccttcttttttttctctggcttatattatatgcgttgttagtaaatggatctcactcgtgagaggatactactgtttcctctgctccagacgattgatctgcctgaaagctagacatgagagctagctgcacaggagatttctgttgtattttcttatgttctgaatgcgccacgtgcagtaactttgtagctggacatgaaacaacacgtagttttcattcttttgtactaccaaagagttgggtttagctgaaagttcttttaaattgatttttgctgagactcat

SEQ ID NO: 2802 - DNA, 2066 bp, Theobroma cacao
acggggctgagtcaacatctcctctcttccttctttcccatctcctttccttgccttgccttgtttcgcccttctcccgtctcccgtctccctctgtcattttcatttatattacttttgtacatttctgttttgaaatacagctcattccttataacaccgacggatttatatgtaactgtctctgtttcccagatttccttcttttcggactcgcttactcttaaggtttctttctctctctctctggctctcatctttcctttatagcagcagatctagggttctttcatgctctatttcgatactcattttttgttttatctctttctttgtttcgcgcctcatcctccttccggttcagcttcgatttgcgcgaaatttgaagcgccagtgaggtaggaggagttcttgttcgtgatttctatacgtatagtgtacttatatgtgatccagaaccgtgggagattacgtagatccggatcacgagtaaaacaaaacaaaaatgagtgagaaccgcaagtttcagctcgggacagtaggtgctttgagtttatcggtggtctcctcggtgtccattgttatatgcaacaaggctcttatcagcactctcggtttcacctttgccacaactttgacaagctggcatctcctggtcacattttgttctcttcatgtggccttatggatgaaattgtttgagcacaagccttttgatgcaagagctgtcatgggatttggtatattaaatgggatatccattgggcttttgaatcttagtttgggtttcaattctgttggtttttaccagatgacaaaactggcaattattccctgcactgttcttttggagacccttttcttcaggaagagattcagtaggaatatccagctttcactggccattcttcttttgggtgttggaattgcgactgtgactgatcttcagctcaatctcctgggttctgtcctttctcttctggctgttattactacgtgcgtagctcaaattatgactaataccattcagaagaagttcaaagtatcttccacccaacttctctaccagtcttgcccttatcaggcgataactttgtttatcattggcccatttctggatgggcttttgactaaccagaatgtttttgctttcaagtatactcctcaagtgctgttcttcattgttctgtcctgcctgatatctgtctctgtcaacttcagtacatttctggtaattggaaagacatccccggtcacctatcaggtcctaggacatctgaaaacatgccttgttttggcgtttggttatgttctgcttcgtgatccatttagttggcgtaacattttggggatcttgattgctgtactcggaatggtcctttattcatattattgtactagtgagacccagcagcagaaggctagtgaagcatcagcacaattgccacaggtaaaggaaagtgaatctgatcctctgattagcgtggagaatggaagtgggatcttgagtgatggtgttggtccaaaagctcctgtatggagttcaaacaaagacctgcatgcataaaatgatggtaatgttaaagtcattggtcctagatggaaaacgtagtaatgaaaactgttccggcgatgaagatgttgctggtaagggtgggctaagtgttgtgcagcaacagatggggtaatttggagatgaaaacttatatagaatattagcttggaaagtggaaggaaatgcctaatgatataccagttttggttattggtagtggaatcaggaatttaggattcaggcgtggggaatggaattgcataccagaatttgatttgttacatgtataatggtcctagacaccgaacaatttttcctagcagttgtttctggttaaaaatattctatatttttgaagcaattaaggcgtattttattgatattcagaatgtaccttcctttcattaaggcgtccctgcttttgaagtatccaaaggggaaatgagttactatttttatttgtgggctcagtgaattaggcaactactagtaataaattcagggcaagtac

SEQ ID NO: 2803 - DNA, 1396 bp, Saccharum officinarum
cacccgtccgggtttgggaccgacggcgaccgaccgaccagccatataataaagagaagcgaagcgaaccaccctgtccctcctcgtctccctcctccccgtccctgattcgcgagaccggaggggcgcacgagcgccaccgccttgatcccgcccgctcctcccccagatctcctcgccattgccgctggtctacccagattcgcgccctcctcgcccagatccgaccgcccaagccggcgcaggagcggtgcaccgggccgcgtggttccggcggctcgattggaaattcgtgatctttcggggcattcctcggtttgtctgtcggtgccgggggtggtgctgctgcgtttcgagggccgcggcggagatgggcgtcggcggggagaagttccagctggggacggtgggggcgctgagcctctccgtggtgtcctccgtctccattgtcatctgcaacaaggcgctcatgagctccctcggctttaacttcgccactaccttgacgagctggcatctgctggttacgttctgctcccttcatgtagcgttatggatgaagttctttgagcataagcctttcgattcaagaactgtcatgggatttggagtacttaatggaatctccattgggctcctcaacttgagtcttggcttcaactctgttgggttttaccagatgactaagctggccatcatcccgtgcactgtcattttagagacacttttcttcaggaagaagttcagtcggagtatccagatgtccctttctgtgctccttcttggtgttggtgttgcaactgtcactgatctgcaactcaatgctgtcggatccatactgtccttgctggcaattatcacgacttgcattgctcaaattatgacaaacaccatccagaagaagttcaaggtctcgtcaacccaactgctctaccagtcttgcccttaccaatcactgaccctgtttctcattggccccttccttgatggctttttgactaaccaaaatgtctttgcttttaattatacatctcaagttgtgtttttcatcgtgttgtcgtgcttgatatcggtctcagtgaacttcagcacttttcttgtgatcggaaagacatctcctgttacttaccaagtcctgggccatcttaaaacatgccttgttcttacctttggttatgttttgcttcacgatccgtttagctggagaaacatacttggaatcctaattgcagtagttggaatggtcttgtattcatacttctgcacagtggagacccagcaaaaaaacaccgaagtcttcccacaacaggtgaaaagaaagccaggcagccccctttgatctcagaactctttgaagcaaagtttaaaaaccgttggcggtggttgctgaataaag

SEQ ID NO: 2804 - DNA, 1556 bp, Euonymus alatus
cggccgggggtatttttcatcaaaattcatcctcctctctcactatcaaatacgcaaactagccgaccaaacagagaataacgtcttcgcttcgcagataactgtctacatattttatcagttgagcttcttcgggactcaatttcctttcgttttttcgctaaattatgctcgaatgaggtattaggtagatccagatcgagaagcaattgaatagaactggggggaaacagtgagcaaagaacatgagcgaggggcagaaattccagttggggacagtgggggcactgtccttgtcagtggtatcgtcagtatcaattgtgatttgcaacaaggcgcttattagcacacttggcttcacttttgccacaactttgacaagctggcatctcttggtgacattttgttctcttcatgtggcactatggatgaaattttttgagcacaagccttttgatgcaagatctgtcatggtatttggcatattgaacggcatatccattgggcttctgaatctcagcttgggttttaattctgttggattctatcagatgacaaaactggcaattattccctgcactgttcttttggagacccttttcttcatgaagaaattcagccgtaatattcagctttcactggctatactacttttaggtgttggaattgcaactgtgaccgatcttcagctcaatctcctgggttctatcttgtctctgcttgcggttattacaacttgcattgctcaaattatgaccaataccatccagaagaagttcaaagtttcttcaacccaacttctttatcagtccagcccatatcaggctataacacttttcattgtcggtccatttctagatgggcttttgactaacaagaatgtttttgctttcaactacactcctcaagtgctgttcttcgttgtcctctcttgcctgatatctgtctctgtaaacttcagtacgtttctggtaattggaaagacatctccagtcacataccaagtcctagggcacctgaaaacatgcctagttctggcctttggctatgttttgcttcgtgacccatttagctggcgcaatattctagggatttttatagctgtaattggcatggttctttattcttattcttgcactgttgagacccagcagaaagctagtgaagcaccaccgcaagcaccacaggccaaggaaggtgagtctgatcctctaataagtgtggaaaatggaagcgggatcttagcggacggtgtagccacaggtcctgtatggaagtcaaataaggaccttcaagcttaaaccttcttgatttaaataatatggttgctcttgggtcgggattaattgaggaaactctctcagcgatgaagatgttgctggacaaggtctccatataatgcatagcagcatttcgggtattttgagattacaacttcaagtatggtagattcactattaaaccgcattttttttggttatttgtgctgtaccgagtgaggctatgaaattaaaagttaaaaccaggatttgatttgataaatatatactgttatt

SEQ ID NO: 2805 - DNA, 1686 bp, Vitis vinifera
ttttttatttactaatattgcccttgattcatataaatatttgaatcatgtcatcaacacagacccaaatttcatgcattcatttctcacattttcccctcattcctttcacactacttcagtttcgttgagctgcttccctggttcgcgggtttgctcatttgcgtctcaattttctctggaatgagatccagatcgaggagacagtaattcggtgaagatgggtgagagccagcggttccagctgggaaccgtaggagcgttgagtttgtcggtggtttcgtcggtgtcgattgtgatttgcaataaggcgcttattagctcgcttggcttctctttcgccacaactttaactagctggcatcttctggtcacattttgttctcttcatgtggcactatggatgaaattatttgagcacaagccttttgacgctagagctgtgatgggatttggcatactaaatggaacatccattgggcttttgaatcttagcttgggtttcaattctgttggtttctaccagatgacaaaactggcaatcatcccctgtactgttcttctggaaacccttttctttaggaagagattcagccggagtatccagctttctctttctatccttcttttgggtgttgggattgcaacggtgactgatttgcagctcaatgccctgggttctgtcttatctttgcttgcagttattacaacctgtatcgctcagattatgaccaataacatccagaagaagttcaaggtttcttctacccaactcctgtatcagtcatgtccttatcaagccatgacattgttcattgctggcccatttctggattggcttctgactaagcaaaatgtttttgctttcaaatatacatctgaagtgctggtcttcattgttctatcttgcctgatatctgtttctgtaaacttcagtacatttctagttattgggaagacatctcctgtaacataccaggtcctgggacatctaaaaacatgcctagttttggcctttggctatgttttactccacgacccgtttagctggcgcaacattctgggaatcctgattgctttaattggaatggtgctatattcttattattgctctcgtgagggccagcagaagcctagtgaagtatcagcacaaatggcccaggcaaaggaaagtgaaaccgatcctctaataggcgtggaaaatggagctgggatcttaacggatgctgttgttgcaaaagtccctgcttggaattcaaacaaagacctgcaggcataatatgcttcctcgctttcctacccattaattcctccatcctagatcaagattagcagacaaactctgtttcagccaagaagaagatgcttttggcagtgggtcatggaaccaagaatacgactttctgtcatagaagtagtctccagagctaagaggagatcacttttctattttttccatttgatttttttttttagctttgtatgagtttaggggggttgaatgggattcatgcccccatttgattttttcaattggggttactttcccatcctaaaacacccataagtctccataactgttcctttttgtatgctcccttgaatattcttcttcctggtaagatgtattttttttaacggaagaaaatataatcctttcccttaatattcgttcgcattactgta

SEQ ID NO: 2806 - DNA, 1783 bp, Citrus sinensis
aattggtcatattaataaattctgcatttaatttagaaagcctaaatgataggcagccagatgttattatgccatataaaggcaaattaaattttttccattgcgtcgttttcatttttatatgctttcgttcttctctgtttctctcagtatcaaacgaaacagtggaggctttcttcttataagaagtaaaacaaacaagcagcataatccctataatttttttctttttattttaataattaaaaagttcagcttgttcggctgctggttgatttgctgaaattttttgacaaattatgatttaaaataatatcgggatcaaagtggaagagaggcgaagaagaagatgagtgaagggcagaagttccagttaggaacagttggggcattgagtttgtcggtgatttcatcagtgtctattgtgatttgcaacaaggcgcttattagctcacttggtttcacttttgccacaactttgacaagctggcatcttcttgttactttttgttcgcttcatgtggcattatggatgaaattatttgagcacaagccttttgatccaagagctgtaatgggatttggggtattgaatgggatatctattgggctgttgaatcttagcttgggtttcaattctgttggtttctaccagatgacgaaacttgcaatcatcccctgcaccattcttttggagactcttttcttcaggaagaaattcagtaggaatatccaactttcattagtcatccttcttgtgggtgtgggaattgcaactgtaactgatcttcagctcaatgttttgggttctgtcttgtcgctgcttgcagttcttacaacttgtgttgctcagattatgaccaataccatccagaagaagttcaaagtttcttcaacccaactgctgtatcagtcgtgcccctatcaggctttaactttgttcatcattggcccatttctagatgggcttttaacaaacaaaaatgtttttgcattcaaatacaccccttacgtgctgttcttcattgttctatcgtgcttgatatctgtttctgtaaacttcagcacgtttttggtaattggaaagacatctccagtcacatatcaggtcctaggacatctgaaaacatgcttggttctagcatttggctatgttcttcttcatgatccattcagctggcgcaacattttgggtatcctgattgccgtaattgggatggtactttattcgtattgttgcagtcttgagagccagcagaaggctagtgaaacatcatctcaactgccccaggtgaaggaaggtgagactgatcctttaatcaatgcagaaaaaggaaccggcgatggcgttgccaaagctccagcgtggaattcaaacaaggacctacatgcttgaaacttgtcaatcattattcattcacttttgataaaattctgtaatctgttccagtgatgaagatgttgctggtaagagtcaccatgtacgttgatagcagcagattgggtgtttggagatttcaacgccaatcatatagtaggtcccagagacataacgagatgccattttatatagcagttttggattatgagttatgaacgaatcaggcatgaaataggataatataccagaagctgatttgttaagtgtatactgtgtcactatatactgaaagaaaagtttcataattgttatttcagtttagtatgtatttcattcaatactacttggctaatgaaaacctgtggtcttgtacggatgtacctatctctccttaatatctca

SEQ ID NO: 2807 - DNA, 1425 bp, Tripterygium wilfordii
atcagttgagctgcttcggggctccaatttcatatcttttttcgctaaattatgctcgaatgaggtagatccagatcgaggagcaactgaatagaattggggggaaacagtgagcagagacggagaacatgagcgaggggccgaaattccagttggggacaggtgggggcgctgtccttgtctgtggtatcttcagtatcaattgtgatttgcaacaaggcgcttattagcacacttggcttcacttttgccacaactttgacgagctggcatctcctggtgacattttgttctcttcacgtggcactatggatgaaattttttgagcacaagccttttgatgcaagagctgtcatggtatttggcatattgaacggcatatccattgggcttctgaatctcagcttgggtttcaattctgttggattctatcagatgacaaaactggctatcattccctgcactgttcttttggagacccttttcttcatgaagaaattcagccggagtattcagttgtcactggctatcctacttttaggtgttggaattgcaactgtgaccgatcttcagctcaatctcctgggttctatcttgtctctgcttgcagttattacaacttgcgttgctcaaattatgaccaataccatccagaagaagttcaaagtttcttcaacccaacttctttatcagtccagcccataccaggctataacacttttcatcgttggtccatttctagatggccttttgactaacaaaaatgtttttgctttcaactacactcttcaagtggtgttcttcattgtcctctcctgcctgatatctgtctctgtaaacttcagtacatttctggtaattggaaagacatctccagtcacataccaagtcctagggcacctgaaaacatgcctagttttggcctttggctatgttttgcttcgtgacccatttagctggcgcaatattctagggattcttatagcagtagttgggatggttctttattcttattattgcactgttgagagtcagcagaaagctagtgaagcgtcagcgcaagtgccacaggtaaaggaaggggaatctgatcctctattaagtgtggaaaatggaagtgggatcttagctgacggtgttgttgccaagggtcctgtctggaagtcgaataaggacctggaagcttaaaccttgttgatttaaataatttggtcgccctgaggtcgaaattaattgaggaaactctctcggcaatgaagatgttgctggatagggtctccatataatgcatagcagcagtttcgggtattttgagatttccactctattattgtagattcaatattgaatactactcgcattttttggttattagtgctattgcgggtgaggctgtgggattaaaacgaggatttgacttgataa

SEQ ID NO: 2808 - DNA, 1626 bp, Euphorbia peplus
aacatctctcactttcttctcccgtcttctccccaaaatcaaaatccttcctcattactccccaatccatcccttctcctccgccatcgccacatgttcttcgtccccatcctcgcctgaatgagatccggataaaggaggaggtaagcgggagaagaagatgagtgagagccagaaattccagctcggtactgttggagctttgagtttatctgttgtttcgtcggtgtctattgttatttgtaacaaggcgcttattagcactctcggtttcactttcgccacaacattgacgagctggcatcttctggtcacattttgttctcttcatgtagcattatggatgaaattgtttgagcacaagccttttgatgcaagagctgtaatgggatttggcgtgctaaatgggatatccattgggcttttaaatcttagtttgggtttcaattctgttggtttctatcagatgacgaaattggcaataatcccatgtactgttctcttggagacacttttcttcagaaagcaattcagtcggcatatccagctttctctcgtaatccttctcatgggtgtcggaattgcaactgtgacagatctccagcttaatgttctgggttcagtcttgtctctgctggctgttcttacgacctgtgttgctcagattatgaccaataccatccagaagaagttcaaagtctcttcaactcaacttttatatcaatcttgcccctatcaggccatgacgttgtttgttatcggtccatttctagacggtctactgactaatcaaaatgtgtttgctttcaaatacacacctcaagtgctgttcttcattgttttatcctgcatgatatccgtctccgtgaacttcagtacatttttggttatcgggaagacatctccagtcacttatcaggtcctggggcatttgaaaacatgcctagtcttggcattcggctatgttcttcttcgtgacccttttagctggcgcaacattttaggaattttcatagctgttattgggatggtattatattcatactgttgcactctcgagacccagcagaagcccagcgagacatcagcaaaattgcctgaggtcaaggaaagtgaatcggatcctctgattggtgtggagaatggaagtggaatagatagtggggttccgaaagctcctgtatggaattcaaacaaggattttcatgcataagatgtcaaattttataaattcattcaccctcgatcaatatttgtaggtgaaactgtatcagcgatgaagatgttgctggaaacgggttctccagatatcggatagtggcagctgggaagtctgatgatcgctcatatcatattagagtaagcgttaaacgaaaatgttctcatatatagcaaatatttttttggcttgtagtcttttgtatgaatcatgatatcagaatattatctgttaaatatatacttttgtcccctaattctagaactgatttcattaatgttcttcagaactgatatttcattagtgttagtcaggggttacattatgttgatattcatttcgttttagtagaactctctgtttatgtaattttttttacattaatgggacttgtgtactctcaatta

SEQ ID NO: 2809 - DNA, 1378 bp, Carica papaya
agttgcggttctccacctttgacatgctcatatttggtgaattgtgaacgaatgagatcctgaattcctgatcaaagaataaaaaagagagagatagagagagagaggtgagaaaagatgagcgaggtccagaagtttcagcttgggactgtaggtgctttgagtttatcggtggtgtcatcggtgtccatcgtgatttgcaacaaggcgcttatcagtacacttggttttactttcgctacaactttgacgagctggcatctcttagtaacattttgttcccttcatcttgctttatggatgaaattgtttgaacacaagccttttgatgcacgagctgtaatgggatttggcatactaaatggaatatctattggacttttgaaccttagcttgggcttcaattctgttggtttctaccagatgacaaaactggcaataattccctgcactgttcttttggagactctgttcttcaggaagaaattcagtcgtaaaatccaattttcactagcaatccttctcgtgggtgttggaattgcaacagtgactgatcttcaactcaacgtccttggttctgtactgtctctccttgcagttattacgacatgtgttgcacagattatgaccaatacaattcagaagaaattcaaggtttcctcgacccaacttttgtaccagtcttgtccctatcaggcaatcacattattcatcacgggtccatttctagatgggcttttgacaaaccaaaatgtctttgccttcaaatacacccctcaagtactgttcttcatcgttctttcctgcttgatatctgtgtctgtaaacttcagtacgtttctggtgatcgggaaaacttctccagtcacttatcaagtcctaggacatttaaaaacatgcctggttttggccttcggttatgttctccttcgtgatccattcagctggcgcaacattcttggtatcctcattgctgtgattggtatggtactttattcatattattgcacaaaggagactcagcagaaggctaatgaagcatcagctcaattaccccaggtcaaggaaagtgaagccgatcccctaattagtgtggaacctggaagtgggatgttagcagatggtgtagttccgaaagctcctgtatggaattcaaacaaggatctgcatgcgtgaagattttgttaaatctcttatcaatttgttcgttaccccatatttcacccctgatcaaattagttattaaaactgtttccagcaatgaagatgttgctgacaagggtccccgtgtattgtatgggtattctgagattacagcttctattatagcagtttcccagagtttgaagggaaaaagaacagcttatcatatatagca

SEQ ID NO: 2810 - DNA, 2314 bp, Amborella trichopoda
gttcttgttttccttttcctgcttttttatttaagtgtgggatcattggttctttagctttccctcaacgttttgctatgcatcttggttttttttatcttagttttatgtgtttattaagaactatgatctgattagtgggcacctttttagttagatctaagttattttttaataattgaaatttattagggttttactttaaactttcgtaaaaaaaaagaaatttatttgggttttctttgtctaggttttggctcttcttagtggcatcattttgggctgaactgaaagactaaggattttgaaattctcgaggaaggaaattaattcagagggaactgagggactggtaacatgagtgaaggagagaggtttcagcttggaacagttggggctctgagtttatcagtggtttcttcggtttcaattgtcatatgtaacaaggcattgatcagcacactcggatttacttttgctacaactttgaccagctggcatctactagtgacattctgttctcttcatgtggcgttatggatgagacttttcgaacacaagccttttgatgcacgggctgttatggggtttggcatacttaatgggatctctattgggcttctaaatctcagtttgggttttaactctgttggcttctatcagatgacaaagctagcaatcattccatgcactgttctcttggagaccatcttcttccgaaaaaaatttagtcggagtattcaactgtctcttaccatccttctgttaggagttggcattgcaactgtgactgatttgcagctcaatgctttgggttctgtcttatcgcttcttgcagttgtcacgacatgtgttgcgcaaattatgaccaacacaatacagaagaggttcaaggtctcatcaacacaactattgtaccaatcttgcccatatcaagcaatgacattattcatcatcggtccattcttggatggacttttgacgaaccaaaatgtttttgcctttaagtacacacctcaagttctggttttcattgttctatcttgcttgatctcagtctctgtcaactttagtacatttttggtgattggcaagacgtcaccggttacatatcaagtccttgggcatctgaagacatgcttggttttggcttttggttatgttttgcttcatgatccatttagctggcgtaatattctggggattctgattgctttggtggggatggtcttgtattcctacttgtgtactcttgagagccagcaaaaagcaagtgaggcagccccacaattgtcaccggccaaggaaagtgaaactgatcccctcataaatgtggaaaatggagctggcataatcgttgatgctgttggtgcaaaatctccagtttggagctctaacaaagacctccatgcataatcctcgctcaccatctgtaatcagggtgtctcatgggcattattagccggatatagccattacatgggcatgtaattgatgatattggcagatgaatatcgatgttgaggatgtcattggcaacatcaacaacagcatcagtgttgtagcaacaattcatcgcagcccaaaagttccatttgaaaagctagttattaatgaaaagtagtcttcttagcactgtggctctcatttcctaaagccaagcctcttgagcgtgatactggtctgtgtgttagcacatcctgacctttgatttttgatctgggctgttgaactctttcagtgacatgcgtaattcttaatattacttttcaaaaaaggtaactctgaatattgggggcggtctttcttcataccttgtatttgtgttttctctgcataagcagccatgagacattattggtaaatgaaatattgatctttcaatatgttgaatagcttctgaatgtatatcttaagattagatgttctttctttgttcagctattgcagtcactacttgtactcaaggaaacttggcaaattcttggtgaatggattattggccatatatatattgggaacaaatatttaagaatgtaatgttcatccgtataactacttcgaggcacgagtcttgctagattcgaatattttaaagtggggattttcccaattatgttacctcccagaaaataaataaagaatttcttgtagctatttctctgtagtgtaattctttttatgggaagtaatattgtggtttactgagtaaactcatagtttcaagactggttgggttaatatgactaggaggtcaactctggttaggtctcagttgagactcacaccagtcaagactcaataaaagttcaac

SEQ ID NO: 2811 - DNA, 2350 bp, Vitis vinifera
tttttttaataataatttagaaaacagataatgggaggagacaaacgaagtggggaagaagcaaccagcattaccttccaaattaaaaaattttccaggcagaaatggagaattgacattccacaattagtgggtagtgtgtcattttaccaaaccatttcactagtcttagttgttgttggactgcaatcaccgcctaacattttccccctaatcactgctctgtacctccttcacactgccttttcttttccttatataattaatccccacctttaatgtttcctaccttttctctcttgtaaggatccgatctgattgcccttttaatttctttgtttggtccccctgaaaatttgtgggttgttttgattccattcccggttttcccttgttttcctggtctcttgataaaacaaactgagggttgagttaatttgatttctccttttgtgggttttcttccttgccaattgggttgttcttgatttttgtttccttggaaactgccttgctgtcctctcgtttgcagttgagttgagctcttgctattgatcttcattttgtctgcttctgctagttcctccctggctttttctcagcaaccaaacagggcttggagttaccttgatttcgcctctggttccgctgagctgctgttgtttgattttgtcttctttgaagagtactttaaatgagatccaaatgaaggaggtgtgatcagagtggagacaagatgagtgagaacaaggggtttgagcttggaaccattggggcgttgagtttatctgtggtttcgtctgtgtcgattgtgatttgcaataaagctctcattagctcattgggtttcacttttgctactacattgacaagctggcatcttctggtcactttctgttctcttcatgtggctctatggatgaaattgtttgaacacaaaccatttgatgcaaaagctgttatgggttttggcattctaaatggaatctcgattggactcctgaatctgagccttggtttcaattctgttggtttctatcagatgacaaagctggcaatcattccctgtactgtactcttggagacccttttcttcaggaagaaattcagtaggagtatccagcttgctctttctatccttcttatgggtgtcggaattgcaaccgttactgatctgcagctcaatgccctgggctctattttatctgtcctcgcagttattacaacatgcattgctcagattatgacgaataccatccagaagaagttcaaggtttcttcaacgcaactgctgtatcaatcttgtccctatcaagcactgacgctgttcatctctggcccatttctggactggtttctgactagtcaaaacgtatttgctttcaaatatacaccgcaagttctggttttcattgttctatcctgcttgatctctgtctcagtcaattttagcacctttcttgtgattggcaagacatcgcccgtcacctatcaggtcctggggcacttgaaaacatgcctagtactagcatttggttatgttctacttcatgacccatttagctggaggaacattttagggattctgattgcattagtagggatggtcctgtattcatactactgcacccgtgagggtcagcaaaaaacttcagaagcatcagcacaatcttcttcacaggcaaaggaaggtgaagctgatcctctaatcaatatagagaatgaaactgggatattaaccgatgctgctgtcccaaaggccccagtatggagctcaaacaaagatttgcatgcatgaaggcatctttattacagttcatacatccaagagctgcagatggaaccattgcaataaggtgttggcaatggaggttccccaaggttgtcaatggcttgcacacccaaattacagagtaatggcaatttctcataccgatcaaggcatttatctgcgttgagaaacatacccttctttttcttgtgttggttcaagcagtaggcacctgagctccctagacttttgtgaggaatgcatataagtggtgtttttgtttctgggtagagaaaatatggggtccatttgaaacttttgataggttttaggctttgtttgaatcttggggaatgtaagaaaaaggaagctcaaaagggaaaataaataaataaataaattatattcgcttatttgatttgtcataaaaaaaacaaaacaggagtgaaaaaaattatttttgaatttatatatatttagattgtttatgctggagttggtacatgttattaagagtctgattgagaatggttttggttaaagcattatgttggttgaggtacgagtccggcttgtgcc

SEQ ID NO: 2812 - DNA, 1699 bp, Ricinus communis
gggccaaagaaaacaattgtatcatttgatcgcaaaactgaatccaaatttaattttctctcgctttctcccctatattaacattaacatcaatctctctttctctacttctatttgaccatctctaactaatttcaaaagaaaaagaaaatagaaccgagccagcacatgaccttgatgagatccggatcgaattgaaaagaggaagagaaagaagagaaagaagatgagtgagagccagaggttccagcttggaactgttggtgctttgagtttatctgtggtttcttctgtctctatcgttatttgcaataaagccctcattagtaccctcggtttcactttcgcgacaacattgacaagctggcatctgctggtgacattttgttcacttcatgtggcattatggatgaaaatgtttgaacacaagccttttgatgcaagagctgttatgggatttggcattttaaatggaatttccattggccttttgaatcttagcttgggtttcaattctgttggtttctaccagatgacaaaattggcgattatcccatgtactgttcttttggagacacttttcttcaggaagaaattcagtcggaatatccagttttcattgacaatccttctcctgggtgttggcattgcaactgtgactgatcttcagcttaatgtcctcggctctgtcttgtctcttctcgctgttgttacaacctgcattgcccagattatgaccaataccatccagaagaaattcaaagtctcttctactcaacttttatatcagtcatgcccctatcaggcgataactttgttcataattggaccatttctggatggattattgactaatctaaatgtttttgctttcaagtacacccctcaagtgctgttcttcattgttctgtcgtgcctgatatctgtctctgtgaacttcagtacatttctggtaattggaaagacatctcccgttacttatcaggtcctaggccatttgaaaacatgcctagttttggcctttggctatgttctgcttcgcgacccttttagttggcgcaacattttagggatccttattgcagttattggtatggtactatattcttattgttgcactgttgagaaccagcagaaggctagtgaaacatcagtgaaattaccagaggtcaaggaaggtgaatccgatcctttgattggtgtggaaaatggaagcgggattttagctgatggtgttgtgccaaaagctcctgtatggaattcaaacaaggatcttcacgcataaagaccccagattgtatgaattcattgaccctagatatattagttggttaaactgtttcagcgatgaagatgttgctggcatagggtccgtgtatcgcatagctaatcggtattctgagattattacttattttacattagattaaaagttggaaggaaattatcctcttatatatagcatttttggttactagttttgtatgaatcaggcatggcaacgggacaataccagaattttattcgttaaatgtatacctttttgttccaaaatactctttctgtagttattcttgtgccaatatgtgaacaatgagaaggcttctggtccttgaacatgtttacatggcagcacagcacctacttccattaatgcatatgaaactctgaagaacacatgcattgaattttatcccca

SEQ ID NO: 2813 - DNA, 1418 bp, Ambrosia trifida
tcatcaatcatcatcataataatctgacctatctgttattaaccttttcactgaagatctcagatctggagttttgaagatacttctatgttttaggttacctgaatgagattttgattttggaaggagattgttagaagtgatttggttgattgattgattgagtgagtgagtgaggaagagatgggtgaagggcaggggtttcagcttggaacagttggagcgttgagtttgtcggtgatttcgtcggtttcgattgtgatctgtaacaaggcgctgattagtactctaggtttcacttttgctacaactttgacaagctggcatcttttagtcacattttgttcattacatgtggcgttatggatgaagttttttgagcacaagcctttcgattcaagagctgtcatgggcttcggggtattgaatgggatttccattgggcttcttaacctcagcctgggtttcaattctgttggtttttaccagatgacaaaactggctatcatcccttgcactgtacttttggagactcttttcttcagcaagcagttcagtaagaaagtcaagttcgcactcaccatcttacttttgggagttggaattgcaacagtaactgacctgcaactcaatctcatgggaagcgtcctatctttatttgccatcataacaacttgcgtggcccaaattatgacaaatacaatccagaagaagttcaaggtttcttcaactcaacttctgtaccaatcttgcccataccaagctcttatcctgttcattgtgggcccgtttctagatgctcttctgacaaatcagaatgtatttgctttcaaatacacacctcaagtgctggcattcattgttctctcctgtctaatatcggtctctgtcaacttcagtacttttcttgtaatcgggaaaacatcaccagtgacttatcaggttttgggtcacttaaaaacatgcttagttttggcattcggttatgttttactacacgacccgtttagttggcgtaacattctggggatcctcattgctgttgttggtatggtgctctattcttatttctgtacccgtgatgcacagccaaagcccgttgaaacttcaacacagttttctcagagtaaggaaagcgagaacgatcctttaataagtgcggaaaatggattgaatgtgtcaaacgagggcagtcctccgaaacccccagtttggagctcagacaaagatcttcacgcatgatttgatcttcagtataaatattctattcacaaatacaaatagccaaatagcacatttgttcccctcacgaaggtctccaccaccaccaccacaaccactagtgtgctataagagacgggaatcaaggtttcgtagaagattgtaagactagtttgttttgatcattcaactttttc

SEQ ID NO: 2814 - DNA, 1646 bp, Gossypium hirsutum
ttttttcatttttctcatctccttctcattcctgctgttgaagcagctgctcccacccacttctaattttcaaccaatctcgggaattttaagcgccattgaggtaggaatcgacgaggattcactacgtgcctctatacatacatattatcgacgtgtatgtgatcgaaaacccttggagattacgtagatccggatcactattgaagaaacataattcataagggaaaaatgagtgagaaccgcgagttccagcttgggacaataggtgctttgagtttatcggtggtctcctcggtgtccattgttatatgcaacaaggctcttattagtactctcggcttcacctttgccacaactttgacaagctggcatctactagtcactttttgttctcttcatgtagccttatggatgaaattgtttgagcacaaaccttttgatgccagagctgtcatgggatttggtatattaaatgggatatccattgggcttttgaatcttagtttggggttcaattctgttggtttctaccagatgactaaactggcaattatcccctgcactgttcttttggagacccttttcttcagaaagaaattcagtaggaatatccagctttcattggccattctacttttgggtgttggaattgcaactgtgactgatctgcagctcaatatcctgggttctatcctttctctgctggcagttgttacaacttgcatagctcaaattatgactaatacaattcagaagaagttcaaagtatcttcaacccaacttctctaccagtcttgcccttaccaggcattaactctgttcatcattggcccattcctggatgggcttttgactaacaagaatgtttttgctttcaagtatacccctcaagtgctgttcttcattgttctttcctgtctgatatcggtctctgtcaactttagtacatttctggtaattggaaagacatcccctgtgacatatcaggtcctaggacatctaaaaacatgccttgttttggcctttggttatgttctacttcatgatccgtttagctggcgtaacattttgggcatcttgattgccgtagttggaatggtcatttattcatattattgcactgttgagagccagcagcagaaggctagtgaagtatcaccacagttgccacaggttaaggaaagtgaatccgatcctctgattagcgtggataatggaagtgggatgttgagtgatggtgtaggtcctaaagcccctgtatggaatacgaacaaggacctgcatgcataaaatcttcaagatgttatattcatttgtcggagatgaaaaattagaaatgaaaagtgttccagcgatggaaaatggtggtggtaaaggtgactcatatgttgcacaggcagcacagcaacaatagtcgtgttatgttggatgtttcataactgttgtaggttcaaagagtggagggaaatgcgttatgatattattagcagttttgattggtattatttgtgtatcagtggcgataatggaatggaatgctgcattccagagttggatttgtgaaatgtatgatgttcgaactccagatacccatcagttttatttgcaattatttctgttccatataatattgaagaaatgaa

SEQ ID NO: 2815 - DNA, 1886 bp, Gossypium raimondii
ggcctataaaatactgaagtagaatagggaagattaatattggacttaaatacctgataaataaataaaaataaatctgtttcttagatttccttttttgtcggactcccaagtgatccttctaccttttaatggagcagatctagggttctttgattcttttttcatttttcttatctccttctcattcctgctgttgaagcagctgctcccacccacttctaattttcaaccaatctcgggaattttaagcgccattgaggtaggaatcgacgaggattcactacgtgcctctatacatacatattatcgacgtgtatgtgatcgaaaacccttggagattacgtagatccggatcactattgaagaaacataattcataagggaaaaatgagtgagaaccgcgagttccagcttgggacaataggtgctttgagtttatcggtggtctcctcggtgtccattgttatatgcaacaaggctcttatcagtactctcggcttcacctttgccacaactttgacaagctggcatctactagtcactttttgttctcttcatgtagccttatggatgaaattgtttgagcacaaaccttttgatgccagagctgtcatgggatttggtatattaaatgggatatccattgggcttttgaatcttagtttggggttcaattctgttggtttctaccagatgacaaaactggcaattatcccctgcactgttcttttggagacccttttcttcagaaagaaattcagtaggaatatccagctttcattggccattctacttttgggtgttggaattgcaactgtgactgatctgcagctcaatatcctgggttctatcctttctctgctggcagttgttacaacttgcatagctcaaattatgactaatacaattcagaagaagttcaaagtatcttcaacccaacttctctaccagtcttgcccttaccaggcattaactctgttcatcattggcccattcctggatgggcttttgactaacaagaatgtttttgctttcaagtatacccctcaagtgctgttcttcattgttctttcctgtctgatatcggtctctgtcaactttagtacatttctggtaattggaaagacatcccctgtgacatatcaggtcctaggacatctaaaaacatgccttgttttggcctttggttatgttctacttcatgatccgtttagctggcgcaacattttgggcatcttgattgccgtagttggaatggtcatttattcatattattgcactgttgagagccagcagcagaaggctagtgaagtatcaccacagttgccacaggttaaggaaagtgaatccgatcctctgattagcgtggataatggaagtgggatgttgagtgatggtgtaggtcctaaagcccctgtatggaatacgaacaaggacctgcatgcataaaatcttcaagatgttatattcattcgtcggagatgaaaaattagaaatgaaaagtgttccagcgatggaaaatggtggtggtaaaggtgactcatatgttgcacaggcagcacagcaacaatagtcgtgttatgttggatgtttcataactgttgtaggttcaaagagtggagggaaatgcgttatgatattattagcagttttgattggtattatttgtgtatcagtggcgataatggaatggaatgctgcattccagagttggatttgtgaaatgtatgatgttcgaactccagatacccatcagttttatttgcaattatttctgttccatataatattgaagaaatgaatttaaattgtattcctatcctcattatacatgagcaacggttttttttttaaatgcagaaataacgcaaataaggacgtta

SEQ ID NO: 2816 - DNA, 1849 bp, Fagus grandifolia
aactctgaatctactaatagcttcgaatcattcattcatccatctaaattcttcacacagcttttcaacccatttcactccgtacacccgtgaaaaagcaaaacaaaacaattccaagaacacgagtgacgaggctctcacttattagttattacgacccaacaaatttaagacttaagatttttgttgttgctaatatcccataattatcaaatttagttaggtttggtgtagtatcaattcaccaaactatacaatacagtcagttttaactttagtgccacttctctttcaaaaaaatgtgactgcctaaccaaagtttcctcaaatcccttttttatcacaaacccagatcagatccaaagctttcatttttctcaaacacccacttccagtaactgaaatctgaggtgggtttgtgattacagagaccaataacaacagcaaagagaagaagatgggtgagggtgagcggtttcagctgggaacagttggggcgttgactctgtcggtagtttcatctgtgtccattgtgatttgcaacaaggctctgatgagctcattgggtttccatttcgctacaactttgacaagctggcatcttctagtcaccttttgttctcttcatgtggctttaaagatgaaattttttgaacacaaaccttttgatcaaagagctgtaatgggctttggcatactaaatgggatctccattggacttttgaatttgagcctgggtttcaattctgttggattttatcagatgaccaagctggcaatcatcccttgtactgtagtcttggagacccttttccttgccaagagattcagtaggactattcagctttcactgattgtcctccttctgggtgttgggattgcaacagtcacagacgtgcaactcaatgctatgggctctgtcttatctctcctcgcaattgttacaacatgcattgctcaaattatgaccaataccatccagaagaagtttaaggtttcttcaacccaacttctatatcaatcttgcccatatcaagcaggcatcttgttgatctctggcccatttctggacgggcttttgaccgatcaaaatgtatttgctttcaaatatacaactcaagtactggcattcatcatcctatcctgcctgatatctgtctctgtaaattttagctacttttcttgtaattggaaagacatccccagtcacctatcaggttcttggacacctgaagacctgcttggtgctggcattcggttatgtcttacttcatgacccttttaactggaggaatattttagggatttcgattgcactaattgggatggttctatattctttcttttgcactcgtgagagtcagcaaaaggctaatgaagcagcagcacaatcatttcaggtagtggaaggtgaatctgatcctctgctgaacgcggaaaatgggaaaggaggattaactgatgctgttgtcccaaaggcccctgtgtggaattcaaacaaagatttgcatgcatgaaggattgttcatacaacgaagagaagcagatcgcgatcatagaaaagcagaaagtctactaaaatgaaaataagaaaaaaataaaaataataagtagacaactgtagagagcaatggcaatatctgtggcataaaaggttttccacctcttacatctctaatctgcccaggtgtgacgcccttattttccttattagtgttggtttagctattatattaagttgatatcccgcaattagctcaaacgaggaatgcatataacgggtattgttgcttttcctggccaaacaatatggtccagctttgtaatcatttttaaatgaaattttatt

SEQ ID NO: 2817 - DNA, 1656 bp, Gossypium hirsutum
tttttcttatctccttctcattcctgctgttgaagcagctgctcccacccacttctaattttcaaccaatctcgagaattttaagcgctattgaggtaggaatcgacgaggattcactacgtgcctttatacatacatattatcgacgtatatgtgatcgaaaacccttggagattacgtagatccggattactattgaggaaacagaattcataagggaaaaatgagtgagaaccgcaagttccagcttgggacaataggtgctttgagtttatcggtggtctcctcggtgtccattgttatatgcaacaaggctcttatcagtactctcggcttcacctttgccacaactttgacaagctggcatctcctagtcactttttgttctcttcatgtagccttatggatgaaattgtttgagcacaaaccttttgatgcccgagctgtcatgggatttggtatattaaatgggatatccattgggcttttgaatcttagtttggggttcaattctgttggtttctaccagatgacaaaactggcaattatcccctgcactgttcttttggagacccttttcttcagaaagaaattcagtaggaatatccagttttcattggccattttacttttgggtgttggaattgcaactgtgactgatatgcagctcaatatcctgggttctatcctttctctgctggcagttgttacaacttgcatagctcaaattatgactaatacaattcagaagaagttcaaagtatcttcaacccaacttctctaccagtcttgcccttaccaggcattaactctgttcatcattggcccattcctggatgggcttttgactaacaagaatgtttttgctttcaagtatacccctcaagtgctgttcttcattgttctttcctgcctgatttcggtctctgtcaactttagtacatttctggtaattggaaagacatcccctgtgacatatcaggtcctaggacatctaaaaacatgccttgttttggcctttggttatgttctacttcatgatccgtttagctggcgcaacattttgggcatcttgattgctgtagttggaatggtcatttattcatattattgcactgttgagagccagcagcagaaggctagtgaagtatcaccacagttgccacaggttaaggaaagtgaatccgatcctctgattagcgtggataatggaagtgggatgttgagtgatggtgtaggtcctaaagcccctgtatggaatacgaacaaggacctgcatgcataaaatcttcaagatgttatattcattcgtcggagatgaaaaattagtaatgaaaagtgttccagcaatggaaaatggtggtggtaaaggtgacttatatgttgcacaggcggcacagcaacagtagtcatgttatgttggatgtttcattaactgttgtaggttcaaagagtggagggaaatgcgttatgatattattagcagttttgattggtattatttgtgtatcagtggcgataatggaatggaatgctgcattccagaattggatttgtgaaatgtatgatgttcgaactccagatacccatcagttttatttgcaattatttctgttccatataatattgaagaaatgaatttaaatcgtattccta

SEQ ID NO: 2818 - DNA, 1898 bp, Castanea mollissima
cttttcctactctctttcctcttaattcattctctgaatcataatatccgaatcctctgcctctattactctttacaatcccccagctttttcaaccccacttgtccttacacctctgaaaaagcaaagcaaaaaaacaaaacaacaaaacccagttccgacattgtattgtattgtatttcatttattttttggtttcaaatacctcataattatcaaatttagttagttttggtaaactgctattaaattagtaccaattcaccaaaccagacacatactgatacagtcttgtttttaactttagtggcacttcttttcttcccaaagtgactgcttgcctaaccaagaaagttttctttttatcaaaaatcaaagaccgccccacaatcccatttttactcacacacccagatcggatcagatccaaagctttggtttttatcaaacagccacttccagttagtggaatttgaggtgggtttgtgattagagagaccagtaacaggaaatcaaagaagatgggtgagggtgagcgattccagctgggaacagttggggcgttgtctctgtccgtggtttcatctgtgtctattgtgatttgtaacaaggctctaatgagctcattgggttttcatttcgctacaactttgacaagctggcatcttctagtcaccttttgttctcttcatgtggctttaaagatgaaattctttgaacacaaaccttttgaccaaactgctgtaatgggctttggcattctaaatgggatctccattgggcttttgaatttgagcctgggtttcaattctgttggattttatcagatgaccaagctggcaatcattccttgcactgtagtcttggagaccctcttccttggcaagaaattcagtaggactattcagcttgcactcattatcctccttctgggtgttgggattgcaacagtcacagatgtgcaacttaatgctttgggctctatcctatctctccttgcaattgttacaacatgtgttgctcaaattatgacaaataccatccagaagaagtttaaggtttcttcaacccaacttctatatcaatcttgcccatatcaagcaggcaccttgttgatctctggcccatttttggatgggcttttgactgatcaaaatgtatttgctttcaaatatacaaatcaagtactggcattcatcatcctatcctgcctgatatctgtctctgtaaattttagcacatttcttgtaattggaaagacatccccagtcacctatcaggtgcttggacatctgaagacttgcttggtattggcatttggttatgtcttacttcatgacccatttaactggaggaatattttagggattttgattgcactaattgggatggttctatattcttacttttgcactcgtgagagtcagcaaaaggctaatgaaacagcagcacaaccatttcaggtagtggaaggtgaatctgatcctctgctgaatgcggaaaatgggaaaggaggattaactgatgctgttgtcccaaaagcccctgtgtggaattcaaacaaagatttgcatgcatgaaggattgttcatacactgaagagaagcagatctcaaattcgcgatcaaagtaagagaaagtcacttaaatgaaaatagggtggaaaatagtgctactgtgagagcaatggcgatatctgtgacataaacagattgtccatgtgttacatctgcaatctgcccaggtgtgagccttccttttccttattagtgttggtttagcattatattaagttgatatcccaccagttagctcaaacgatgactgcatataatgggtatcgttgttttcctggccaaacaaatataacagccaataacatttattaaaaaatatta

SEQ ID NO: 2819 - DNA, 1905 bp, Eucalyptus grandis
ggtttgggtgggcctcgtgggatcgggatcgtcgatgctccgtcaacaaagaaaatgaattcataaggggagggatgtgccagtgccagtgccaccgctaatcgttattggtaattcggtaagacatcccccaatcaaatcgtatacttaaataatcaaagtcatcatccccgtcccagtcttgctcgttgaatttttggtcattttcctctccctcctcctcctcggtcgctccctgccatcctgccttcctgccatcctgccttcctgcgggccttcatttttcatccgggggtttgccgatttcgatggtcaaaacctgagtcccatgatctcccttgatctccccatcctttgcccaccagcctttcttcctcgatcaatgcgattctccctccgttgagctgcccttctttcccccaccccgaaattcaggtttattctccccgtcgagaacgcagatcgatccagatcgcggaggggggcgctcagtaggacgtactgaagatgagtgagaacaagggattccagctgggcaccatcggagctttgagtctatccgtggtatcttcggtttccatcgtcatttgcaacaaggccctcatcagcaccctcggtttcacgttcgccacaactttgacaagctggcatctgttggtcacattctgctcgcttcatgtggcattatgtatgaaattgttcgaacacaagccttttgatgcgagagctgtcatgggatttggaatactgaatgggatatcaattggattattaaatctcagtttgggtttcaattctgttggtttctaccagatgacaaagctggcaatcatcccctgcactgttctcttggagactcttttcttcagaaagctatttagtcggagtgtccaattctcgctcataattcttcttattggtgttgggattgcaacagtaacggatttacagctcaatgttttgggctctgtcttgtcactgcttgcagtgcttacgacttgtgttgcacagattatgactaatacaatccagaagaagttcaaggtttcttcaacccagcttctgtatcagtcttgcccttatcaggcaattacgttgtttgtcacgggtccttttttagatggcatgctgacgaataaaaatgtttttgctttcaagtatacccctcaagtgctgttcttcattgttctctcctgcttgatatctgtttctgtaaattttagcacatttttggtaatcggaaaaacatcacctgtaacatatcaagtccttggacatctgaagacttgtctggttttggcttttggctatgttctgcttcacgacccttttagctggcgcaacattttgggtatcttgattgccgtagtagggatggtactttattcttactattgcacagttgagacccagcaaaaggctaatgaggcatccgctcagctgacccagcccaaggaaagtgaaactgatccactaatcggtgtggaaaacggaagtgcaatcttaagtgatggcgttgttacaaagggccctgtgtggaactcaaacaaggacctacatgcatgaagtcatccacctttaattaggcattttaggaagcagcagcttaggtgaattggtagtgtctcaaaggtactgctctaccaaaaagtcctgctggattcctgagatcaagactacgatgctctatgtgaagttagattttggagtcaagagagatgtagcttatacagcaaacttaatcattctttttccttgttgatgtttggagaaatgttgaccttaaataccgaaaagaatattggatgtttctttgatgcatttagctttcttcatactaaagcaaacatagcgtcttttgaggcctttctttcccccgagttatcgttctcattttcctttcca

SEQ ID NO: 2820 - DNA, 1674 bp, Amsonia hubrichtii
agaattgaaaaaaccagccggaaacaaactcgattgataaaagtcaaattcctcattccttagatttgttctattttattatttaaattctactcaagtactaagacaatgcccatcatttaaaacaaaatattaatatacaatttttcgtcgttccgttgagctctgcctcgtcccactgggtgctactcttcttcattgcatttcttttccatcaatctcagttatctgattcatttctcctcagattcctgtaccaacgcgatcacatttcttttctgtgttccttatcttaattttgcaagtttcggctcgtacatagagatgagatattgagattgatagcgaataagcttttaaggtagcagtgaagatgagtgacggccagcggtttcagctgggaactattggagctttgtctttatccgtagtttcatcagtttcaattgtgatctgtaataaggcattaatcagtacacttggttttacatttgctacaactttgacaagctggcatctgctagttaccttttgttctcttcatgtggcattatggatgaaattgtttgagcacaagcctttcgatccaagagctgtcatgggctttgggattttgaatggaacatccattgggcttctgaatctaagcctgggtttcaattctgttggtttttatcagatgacaaaactggcaatcattccatgtacagtgcttttggaaactctctttttcaggaagaaattcagtagaaatatccagggttcacttggcgttcttctcttaggtgttgggattgccactgtgactgatctgcagctcaacgttgtgggttctgtcctgtctctgcttgctcttgttacaacttgcatcgcacaaattatgactaataccatccagaagaagttcaaggtgtcttcaacccaattattgtatcaatcttgcccttatcaggcaatcacactgttcataactggaccgtttgttgatggacttctgacaaatcagaatgtttttgccttcaaatataccccccaagtgctggcattcattgttctctcctgcctaatttcagtttctgtgaacttcagtaccttcctggtaattggtaagacatccccagtcacttatcaagtccttggacatctcaaaacatgtcttgttttggccttcggctatgttcttctccgtgacccattcagctggagaaacattcttgggatcttgattgctgtagttggaatggtactttattcttattattgcactctagagggccagcaaaaagcctctgaagtagcagcagcacagttggctcaggcaaaggaaagtgaatcagatcctctattaggtgttgaaaatggaggcggtatcttaactgatggtgttgccaaagccctggatggaatacaaacaaggacctgcacgcataatcatccctcggttataatcaattaattcattatagttcagaagcatgcaatgtaaactattccagcgatgaagatgtcgctgcaagggtttgtgcacgttccagaggagttcgagtttggttatttcaatagattataaacctctatctggtaattatgatagctaaaggatatatcttcagtagagcaattttgttattcaggtttgtacaagtatatatattggcaatagagtattgttgt

SEQ ID NO: 2821 - DNA, 585 bp, Zea mays
actcatccttcctggatgcctgatggtgagtgtgtgacggcagtaggttccactgctcggccagctcgtcacatctcacgctcttggtatcaccccagtcgcctcttacctcccgacacatacctgcctcccttggtgcattgcacctatagcactccatcctgctcgcaaagttgtgtacgttgcaaccaggcctgcagatgcagacatgcacgatccagtcgccagctttccacccagcacggactgcggcgctgtcgcgtccaccagcaaagtcaccctcagcaccggctgcgccttgccccgctgggaagtctctgacgatcgtgccgcacttgaagcagctgctgcggctggcgaagttgtggtagccgcagctgcagtaccagtcacctgggcggatgtccagggaggtcagcacaccaaccgtgctatagccgtcgccgaactgcaagtcagggcgtggatcacggcaacgctggcagtagtcacggcggctgaagttgagatgctggcagttcttgcagttccagtctccaggcttcctctggttgttcattcgcagtgaacagctgccctgcatgc

SEQ ID NO: 2822 - DNA, 724 bp, Saccharum officinarum
aacacagcaactgaaaccctagtaccaagaacaaacaactacaggagactttgcaagttcactgaggcgctgttgactgcgaatgaacattcagaggaagcctggtgactggaactgcaagaactgccagcacctcaacttcagccgccgtgattactgtcagcgttgccgtgacccacgccctgacttgcagttcggtgacggctatagcacgggtggtgtgctgacctccctggacatccgcccaggtgattggtactgcagctgcggctaccacaactttgccagccgcagcagctgcttcaagtgcggcaccattgtcagggacttcccagctggacaaggtgcagccggtggtgagggtgacttggctcgtggacgcgacagcgccgcattcgtgctgggtggaaagctggcgactggatctgcacaaggcctggttgcaacgtgcacaactttgctagtaggatggagtgctataggtgcaatggaccaagggaggcaggcaccgggaagtaagaggcgaccgaggtgataccaagatcgtgagatgtgacgagctggccgagcaatggaactaactgctgtcacacactcaccatcaggcatccaggaaggatgagtctactacgtacacgagtatattgttgattgccaagcgtagtaccgctgctgtggttgcgtgggtggagaagtacccaagcgcaacaactgttacgtgtgt
